United States Patent 10,240,205 (METHODS FOR ASSESSING RISK OF DEVELOPING A VIRAL DISEASE USING A GENETIC TEST) - sequence listing, part 12

SEQ ID NO: 347 - DNA, 939531 bp, Homo sapiens
gtgcatttgtgttgtgggggcatggggtgcatttgtgtgtatatatgtgtggatgtagggtgcgtttgtctgtgtgtatttgtgtgggcatggagtgcatttgcgttgcgggggtgtggagtgtgtttgtgtgtgtgcacacgcacatggttctcatggtcctcccgttttcaactgaacctgtaattagctcctcagagaccaggtaatcacagtttgctttttctacctgtaaatgctcattggctttctgatttcccattaatttcctagctttaaattaccaagaattggactttttgtaaaataccaagttatcggaacaaagaccggcactctgggaaggcaaatgaaaaattccagtgtctctgtaactgagattgcctgttattagtaggtttctctgtctgtttggttttgtctacatttgaaaggaagcttttgaggaattcatggagcatgtctactctattccctcccaggtgagatggtgcccctccaggaaagtatcagaatgcagccattagggctggacatttctaactggccaagtctacacaggcataacaaattgagcaattgtggttatgatcacaatttctaaaactgggactctaaataataggttccagaagcaaattaaatatcaacaacccaattaccttttgtctctgctaccaagcatgaattctgatagtcattgtcttacttctctatgttcagagaattatatttaagggaagaagcagctaatgataatttactgattgttacaaacaatctacatgtcagctatatagagtcatctataggaattaattgtatgagctatatatgtcaggaatatatagagtattcttgacagtaaattagcattagcattaaaacgattagtattataattttataatactaattataactattagttaattagttcaactgttgagttgaactttctgcaatggtgggagtgttttatacctgagctttccaatatagtagccatgagccgtatgggcctactgagcatttgaaatgtgattagtgcaactgaggggcttttaaaataattttagttaatataaacttaaccccattgagtagtggctaccatattggacagtatacgtctataggccctaatctcatctcctctttaaaaagaatgaatatgtatctttattaataatctgtgttcatatcttatataacatacctaaaaatgtagacaaggcagggcgcagtggctcacgcctgtaatcccagcactttgggaggccaggtctggcggatcacgaggtcaggagatccagaccatcctggcgaacatggtgaaaccccgtctctactaaaagtacaaaaaaaaaaaaaaaaagttagcctggtgtggttcggacgcctgtagtcccagctactcgggaggcaggagaaaggcgtgaaaccgggaggccgagcttgcagtgagctgagatcgcgccaccgcactccagcctgggcgatacagcgagactctgtctcaaaaaaaaaaaaaaaaaaaaaaagtagacaaaaagcctacaaacagacacacccaactgttaagacctctcaggttgggattagaaaggtatgaagaaaggattttaacatcttgtcttgcctaatcccaaaaagaaaaaaaaataggtgataagattaaaaatgaatcaaataaatcagatgcaaccaattatatcatggaaccagttatgtcagtccatctctttgaattaaaattaaaggaaaaaagatggagggttctgacagttatctctctaatcgagacagccctctccctctctctgtccccttacagagaaagtgaatttgggagcttcggtcaaacatcccttgtctttcgtcaaattagtgcctaatgtcatcattttggtggctttcaaaggtgtgaaccagcaaacgggtgacagtgagaggaaggaacaagcatgtgaacaaatgcgtgaaccacagtcagtctctgaatggaaatccatgtgtcttatgaaaatcagttattgttgaaagccatttgcaaagcttccacgatcctcgcttggctggtgcacggctgtgagtgcttctttccaagtctcctgtgggtgacggggaatggctaaccagggattgtgttcacaggcatatcgattccaagtctgatcacagccacaaatttctttcccaggttagtaagaagaaatcaacactttactttcttggatcatatgtttttaaacattagtactgaggaaataaagaaagggagagaggaagaaaaaagaagtacaagaaagaatacactgggctgggcgtggtggctcatgcctgtaatcccagcactttgggaggccagtgcagacagatcactaggtcgggagatcgagaccatcctggctaacacggtgaaacccagtctctactaaaaatacaaaaaattagccgggcgtggtggcgggtgcctgtagtcccagctactcggggggctgaggcaggag[135 bp omitted]caaggagaagcaacacagtgcaattctttaaagtgcatacaattaaaacacatagaagaggaaccttggctagaattacagagcttgatcaagtctcatccatggttgacactgtttgttggatgatttggacatttggagcctctctatgtggggagagttttctttatccctttcaaatcggtatgccatctctacatacctgaattattataaaggtaacaaggttataagctcccccatgcctgccaggatgcactgctttgctgtgactgagccacactaggtgctaaacttttctgcactaatgcaatcaaattagaagttaaatctgatactgtaacaagttaccacctgggaacagaaatgctttgctgttttattttttcttcgtagcattgtgaaatgaacatggcatgtggcacattttaattacagcaaatattaatttttaatgggaaatgtacacctggctttgtattgttcataaattatctgagaggttgaaatttatttacgtgattttgatgcagttgtaattaaagtgaagaaactaatagccttctgtaattgaaggcacattaatctgaaagctacctgagggcagggattctgtgttaaccgtgttgtatactcaatttagtaaaatacgagtcttgggattagtggtcttgtatgcgatgtgctacacattttccagatatttctagggtattttctgagctttagaaaagtgataatatgatctagtactgtaggtaattatgtgctaagaaaagaggattctatcacattatctggcattgcttttttagttttgtaatggagtaattgattagtactactgcattttagcaaggtattttgctcctatacctagtggatgatgtttaagttaactctatttgtgtgtccctgagaaagagaaccgaggcaggcgctcggggaatggaacagggacaaagaaaccaaccaaataacactaggtatcagttttcagctgcatgtaaactcaacttattttttaatgattttattaggaagctttctacattctattttgtaatgcatttccctgagggaactttagaccttgcaggcctgtttgcaattcctgtcagattaggggggaaagaaagagaacagaatgatggaaatttcacacgttattcagtgttttaaaaatccagtttcttagcctgacagtttcttaaatctgtagaccttgatgttttaatcttatgcattctgatggagcttgatattcataactggtgggcttggtaaatttttaatcaggaagttgaatatgatgagaaaacacaaggggaggtttgtgttttgcaccttgtcatcaagctttccagtttcattttcactttttgcactaagagtattcctcagaggtgtcagagctgcccaaagctgacttccatccatattgaaatgactttttctgagctttccaaaattccaatttcagtgcaggtggtaatatctgaatgtgagcagcagaataaatagcagtttaaaactcatataaatatacatttatgctccatgtgtgaactcataaggtgtgggataaatcttgtcatttcaacataaacggaataacaaatagattgaaagtgggatgcactgttgcgaatacatgatctggatgcgcagtgcgattaaacagtgatggcttcatgagaatcgaatttcaaagatcacacaatcgattaaaacaattcagtctccctggtcatttttgtcagtaaattaaaacattaatttcatcccaagaatgtttttcagtgttttttattgtacaaagtaacaaacacatgcaaaagtagagaatagtaacatgattcctcatgtacccatccccagattcgataattaaaactcatagccaatcatgtttaatctatatccccacttgttttctccacattcctgaattgttttaaagccaaggccagacatcacacattttatccataaatgtttcagtatgtatctctaaatataattacacccaatccttcaacattaacattgattccctaagatgattaatatctgatcgctgttcagattttcccagttatcttacatatttataaagtttccttgaactgaaatccaaacgaggactatagaatgcaattagttaatatggctagagttccttagtctataaagagtaaagaactttccattcatattttactctcttttttcttagaattcttaaattaaagaaactagattgtcttcctgagtcttttgtgaaaaatatgattgtgaattttcttgtttatcgcacacaataaatccaccttataaattattgattgaaccaataaaacctatcaaaacaatttaattgaatacacatacaccacacactctagttttttttttatttttaatttttatggttatggaagagttgtacatatttatggggacatttttataaaagcatacaatgtgtaatgatcaaatcaaggtaattgaagtagcctaactttaaatatttatcattttgttgttttgcaaacattccaaaactactactctagttattttgaaatatacaatgcattattgttaactatagttgtcctattgtgctagtgaatactggatcttatgtcttttatctaattgtatttttgtacctatgaatttacctacttctaactcccccttgctctcaactccccttccttgcatttggtaaacattattctactctgtatctccatgagatcaatttttttagctcccgcatttgtatgagcacatgcaatatttgtctttctgtgcctggcttattttagttggcatcatgtcctccagttgtgtctatgctgtttgaaatgacaggatgtcatgcttttttgtggttgaataatattccattgtatgtatgtaccacattttttcattcggttcatacattggtggacactcaggttgatttcataacttggctgttgtgaagagtactacaataaacatggcagtgcacatatctcttctatacactaactttctttcatttgaatatatacccaacagtgagactgctaaattatgttagtgttagttttagttttttgaagaacctccatactattctccagagtggctgtactaacttacgttcccaccaatagtatacaagggttccctcttctccatatccttaccagcattcattattgcctatctttatttatttatatatatatttatatatatatttatatatttttatatatttttatatatacttttatatatttatatatatatttatatatatttttatatatacttttatatatttatatatatatttatatatatttttatatatttatatatatatttatatatatttatatatttatatatatttatatatatttatatatatttatatatatttatatatttatatatatttatatatatttatatatatttatatatttatatatttatatatatttatatatttatatatttatatatttatatatatttatatatatttatatatttatatatatttatatatatttacatatttatatatatttatatatatttacatatttatatatatttatatatttttatatatttatatatatttatatatatatttatatatttatatatatttatatatatatttatatatttttatatatttatatatatatttatatatttttatatatttatatatatttatatatatatttatatatatttacatatatatttatatatatatttatacatatatatatttatacatatatatatttatacatatatatatttattcatatttatatatatttatacatatttatatacatatttatatacatatttatagatatatttatacatattatatatatttttatatatatttatatatatttatatatatttatagatatatttatatatacatttttatatatatttatatacatttttatatatatttatatacatttttatatatttatatatacatttatatatatttatatatacatttacatatatatttacatatttatatatatttatatatatatttatatatatatttcttttttgttttttgttttttagttgttggtttcttttctttcttttatatatgtatatatctatattgcctgttttttcagagagctattttaactggggtgagatatttcattacaattttgatttgcatttctctaatgattagtgacgttgagcatttttccgcataccttttggtcatttgtatgtcttcttgagaattgtctattcagatgtttgctcatttttatttggattatttgggttggggttttgtaccaagttgtttgagctcctcacatgttctggcagttattctcttgtcaggtgggtagttggcaaatgttttcttccattttgtaggttgtcttatcacttgtttgtggttgcctttgctgtgcagacactttttagcttgatgtgatcccatttgaccatttttgctttggttacctgtgcatttggtggcttactcaaaaagtatttacccacacccatgtctggaagcatttccacagtgttttcttgtaatagcttcattggtccaggtcttacattaaattctttaatccgttttgatttgatttttgtagatggtgaggaatagggacatagtgtttggtcttcattatgttgatatgatatgtcacatttattgatttgtctttgttgaaccatccttttatcgcaggaatgattcccatttgatcatgatgaatgatctttttaatatgttgaatttgattcggtagtattttgttgaggatttttgcattcatgttcatcagatatattagtctgaagttttcttttttcgttgtgtatttgtctagttttggcattaggataatcctgatcctgtagaatgagtttggaagtattgtctactccttgattttttagaatagtttgaatagaattggtattaagtcttccttaaatatttggtagaattcaacagtgaagccatcaagtcctggccttttctctggtgagaatctttttattacttcttttatagcattacttattgatttatccatgtttactattatttcatgtttcaatctttgtagttttttatgtccaggaatttatccatttcttccagattttccaaatcgttggcctatagttgataaaaatactctctaatttacctttgaatttctgtggtatctgttttaatattttcttagctctgatttcatatatttggacattctctcttttttcttagcgtggctaaaggtttgttgatttcgtttttattttccaaaaacaagtttttattttgtattttctctcaatttcatttatttctgctctgatctttagtgtttcttttctttgactagttttgggtttagcctgctcttacttttctagttctttaagatgcagttttaggttttttgttgctgctgttgttgttattgttgttttttatacggagccttgctctgtcactgggctggagtgcagtggtatgttcttggctcactgcaacctccgcctcctgggttcacgtgattctcctgcctcagcctcccgagtagctgggactacgggcatgcaccaccacacccagctaattgttgtattttcagtagatacagggtttcgccatgttggccagggtgatctctgtctcttgacctcgtggtctgcccacctcgggctcccaaagtgttttgttttccttttttgatacaggcatttattgttataaactaccatcttagtactgcttttgctgtatcccataggtttcagtatgctgtgtttctactaaatttccttcttaaattatttaattcatccagtagttattcaggagcatgttatttaatttccatgtatttatatagtttccagagttcctcttattgatctcttcatgttttctattttttcatggttcaatcttggtaggaattttatgtcccgggatttttatgtccaataaatgcttattgatttctagtttcattccattgtggtcagaaaagatacctgctatgatttggatttttctgaatttctgagacttgtgtttcggcctaacatatggtctaccctggagaatattttatgtgcccatgagaagaatgtgtattattcagctatcgaatgaaatgttttgtaaatgtctattgatcaatttgttctgtagcgcacattaagtcagatgtgtctttgttaattttctttctaggttttttgtccaatgctgaaagtggtatgttaacttagcattcccaactatcattgtgctggggtctgtttctctctttatctctaataatatttgctttatatatctgagtgatccagcattaggtttatatatatttacagttcttatatcctgttgctgagttgacttctttatcattatataatgaccttctttgtctctttttacagattttgtcttgaaatatattttatctggtataagtacagctctttatgttcttttttggttttcatttgcatggcatatctttttctgttctttcattttcagtctgtgtgttttcgtaggtaaaaatgagttccttataggcagcatatagttgggtctttttaaaaaaaaatttattcagctagtctgccttttatttggagaatgaagtccgtttacactcattgttattattgataggtgaggacttactaccgccatttagttgttttttgttgttgttgtcattttgttagttctctcttcctttttttttttcttcttgtcttcctttctatataagcaattttctggtaatgttttaatttctgtcttttaatttttttgtgtccctgttaaaggtttttgctttgtagttaccatgaagcttgcaaaaaaaaaaaaaaatcttataaccaattattttaaattgattaaagcttaactctggtcacaaagaaaaaacattaaaaaggagaaaactaaattctacgctttatctccatctcctgcagtctgactttttgctatctctgtcttttttactgtctttcaacaaattgttgtagttattattatttttcataggtttgtcttttagtcttcgtactaaagatatgagggctttacatacaattataatattagaatattctgtatttatttgtgtgcttgcttttaccaaggagctttagaccttcaggtaatttcttgctgcacatttgtacccctgtctttcatattgaagaactcccttcagcattccttataagacagatctagtgttgatgaattacctcaggttttgtttgtctgagaaagtctttacttctccacgtttgaagcataactatgctgaatataatgttctagctttgaaagtctttttgttcagcactttaaatatgtcatcccactccctcatggcctataaggtttctgctgagaagtctgctgacaaacatttggacttctttatattttctttgcttattttctcctgctactcttagggtcctctttttgtccttaacctttgagaatttgattattgtatacctctgggtttcatctgcttggtgttgcttgactttcttgtacctggatattcactgggtttgaaaagttgtctgttatttttttgaataaactttctatcccaatctctttctctacttcttcttcaaggccagtgactcttagatttgccgtttttaggttattttctaaatattacaggcatcttttgttcttttttagcttctttttttctctacagactgtattttcaaatagcctctctttgagctcactgattctttcttctgcttcaccaattttgctgttgagacactctgatgcatttttgtgttgttgattgcattcttcagctctgcaatttctgtttgatttttttgttattataatctctttgctagatttatctgatagaattccaaattcctcttctatgttatctccaagtttgttgagttttctcaagacaaccattttgaattgcctgtctgagaggtcacatatctctgtatctctaggattgatcactgatactttatttagtccatttggtgaggtcgtgttttcctagatgttctccttgcatgagggcatttgttaatgtctgattttttttttttataaaggtgctttattgtgtggatagttgttcaatttggtgttcctgtggtcgggggttgtggggaagtaaatccctggaattttctatttagccatcttgttccacctcatatatttcattgttttaagaaaaatgagtagaagttgaaagagttgtataagagctaagtgaaggtcggctggagttattgtcaccaagcactcttctaagttgcttgaaaaatagcacaagcagtgtttcttaactgctcatataggggatctttcttccttgggtaaactcatggttggcattgacattgatttgttgcacttctgagtgaaaaaaaataggcatttaacataaaagagattactcttaggaaatactggatgtgactttagaaagtggtcatggttccttccaaaaatattcattattaaatatagtgttatatttcatttctgaacaaagagatctacgagatctggtctgctctggagaaaaaaaatgacaaaggagagaatttgagggaatctcccagtccgttcgtaactaacataagagtttatgcaaaacaagaattattctaaacaccatggatggtgggccataagccatctcatttatccagacatctctgtggttcagcaaatttcccagttgccctgtgtatagagcttttagggagtggagttattgttgctaaggagaggtcactgtttttaggctgggcaaaactgcattgatccttaggaagaatctagactagacaattggcaataaaagccatttgcatctgggcaacacctttccatcctaccttccccaaagcacactcagcagtagttcctcttaccacttaaataaaaacttcaacatgtggggacaagttttccattaaataagctatttttcctttgttttcaactgcacaataaccatcagaaacacttacctaatatttatttccacgttccatgtaccatgttccatgtgagcatgttacagccactgtccagtttaatatcatatgaatatgaaataccaattccactattgttatcatcattttccagatgaggataccaaacaaatgcaggaaacaatgagagcatgatgagaacttactttagaatacagagctagaattagactcaaagtccattagactctaaaactgatgctgctcctcaggctccgcttagcatttacaaaaaatggcactgtgactgaggaaccttgtgtacatgcatgtgacttcccaggtggcacttaccaacagaccatccttccaaatagctgctccttaaacaccccatcttgagcttagagacacacacaaatggtagtgtctgcactggggaggatgtacctggggcagaagcctgttcagggcctggagtgggctttgtcactttggcaaaagtctgcatgactttgggtccccctaaatgaatggagttcgggggccaggcgaagattcccatgaccctgttgactcctcattccttggggaggggtatgtcagaagagggtcagaactggaccctcacaagtatgggcctggccaggagacggggctttttggctctgagatctcttaaccacttgttataattcttcccacattacaaaggcccacaatgtacccccacaatgaggagagtccctgttgtcccagacagcattattcttcttgtacctttgggcttcatgcatcatttttcaggaggtagatcaagtggaagaaacatttttacagggaaaaagcagaaaaataacaacaaagagctgtgtagccccttaaaagactgtagctgtgaacatttcagacagagttcagagatcctggaaaggaaacagtaagccaaaaaacctctccaaaaattaataataaggacaaagctggttcccctgatccttatgaaggggatgaggagaatggatggtgctctgtgcgcatttagaggtcaagtaggtcaacaaagttctgttttccctgaatggggaccctagcactacggtgctcccatctagctctttccttaaacagttggaaatgagatacttaaagaaactccacccaatggaagtggacatgaggtcacatcgagggtcatggtcacaattgactaaaagggtagggaattgatttgaggatagcatatttcagaccagaaggaagagaattgcttagccggcaggcttttttacttttaaaaaaaaaaaggcttattgactcttagggaccttatctgaaagtgtcatgaccatgtctccctctgcacaggtcacccatctcactaaaaacttcctgctttggggttcaggttggaatgtcagaaatacattagttgatttgaattttgaatacgtgaaaagaaagcatccctcatagattgtaccttcaccgaaatgcaatgatttcctgccccaattgagtgctctccaagaaacgttgatgaaacatttatcagatgtgtggagtgaaggtcgtatgtggcacgcttggacagaaataagctggataaagcaggcagcattctctatgcagttccctaactgatcggcccgttctaggcagcataatcttaagagcaaaagccaggttggtcctgccatgttcgtgtattcatcaataacagcacataaagaagttctttcaacttaggattttatgcagaaacggtgaaatgattaacatcagaaatagcaacaatgccgtgtgatttccaaaattattttatttttctcctggttatacagttagagtgtgaattggagtctccctgtggttaagttgaagttgtgtgactgtatgctgggcaatagaaattgggtgtaaactgtattaatttgtgccaattccagatttagccgtaaatcacctgtgacacccttcacagtctctgttctccatccactgtgaccttggaggccaggttttgaagacacgttattacaagatgaaagagattgcatccctgagtgattcatgatcgtagcattccattgattactctaaaccaagctgcaaatgagcacagagcttctgctggcttaatccccaaaacctggagttgtaaaggacttagtcttcctccataatacaacttaatccacgtctactgaaatagaagtatatttatattctataaagttaacataagcgtaactcgatactatagagagaagttttaatattaatagccaatctgtcattactaaacagctggtgaaaggccaatgaggccgggcacggtggctcatgtctgtaatcccagcactttgggagtccgaggtggggggaccgcttgaggtcaggagttcgagaccagccagaccaacatggtgaaaccccatctctactaaaaatacaaaatttggcaggtgtggtggcgcatgcctgtaatcctagctactgggaaggctgaggcaggagaaccgcttgaacctgggaggcggatgttggagtgagctgagatcgtgccagtgcactccagcctgcaacaaaagtgaaactccatctaaaataataataataataaaataagccaatgaggtctgctgcatcatacctgttctgatttgaataggatgtcccttttccaaaattccccagcatctgcagagtattttattcaggttcaacacaagctggtgaggcatgtaactaccttgtaactagtttcataataattattatcgtctctctgaaaatagtcagcctgctttggacacaggtgctgcactgattttttttttattattatttatttattttttattttttatttttttgagacagagtctcttgctctgtcgcccacgctggagtgcagtggcgtgatctcggctcactgcaagctctgccttctgggttcacgccattctcctgcctcagcctcccgagtagctggaactacaggtgcctacgaccatgcccagctgattgtttgtatttttagtagagacggggtttcaccgtgttagccaggatggtctctatctcctgatctcgtgatccgcccgcctcggcctcccagagtgctgggattacaggtgtgagcgaccgtgcccggccccccactgatttttctgaggatgcctctgtgatgtcatacgatgtgccaatttccatcttatgtcctaaaatggcatcgcctcacttctgagaaatactgtcactctgtagctaactctctgctctaagaactcagcgtccccaagccaacttcccgagttcctcctagcattctctattctttccgccgcacaatgggacatgtggttttattccctgaaaagtcacttctggatggacccagtctgaagatggttctcctgctgtatagaaacatggatgtcgcgaaattgcctattaaacagggaagctattaaacagcctccctgaatttaccagattaggattttagtgaaaaattaccgcctgcccactgcttgtgggtagagtgttcttcagaagaaacattaaggtttaaagactgtaagtcatgaaatgcacgtgacaagatgaatgtcattgtatcatttcccaagccgcgatccccatggttcaccagaacttaaatacagcagttgatatttatagccagtggtataagaccttgtcttcaaggtggtgagtttccgctttgagatgtattccagaatgttacaatgttaaggggtcctaggtgttaatatcaattttataatttttaagacaaagaaagtgaagcgtgtggaaggcgagagaaacactaatggtgtcaagttggtattttagagagaagcagtcatttcattctcagttattacctatgctggttgtgcaaatttaagcaaattattgcactcaataggcgccattttctgtatccatagacagtggggactgtttgactcagtgctgtgcccatctttgcataaaaggcatttttacatttgtgtgcattggtgtgagttgtctgtttcttttgcccattttcatccttttcttgtttcattttctccatgtcttcgaattttcacagtaatttacacagaagtctgcatagtagtctcttagttttttaaaaaatcttctgtttgaatggtgatcctcttgtaatttctcattttctgtctttgtgctttctcccacctttttcttcattaagtggttagctactttttttcttattttcaaaaaatacccttaaaacatatgatttggtttattaattagatctataattattctcttccctaacttattgatttctggtcttccgtaacttactggtttcttacgtttatgaatcctttcttaagcttttttgtttgtttgaatttactgttatttttctaaatttttgagatggagatttaataaacttatttatatttttctattatattgaaatttttcatgctgtgaattttcttctggttctgatttaaatgtgactcttagattctggattttattttattctattattattattattattattattattattttatgacagactctcgctctgtcagccaggctggaatgcagtggtacaattttagcttagtgcaacctctgcctccagggttccagccattctcctgcctcagcttaccgagtagctggtattacaggcacccgccaccatgcctggctaatttttgtatttttagtagagatggggtttcaccatgtttgcctggctggtcttgaactcctgacctcaggtgatctacccacctcggcctcccaaagtgctgggaatacaggcgtgaggcactgggcatggcgccctccatcgttctttttgttttgtttgcatcatagtttgcaaagtgtggttctcctttcctatttagcctctattcccccaaaccattgttttcccaacactgccttctccaattcagcacatgtttttaagtctctttactgtagttaggactctgagcttcctgttctgtctgtcattattttcacttgtatggtggatgtgatttcagttcagtcttggctctccatccctcctcttcttcttctcctgtgtctctagaccctccttattcttgtcaaaagctcaggatgggaaataggaaaatagttctgctagagggtggtatttattttcaaatcacagttatttaactttatagttttgtgtgtgtcaccaaattatggtaaaggatggtatttgtgtggtttattttttcctgtttatctttttttttttgcaatggggtctgactgtgtcacccaggttggagtgcattggtatgatcttgactcactgcgtcttctggctctcaggttcaggtaatccttccacttcagccttctgagcagatgggaccacaggcatgccaccacaatacctgactaatttttgcattttttgtagggatggggttttgccatcttggctaggctgatctcaaactcctgacctcaagagatcctcccgcctcagcctcccaaagtgctggggttactggtgtgagccaccacacccggcctgttcttgtctatctttatagagttggcagaagatgctaggagattccagctgccattgactcagctgcatggaaattgcttttcttttttaatacattcattatatatgattagttattgattattcattttaaaatactttgcatcaaattatttctctttccaggcaggactggctgtctaataggtgcagccctgtgaaaatgaaagttcagggccccttcctaaaaaattgtaaagaacttcaagatggcgaaagtagagcatcacgccagtcacattggctcacacctgtaatcccagcacttcgggaggccgaggtgggtggatctcttgaggtcaggagttcgaaaccaacctggccaacatggtgaaaccccatctctactaaaaatacaaaaatcagccaggtgtagtggtgcgtgcttgtagtcccagctactcgggaggctgaggcaggagaattgcttgaacctgggaggcagaggttgcagtgagcagagatcgtgccacactgcactgcagcctgggggaaagagtgagagtctgtctcaaaaaaagcatcaaaccaggtgcaggaccctttgagtggcatccctgtgtgtacacagtcatacctccaggaaggtggtactggttcaatacttttatatattaagtaactcttgtttaataactttatatgtgttaagttatctaacacagagagagagagaactagagactggaacttaggagagccgaattctattcccaaatgtgtcttggatttatagtctgactttgaactctggagttctgttttcctacttgaaaaatgaaagattttaccctgaattgcgtttcacgaactatcacatatattactgataatacctaaatacattttaatagtggtattaattatatcacataaatagaaaaaaattgaaacacataaactatgctttttctgtatattttttcttagcaggtagttaaggtgagtaataacaaaacaaggtcaattttaaagcactattggagaattataggtgatatttagattttgtaagaattgtgaagattacataaatacatctaaagtttggaaaacgttgctcaggatgatccctaaggacgctttcaagtcctttcagcattttaggattctataattgcatatctttatgcagaattatgcattttttgatttagcaaataggtagatttaaatatataattaaaggtcaacctgttcataccttccagaaagactggggtgagatgaattccatatttttgtgtcatctaccaccacaaattttatttcaatttcatataaaggttaaaaattgagatgtccccatgtacactcaacgccatgtagtactgtgcctcctactacgaagtcagggttgcaaaaagccttcatgtaacattgctgtctatggtaacttgatgtcatgtctttttcatttctggttttcatgtctgttgtatctgacattctaaagaattcaaaatagattgttcttgaaggggatataaatagaagtgatgggccggcatggtggctcacgcctgtaatcccagcactctgggaggccgaggcagatggatcatgacgtcaggagttcaagaccagcctggacaagatggtgaaaccctgtctctactaaaaatacaaaaaattagctgggtgtgatggcgggcacctgtaatccaagctactagggaggctgaggcagagaattgcttgaacccgtgaggcagaggttgcagtgagctgagactgcatcactgcactgcaggctgggcgacagagtgagactccatctgaaaaaaaaaaaaaaatagaagcgataatgctgtacatctgttagccacttggatgctctctgccagattgcacaaaagttcatggtacgcctgctgtcaccagatttgggtattattttttaagaacccagaaattaaaacagataatatgatcctgttgatcaaacagtataatttttaaaaaggtactgtttgttaattttaagaacattccagtagaccgattggaggagaaatgtggtccccctgttaggcttagattttacataaaatttttaaagtgaaatttgattggagaagttgagttttttttccaaaatatgattttcttccattgagattgattggactctataggttcactgcaggagggtgggacattcttacctgttcgtaatacagaattctctgagagaaatatcccttcatctcagtgtctcagtggacattgttggtattcctgagtgttttgacattttggccatttccaaacatttctaggtctttgttattgacctgcctacatttcaattcttggcccttccctctgttttgaaatgactcattcttcacaagagcaaactgaaagctttactgttaagcaaaaaaagaaatcttgagccaaagtattataacttgctctgtaggaaatgaaaacagtgcattggccatcttttcaccctgttgttagagtatattaaattaaaataacacagcaagaaacattagtttccatgattcattttagatttatgttggtgtgtggatttggttggttgtttctttggttagtagaaggtgatgtattaaagtggaggtctggtatagctgatggaaatgagtttttttaaaaaggttatgaaacatctatctccctcttgagcagtagtccaggggagtgatcacatactgagatgaaaacaagagggtggtaatacagcaagtggtgtatgattcagtaactccaccggattgctttattggttaggtaatgaagcacgctagggaatttctatcaaacaggagtcaacatactgcccaataacatctgaaatgactgaactataagtttagggagcatgggatgaggtgtactgttaaatcgctcctatgctggaaagtgttccctaagttcttcccatcactacctggagaagttgatgcgggattactgggagaaggcttgtgacttttaggtcctctcagagctcttcactttgctccatgttgtgtgttgttttcttgttcgtgatttttttttttttttttttttacaatgaaggcattccaatcgggctaatacaaacatgaggcattctcaaactacaggaaattgctttccttaactacactctttgaaaaaaaatggggtttaattacctgctgcttttctattgctcagattcccttcaggatgcagggggagggatgggagagaagtttcctttgtgatttaatgtaattattcataatgactacatatggtcattttataagttcctaattattttaagtgattggtgcatggtcatttgcataggctgtttagcagaaaactcattcagtgacctacatataaatcatggaatagtttctaggcatgtaaagcgggtgagagaaaccaaacccttccccccatcacttatggttccaatgtatgcatcccagaatgtttaatgtaaatcataatagcagcttggatccagtattcttcatacaaatgtgtggttgatgtagggaaacatgtttaatgttttctttcagtagcagatggtacatggatttttatttgatgcaggcactgctttccaaggtaattgtcaagggcttttttccccctatgaaaaaaatggagggaaggcctctggatcaacccattcatttcacagatgagcaaactgagacctcaaatattgagtaattttccctaaatcaccagtttttaaacagagtgagggctaaaattcacatctcctgacagtcagcttaattctcttttcgtcatactgcacattttctcttgatagttgatgtgatatatgtcactttaaaaaaatgagtttccatttctgggtatattttatctactttcctcctcagaaagccaagttctgttgattcatagtaaggaccagatatttcatagtgctaattccaagctgggtataatttgtgacttctaggttacccacttgtgtccacaaaccacctaaattttttaattgtacacagtcaagtcaccttgatagaaggggccttgagagctcatctaattcagtgatttttccaacactggtttcagggctgctgatgtgctattgcatttcacccgagtccacaacaaaataagaagaaaaaaaatcagctctggggagttttgtcctcaagttaaattaattcccattttttttaagttacgtctttatcaaatgttgatgcttaaagagagacattgttggctgcgcacgttggctcacgtctgtaatcccagcactttgggaggccgaggtgggtgaatcacgaggtcacaagttcaagaccagcctggccaatgtggtgaaaccctgtctctactaaaaatacaaaaattagcctggcatggttgggggtgcctgtaatcccagctacttgggaggctgaggcaggagaatcgcttgaaaccagaaggcagaggttgcagttagccaatgttgcaccactgcactctagcctgggtgacagagtgaaactccatctaaaaataaaaaatgaaaaaaaaaaaaagatagtcatcgttgctttcttttattttcatgagaaaacaagaaatgacacatgtatgtcagctttccacaaaatcaccccctgccttccctttccttttatgttcttatgtttttattgtgtttacctgtcagtgaatccaaacattgagaaacattgggataagggaatgttattttctaggaaaccaaagttttaaaatatcatggttactgtattagtccattttcatgctgctgacaaagacatacctgagattgggcaatttacaaaagaaagaggtttattaggcttacatttccacgtggctggggaggcctcacagtcatggcggaaggtgaaaggtatgtctcacatggtggcggacaagagaagagagcttgtgcagggaaactcccattttttaaaccatcatatctgaagagacttattcactatgaagagaacagtgaaggaaagacccacccccgtaattcagtcaactctcactgggttcctcccatgacacttgggaattgtggcagttacaattcaagacgacatgtgagtgggtacacagccaaaccatatcagttactatagtcattttttggcaaaaccaagaaatagcaaacttgagcccgattccttaaaacagataaagcaccctaaccccccactgccaaatcaacactcttccactatatcattttccattttcaataaataactctttcatccactgtaaataacagaatagatgttgtctatgaattcactgcttaatatttcatttatctacttccttctacccttattcatacctatcctaaacacttttcaaaggaactttctctctgtctcttgttaaaaattttctcttgtaattcttaaatatgtacagatgttaccaattggtaagagattcttttttgatgaactttctctcctgggtacacatttatgatcctaaacgccccatgaagatgggcctacatctgccttccaacttcttctatgtccctcagtcataaatatctacattgtttctttgataaattttgggaatgatagaagacaataagttgcatgatgactgcttgtcttgttctttgttaaatgtacctatgtctccaccccctttcttccacatctcaaattggaaatcattgagtactaggagagagaggaaacagggcattccttagtgggaaaacataagatgccacgggcagtctaaatgtcaagatttggactgctggtctaaaaggtttccactctctgggttgctctagtgaagcaaataaatagagtaacacatcgatcctcccacaggtagaaggctctgctgttcgttgttttactactctgcagataggcagcagcagcagcagaatttgttagcaaggatcagtctgagtcgcctatgtttactaaggaatctgtccaaattggccgtgcctttgatggatattgttattcccccataacgctgtccttaggatcctggtaaatctcagaaatctctatacaaagttaccgtttcagagcaatgaatgtgggcaaaggtgaaaatcattatgaagcagagagtggagattattaacaggtggtcgaaagagagagcgagagaaagggggagagagatagagttgctttgttgcgcaataacatgaagataaaacagttaaacacatatatcctgtttcccccagtacaagcctaatgttgctgatttcaggttcctgtgacatcattcatttactgcacctattatattacaatgggggtaaaagaagcactttccattttcatgacagaagaaatgaaacagcaccagcattaacaatagcatactgggcactgtatctgttctccttggttctggaaaggtcctagagatttatgagtaaattggaccattccaactataggcattaaagttctggtgtttccaaaccacgttggctcttggggtccattatacctggttttatgatgtttaaaaatccaatatcatttggtaagaagtaacacaacattatgtctgcaatcatgagctctagaaccactcgacttgagttgctatcccatttctactaactggtagctagctgacttttggaaaggtacttaaactttctgtgtcagtattttcttgtctttgaaatggagatgatgatgatggtgatcacggtgatggtgatagcggtgatggtgatgatgggaatagggatgatgatgatgatgatggtgatgatgaagttgatagtgataaaacccaacacataggcatgttagaaagactataaatatatgccacacccttaaacagcatctagcacgcatttaataaataggtctcattgtgattagcagaacaaatgaaagcagggcgtttctagtctcttctctggtcgtgtccctaagagaaactggaggtgcctaagaatcactggggatactagtcccagagaagagttcctggatcctgttacatgcttcctgaatctgcatagattgtatctagaaacttgcatttttgataaactctgaaaaaggttaaattttgagaattgatggatttgggcaaacgtgaaagccattctgagacagaagaagtagaggctatcaccaggtggtcctgcttaatagatagggagagacagagagctgctatgttgtttaattcagaatggcagggagctgaaacattgcctaattctgaaccagacccctgatgcttaaataggaagcccagataacacccccaattctaactgcagccatgctaactaagataacagctgtctgtattcaaagacacatatatctgtgctttgttgactagtgcctttcgtttctctggccaaagcaaatgtgcttttttggctttaattttgtgcttttcactaattaagttgtttatatgaactaaaatatttatacacccaagataatgaaaataacccatgataaatggaacaaatggagtaaaagtaaagtagatttagtggcaccatagtttattgagcatctgtgattagattgtgttccctaggatgcttcggggagtgtaattcaatctgcagtttgaactgatgactcttcctttctgtagaggtttagagaaaaaaaatgaattcttgtttttaatatctcaagtttctcttcaaatggctacttgttacatcttggggtaggaggggagtcttttaggaaaaagaagaatgggtatattttgttgccatccaggagggagactgggcagaaaattaggctatatttggtagcttataatctaggatgtgtgaagatggggtacggtgactagctgatgcaggtgaatcccagaactggggctcagcttcgaagagttcttagctttgctcaggaaagaattcaaaagtgtgctgatggaggagagccagtttactaggggaaaccgtgcacagcaatatggctgctccatagacacagcagggccaccccacaggccgagtagcactcctggattgttggctagctgtatttctagctacttatcattatatgctattaggttggtgcaaaagtaatggcagtctttgtagttaaaaaaaggtaaaaactgcattgacttttgcattaacctaataaggcgtgagttattcgcaaactttctggaaaagagggagttcccagagccattcatgatggttaatattaggtgttaacttgattggattgaaggatgcctagagagctggtgaactattgtttctgggtatgtgtgtgaaggtgttgtcagaggagataaacacctgagggagcggcctgggagagaaagacccaccctcaatctgtgttggcaccatccaatcagctgccagtacagctcgtataaagcaggtggaagaaggtgggatgagctagtttgctgagtcttccacctttcgtctttctcctgtgctggatacttcttgcccttgaccatcagcctccaggttctttagcctttggaccgctggacttaacaccagtggtttgctagaggctcttgggactttagccacagactgaaggctgcgctgtcagcttccctgcttttaaggtttcgggactcggagtgagtcattactggcttccttgctcttcagtttgcagatggcttatagtgagacttcgtcttgtgatgatgtgagtcaattctccttaataaacttcctttcatatatattaaacacatatatcctattagttctgtccctctggagaaccctaatacaccatctaagataacttctgggcattgtcatggtgtcagtaaactgtcatggtgctggtaggattgtcttatgcagatgtattatcgttcctagtcctactggtttgggccaatttctttgcgacatccagttttgatcaacagggtattgaaaacaagtcttgctgttttcctgcctcataaccatgtctgtttgcccaagactgtcccagttttagcactcagcattgaaaacccagcaccctggaaacaccttagtcctgggccaaccagacgggctggtagtaccaaaagtcagggctacctatttttgtttttcatgcaataagttaaggaagtggtttcctactctaggatagtgcttctcactctttaacagtgataggcattgcctggggatcttgctaaatgcaaattttggttcaataagtctcgggtggggtcggagcatctgcatttctaataggcttccaggtgattcaaaagccgcccttccgtgcacgctacactttaagtaacaagcttctagagggcccggtaatcacctggccggatggttaaagagcaaattcaggataccaacattttttaattctttgcaattacttttttctctccctaaaatttttgccttttaaatcactggagtaggcccgtggacgttcagtttttcctaaaaagactccttttatcttttagataaagtacaaagtaagggtctctagaaagcagtagatgacaaagtagcttttgaaactaaaatctcatgtgagtgactgtataaatagcatacaaaatggaaggatttttcattttcttctggttgtttttctatgtagttggaagttaattcacttcaagtggaaatctggaaactagtttgctatccgtcttgcccctgtttgagtatctctcaagggtatctgacaacagtgtgggaaatcaataaatgtttgttcaataaatgaaaaagtgagaatcatttaattcaatgatacttaaacttgaacatgcacaaaaatcagacggaggacttgttaaaagtgcggattgccattcagtagatctggggattgacctattaagcatttctgatatgctcctaggtgatgttgatgtcttggaacacactgtgaatggcaagaatcaagattgaacatgcaaaaaaaaaaaaaaaaaagtaacgttacatatcatgtattttgccatgcaattaaaatgctgggaagtgtgatgatgattttgtcctttagaacatataaatgggatctacagttgagagagaaccatacaaggctcttggtaatggtcaggcttatgtatttaaggtgtaattgcatctatctttatactagttcctttcccttgggaactgctcagctgaagataaataagcaaaacgggcacatgtgtagcctaatagcaaatataaagattattgagccagtttatagtgactcaataaaattctgcttgtcatgggtaagcaaaagtcagggcccttgaaatttagggtgcagcaaaaggaagcccataattggggtggaggttggggagatggccaggagactcatgtgtccatcaggagacagctaattgggcaggaaaggtgtttctggaccaaactgagggtcacactgctatttctcgtggtctaataatgaggtgcagatgaactggggaggaagagagtttttatttctgtaaccagttacagggagaaggtctggaaaatattgccagaccgactcaaaattacaaagttttccaaagattatataccttctaagttgtatgtctacatgtaagtgtgcattcatctgaagacctaagtggttcatttattgtcatctgtacctaagatctgagtcctgaggaccttcatctggaccttcagtaaatttaatctaaatgggtctaggtgctggggtgattacccttatcttgtctcgtgctaatcatggaggttgggggagttcttttagaccccgcaataaacttgtttgtggaggcctggggagtttcttcagatcccagtaaaacttgtttaatcctaaacaagtcctgttaagaaatccttcagtatcttgtcaggatttaagccccaggaaaggcctgggcacaattctgggtgggctttggttgcatcccagcctttgtagatgggctctggctgcctcagcttttattatttaacttaaccactcagtcagtgccgaaacagtagttgtggaggcctgtgttagtgagacctgatttgccacacagggtcctgttgtgcttctctgggaatttcattgcttggatgttatttgacatttcccttttaacagttaatgttagaaagtccatgttatggcctggcgcagtggctcatgcctataattccagcactttgggaggccgaggtgggcacatcacctgaggtcaggagtttgagaccagcctgaccaatttggcaaaaccctgtctctacttaaaatacaaaagttactcgggcatggtggtgcacacctgtaatcccagatacttgggagggtgaggcaggagaatcgcttgaacctgggtggccgagattgcagtgagttgagattgtgctactgtactccagcctgggtggcagtgagactccgtctcaattaaaaacaaaaaaagtgcatgttatttgatggtttttatattcctttattcatttcggcaaaagccattcccccacgttgttgtaagaatctgattgttagatgatactcttgaagtaggctgacccaaaatatttttcggagacttggctatgaagaattttataaactaacttaagttgcctttcttttaaggagctgacatagtggaattgtgcaaagaagttattttagtttcccttagggttaaatatttattgaagagggaagatggcttcttccacaacaatttttattttctccttttctaatctgttctaaaagtcttttagctgccttgctactaggaaaagggacttactcatttccattgaactcaaaatgttactttgtgtgtgtgtttaatttccccatcacccactctgcagactcaaaacctctgagctagaccatgccttgattttttttttcttttaaatgccatgagttagacatttaaggacaccaaatgattgaaaatagtcgaaaatgttcacttgaccctcattgcctatgacattgctgttagctttctgcatgaaagtgcaaacttcaattttcaggaaggcccacatcccagaactggcattgtttccttagtcattggaagcagaaaactacagcagaagtgttgcctccagccgtacagagaagaacaatctgcaggcacaatctggaaacctttcccagtgaagggagaaagtgagagtggcgttctggccttggaaaaacaaacatttgttattactttcctagggactgaaatttttagctccccagtgcaatctgtgtataatctagatttccagatttcctaaatggaaaacagataaacaaaaatcagccttcttaaattatgtatggtggtaaaataaagtaactgagaaggaaacaggattcctaaaccgaatggactttagcaaaagaatctttcaccattaataatttctccctgaacaaatatgcagatattttaccagacagagaatagagactttgttttggcttatcttgcttaagagtaattctgagaatctattacttgtgagagaataagattcataaggaatgttcgttagagagttgtactgggagattcacaggctacatttctaattttttcctaaagaactccttttacaataaaaaaccatgctgtaagctgcagagtgttgctgaaatgtaagcttttaccattgttgtagatctggcatcttgtttagaacccatagtttcctaatatttgcacgttataacatatgaagctaaactgtatagtacataaaactcatacaattttttttttttcgagatggagtcttgcactgtcaccctggctagagtgcaatgacatgatctcagctcgctgcaacctctgcctcctgggttcaagtgattctccttgcctcaggcatccaagtagctgggattacaggtgcccgccaccatgcccagctaacttgtttgtatttttagtagagatggggtttcactttgttggccaggctggactcaaactcctgacctcttgatccgcccacctcagcctcccaaagtcctgggattacaggcatgagccacccagccctgccaatacatacaaattttaactccagggtaaattgataagacttcttccttcatggaagttaaattctaataggatccctaatgccccatctagccctgcagtatttcaggtcaacaataactctttgctgactgaagatttgactggatggtacacgccctccaatggaactaacaggctcaacagctctaggtgcataaataatcttcatcctacaaataaagaattctaaattggactctaaatattgtatgtggctactgtggaagctaggaagattgattggattaatatcaagtttcacaatgtgttctttcattaggatgtcagtaatgagaatgaactattcattagaacagccaactttctaaagaataagagtgctgacctcacacatgactggggcagaacagggtactgtttacttcatgagagccctagaatgggacgcagtggattgggggccgttccctactctattgccaagtatgtgcatttgccactctgacttcttataggtaaagtattggcagttatgtcctccatagtcaatttcattcttaaaaaggccatgtgtcccaaacattaactgaaaaacaaaaagcgagattcaaagacttctcatatgctgttggtcggagtgtaaattagttcattgtgaaaagcactgtgaaaggcaattcatcaaagatctgaaaactgaataccatttgacctaccagtcccattactgggtttatatgcagaggaatataaattattctaccataaagacccatgcacgtgaatgttcactgcagcattactcacaatagcaaagatatggaatcaacctaaaggcccagcaataacagattggctaaagaaaatgtggtacatctacaccatggaatactatgcagccataaaaaatgagatcctgtcttttgcaggaacatggatggagcttgaggccattttccttagcaaactatgacaggaacaaaaaaacaaatattgcatgttctcacttacaagtgggaattcagtgatttgaacacatggacacacagaggggaacagcagactttggggtctcctggaggatagagggtaggaggagggagaagagcagaaaaaaataacttgggtacttggcttagtacctgggtggtgaaataatctgtaccatccccataacatgagtttacctatgtaatgaacctgtacatgtacctctgagcctaaaataaaagttaaaaaaattctcacttcagttatcacattgaaaggaatacagatcatcagacaatgaagagcaaatcaaattattcctggtatctcttcgaggatgtttacaaggagggaagtctgttaatgaatgctgaaaacatgtgaaattatccttaccatcttgtccattctgcatgcctcacaatgtaccctcctttcttcaaggtttttccctccactgtaaagtctgaagtgtaacacccaagccatgtggagattttcacatcttcgctgccctgttgtcctcagcatctatctccgcctttctccttacagtcacacttggctctttccaacacgaatcactagcctttactttccctgttgtatcttctttactcattgctttagttctaaaccatagaattccaaaagccaagctggaaaaggaggagttaccttttgtgaggtgagaaggggaaaaactgtgggtattcatactcaaaatatttgctagttgcagctctataagaagtcatccagcagcttggagaagtatatggttcacaaagatgattcatccaagaaccagtttgaatatttagatgatttagagtggaattagttagaatagaaatgagtatagaattgccacaggtcacaatataagagaaaaattagcaaattaattaattggatgttgttctatagccagtatttgttttagagatttttatgaagtacttttccttcctgaaagtcattataaagctttgtagtaacctgataatgttgaatatttactttaatgtcatccaaaaaactatagagttttgaaagatggaatgagaaactggtctgtaataaggaaaaaccagaaagactgtaatacatttgcatctttttcaaattcatatgctaactagagctaacaaatgttaaataatttcagaaagtatctttgctgggcctattctgaccagtaaataaaagcatttgaatgagttcaccatcttacatggatagtctgtggagaagaaatggattttaaagagcctgaactagttcccagcaaatttgatcacatcattggttttttaaaacatgtcttttacctacacgcggtaacagatttgtattatatgcgctaaaatgataatattgatattaatgaggtgatattgtcttacatgtattaccaggggagcatctttctgttttttctccctttctttttctattttttctttgtttctttttctctttccttttcatttatatatataaataaatatataaatatatatatatatatatatttttttttttttttgagagaaagtcttgctctgttacccaggctggagtgcaatagcatgatctcagctcactgcaaactccacctcctgggttcaagtgattctcctgcctcagcctcctaagtagctgagattgcaggcacgtctcaccacgtccagctgatttttgtatttttagcagagatggggtttcagcatgattgccaggctggtcttgaactcctgacctcaagtagtatgcctgcttcagcctcccaaagtgctgggattacaggtgtaagccaccgtgcccagcctctttttttccttttaataaaacactggttacaatgtgagaaacagattggagattggacagggagaccagttaggagtctgttccagtagttcaagtgacagctgatgccctcttaaactaaggtattgagggagatgatgggaactaaacagcagattcaagagttctagggcatacaatgaagagaacttggcaataaattgataatgggaattttgagacaaggatgagtgagtccaagttgatttctgcatttagggttggttgactgaatggtggtgccattcacctggatgggaaatgctggaggaatgttggagtagcacacagggctggggtcctgagttctgcactcactaatgggactttgcttgtcctatgatattaagatgcatactatggcggagtgtggtggctcacacctgtaatcccagcactttgggagcctgaggcaggcagatcacaaggtcacgagattgagaccagcctggcgagcatggtgaaagcccatctccactaaaaataaaaaatttggctgggcatggtggcagacgcctgtaatcggagctactcgggaggctaaggcagaagaatcacttgaatccaggagatggaggttgtagtgagctaagattgtgtcactgtactccagcctggtgacagagcgagactccatctcaaaaaaagatgcttattatatatatagttctattgaatatgtatgttagtatatatatctagttctgttgaatatatattattgtgtgtgtgtgtgtgtgtatatatatatagggtataatatgcatatgtaatatatgcattatatataatatgcgtattgtaccctgtatatatatatgcatagaactatatataatatgcaaattataccttgtgtatatgtatatatactatcctatacaatagaactatatatatataatcatactcaatagaactagatatatataggatgtagcaatatgcatagaactatatataatatgcatattataccttatatatgtgtgtgtgtgtgtgtgtatatatatatatatatatatagttctattgaagtatgcactagcttccagcatgtagcctttatattctactgatgccccatcactttggaattacctcttatctttttctctcctgcctttctaatatcaccccaccactgattcccatctgattatgcctacttcactgaagcacccttgtcactcccttcaatgcctaaagtattgctttcttaagtgctatggaagcagagttccttttcttgcagtgaataaactacatcccaaggatctcaccccttgcttccccagtgaatagctctcagatggaaaataaaacagcaccattactctctgagattaagagggacaggtttgcatactcaacaaacattgtctgatggggaataactgccaaatttatcatctcagggtgttggtagttgttattttaatgtaaattttgaatagataatagattaatatgaatcttattttaccaggcagaaaaatggtatacagtgaagagtaatgcttcctccaacctctgcccccaggtaatactgttcttttctccacagacaaatacctggttatctctgggtctgggtattaactgtatctgtgtcttctcccagtcataacatacaatatctctaattcatagaaaatcactacctcttaccaagggaatacttcctgtaacacctttagcagggaacaatatcggataatcccaaagcaagatgttaacgcaaactaaatatgtcctgagaaggactctgtacttctatatttgagtccttgtggatgaactgtaacctagcttaatagacaagactgaaaacctgacttaggagtatgcacctgtaacaatagttgagtcttggccaatcccagccgccatacttcaaccacccatagactgctaagtgttcaaaaaaggcaaacaccaacctgtcaccagttcagctgtttgtgtacctcactgctgatttctgtaagtcatttccctttttctgtctatgaattttctttcaccaccttggctacgctggagtctctgaatctcatgtgattctgggggctgccttctgaatcgttcattgctcaattaaacttctttaaatttaatttggctgaagtttttctttaaccagagggaagaaataaactaatgtagattgcctctaagtgccagccactgtgccagacactttctaaaggtgcatttttaaagaattattttttaaaatttttgtggatatacacatagatgtattgatttatggggtacctgagatacaaaaatattatcttcctcatctacattgaagagctgtcattcaccccaggaggcagtgtggaataagtttctgtgcacctgagactatatcctattgtatatgaagccttcaaccaaaagtgccataaccttggtacagaattgctaccccatccgaagtccataggaacacagcatagaacaaactgaagtctgagaagttcaggtgagatacgtagagctgcagaagaggagtttttcattgtctctgaattggtctttctcagcgacagagttatttatgagatggggcaatcatagaaagcagtggcttttaaaaaacacttcagctgccaaaaatcttattccaattctctggaagagtgctgtcgtaccaagtgtaattcaccagtccggtgcctttctggaagttatgaaattggagagagttgcttttgtacaaatgaataaacaccaccaagatgagcctacccgcttgtcctgagttgagattgatatgatcagacatctagagcttgttctcctgggtgtctctctgaaaaaattctcttctctctcaccttttttttttttttctgttaataagtagacaatgctctggtctgatggggtctcaggaaggaaactggtatctatcttttcttgtcaacatttaccaacaaatatgcctcttatggacagggatagggattacggatcactctcattgtcttatgtgtgcaacttggagtggattgttagctatccagaaaatgtccatccctctttttcttggagaaattcactttttaccacattttgtgattcaaattggtctgtcactgaaattattctgaaaggttaaatgagacccatgagggccgtacaggaggcttccgtgcattttttcctctccttgtccaagtggtgaagaggtaggcacataaactaagcgtggacaatggtactttttcctgggagaaggatgactaaaaagatggcgacacaaaggtatctaattttccgttcatggcaccgttcatgagtcttgattctgtgaatgtccccatatgcccctccaaaaacctctttttttttccttaagttagccagttataggtttgtattatgagtttcatagtgctataaagagctataaagaacttcctggagactgggtattttataaaggaaagaggtttaattgacgcagttccacatggctgggaagtcctctggaaacgtacaatcacggtggaaggcaaaagggaagcaaataccttcttcacagggcagcaagagaacggagcaagagcagagagaactgcgtcataaaaccatcagatctcgccagaagtcactcactatcaggagaacagtgtgccgggaaaggtcgccatgatccaatcacaagcctccctcaacatgtggggattacggttcaagagctgatttgggtggagacggagccaaatcatatcaaggttcggttgcttccaaccatacacgtaacagatatttcactaaatgctattccagaacggatttacacaatttttggaaatagttacagaacacacacagaaaaactgatgatgataagataccccgaaaaacacacctgggtatttctttctgggatgttgtggctgagataccttgatagaaaagccgattttgctgagtaacttctaaggcctccaattctgaaggaagaattaagtgatatgagagtttggaaaataattgaagagacctgcctttgcaggaaataatataggcaggaaaaatcaagaatgccacaaaattgagtaaaagagaacaaaagaagagaaatagaattacctctcaactttgtaaaatagaattgaacccagtaatactggataagatttaaaaatattatggggtaggatcacttctattaaatgtgattagcttttagctagataacattgaatattttaatgtttcattggctattatacaatatatttttttcctctatgaatattgtaaaattcctgtttgatttaggagtcagggatgtttaagtgattatgtagctagtcctcagaccacagttaaaaaggtacttttgttttgttttctggcgttgggaagattagcaacctgggtgctagcatggaaaaggcacaggaggccagttacggtgcctcaggtctgtaatcctagcactttgggaggctaaggcgggtagatcatctgaagtcaggagtttaagactagcctggccaatatggtgaaatcccatctcttcaaaaatacagaaattagctgggcgtggtagtgcacgcctgtaatcccaactactggggaggctgaggcaggagaatcgcttgaacctgggaggcagaggttacagtgagccgagattgtgccattgcactcgagcctgggcaacacgagtgaaactccatctcaaaatataaataaataaaatacaaaatataaggcacagaaaaaaatactgaaataagttgcagactggaatttcttacagatgttgtttctcctcagcatgaacagaggtggccatgccatttctccagataaatagtgcagtacaagagtgttggttggtttcatgtatcaccatataaagttgtattatcagactccatatgatgaagaagccttcacgagaaactcactaccaaagcaaaatcgttttaaattaatgaatgattttcaagtaaaggccccataggattttttatttgtcctcctgttagaatgaatatctgtgaatattaagctcctcacatttcctgttttgttaagaaatttgttcaaaatgaaagtatctccctttagaccaagctaggacggtctactaacagaaccttagaaaggaaacacaatgcaaagtgccaattagcactgcaaagttttggttcagtttcttattttttattttttttgagacggagtctgggtcttgtcacccaggctggagtgcagtggcccgatctcggctcattgcaacctccacctctagggttcaagtgattctcttgccatagcctactgagtagctgggattacaggcacatgacaccacgcccagctaattttttttgtatttttattagagacagggtttcagcgtgttggccagactggtctcaaactcctgacctcaattgatccacccgcctcagcctaccacagtgctgggattacaggcgtgagctaccacgcctggccttggttcagtttttaatgcctaaatgtggtctaaatcttttaggacaagtgtggcctcatgcaacatggattgttggaggcctcatttgtgctcataagcggcattttccttgtggacctcctgttttactccattaggttttgcatacagcagtaccatagaagatggagcacttagaaatggtgggaagcccctgagtcctttgtccatcatgtcagagtgacgatgtttctagaggtcattgctgtctttctttggagactgggagaatagggaagtaaaggaagatgtttaaattccctacttctctcttttttgttagatttttaaataaaactttatttcacaaaagacctattgtcatggcaaccagtcaaacaatgctgatgtatatgaagaaaaccatgaatatattttcactcccattaaaaaaaaaaagtgcaacctaagttttcaggcctcacctttgtatggttaaatatcaggccacaatgacttcctataacaaaattgtgattatagcaaggatgattggctaattactgaaatttacacttctccggttccccagatagtattccagttctttctggcagtcctcaaaacagccatattccatgaaacaaccctcttcgtttctagcctccagttgaccacattcatgtaactgccttcagaagctgctgcttgttgcaattcccatcttgagaatgctcgtatgggttcccaggtgtcacctctgaatgttctcatggctctagtttggggaccccagctccttcttaggttttcttcagagacagggccaatggctctttccccagccctatgctatgatctgtcacctggtccctaaagtagctttgcttgtgctgaatctcactaagtgtctctttcatcttctgcatccaaacctctctctccacaggtggctcaaaatcaatctgaagaactgagtagggggtggatgcaattccttttcattttgaatttctttatcacctttccaagtcccatactctctcaccctatcaaaatcttctccctctgtccctagttataaaatcaaacctcctgggcatgccaatggcagcaggcacctgcagagatgcggaggattcctgaagaatgagtgaagggaggaggcgctgttgatacccccaacccctctggcttccatctgagctcagccagccccttgttaggtaatgaagggagataatggtccagactggttacatttccttcctcaagttacccagcaaactattaaccagtccttgctactaacactctcatcatggcactggcaatatctgaggaccggttcagtgatctgcacaaagggaaattagattcaaacataacaacttgtcctggagtgaaaagcagatgtataatttctctcatttgtccctactttatttaatagcccacatagggagcttatttaaaactcctagaacaacaacacaccaaacaagccaatattctgagatctcattgcatgatcaacatgatgataataactgttttcttctttcatgtaataacacagagagaaaattgtggtgggggggagggaggaggtctaagagagtcagaaatgtccttttctgatcttcaaactgaaagcaagaaagttgattaagacatagctcctgatcatgtcctaagtgtttccatttctttctgacattgttttccatccattcttacggtaaataatctctgtgtgtcaagcctgacattgggtggtagaagcaggtgggtgaacaaggtagatgtggcttctagcttcatggggcttagagtctagtgggagacaggcattgatcaaattaataatgacaatccttagtatgtgctgtgaagggaagttacactgatgagcatgatagatgcgaatcacagagattctcaagtaaatggcagttaaggacagagctgaatgacaggtaggggacaaagaggctaagggggaagggctcctccaagcacagggagcagcatgtggaaggtcttggaaacctgaggaagtgaagtgaaaagtccttcagtctggaaccctgggggagaggtggggctagagttgaggttggatagaagcagcacatcaaggggtttgggtttatgtcctgtgagtgtttctggaaaggggtcctgatccagacgccaagagagggttcttggaccttgcacagaaaagaatttggggcgagtccatagagtaaaatgaaagcaagttttttaagaaaatacaggaataaaagaatggctgttctacaggcagagcagtggtatgggccgcccagctgctcatccttatcattacttcttgattatatgctaaacaagggatggattattcatagtttttcccggaaagcggtaggcaatgactagaactgagggtttctccccatttccgaccatatagcgtaacttccgggtgttgctacagcatttgtaaactgtcatggcgctggtgagagtgctgttgagcatgcaagtgctttataattagcatatagtgaagagtgaggatgaccagagatcactctcattgccatcttggttttggtgggttttggccgacttctttgccacttgctattttattttctaggtctttgtgccccgtattgtgtgctgaactcctgtctcatcctgtgactaagattgcctaaccttctgggaatgcagcccagtagatctcagccttactttacctaaccccttttcaagatggagtcactctggttcaaacacctctgacattcgcagtggaatccattaaaagatgttaaggagatatgattatatttctaaattgtcactccagcatcccctacgccagacattatgccagtctctatccatacagtatctcatttaatcctcccgtcattaatctcattttaccaatgagtaaacttgaagcaaatgagtgactttctcaaggctacctacttacgccttaccagggccaggattcaaacctagacttgttcagcgacagaacacacacttaaccattacccactcttctctctggtccccagcaaaaagtctatagtttgcagccaaacctcattctctaattccaactacctaatagtttgctcttaatagttactttaagaggaaaagcttaattctcacaacatttgtcaacactcagtctgtttgaatgggtataatttaaaaaataatttacttccactgaaggaaagaaaggactgtcttgagaagtaagaaacttgaagatctttaagagtattaatattaaggttggcaaatcctttgagaagagtttctttctgcctattgtaccatttaaaaataatcggccaggagcaatggctcatgcgtgtcccagcacttttggaggctgaggcaggaggattgcttgagctgaggagttcgagaccagcctgtgcaacatgaggagaccccgtctctacaaaatttttatttttaattaggtaggtgtggtgatgctcacttgtaatcccagctcctttggagactgaggtgaggattgcttcagtactggagttcaagaccgtagtaagctatgatcacactattgcactcgcacttgagccacagggtaagaccttgttgcaatcaatcattcagtcaacaatcattgtgtcatgtctgcctgcctgttgaaaaagccttttagatgaaagtcaatcttcggttttgttgttgccagactggccccttcatgtaattttttttttttttttttaaagaaacagggtcttgttggccgggtgtggtggcttatgcctgtaatctcagtactttgggaagccaaggcggacagatcacaggatcaggagatgaagaccatcctggctaacacagtgaaaccccgtctctactaaaaatacaaaaattagccaggcgtggtggcgggcacctgtagtcccagctgcttgggaggctgaggcaggagaatggcgtgaacccgggaggtggagcttgcagtgagctgagactgcaccactgcactccagcctgggtgacagagcaagactgtctcaaaaaaaaaaaaaaaaggaagaaaagaaacagggtgttgttctgttacccaggttggactgcagtgatgcaatcatatctcactgcagtctcaaactcctgggctcaaacagtcctcccacttcaccctcccaagtagttgggactaaaggtaaataccaccatgcctagctgttttttttgtattttttggagagatggggtcttaactgagttgcccagggtggtctcatactcctgtgctcaagcgatcccactgcctctgcctcccaaagtgctgagatggcaggtgcgagtcaccatgctcagcctctttgacataatttttgcaaatcaatgaattggacttgacatctaggtgactgtggatacagaactgatgtattaacctttgacatggctgcaacctgctgagtaaaggctgatcccttgactggacctgttatacatcactgtccacttgattaggtgcaaggaactttgttgcagagattttaaagtggaatcagacacccaggtaacatacttctgaccaccttaatgtgtcatagcttcaaacacatttaaccaaagcccctctcccatgtacgaggaccctgcttacctgttagctgcgtgtgtcacccttctttagtgtctcatggtagaaataattcagttttaaaattaacttttagctggacgcagtggctcatgcctgtaatcccaacgctttgtgaggcagaggcaggcagattggttgaggtcaagagttcgagaccagcctggccagcatggtgaaaccctttctttgcttaaaaaaaaaaaaaaaaaaaaaaatttaactggatttggtggcgcatgcgtgtaattgcagctactcgggaggctgaggcaagagaatcacttgaacccaggaggaggttgcagtgagctgagattgcaccactgcactccagcctgggcgacagagccaaactctgtctcaaagaaaaaaaaaacaaacaaaaaaaactaccaacagtctacatgaaggttgtgtgtgttaagtacatctgttaaacttctaagtttctgacaaaaaccttattaactataactcaagaattcatgaagtcccctgtgaatgtgactcatatcagacaggagatcccaagcccttcatgaaggcttgcctcataccctgttcctgggccattgcccaaaaatctactgtgtctctctgttgggcttcagaatgagatgatctggttttaaacgcaggcctgccatcctcaagctaaatgagcatgggttagtggctaaactttttgtgtctgctctcctatatctcacatgggcataaaactatcttagatgtcatgatgtaattgcattattgtttcagattttccacccctccctctatggaagcccttttctaggttcctctggtagagtaccaggcatatggcttcctgccacagggatcctgctgttggtcctgtgacagtttggccaacgaaatgttagcagacatgatacaagcagaggctttagaagtaggtgcttgtgtagctggattcacctgtgtgtgcgtctttcattactatgagaatcatggtttctaaatgggtgtgacatacggagctcacctcacccatcccacaagtgggacttaaaccaagtttagaagaaatgaacttcatctgacgtacagatccatgagtggccaaaaagaaaaaaaaaatattattgaatgccagtgagagttttatgagtgagtaaatgccagtgaggtttgttatgtagttactaaagtggcaataatacaagctgttgtaagatttaaactctagttcccttttttcttctaaagttgctatggcactctcatttaacctctagtagggcatgtatcactcagcacctgtgatgaatagctgctattattcatttttccccccttcttctggtaaagccccttagtgtttctctagagaagtcctctcttccaccctcagtctgtgtcatcagatagaaaaagccccaagcttcacaagggggagtgtgatcgaggcctggccactgatgccatttcatcctcctggcctccctgactggtccgtgcctgggcatatcgcccaactcagtccaatgagattaaatctcaggaatttacatggaattctttggaaagagactcgatttcctctgggcatgctgaactgatagaatgaagtcgaaattttggtagccacctctccatgggttgaaaggcacctgtctgagaatcaaacttgacacagaggaaaataaaggtaagtaacagagatggactatcaacggcattgtataagcgacttgaatgagttctgtctgaatccaaacaccacagacttccggtttcaggatccaacaatttccatgtgggctatggcagtttgtatcatatatttgacccctgtgagccttgtacactggagtgtcctaacattctgtttatttccgtatagaaatcgtcttcattcctgtggttggcaatcctgcatcatttaactttgtgtctcccagtggaaatggcatagtcccttgtacatagcaggtgctcacttaggtttgaattattgcttagatgaataaataatattggtctacagtgaacacacacacacatcctttaacatggctgtagagtttaagttgcaaaaggtcatcttcagaaaccaaaaggtaggccgggcatggtggctgaggccagtacttagggaggcccaggcgggcggatcacctgaggtcgggagtttgagaccagcctgaccagcatggagaaaacccatctctactaaaaatacaaaattagccgggcctgttggcgtgtatgcctgtaatcccagctactcgggaggctgaggcaggagaattgcttgaacctgggaagcggaggttgcagtgagccaggatcaaggcattgcattccagcctgggcaacaagagtgaaactctgactcaaaaaaaaaaaaaaaaaaaaaaaaaataacaacaccaaaaggtatatagtataacaggtattaaaatctatttcaaagaaaggaacttgttgattacgacactggtaatttacagaagagcaagcatttgaatccagccctctgattccagtgtaacctacaatgtaagtgctttcctcaagcataccttacagagctctgcacatcagggagactgttcctgcagaggtgatgtcatctggtattttcactcatcctctggctgtgtccccacccaaatcacatcttgaattgtagttcccataatccccatatgtcatgggaggcacccaataggaagtaaaattgaatcgtggggcttgatttttcctttccttttctcataatagtgagtaagtctcatgaaatctgatggttttataaaggacacactgtctcttgcctgccgccatataagacatacctttgcttctccttcaccttccatcgtgattgtgaggcctccccagccatgtgcaactgtgagtcgattaaaccttttcttctttataaattgtccagtctcaggtatttcttcatagcattatgaaaatagactaatacgtcctcttaatcatcaaataatcttttgattccctaatggatagataggattgttcaggtaactgtgataggcccaacacagtggctcctataatcccagcattttgggaggctggggaggaaaaatcagttgaggccaggagttcgacaccagcatgggaaagatagaaaaaccgtctctacagaaaaagtttttaaaaagtaactgggtatggtggcgtgcacctatagtctcagctacttgggatggtgaggcaggaagattttttgagcccgggagttagaggctgctgcaagccatgatcacactactacagtccagcctgagtgacagagcaagaccctgtctccaaaaaaaaaacaagcaaaacaaacaaacaaaaaccgaaaactgcagtgcattctcattcttagaagattttttaagagcctctataggcctcaaatcgatgctaagtcagagacttattactgcaaaaggcctgtgaatgagcacagataaatggaccattggtacttccaaagaagccatgtagaagttaattatttttgacccatagtgttgctgtttttcatcctttgtcatccttagcagtttggaccatacatttcatgcacaatggttgaatgataattaaagctaccagttattgaatttgtattatgtgttatatacagttacttgtaagggagtcttagggttattatcacttaattcttaaccctacaaaacagattcctatatatttccagtgtgagaaacacatctcagaaatgttaaagtatcaagccactacaccattaaaaaacaatagtgatgagattcagtgccaggtttatctgcccatgttcatgatctctttgctggaaggcactcctggatttggctagaagtccagtcatggcctctacccttgtagctgttttaaatatggtgtctctttacatctaaccagggctatcacctgggtctgtggtgctttcctctcttccctattactaagttttgctacctgacatgttttgtccccaaattggaaaactagtctagtctttgatactgttttattttaaaaaatttcattgaggtgtattccacataactgatatcaattatttttaagtgaacaattcagtggcacatagtgcattaatgttgtgcaactaccacctttatctagttccaaaacattttcattatcccaaaaagaaatcccatgcctattaatcagatgcttttcatttctctctccccccaaccgctggtaaccactggtcggtctgtcacaatggatgtgtccgtttatgatatcttacataaatcgtacaacacgtggcctttttcatctgacttctttcagcataatgtttgcaagattaattcacatgatagcctgtatcagtgcttcatcaatttttatggctgaataatattccactgtagaaatgaaccaattttttcattgatagacatttgggttgtttccattttctagctgttgtgaatgatgctgttatgaacatgaaggtgcaggcacttgtctgttttcaatttttgtgggtatatacctaggcatgaaattgctaggtcatatggtttaaccctttgaggaaactctgtttttcacagctctagtttctgatgtgattgcctctactgtttggggatggatgatacttcgctgacataccttctacatgaccaaatagggagcatggttgtatagacttgacaagtgatcatcatactgagactactgccagtgaaatggttgcgtgtgatttttctgcagctactgggggagacagactgagaaaggatacagggaagcaaaacgggagctcgtgtgccaagtcgaggcattgtaagaggggagaatgatggatggttggatgacagtcagtttgaaatgctggtatggcagatttcccttgagtatcaatgctcagtagtcccactttctgccttttccattctatcaccattattctttgttggacatgcacattcttcaatgcctgttgactctcagccattctgtggtctgttactgtcacttgcaagaatttggctgtcaggggagatgccagcaagtcttttaaaagccactgcaaactttcattgctaacttgtaacttggaggaactttcagagaaagggttataaataaaacacatgcatcaatctgagtttcacaacaggaatgcaattccacttcgtggctagagataaaacatgtcttgccgtgcacagtgagctcttcgccgtgcttgcattttatttcccatcacaatctaagttatggcagatgaagctgctcataaggtatgaggttagacaaccccatgctaattcacttttacacgctatggtgtgtttttaaagatccaagctctgctttcttcagcaactcaggcttgaaggaagggagaggggtggaaaagaacccagaagaacctatgggacaagcgcgagtatggtctgactctccaaccaggttaagccttttgagagcaatagctgaatcttagatctctttgtgccttaaaatgcctggaacagtgattcacataaagggcatgcattaatattaacaagtgcgtgctgctgcagcagaggatagttctgataaccattagagttcatggacaaaaaacgatgatccctaacagcttctcaacgtgtagatactttgcttagtactgtatgtgcattattctgatgtcatgtttgttattggcatgtgtgttgaatacaattatttccattttacagatgggagactgagcatcagagggtcatagccattttatgaagcctgtatttgatagaagccaggaccatctcagccccaaagtgattagggagcctgtgttccttcttaagcattaagcattctacttcactgacctcttggcccatctgaaattgttttgttttcttttttttttttcttttttttccccagaaagagtcttgctctgtcaccgtggctggagtgcaatggcatgatcttgactcactgcaacctccacctcttggattcaagtgattctcctgcctcagcctcccaagtagctagtattatatatgtgcgccaccacacctggctaatttttgtatttttaatagagatggggttttgccatgttggccacgctagtctcaaactactggtctcaggtcatctgtatgcctcagtctcccaaagtgctggtattacaggagggagccactgtgtctggccaccacatgaaattcttataagggagtatattatcttcttccttccttgaatattccaccagttttcctcccttgattttgaatctccctattcttgatttcttagggtcagtggaaatcattcttcttccctttttcattcatttgttcattcattcattcaatatttaccaccaattgaaattttgaatgttaaatatcagccactgttctagttgttgcagataggaaaactaataataggagattcctacctctggggacctagccaggtaatcagagaaatagagggctctgtgctgtgggctggggttgaggggattacagattgctgcaaaaaggagcatgctggagttacacgtaagaaatcagtgtaagaaacggtgtcctggaagaggtggcatctggtccaaatcttgaaggatgggtatgagctggccccatgaatgaaagtgtggagaaagtgtagagttctccattatctggatttccatatctttgtctacaccttgtattttgtagtaatggaatggtgaagaggagtttccagaatgtaaatagttatttggctaggcgctgttgctggcgcctgtaatcccagcactttgggaggccagggcgggtggatcacctgaggtcaggagttcgagaccagtctggccaacatggcgaaactccatctccactaaaaatacaaaaattagccagatgtggtggttggtacctgtaatcccggctactcatggaggctgcggtaggagagtcacttgaaccagagaggcacaggttgcattgagctgagatcatgctacagcatgctccaatctgggcaacagagcgagattccatgtcaaagactgtaaacagttatcttactgtcaaggcaactcaagatgttctattgctttaaatagaaaatggtagtggtgttttgtagtaaattctatatttcattttttaaaaattaacatgttgagtatatctcctatttttcttaataataatcataataaatactaatacaagtctgtaagttaaaggtgtgctgttttgtcaacagattactctgaagagaaaatccattccttatcaaaagaggttcttggattcatcactcactaccttgaaataataatgtttttcttgtatatactctctgttttacttttctttgaaaaagtccaaaagctttctttaaaaacttttctggaagaaaacatttaaaaggaattaaatatatttttaaatttgtaataacatgtcaaagataatacatgtggattggaaagaaacactattaacatttcaaaagtgaaataattgaaagtggtattgttgggttcctgccatcttccctagaggcaaccattggtacatgattaagtgcatccttctacactgaggatttcttttttctttctttcttggtttttttttttttttttttttttttttttttgagacggcgtctggctctgtcacccaggctggaatgcagtggcatgatctttgctcactgcaacccctgtcaccctggttcaaacaattctcctgcctcagcctcccaagtagctaggattaacaacctcactcagcacccttggcgttgctggtcagatgatcctttcttgtgggggggctgacgtgttttgggaggctgcttagcaattaacctcactgccctctagctactagataccaatgccacaccccttccctactctagatgccaaaaatgtctgtagatattgcccatgttcccctggggacaaaaatggctggtgttgagaatcagtcttctagatatttttaaatacacacttaaaattcacgaattaacggaaaagccagagattattcagcaaggcagggatgatttgaaaagggaaaggaaaaataacgacaggaaaagggagttgtgtgtttagaacaaacaagctgagaacacaaaatgaatctcactttttgaacagtcttttgatattgaaggtccaggtacctacgcacgtgtgaagcatttttgagttccattttctcttccttttagaaactgcaacatcctctccctgggagtgggtatttattcaccgcttcactgcagaaagcaggagtcttggataggtaacacaaggaaagaacctagtagcagatgaagaggaaagggagggaggcagggcagtcgatgccagggacacgtgtaacggggtcctgaagacacgcagctaatgaaaggtaagggtggagacagaggcagcgatcctgcacaggaacttgcatcttccatccggaaggaggaatgaatatccttggggagccttctgatgtaggtggcagcaagactttaggaatcgtgtgactttaaattcaaatcctggttgtaccgcagggtgctcatcctttaacgatacgagtttccatgtctgcaaaaatgttgaaccttctttacattttgggtaggccgaccacatcgtggtgatgtgcagaggtggtccacgttcattgcccaggtcccccacgttcattgcccaggtctcccgctagctgtttatttcatcttggtcatgccgtctcacttctccctaccccagttttctcatctggagaagacaggactcatcgtcgccacgtaggttgtatgtattgagtcagtcgacgcatgtaagagcttagaacagactgagtgtggtgccttgtacctgtaatcccagcactttggggaggccgaagcgagaaaatcgtttgagtccaggagttcaagaccagcctaggcaacatggggagacccccttcttatttacagaaaaagggaggggtgcttagaacactgcctggtacatagtaaatactccagagttgctcgctgggatcattagcactcaagtaattcccatgggttgttaagaggcttagagatgagaaaataacctagaacagtgcctggtatacaataagcgttccataagtggcagtgtgggcacagtcttccgggcatacgtgcttgcgggcatgcgtgctctcacgtgctctattcctcctctctttggtccctctccctcttgacattttcctttcttttttttaaaaaccttcctttttttctttgtttgctaccagcctaagagctcaggagagaggactaaccctaagaccaggtgatttatttttctcacgctcatttctctttaataattatcatattgactctgaatttattatactacaagaatgactttatgtgaaatctcatgaatttaaacattaatgtaagataaattaattttaaattgaaatcctcaaacgcagttggatgtgtttccgtatgatgaataagaaattttccgaataaaatctgaatctctgatgttccattttttgtgcaaatggaagaaataggtgaggatatttgacaaggttaaaatatgattgcactgcaatagataggccatgctgtaaactaactttttagtctggggagaaagcagtttgggggcaggctttggtggataaaaagtgaagatttctttgcacatacttaccgagtctcttagtgtcctttaatctaacaccagtgaatataagatataccatcctaaagaggacactattttttacatttttaaaaataaatccattgtattagaggtgtgtttttttttttcttcaactactttaatctcattttctcctaaagttcttctcttcaatatgatctgcaaagggttgaaagtgctgtcctccaaaccaggcgtaagaaagtggttacagataaagcaagtaaatccattaaagaagaaatgggaagatgtgttgtgtgccttatctgacccagcattatcgctggaggggaagtgcttatagggaaggaagagaagtttggtcaattgatgcagtctcagtatgatgacagctggtgacttcctgagggttattcatcacacttcagcagggtgatgttttcaaagcctgagtgtgaccatgtcactcctctgttctccagcgctttcaaaataaaactgaaatccgtctcagagggccagtctcagagtatcccctgccagccccatccttcactgctcagcagtcacctccttccccctcctcacccttttgaggtctcttctgatccttcaggggccagcttctctccgtcccatggttgtttgcccatgctgatcccctacatggatctccggtcacctccatcactcttacctggttagtctttccctggcctttatcccaggtcagcttcgcttctgcaggaatgcctgccttgaaacctcaggtccttctgttccccctcttagagcactgggctattctcctgggaggcagtaattccagtagtaatttgcatacatttgtaagcagttttgattaatgcctgttgtttccactagactctatgctctgtaggggacaaatcttgtctgctttttgctcatcaatttttccccagcacagagctcaatactggcactggtaaacccttgagaaaatgattaaaagcctctaagatgcatgcagttatgaagaaccaacagaaggtacaggtggcatgggacagcagtcaggaagcaatttggcttaaggaggaaggccagtgactcacagatggagtctcagcacttcccttgcccgtagaagtgagaaacaatacaggtagtcacagcatagtaaaaatttcaggccaggcacagtggctcacagctgtaatcccagcactttgggaggctgatgtgggtgggtcacaaggtgaagagatcaggagcatcgtggccaacatgatgaaaccccatctctactcaaaatacaaaaattaactgggcatggtgacacaggcctttagacccagctactcaggagactgaggcaggagaatcacttgaacccaggaggaagaggttgcagtcagtcgacatcacgccattgcactccagcctggcaacagagcgagacgtgtctttaaaaaaaaaaaaaatcagatagcagtttcatatgactagaggctgtgggctgatcagatcctgaaaaaccgggcatggaccaagctggctaagaccaagtggacccaacatggtgctgaatttgacctaggattcacctaggacctcatgatgtgtttgttaacatcctaagtcactgtgacttgggatgttaatgagtgacttaccatgttaatgagcatatcacgaggtcctaggtgaccagcaccatgaattccgagaatacctacgtttggtgtaaaaatggatggcatcacaattctaagaaatttccaccctttcccaggaattttcataagtattccaccccttggctaaagaaacacataaaggtagcagccccaaatccccttaggcatggtgctctcttgagtccgcctacactccccctttcttgagtgtgtacttttcccgttgttataaatctctgtacttccactgttgcctgactcatccttgaattccttcttgagacggtgtcaagagcctggacacctgccgggatcagggtcccaccagcatttggggacctccccaagcccactagtatcagtagagtccctataggtaattgtctaataagtggaaggtgggtgtagaagtttcaagaaaccaaagaaatgtcagatgtgtcatttgacccaaaagaaaagcattttaaaggaagttaatgaaatgcagtcagaaaaaaaaaaaaaatagcataaaaggagaaatctgagaagttctacttttaggaatttaatctacataaatacatatataaggaggcaagaatatgtgaggaagtaaattcaatgtgtacacacacatacatacacagacacacatagatatatagaacgattgtaaaaggctatttgtagatttcttgggtaagttttgggtctgtccatgcaatgaaataccactcaaccattaaaaaaaaaaaaaacaaaaaaacgttaacttataggtacttagtatgacaaaataagtaccattagttaaacaaaaacaggtatttgcataatcatgtgagtaatatgaatgtattttcttttttcttttgtttttttaagacggagtctcgctctgtcacccatacggcagtgcaggggcgtgatcttggctcactacaacctccgtctcctgggttcaagagattcttctgtctcagcctcctgagtagctggaattacaggcacctgccacaacacccagctaatttttgcatttgtagtagaaataggatttcgccacgttggccaggctggtatcgaattcttgaccttaggagatctgcctgccttggcctcccaaagtgctgggattacaggtgtaaaccaccatgcccagccctttatttttattttattttttttatttttttgagatggagttttgctcttgttgcccaggctggagtgcagtggtgcagtctcagctctctgccacctccgccttctgggttcaagtgattctcatgcctcagcctcccaagtaactaggattacaggcacacaccaccaagcctggctaatttttgtatttttaatggagacaaggttttaccatgttggccaggctggtcttgaattcctgacctcaggtgatctgcccacctaagcctcccaaagtgctgggattacaggtgtgagccaccatgcctggctgaatgtattttcttaatgtgtgtgaagacatcagtatctaagaaaagattgtgcattctgatatacacaacagggaaagtctaaaataatacagaactattattcctggttagttcctaacattgtttcataagaaaatattccactttttttttccagtttatctttgaattttactaacgggaagtaataatagatcaatgaagaaaaatgtcacagggaccgtaagaggaagaccttagaaaaataagcaggataaaagcatcctctatgccaggagttctcaactgagactgttttgttcccccaggggacagctggcaatatctggaggcattctggtttgtcagaatggggtggggaaattgatgttgacatctagttggtagaggccaagggttctgctaaacataccacagtatatagaacagctcttacacaaagacttccccaagccaaaatagcaacagtgtcttggttaagaaacgttgctctatcatggttaaaatatggttctctactctttgcattctggtaattttaggaggatgacgtcctctgttgagatggtaaggggtcgagagagtcatccagataaaatcggtgttgactttacaatatctgaatcactcataaaattattcaagatagtaactctcccacctcctggtcaggttgacatttcagcaaccaggtagaattggtcatatagcctgttgtgaatccatggatattttatttaattgcgatatgtaaagttctccaaatgtggatgccatagaaccttcggatttaccatctaagccttttcccaattgatctcactctttttgctctaatcaaatgtacctcaacctccatctaaagtaaagctggatagattcatactactccattatcactaaggttcattttatttgcaagcggttttgctcattataatttcattagcatatttggaggtggggaatgagagaggagacaacacagcttagtcttaccttaaaccttggcttgacttggtcgaattttaactctattcttggctcacccaggtcttatagtccaagatgtaaatttacagaaacaacttcttggactctcctgttttttccaatgtcttattagatgatacgtattttctagattttactgagttaacatattttagttgtgttacctatgcaaaaaacaggaatactctgaaacatatttaaccacataattatacctcagcaaaccctccaaccaaatgcccattatatatcatttacttagcctaatatatttccctttttgaatataagagatttcacctctgaacattacatctaaagatgggcaactgtttaattatttgagtaactcaaaaatattttcaacaagagccagggctgtgggaagtgtcctcaaatggaagggttttaagcattttttttaatacaaagatgataacttgcaaccagttctattatttttaactctttgccccttcctccatctcttgggtttgagaagagctggatctttgggcaattatttattccatttccacatctttgggaaggagggacagtgggaagaacaagacccagcacttggggaatttttatgattatctccagctgtgaatgctagggagcatcatttatgcagtgaaagaagtaggaaaagcaatgtcttacttctgacgaagaacttacagttctctctaaaggggtggaataaaattgctattgcaaaaacgggaagatgttgctaatgggaatataccgaatggtatcactaattaaataaagtactttggaattcattgacagcctgcacttaagaatataattgcatattaatcaaccatttgtagacaaaactgaatgctatttattatgttaggataaaactttttcctgatatttcaaagcctgcgattcaactttgttcctaaattcatcttcagaaatgaatacactgtatttgtatgtgaggagcccaagtgaataaataagcaggagtttctgaagggaacaacacagtgggatttatcttgaaaagagcaattgctgacatatgtcacatgtcattaccagagagttggagacagtgttactcattatgtggttacagagtgttctaaattagagaaatggattattggtagtggatgatttccccagattgctacttaatagtgactgaggggtctgcattactcatatttgcgatgaaaatggtgccaaaacccagcagtggttgactgaaatgaaatgtaacacctattgggtattatcttgagatgctgcctaattgtatgcctcttgcttagtatgaatgtcttggggtctcaggggctgggtgcttgcagcagccgcagacggaaagtgaaggtttctaagttatttacctttttgttgcttcctgcctccttgctgccatgcctgtgcacttcagtaattactttacccactcaaaataagtttctccacttgccctttttccattactgggaagggtctatctttgcagctctctgtaactgtccctacctgtttgagctgccaggcttgtgctcctaggtgagcagcccagctactgttttcattcatttattgattaaatagttaagaatcccaactacgtatcaaagcctgtgctagaccttggttctggattgacaggcgaactagtgtatctgcatttctgcagctttcaatctctggggagacagatattaaaaatacagtcacacaaattgatatgtaactcctgctcctcatttaccactaatgttctaactcagcactagtcctacaggcctcttttctcttattcaaatatttcaggctcttttccacctcatggtctttgaactcactcctctttctggaaggctttttctgtggcactttccttttttttcaagtcttgtattttattttattttattttatttttatttatttatttactgagacggggtctttttctgtcacccagggtggagtgcagtggtaaaatctcggctcattacaacctccgcctcccagattgaagagattctcctgcctcagcctcctgagtacctgcgactataggctcccaacaccatgcctggctaattttttgtatttttagtagagacagggtttcaccatgttggttccgctgttctcaaactcctgacctcaggtgatcaacctgcctcggcttcccaaagtgttggggttacaggtgtgaaccactgctcccagcctcaagctttattttagctcccaccttctcagggagaccctccttgacttcccagactggaatgccagcctggccagctactctctgacagtctgaccgatcatttcctccactgcacttatacacctgttagtatgttgttaaagttacatgtcacagggcagagattttgtcttcctcatgtcttcccattggcacctagaattgactggatgccaaatagacatttgttgtgaccagagaaagactctagatgctatggaatattaaaacaaaaagaattaatttggatgggaaggttcattgaaggtctctgtgaaggactagcattgaggttgatgggtaggtaggaattagataggaagagagatggaaaggagtggtgcagactgaggagacagcgtgggcacagcttgaggaggagaggaacctggcaaggttgatcaatccacagatgagtgtgtccagagtgatgtgacaaggggctagagacatcagccttggaggcacagtagggtttggactgggttgtgagtacactgggaagccattggaggaatttaaaggttgggggtacctgatccaataaatatttttttttctatttttatttttttgaggcggagtctccctctttcgcccgggctggtgtgcagtggtgtgatctcatcccactcggctcaccacaacctccgcctccccagttcaagtgattgtcctgcctcagcctcccaggtagctgggattacaggtgcccgctagcacgccccattagtttttatattttttagtagagatgggggtttcaccacgttggccaggctggtctcaaactcccaaccttaagtgatccacccacctcggcctcccaaatttgctgggattgcaggcatgaggcaccacgcctggccctgatccaaaaaatattttaataagatctcttgggctattgggagaacacttgtttgggaggggaagcgtcaatggatgcctatagccttgcctggtacagagaaagtactcagtaactgtttattgatgaatgaatgaatgaatgaatgaatcagttaattaattaacaggagatatcagtaagtgatttgttcttaaaaagaaaccttgcagaaacttgaaggtgtttgtttgggatgactaagcaagggtagacagattgttgttactcataaatgtcaaaataagaattataaaatttagaataatattgttgtcatgctaagtgatatctggagttaagcgtcctctctgacctgcgactgctcgtgagacagttgcatttactcaggtaactgtggctctcagagtcattcttaaatgttttctttttctccccaatgtgtttgtgactttgtccatctggaagtcaagttcattttggccaattaacttcaaaggcctgacttctctatttttttttttttttttttgagatggtgtctcgctctgttgcccaggctggagtgcagtggcgcgatcttggttcactgtaagcttcatctcccaggttcacgccattctcctgcctcagcctcctgagtagctgggactgtaggcgcccaacaccatgccccggctaattttttatattttttagtagagacgggttagccaggatgttagtgttagccaggatggtctcaatctcctgaccctgtgatctgcccacctcggcctcccacagtgttgggatcacaggcgtgagccaccacgcccgaccggcctgacttctcttgtgaagatggctccgttagtgagcgctgtggactaagatccacaaacacagctgctatgcgggttccctttctgcatctttgtgagtttcagtgtcctaagctagccctcatataggcatagactccttgatattttactctgcataatcaggacaggaaaagatataggacctgtattaaagggacacaagattcagaatcacattaacttccaaatctcagtgccttaacacaatttaagtttctatcttcttggccgggtgtggtggtcacgcctgcaatcccagcactttgggagtccaaggtgggaagatcacttgaggccaggagtttgagaccagcctggtcaacatggtaaaaccccatctctaccaaaaataaaaaaaagtagctgggcatggtggtgcacgactgtagtcccagctactgggagaggctgaggcatgagaatagcttgaacctcagaggtagaggttgcagtgaaccaagattgagtcattgcactccagcctgggtgatagagtaagactctgcttaaaaaaaaaaaaaaaaaaaaaaaaaaaaagtttgtatcatgtgtagctctaaatcggtgtcctgatggatggacagttctactccataatgtgatacagggacccaggctccttccctaggtggctccacctttatggttgccaaagaaagagaggatcatatgtgctgagcctaaaatgataaagagcagcacctccattcccattccatctgccaaaagtgtcatctggtcacatctaactgcagaagaagctcagaaatacagtctctgtccttggaggagaaaagaaacctactgttcaatagctagctcagctctgctacaaaacgcctgctatagaaatgggagacaatcatgcattccttttctacaatttatggtatttcatgggtgaaccattaatacgtcaccgggtaacgcattattgaatatgttagtcattttcttttctcatcgtttcttgaaaaagaagttgtctaacagtcctaacttcccatctggcttcttaaaatctgttttacaagcaatgagatagttaaggattttcagctctgtggttgaattactccaaagaaagaaaactgcttttgaagttagaaactgaaacacacagcaacagaagcaaccagaaaccccatagggttttaaccttgttttgtcatatttctcaacaaactccttatttgtttggggattctgcttagctctgtgcagaggtatcttgctttctgtatcacttcaaaccttccttctacgtgagttagccttagggtatgaccacgaatgacaccttcaaatgggaaccttttgtgcctagagaaatcaaatcatctttcaagacttggctcaaggggtgtatcttctgtgaaggtcttacggactttcaccccgcttcgggggtgacagttcctttcttatgcccctaatttatcctgtgtggactatgatagctcccttgctacaataacatagttctttgcatttattttcttaaagtataacaccagttcattacagaaatttctaatttctgtaattagaaagtacagatgttttttaaaaaatcaagtaaatattatgtgtgagtccatgatgcagaatacttactgctgaaccacagggcctgtatggttaatcattgaatcagcgttgccaagcaaagagtgtgacacacattacttccatatcagtagaagggtggaaggatggctggatgggtggatggatgaatgactcacatagcttctcacggatgaacacacctatttactcggcttttacagtaagcccaggacagggtaaggatgagttggaaatgatatatattggttaacaatagccagagcagtactgagagttcccttgtttgcaaacagtacagttttaagttattcaggaaagctggttttctgagtttaaataactaaaatcaggttaggttgtactaggtaacatacaaactgtggatctccgtgttttaacacttgcatattgctctctcatctgagcgtgctgctagtctgttccacgaggtggctcaagacccaggctgcttccattttgtagatgtgccacctggctgactctgataaggaagtggagtcagagttcttgggttctccgcaatggtagtgacttccaatcacggtccaccagctagagctgatcacccagcctcacccaacagcaagagtattttgagccactcagaaggtgatgagaactagacatggatgaacataaccatgtcctatgcagtaccgggtaattgggaagactataataaaaatggtttagcatgtgagtactgggctcagactggttttgagcctctactgggaacaatttgtgcaatcttgggcaagtcgctcaatctctctaagcctcactccctcattgaaaattgaggataataatagttttaattaaataatgtgctaatcactgtgggcattgtgcaagttcagataaacattagttatctttaaatgtccatgaatacttaaaataattgtcattattacaatcttgttatcattggtagaagtggtagtaatgaggtagcacttgggactccacttcagaccacattgaagactggcggaaactgagaagaggcactgaaagcatgcccaacagcaacaatgacagtttactgtcaccatggcaacagcaggaagttaccacctctttccatggcaacacctggaagttaccacccctttccatggcaatactgggaagttaccacccctttttttttttttccattttactttaagttccgggatgcatgtgcagaacatgcaggtttgttacaaaggtatacatgtgttgtggtggtttgctgcacctatcaacctgttgtctaggtttaaagccccacatgcattaagtatttgtcctaatgctctacctccccttgccccctagcccccgacaggccccagtgtgtattgttcccttccctgtgtccatgtgttatcattgttcatctgccacttaagagtgagaagatgtggtgtttggttttctgttcctgtgatggtttgctgagaatgatggcttccagcttcacccatgtccctgcaaagaccattaactcattcttttttatggctgcataatattccctggtgcatatgtgccacattttctttatccagtctattattgatgggcatttgggttgactagcccttttctagaaatgtctgaataacctgccccttaatttgcatgcaattaaaagtgggtataaatgcaactgcaaaactgcttctgagctgctactctgcacacactgcctatgaggtagtcctcttctgctgcccctctgctgctgctgtgcactgccacttaagtaaaagttgctgtctaacaccactggtttgtcctagaattctttattgggcaaagccgataaccttcccatgctaatccccagtctgggggcttgcccgtcctgcatcggtaatacatttgcttagcatcctccaggggtctcaattagtgtcatacaaatgtacatgcctcaaaaggatatatcagaatactccattctcagctttctcaggtgcttccccgtcatactctgaaggaaaatcacactgagaatctcacccacagaaaaaggattcttcattattaaataccattcaagactgtgcactggtttttgatttttttttttaagaaaaaataaggggaggagtgtatccatcattttcttttttttctttatttttgtgaccgagtcttgctctgtcgacgaggctggagtgcagtgctgtgatcttggctccctgtaacctctgcctcctgggttcaagtgattctcccgcctcagcctcccaagtaggtgagattacaggcacacaccaccacacccagctaatttttgtatttcttgtagagacagggtttcaccatgttggccaggctgttctcgaattcctgacctcaagtgatccacccgcctcagccccccaaagtgctgggattacaggcaagagccactgtgcccggcacatcattttcaacatagctgcctcagtctgaaaacgataactcctcactctactattaaccccactgactccatctgggcagaaaggctgaggttaggttgtcagctgcgtcactgctgtggaaacatcgacagactcaataaacaccctgaaatttaacatgcttctgctatctgctgaacagctctgggcacaaataggtttcttttattatggacagaaaggccaagtgaaattttaatcagacagacaaggagggtatctgagaacactgaaatgccagccctgctggtatttccacaatattgaacttgtctttcggggaccttggtaggtatttcaattagctgtgagacacacagcctgtgtttttgcaaactctcctatttttaattaagatgctgttcactgggatattagaaggcacacgattcttcttgtaatatgcaaactatagaagagaaaattaagcagttgaaacatttggatgtagaaagtggattgtagtcatagctaaaatcatagcacttcgtgtactcatagctataatcatacctctgttcttacgtgatatttggggtatcttttcccctcccatcccattctctcgatttcttaactttcaattgcattattatgtatatttgctttaacgtatgatgagcctgttttcctgttttctttttaaaataacgaaatatttggtataaacaaaataatatctgtagcaactatggaccctgggaaggataataaaacaaaaatccgtgagtttactactcaacttaaaaattaaaatgctgatcagtactactgaattgacttgcttgcttcttggtgagtttattttttcatggagataatcaggcaccgttttgccagttaaggtgcctaaaagcaccataaatcactggaaattctagactaaaaagaggtctttctttctttaaagctttgtccatcttttagtcacacggaacacactgaaagaccttccgaaaaatgaaaaggcaactttagggtgtaaggggctgcagggccgcctctaacattcattcgttcattcattggtccctgtatttcaggattcctgcgttggttcctccattccttcattaaatgttgagtatgatcacagtcttctttcaactataattagtagaattaactgctattggctgaatgttcatgtccccctaaatttgtgtgttgaaattctaatcccaaggtgatagtattagaaaatgggatctttgggaggtgatggggccatagagcatagccctcatgaatgggattagtgccttcataaaaaggcttgagtctggtcacagtggctcatacccataaccccagcactttgggaggccgaggctggtggatcatgaggtcaacagatcgagaccatcctggccaacatggtgaaaccccgtctctactacaaatacaaaaattagatcagtgtggtggtgtgcacctgtagtcccagctactcgggaggctgaggcaggagaattgcttgatcctgggaggtggaggttgtggtgagctgagatcgtcccattgtactctagcctgggcgacgaaagtgagactctgtctcaaaaaaaaaaaaaaaaacgaaaaaaggtttgagagacccctcaccgctttaatcatgtgaagttagagttaagggtatctaccaggaggtggacactcaccagacactgaatctgccagcaccttgggcttagcctccagaattgggagaaataaacttgttttgtgcaagccacctgtttgtttgtttttaatttttagcacctttttttttcaattttcttgtgcatttgcttaagttccttgtacactctggatattagcctatggcattttgctagaagcctgaacagactaagacaatgattatgaaaagatttagttataaacattataataatggtcagttatcctgcccattatactcaggttcttttgagaattccttgcgaggtttgataaggacattagattttgtttacatgtttgtggttttagacagcaaacatgcattgaagaatgttagacaggaataaagttgaaatagcctcactcacactaaagagcccagagtgttaattgacatcctgttttccataatttttttcttttgtttgcttgtcaataaaaccctcatgcaacctgagtggaaggggagagtcattaatgcggtagatctggatgattttctgaacaacctaacctcacgctaatgaggcgagtattaccacaggccctttctcctacgagctgtccacccacagttgaagagctaattttactctcaaaactctcacgaatgcttttggttcctgccggctcttgagtagtaacagagtgctttagccctctgtggaaaatgatggaggcattgtcagggcacatgaaccctctaagaagtggatgtggtcccacctctacttaaacctggaccatgcagcttaagggttccattctcaagccagtgaacatcactgtcttcatgtgaatgttcttcaggtagaattttttagcataaaaaattccaacaggccgggcgcggtggctcacgcctgtaatcctagcactttgggaggtcgaggcgggtggatcacgaggtcaggagatcgagaccatcctggctaatacggtgaaaccccgtctctattaaaaaaaaaatacaaaaaattagccgggcgtggtggcgggcgcctgtagtcccagctacacgggaggctgagggaggagaatggcgtgaacccgggaggcggaacttgcagtgagcggagatcgcgccactgcactccagcctgggtgacagagcaagactgtctcagaaaaaaaaataaaaaataaataaataaataaataaataaataaataaattggaactgagtgttagctatttgagtagtctcagctgaataatacctctgacatggtatcattctgtggcatatatttttctgtaaggaaataaaaacaactttcttaattatttttttctgatcagagaaacaacacatacacatctttggaaagacaaatactttgtgcacatatagagaagaaatgttctccttatttaatccaactacttggagattattcactgtttgggcaactttgctgaccttgctctatatttatatacaaatatgaatgtgtgtgtttgtttagaaaaaccaaattgaatcatatatttttatcctgcccttttcagcttgatgaatatctgtatcaactttttaatggctctgcagtgttccattgtatagacatacttaatttatgtatccagtttcctgctgacagacatttagactgttttttttaaatctatttgctttttttttttttaattttacttcaagttctgggatacatgtgtagaatgtgcaggtttgttacataggtatacatgtgccatggtggtttgctgcacctgtcaacccgtcatctaggttttaagcccggcatgcattaggtatttgtcctaatgctctccctccatgttcccccaaccccctgacaggccccggtgtgtgatgttcccctccctgtgtccatgtgttctcattgttcaactccgacttatgagtgagaacatgcagtgtttggttttctgttcctgtgttagtttgctgagaacgatggtttccaggttcatccatgtccttgcaaaggatatgatctcattcttttttatggctgcctagtattccatggtgtgtatgtgccacgtgttctttatccttgatgggcatttgggttggttccaagatttactattgtaaataggttgtttcttattgttgttgttttcaaaacataacacattttaagcatatgattctctgagcaaagttttctattagagtggatgtctcttgggtttaaagaatgggtgaaaatctctttatttctgtgaaccttttgcaaagttggacagcagtatcaagttagccaaggaaggatgtcacacagagtggccatggtggtcttctggagcaaatagagaaaacacatattccagggaggaaaaaaaaaaattccttactttttgtatagcccaatcttattttcagttaataaagctttggccagacatggtggcttacacctgtaatcccagtactttgggaggctgaggcgggcagatcacgaggtcaggagatcgagaccatcctggctaacactgtgaaaccccgtctgtactaaaaataaaaaaaaattatctaggcatggtggcgggcacctgtagtcccagctactcaggacgttgaggcaggagaatggcatgaacccaggaggtggagcttgcagtgagccgacatcgcgccaccgcactccagcctgggtgacagagcgagactccatctcaaaataaataagtaaaattataaaaaagctttacaggtagttccttttcacatataaattaagttagtagatttaggaacgtatccttcactattctgttccatgccaaaagaaataacaaaaacaagatttgacccttaggttgaagttctcctgaactgactgttccctcaatatcttcatatcccctggattgtccttcagtatctaagaatatgggggggaaattaccagaattctccactgtctcatggaaatcacaaggcttgcttggatcgtaatgtgtacaattcactattaacaaaggatatggcattttctgtctgaaccttttcccaacaatccattttctttctctctctctttctctgtctctctctccccacccccaaatccctctctgtctctaagccaccatcacatcttccctgcatggcttttctctctctccatcattacccctacaggccagtccccttatagcttctggaggaatcttctttttttttttccttcatgttttaagttcaggggtacatgtgcaggatgtacagatttgttacataggtaaataggtaccatggcagtttgctgcacaggtcatcccatcacctaggtattaaatctggtgttcattaggtattctttctgatgctctctttccttcccctcagcagatccccacgcccattgttctctcccatgtgcccatgtgttctcatcattcacctactacttataagtaagaacatgtggtgtttggttttctgttcctgcgttagttatcttccaactccatctatgtctctgcagaagatatgaccttattcttttttatggctgcatagtattccatggtgtatatgtacgacttttttttttatccagtctttgtcattgatgggcatttaggttgagtccttgtctttgctatcgtgaatagtgctgcaattaacttacatgtgcacatacctttataaaagaatgatttctgttcctttgggtatatagccagtaattggattgttgggtcaaatggtatttctgcatctaggtctttgaggaattgttagaccatcttctgcaatggttgaactaatttacactgcctccaacagtgtaaaaatgttgctttttctccataaccttgccagcacctgttttttaatatttttattagtaaccattctgactggtgtgagatggtatctcattgtggttttgatttgaatttctctaatgatcagtgatactaagcttttttcctatgtttgttggccgcatgtatgtcttcttttgagaattgtctgtttatgtcctttgcccactttttcatggggttatgtttttcttgcacatttgcttgagttccttgtacactctggatattagacctttgtcagatggatagattgcgaacattgtctgccattctgtgggttgtctgttcactctggtagtttctttttctgcacagaagctctttagtttaattagatcccatttatcaattttcgcttttgcagcaattgcttttggcattttcgttatgaatccttgcccgtacctgtgtcctgaatggtattgcctaggttttttttttctagtgtttttagagttttgggttttacatttaactctttaatctttcttgagttaatttttgtgtattgtgtaaggaagaggtccagtttcaattttctgtgtatggccagacagttgtcccagcaccatttattaaatagagaatcctttccccattgcttgtttttgtcaggtttgtcaaagatcagatggatgggggtgtgcagtcttatttctgagttctgtgttctgttccgttggtcgttgtgtctgtttttgcaccagtgccatgctgttttggttattgtagccttgtaggtaatcttcttaaatcatacattttatcaggacactatcacttacgacccttcattggtttctcattctacaaagagaaaatttcagagatctcaccagaacgttccaggccttgcttctctgacacagacccatgtacctccttcctgacccccatacacaactcacactggtcttttatcagatcctcaaacaagtaaggctctttcatattttagagactttgtacctcttccttacccctcttgggataatctcagtcccacttgtgtatggctattccttctgattctttatatctcactttaaatgtcattatcttaaaaaggcaaatctcaacctgccatggacagcagatgcttcttccttaggtgttactgataaaataatgcatcaatgcatctctgtaaaatgaacctgtgcatctgcttcaggccatatttctgtccctcaacaagcacatcacagttgtaatctgtgtccattcatatttctgtaccactaaaatataggtatagtctttgtttttcattcgtatatcagacttgttgcctagcccagagctgcttacacggtggcccatccaataaatatttgttgaagactgaggacttgggaagggtgtgtgcatgttttcagtctgtgtgatagcttcacctcctattacgtgaattggcccgaagatccccaattccgtgtcatcaagaaacatggacacatcacagactcactcaacatggacacatcaagactcacttaacgcagggtggcttcccaacagcaagctgtattgctgaaaagcaggccttttccagtaagaacatggacaaggacaaacaagagactgcactgtgttctataagaagacacctgggtcataatgagggagagaaaaataagaccacagcaaatgaaacaaaatgtgtaacataccagacaggggaggaatcaagggagctgttcggggagctgctgcaatgcgagattggagctacaaatgtggaaacgcacgaagacctttgcccctatgaatcatgtattgggaaaacagttgagcatctacagacgtcaaataaccaataaaatttcatgaatggtaacgttcgccagtatccgggagaataaggctgagctctcaacatgatctgctaacaaaattaggtcatttgtctttgataggagatggccactttcttattttttatttattcatttgtaagcagctgctttaataagcctacaggatcttggatggcatgctcataagttctagtaaagcctggaagaaaattacaaagggaaagactgcctctaaattaccctaggaaacaaaaaaaaaaagaggtgatggctacagttttaccatgtctttgggggcaaagtgatttccttctttctgtgttcttgttggggaaaaggggaaggtgttaaatcccacagctgcaaaatagattcatttctgcctctcttgtaaagtgaagcatctttccttcccagagaactttatcttgcctcagtcaaccctgctcagagatggttcatccactcctgtcttgcggccattaaacatagcaactcaagccctcacttccagggacttaatattggtcatttaatactgcataacaacatttcatgatatacaacatgtatctctcatgcctttctaggctggctggggtttggctggcccagactgtgctcatttggacagctctgcttcatgctatgggtccagccagacctgtgtcctcacaactgcaagggggtcttcaatctgccctatgtgtgcacattctggggccgggtctaggggaagcagccgtctagactgcttggtgctctgtcatcatcttcacagcaatggggagccacagggggtgggctggaatccttaccactgtggcccacgttttattggccaaagcatgatacgcaactgatggcacagtcaaggtgtagggaagtgtggtccatggtcagtcgctgaaaagttgcatggcaaagggagtgaatacaagggacgtgaagaatggaagaattgctgccagtaattcagtcgaccacagcataactacaagaggctgatacggttatttgacagtgatcgtcaggattagagcacccatcaacctgtgaatgcttacacatttttattctgttttaaaacagtcacgtgtggcttagaaattaaataaaatctggtaattttactatgaaaaaaattattcccaccaagacttccttttggtggtggttgttgttgaaatggagtcttggtctgtcagtcaggctggagagtactggcacaatcttggctcactgcaacctctgtatcaagcaattatcctgcctcagcctcccaaatagctaagactataggcacctgccaccatgcccggctaatttttttatttttaatagagacacggggtcttaccatgttggccaggctggtctccaactcctgacctcaagtgatccacccaccttggcctcacaaagtgctgggatttgcaggtgtgagtcattgtgcccgatccaagactgtctaatgctgtgttaccccacaaggaggctgatcacagcctccttgtggggtgatacagcaagtggcgacaccatggtgagctcgggcccatgaccattcaaagggagtcacttcacagctgcagctgattgtgaccatgtgggaaggtgggcatagtatggccaggctttctcatttctccagagaagtttggcatctgcattttttatgagtgaaatttatagtttttgaatgttagtcactaatacaaagttttatgaaaatgctttgcatgccaaacaaacacttctgttgaccacacatggccagcaggcacccgattgccagcccaccttagactgaaggcactatttgctattttcgacattattggtcaaatctaaatagctagatggatatatagaaaaagaaaagaagagatagaaaaaaaggtgatagaaccaaagaaagaatgaaagagaagatgtatgtgtatgtgtgtagagagagatgatggaaggaaggaaaggagggagggaaaaaagcaacctaggtagatagctgggcagatggatggaatgagagataatagatggataatctttaacgttcagtaacatatgacaagtcacattgccaagtagaagaaactcagcaggcagcatttaaagagaaagtttcacactcatggaggagcaggccagtgattagtgtcagggataatgacccaaattcactgattgtatttcctcaggtgtcaaagaggaacagaaaacgatagtgttgcaaagaaaaagaccagagaatgtctcaccctgggtaattctaccttgcttcatgcacgcttaactagcaacttgcctgtcctgattccaaagcacgtttaggtagtcccaccattggccaggcttacgtgtccctgaacctgcagatttaggaaaaagtaaacagctgtcctcaagagtgcatgagacgctccacatttctcctttgtgatttatatataatcatccccagagagtgaaacaaaggaaccaagtaacttgctgaacactcttgaatgtagaggaaaaattatccacctatcagagagtgtgttgacagtagtgagcttttaatactgaggaagtctttccgtggcacctaaaagttagctcctgcaatattctgctcattggcaaaaatcgtgttcatttttaagagaaatagattatgacaaaagtagaaaaaatatagtcttatactttagatagaactgaaaggcctggctgggtgtggtggctcacacctgtaatactaacacttgggaggctgaggctggtagatcacttgaggccaggggttcgagaccagcctcgccaatatggcaaaaccctatctctactaaacaatacaaaaattagctgggtatggtggtgcatgcctgtagtcccagctactccacaggctgagacaggagaattgcttgaatgcaggaggcggaggtttcagtgagctgagattgtaccactgtactgcagcctgggcaagaaagcaagactccatctcaaaaaaacaaaacaaaataaaacaaaaaaaactgaaaagtccatctgccatgactgtctacatcgcctacatcccacatatccctaagacccagtacaaatgccatctcctccaagaagccaccttgatttctacccactgaaaatcctctctccctcttttctttgtccgttgtgccttatttttcttcctaccctgccacttaactctccctgatttataattatttgtgtgtgtatatctcccagttgactaggaagatgacttggattagaaagctggagactttgtctttgaatcttgcaatactgttgattttggtagatgaacaaaagtgacaagtgacatcttttttctcaaagaaatacaccatgtactcctttgtgcatagataccttcttaaccgagtcgattgacatggactcttaagtatttagcttcttggattctaaagtaaacttacaagttcctgcaccctagggttcctttccctttatcatttagtccttcattcagtgaattcagttgttcctcaaatgaagcagaaatgattcctcttttggggcgtaaagtgtagtgtgaagctttaaaaaataaaagtaaataaataattgcatacttacaaatattgacaggtacgatgaaagaataaactacgttgttctacaaaataaaattaaggtgagtgtagttgggagagaaccctacttaggtaggttggtcctggagggcttctctgaggaggtgatgttcaagctgaggggtaaaggatgacaaatgaggtttgagttgagagcttatcaggagactgattgcctaaggtacaataagagaagagatgggagaggaagttggaggaagaaacaaggccagatctgtacccacacagctaagattatatccctactggccttaacaaattaaagcacttcttcccatgccttccacagatgactcctaatgtcattcttttgcaatatttctaccttctttcattttaacttccgttacatatagctatgcagaaaaaaaatcaatttgttggctaaaataaagaatagtgacaataccaaatgctgtcaaagatcactcaaatattgctggtgggaatgtcaaatgacttaatcactttggaaaatcatctctcattttcttgtagaactaagcatgcacctcccatataattgagcaattgcacacttgggcatttatcccagtaaaatgaaaacacatccacaaaacaacctgtatgcaaatgttcactgcagctttatttgtaataatagctaaagactgtaaatagcccgtatgttttcagtgcatgaatggttacactgtgataatccacactgtggaatactatgtagcaataaaaaagaacaaattattgatgatagacacacaacaactaggatgaaactccagggtgagtttcactcccttgtggtgagtggaaaaaaagcccatttctaaatcattttgtccagtctcagcaatcatttttatgtatctaaaggttacatacaaaatgataccgtgtatgtagcattcttgagtttaaaattctagatatagagaatcaatgcgtggttgccggggtcaggagtgagaggtgtggagtgacagtagggtgtggtcatagaaggcgtctttttgtctgtggactattttttgtcctggctgtgatatttatagttttgtcagatgttacccctggagcaataagagtagaggtcatgggctctctgtatattacttattaaattacatgtgaatctacagttatctcaaaaagtttaatttttaaaattccttcatataacaacttagagtttgaaagatattcacaacatattttacatattaaatttttatttaaatatttgtgttctcctctgccaaattgtaagagctttcccctaagagatcttgtcttaattatctttacatgcctcctctcaagcctcctgttgtcagggaaagaacaaggctctagggtcgagaagacatgggtgagataacaatttcaatgccaggcaaaggactttggcaaattcagagcatgatttgataaagactggaactcacaggcagaaggactggcaggtggcacccggacccttaactccttcctctgggcatcaaggcgcagacatggatgatgccctgtgtgcttgcattctagaacagggacaccactatcctttagctgtattttttggggggttggagagtacggtgtattagtttccattgggttttttttttttttctttttttgagatggaggttcgtcgcccaggctggagtccagtggtgtgatctcggctcactgcaagctccatctcccgggttcatgccattctcctgactcagtctcttgagtagctgagactacaggcacctgccaccacgtaactaccacagatgtggtggcttaaaatgatataaatttattatctaacagttttggtgatctgatgtctgaaatcagtgtcactggcctgcaaccaaggttttgatagggctctgctttctctggagtctattcttctagcttgtagtggctacatgactgcagtctctgcctctgtgttcttgctgtcttccgttctgtgtgtgcctctgcgtctttcttttaaggatgcttgaggttgcgtgtagggccctctggataatccaggttgatcacccattttgtgagcatcagttcagtcacatcagcaaggaaactatttccttacaaagtttataagtttcagggatttttgacctgagatatctgagtggctattatctggcttattagggtaagtgtgagaacagtcttacaagtagggaacaattccttgtgtctcagaaattaactttggcgagatacatggtggcaactagctgtccaggaaaggtgcatgttggaaactagctgtccagatgagatgcatgctgggaactagctgtctgggagaggtacatgctgggaactagctgtccaggtaaggtgcttgcctaggtgaggtgcatgccaggaaatagctgtgccagcgaggcgtgggctgggaactagctgtctaggtgagatgcatgctgggaactagctgtctgggagaggtacatgctgggaactagctgtccaggtgagatgcatactggaaactgctttccaggtgaggtgcatgctgggaactgctgtccaggtgaggtgcatgctgggaactagctgtccacacaaggtgcatgctgggaactagctgtccatgcaaggaggatgctgggactgtgttgatgacatcaagagaccatgtgagcccagcaccctatggatggacaatctcactggcagaattggaacagctggtcccagctggcttattgccaggcaacccagagacagcctctggtgttacccttcacacagttctatccctccctccatatatactacctaatgattgtgcgaacttgggaaagctgcttaacttctctgagcctgagtttcctcctttgtaaaaggagactaatactggtgtttacccttagggcttttgtgagcattaatgatagtatgtataaggtttgtagtaagtgccatataaatgttggctgtaattattatattcttgtttttgatattgtttctatgaggatggtggtggtagtggtggtggcatacctctgtgcattgtagcataccctaagggttggctgcataacgttgaattttagttcgcagagttactgatagtgcctgcccccagccattgggcttcctggtttaaaaggcaaatcatcctgatggaggatggtgcctacagtgtggtgctcgaggacaatccctgtctgcttgggactctgacagtggtagatgctttcagaatttgggttatgagtgattgagggaggttagcaaacggattcctacctccttgtactgtatgaagcagtttgatgggattaatttgcatggcccatagtaaatgctctcagcctgtatggaggctaatttgtgaacctgtagcaatttatcaccctggttggattcgtttaccagtagacaatgtgattgggataatgcgcctcactgtgcgtggagaggagctgcactctgacctcacttgaagaaaccaccgaggggtaatttcctccccaacggatgactgacattacagtgtggtgacaaatgatgagtatggtaaatggttaatatagccagggccaggatctatatgatttatgcaaataattagctcttcctgggtagtagcctgcatgtctaggtaacttttattttttcagacagtcatctccgtaatgagctattagtctgcaggccagaaagaaagaaaggtagaaggaaggacagacctcaggcagttaagtctttgttccttccagaaatcctatttatttaaagctgagtgtgataatgttttcttttacaaaactccattgctctgtattgtaaaagcaactcaaaatatgagtgtctgacgtttattagtttcaataacggtttctggggtttagacagagcttgcattcatcttcactgagttccattaacacggagggacatataccattagcaccatttcctagttagagaatgtaaggaaagatggaggatcaatatgactgtattaggaaggagtctttgggtacaaattatggaacctatgaagaggaaagggcttaaggggttaattattaaaaagcttatctaaggaatattttatataaatataggatgatctgggaagctaaattgatggaaattcaatggcatgttacaccttgagggctgccagaaataggaagtttagcgaagttgggactttctctcaggttacctgttttgcctggccaacgacatcttctgaacctcacgcattacctccctgccaactaggagaggtgaatttttttttttttttttttttttttgagactgagtctcgctgttttgcccaggctggagtgcagtggcgctatctgggctcactgcaagctccgcctcctgggttcaagtcgttctcctgcgtcagcctcccgagtagctggaactacaggcgcctgccattgcgcccggctaattttttgtatttttagtagagacggggtttcaccatgttagccaggatggtctgcatctcctgacctcgtgatccgcctgcctcggcctcccaaagtgctgggattacaggcgtgagccaccgcgcccagccgaggtgaataatttttttattctggtttctatatgacagaggagaactttgatcaccgagattagaatcccttgttaatgcttggactaatctttggtggcaaaggagtcagtgccacctaaggacaatgtttcactgttgggaggtgggtgggaggagtaggtcctgagaggagagagtgatgatcccaacagaagagaaggatgctatgtagggagttgacagattccagcactatactgtaaattccgtgagtgtgtagctatacgtgttctggtgagcatgatatccccagtacccaatatagtacctggcaaaatgataagcatgcagtgaacatatgcatgaggaagggagggagggagagggggaaggagggcagtcagcattctagtatacaggtctgagatagccaagaaaaagcaagcaaaattttcagcaggtagtcacacaaaacagaaataagaagagatcttggccgggcgcagtggctcacgcctgtaatcccagcactttgggagggtgaggcgggcggatcatgaggtcaggagatcgagaccatcctggctaacacagtgaaaccccgtctctactaaaaatacagaaaaaattagctgggggcgatggcaggtgcctgtagtcccagctactggggaggctgaggcaggagaatggcgtgaacccgagaggtggagcttgcagtgagcctggatcgcaccacttcactccagcctgggcaacagagtgagactccatctcaaaaaaaaaaaaaaaagatcttttaactctggagagttatctcagcgatcgaaaccttgattgcacttcctagatttattggattcatttaattgcgcagcccttggaagttttatcctctacctttagaggatttgagtgataaatttccttcttcccttccttcctccttccctccctccttccctccctctttccctcccttcctttcttccctgctttcttccctccttgtctccctccttacctcccttctttccttctttctttactcatgcacatattcacttcatgggctctgtcatttgtacccaaagactcctgcctaatacaggcctattgatcctccatcttcccttatattctctaactagggaatggtgctcatggtatatgtctctctgggttaatggacctcagtgaagatgaaatgaagacccttcccttcccttccctttcttccctttccttcccttccctttaccttcccttccctttaccttccttgcttcctttccttcccttcttcaaatgtgtattgagaaccagatactgtgccagccacgagaaacatctgaatcatcaaggcagcctccatctgctcagatctttttagtaggtgttttattgttgagtatgatgatgtaggagttctattcccaattcatattgttttgaagccacgtctgaattctgagtaactaggatgatgagtagactatgtctccttggagtccctgtttgaggctaggatttaggtgagcaatcctgatcccactcaggagacagcaggaccacctgagccactgacctttaaacccaggatataaaggttatcattgccctctagaaatatcaaattggtaagaaaggaaaatgctccctcatgaatgttcatcaaagagtgtttcccatcaggtgatattctgtcccttcaggccaccgtggaattcattaaagatgagaagacagtgataaaccacctcttgtgcaggaatatttatatattcctgtattcttcaagatgttacaaattccatttaataagtaaagtggttatctcaatcacaaactaccatgaggcaataatgatgatccatttgtcaaaaaccgccactcaagcactaaggagatgtgtgtaacagttggcattttaagcattgcgattgtcaaaccactgattgacagatcccttaattgtcaattcagataataataattctgctgcaaaatgttagagacagagaaagggaaaagaaagaaagagaaagagaaggaaagaaaacgaacggagggacatgagaagaaagggagggacaaagagaaggaggacttgagataaatattagacatgctttggagtttttcaatggcttactgcaaatcgtgttcaaccccacatcattgctggctggttgtctttcttatttgttgtgaagtgattgcttcaaaaaccctgacacaaatctctgtagagtgattttttgtgtggtcaagaattttgtgattttaaaaagactttcaggttcctgctgatttgggactttggctctctctacgctgatatataaatcatattacacaatattgataactccccaatctctaaataaatcgcaaacttattaggaagaatcccaaagaagaagtcaacacctttactgaagaactatttaaaaagatgtatgggtagcatctaagtgctcacgttattcttagtgaatcagaggtctccatcctacgaagcatgggagaggtcaaatcccatgtacgccagctgaaagagttaagccatttttctatttacatggtttatttcacaagggtctgactcattgggcataaccagcacagttaaatttcaaaattactatttggtcctttttttattgactacaattcaaggctgcttcaagcctcccaaatttaatcgccgtagctctttgccaagaacattatgttttattttcagtgttaaactgtgtaagatgcccctaaggctacatggaaacttactctctgtgatagcagctaacggagtgtatcagttgttcatgatttcccattctcctgtaaattgggagaggcagggagagcagtggaatgcgaattttgttctgtcagcactttcttgccccagctttagcccaagcagtgcctgttttggtaattaattatagtgtgtttgtagctcttcatgctcagttaccatttagcaacctgtcaaatcctgagctaatgagcctatcccacagaagtcattgcatttactttattttatttttaagcatcaagacaatactggtttttcgtaggtcagatgaagttgagagggagattctaaaccagcatatggaaaaggcaaggcttttctcttctactcacaaatgttcatcccaagaatggccttgcttaaagtttttcattgatgtttctctaactagaaattggagttattaaatacagttattaaaatacagttattaacgtgactgtaatttaatatttgaaggaagaaatagctcactcataagtgtccttttcaaagtgttgttggtaaacgaaggttgaatggttttgagatttatctcaaatgatgaactacactttgtagggaatgtttcagaggtcttccctctctgtgttgagagactagattaggatatctagcttaggattttcatctaaaatacaggaaaaagcagagcagattcgtgatactttcctctccttgttggttttgtgttgttctttcttctttaattgtggacttgaaggagttccacaatctcgttatgggaaggacttaggcatagcactttggtttccgggcagaggtagaacatactccttgaagctgcttttgtatcacgcttgcttgttttacttagaatcgtacggttacagctcaattaaaatagcagagttttctgagaatgatttcattctctttatgtgagactcagacgatttcatttagtttatatgagacatatcactaatctctactaaaaaatagaaacaataattttatggaattacatatcagaatatgagtgttcagctcagcctctttatggaacagtgtataccaaaaacacatctttattcttagttgaaagttttagaaaacccagaaattagagcagtggcattcgcctctgctggttagaagtataatcttcaattcaacatgcaaaactcagactcgtagctatttctgaagctcagctataactacagtatcatgtggtcagtaagttctgcatttctaaaggaagatattattttcactgtcaatcaaaggtaggtaaaaacacatgtacacattttagcttagctgaccaggtcacagggatgtgtacctgtttatgtataagtgccaggactgaggctggaaggaggaattaagttatgctcccttaataccatcagtgttgtattgtcctaaaaaaagtgtatatatatatatatatacatatatatacgtatatatatatgtatatatatacgtatatatatgtatatatatgtatatatatatgtatatatatatatacaaaaattagttcctcaatccaataagaacatgattctgactctttataaaaatgactcctcttgaatattatttgttcccatctcattcgttgataatatctattatatttttataagaaagagtcaaaaattctatgcaaaattctctgttctcctcaaacagatgacgcttttgcccatacttggctctaatatcataattgattttacttgtcagctctctgttcatcagagaacttgataagcagaagaacagttgctcactcttgttcaagtctactgccctaatgcccatggacctgcaaatttcccaaatgtgagtggtttttatgctgcctgtggaaatctgaatttagatgagccacactttgtagaaaatgcttcagagatcttcctgccgcctctctgtgtcgataacctccatggaactgtgtttgtgagatactcaataatggaaccatttaattcaaattttttaatcgactacggtatcagcaaaatgagaaatgtctttcacccttgatctttgacaatagcagacatgttaatatgaagttactgctaaggctccaaaaggcattgatacaagtatattttttctgccattcttgtttctttatagaatcacacttttgagtattcagagcttgcttttcctttgagttagaggaatgcattggagagaagtgttattgatgagggctgattaagcaaattaatgaattgagacagctgaatagtaagtgagaagaatttgaggagtggaattggtttttgctcattgactgtaaagtgtaggagttaacaccacaagggtacctgatggaacgagctataataccgaggtaagtgaagagagagcatttggaattgtgtactatttttcctcttccaatgaatagctgtgcgctagctgttcactgctttcctggcatatgtttttcttgcttcattttctgagtcatctgcaatagcggaaatgaattcattcaacaatatatattgaatgcccgttatgttccagacacaatgttaggcacttaatggtacttgtggaaatacattatttaatgtctgatgactaaatgttctcagttctgatggagtcaagtgtttttggctgggggtggtaatatttgggaagcatcttggaaagcatttgttatttcaaactcttcaaatctgcaagtcttacaaaacactacacgttggctaagacgcgggggcagcgggcgctctaccgtgctgctgatggaagagtatattgatgcacctgctttggcgctcactttagtaacatcatgggacattcaagatgcatgtagttttgagatatttcatccctaaatgcacacatgaaggagacacatagaagattcattgtggcatccaagcaaaacattaggaagacaacaatcaaccagacattaattgtccaccaatagggaaatagaagataaattgtagcaaaagtcatgtctggtgtgtcatgttaaaataaataaattagatctctgtgtgccagtgtggataaatctgaaaaccataatgttgaacaacaacaaaaagtaatttgcagcaggagacatacagtatgacatcatttatgtacagtttttggacacagtaaaatgttttcaaaaatatataaatgtattcaaaaatagatattccaaaatatacatttatatgtatttatatatgaatgtgcccaaaaatatatattctcttggggtctatgcatatatggtaaaacgagatagagctatgtgggaatgatacacagtaagttcagcagtatgcccaccactgttagggagtaggggagcggttgtaatctgcgagagtgactgacaaggattccattatatttgttatattttatgttgcaagctgcggggtggacatacggcatttgctccagcatcttccgtattttttatatgtctcatgtattgcataagaaaaaagagtgcatctgaacagctacagttaccgctgtgtctgtgtgtatttgcatgctgagttttttgagcaccacactctaaccatagtctttgcaaaagggttttatacaaaaacaaggtccctttcgagtgcattgtcttggtaagattgttaagggcagatgagtaaagagatgcagtaccctcaatctacaagacaaaagatggaccagtcaagcagttccctaatgtctttgatcaatgtaaactgctaattgcaaggcctgactctcttttccaaaaggaatgattcccctcccaaccccctccccccccgactcaattacaagaataattgcttcaactctcaatgttcctttaactgggcacgttcagtgttagcatcttaggctctcatttcatatgaaagtactaagttgttccagtaaacagcctctacattgggtctttatgttgcaatattacagacttggcatgcaacctcctctatttttcactgtgtataatgaggtcaaattcgttttggaaggcccggaagtcttcaggatttacagctatttgaaaaccctattgataataagtatttggccaaagtgtttccacgttcatacactccccctctttcctagccagcgtcccttggtttttttttttttttttttttggttttttttttggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaataagtactgacccttactctagagagttattgcacataagaaacccagagtcctaggccacctccagagattttaattctgtaggtctggagtggagactgtttgccttgtgaacaagctcacaggcgatgctgatcgtgcaggttcctggaagcacattttgaacaccaaggccccagagcaggttcaatgaaatggaggaagagagtcaaataaaaatcctttcattcggtgctatggggatgcaatggcagagttattagcaatattacagttacctaggaaaaggagcaaacagctctgccttgcccaggcaaccagcagaatggaggtgatacttaaccagcatcttgaagagtgaagagatttccaggaagaaaagagagttcatgttacaggcagaggaagtgacatgaatgaagtacaggacacaaatggaaaatgaaagtggttttgtatgaacagagctggaggtagaattggaatcatcacagatgctgtttaagaattgtctgtggctcacacctgtaatcccggcgctttgtaaggccgaggctggtggatcacctgaggtcaggagttgaagatcagcctggccaaaatggtgaaacctcgtctctactaaaaatacaaaaattagccagtcatggtggccggcacctgtaatcccagctactcaggaggttgaggcaggagaatcacttgaacccaggaggcagaggttgcagtgagctgagatcacggcactgcactccagcctgggcgacagagggagactctgtctaaaaaaaaaaaaaggaagacaggccgcagctgatttttgaaggaatttgcagagtccttctaaggtgtttggtacattattctatgatgtatggtggagaacagtggaaggatttttacagattattggtgggagagtggatgaagagaaattaataagcaggggatcaaaagtctaggtgaaaaaacaggagggcttgcctgaattactttttggaatagagaaggacatggcacaaaacattccaacctaaaggcaagaccctcaaggttggagacgaagtatcttctggatgcagactgggaaaagtgattagcagcaaatggtcaagatgaatgggtagagacaaaacgtggctcaccaggagggtggtgactcactaatcttcaagaatgtatggctaaagattcaaagctccttactaaaatttagaaaaggcccataatggaaggaactaagcaagttttgccttctgctacctctgaattcattatgttgcctgtacaagtagaacacatagcaggaactgtgttttaatactaattacaattattttctggttacatagataaatgtaaataacattaaagatgtgatctgttcctggacgccatttttatcttctttgtcagaaggagggagagagaatggcatcaaaataccaaggttctgtttttttttttccttaaaaaaaaaaaaagaaaaaaagaaatgaccggaagcacaaattggatgcctgcgctttttttttttttttttttttttttttaccaaaaccaaatacaaccttacagaggtaataaaccttgtgatacagtctcaggaggatgtgctatgaaaggagccaaatcaggtaaccagaaacaaataccaagttctttactggtattttgaatgtttattaaacagttaccaatccattgccatttgtttccttcacactttgtgctccctccttcttccttctcttgcaaaatcctcacaacttcttctgtctttatgttcctttttttttttttttgttgagattatgccttgcaaaacctctaattaacctgcctagcaaaagctgaaccttcttcagactacagggagagtagcagaaaaaataaaagtgacaaagaagaaagcgaaggagtctctttagcaggaagaaggaggggtcatttcagggaaattattttaataattcttgtcccattacataaataattcacttttttcttctatgtcactgtattcctagggttcttctcaaagcataactcttccacatttagacacgttcaaaaataagaaattagagaacacacttcattctttccttatcctatccagttatttcaagacaaacatttgaaaaacaataataatttcagactgcaataaaggaaggctatttgttttacttttgcaggcacagaaattttgtgaaatcaccaacaattcagaaaagaaatgacatcatcatgcccgaaaaagtataaatgacataatctcaaattaacacataaaaacgttaattaaaaatttagttttaaacccccctattctctccttcctcttttttttttttttttaatcatggcctaatacatcaaaacaggctggatgtgtcaacggcaggatatttgagaatcaaggatctgattcaaatgttttatttgttcttgatggaaaattccaaactggcttttaaagcctttcaataatgcatggaatcctgaagaaaaagttgcttcctagaagatgttgctctgttcaacctgtatttttaagtgtctttttcctctaatgtgggtttaaaaacaataaggagagacatatgctacttgggtattttgttgaggccatttccctttttttatctgaggtcatgtgaatggatactcatcaaaacaagaggggcgtttttggtttctctttttgctgataaatcgaaaacacaaaggtcaaaaataagccctgttcctcaatcccagtgccaatgttggagtgggtttttctttttcttttttttttttttttttttttttgagatcgaattttgctcttgtcacccaggctggagtgcagtggcgcgatcttggctcactgcaacctccgcctcctgggttcaagcaattctccacccttagcctcccaagtagctgggattacaggtgcccaccaccactcctgggtaatttttgtacttttagtagagatggggttttgccatgttggccaggctggtctcgaactcctgacctcaggtgatccacccgccttggcctcccacagtactgggattacagacgtgagccaccgtgcccgacctggagtgggttttttaagtacttataataattacttgaataatatgtgttcattgtagataacatgaaaaatgcagaaaaacacaaagaagaaaaatcatttctaattttaccagtgtttatcattagtgtgtgccatggggatatttcctttctagccccacacacccaggcaccttcttgttttttaacatttatttaacacatggttaatgacttgctactatgctgcaggaattgtatcaggtggtagaaatacaatttgtattaattgtagataatattttgtgatacattattttttaatttaataagatactatggactgagatgtattcttcatgacgtgtgatgacaacgtagtaatccctaattcctttagttaataagttcattttaccttctcattttgcctctcatttgctattttatcacctttcacaaataggtttatttgttgttattttttcctgctttatttgtaagcagtattagataacagttgcacacggagaattttcaggtacaattaacttctctcttttttgcgtgtaggcttatttcttcctgacaagtcttttgccttctaagtaacttagtgttgaaacattacatgaaaaagccacctcatttggttcttgcacagtaatgtctaaatcacataagaaatgcattgaaaaaaacaatcggggaaaaaagagggagtaatattggctagcacatctttgaatgcatctggaaagaaaagagtaaatcaggattgaaatagaagccaaaagatgatatttttatggaaaataattcccctctccttttctttccccagctctttttctatctaatatgcatttttctttatattataaaacagctttgctcaccttatctctggtagttctttattacttcagtgtcttctcatcattttttaaggttctggaaatgtaaactactttcctaccacttttcatttttgtggatagggtggctgatgggctttaagtttcaagctatgatgaaacaaggaaatagatcacttcttacagtgtaataatggaactctgttgatgggtctaataaagaagaaaaaaaatcaaaccttatccatcatctccatgacttctagtgtctttcccatctgcatcttcatgttaagcaaaaaatatataatgcaaaaagtgtgtttcacaaaggactttttttaaaaaaaaaaataaggttagggctttctttccttctattttttttttttttttttgagttggagtctcgctctgtcccccaggctggagtgcagtggtgcgatctcggctcactgcaagctccgcctccccggttcacgccattctcctgcctcagccttccgagtagctgggactacaggcgcctgccaccacgcctggctgatttttttgtatttttagtagagaaggggtttcaccgtgttagccaggatggtctcgatctcctgacctcgtgatctgcctgccttggcctcccaaactgctgggattacaggcaggagccaccgcgcccagctaaaggttagggttttctaaggttgtaacttttgcatgtgtattacttgccacacaaagcatcaagataaggaaaccagcccttatgggtccttagcttcatgacaatatctaaaggtcatactgttttaagcatacagaaaaccctctagtcagagtctgtgttagctgttctttaaaaaaaaaaaaaaaaacttccatgtcttgctattattatgagtttgtatttaaaaatttcattctaaccagcaagaacacttccagtgggaatttctgataaagcagtcaggttttagcttggagatgtactaagtgcagaagttttgtgagttttcttcttggtcttgcaaagaaaagcatgaagctatataagtctttctgtaggggaaaaaaaaatactttttttcttccttttttttcctttctgatgagcatggatggaggagagatccatccatattctggatcattattggctctgatgatggttttgtacaaggaataacctctcttggggtagtgattctttttaatgacctttataaaccagaatttttgttcatctgagaaactaatgaggattaagggaagaaagggggccgggtgtgggggctcactcatgtaattccagcactttggggggccgagacaggcggatcacttgaggtcaggagttcgagatcagcctggccaacatggcaaaacctcatctctactaaaaatacaaaaattagccaggcgtggtggtaccggcctgtaatcccagctacttgggaggctcaggcagcaggatcgcttgaacccgggaggcagaggttgcagtgagtgccgagattgcctgggtgacagagcacaagactctgtctcagaaggacaaaaagaaagggatccaacagatatttatcagttaatgtgtgaattacccatggcatcattacctttaggtttgctcagaacaagtcctgtttatcccttgatcctggtgtaattattgacatccccctttctgctgacaggtgtcccagtttcaacgatgtattatatagtcattccatactcttaaacaagagagtaatcaaatatagaagccaagcgtccagaactatggctcagacaaattggcagttgaattttgatttctgtacttgattttttctgagaagctgaaactactatacttcagttaacttatttgcgaaatataggtattatagtaatgtttttgccgtatgggtgttgagaaaattaatatgtgaaattttgatcaaagtacctgataaatagtaaatactcatttgaaattagcaaataattattcctatattttttttcattgaagtctttcagtgctacatgttacagcctccaagtcatttaatttatagaaacagaaatacttcgtggtctgcagcagtggacacaggaagtggcttataagaagatggacacagaaagtggtttgctgaagtaagaggatggtaaaacagagtggattcatctatgataagtgtctataaagggattatggatctagagaaatttctgtaagttttcttttgggttagtgttcaaattggtaaagttgccagggcgaggtaggaaagtcacattcaagccagtgtttcatatttattggtttatgatttttttttgagacagtctcactctgtcacccaggctggagtgcggtagtatgataacggctcactgcaacctctgcttcctgggttcaagcaattctcctgctttagcgtcctgagtagctgggattataggcacacaccaccacgcccagctaatttttgtatttttcctagagatagggtttcaccatgttggccaggctggtcagaacttctgatctcaggtgacccacttgctttggcctctgaaagtgctgagattataggcatgagccattgcacccggccagtatttcttaaagataggtaataaggttgcatctttttgctcctcgaaagatgggctttgccatatgacttactttgactaatgaaatatgcagggaggtgatgtgactttctcataggtggatgcttgaagtgacattttgtgagttaccacattttctagcccttgccttagagattttggatacatgaggtgagagaaaccgtctgtcagctcatgtccctgagtgactacaaaaaacaaaagttccagccaacctgtattgagcacatggtacgaatgagaaataaacttccattgctataagccactaacttcaggggctgtttattacagcagcattgtgttgcccatactggcttatgcatcttgcctcttgcttacctgtcatatcttctgctgctttgcacgctcatctcttccttcccccacttgccattatcagcaacacttgctgaccacctatatgtgcaaagtgcttggtgtcaatatgtttctcataagaaccttatcaagtaaatacttattatatcttgccactgccagatgaagaaatgggctcagagggtcactgttcacaaatcccatagttgtaggtagagaaagagtcaaacatgggtctttcaagctccaaattctgttattaaccactgtggtatctgtcttgtattaggaaggagttcccttactgtcttttgaggttttttttttttaatgtaaatgccctgagtttttcaacacatataaaagggttttatgaatcctttttgttcataaaaggagattaacattaatttctgtgcagagtaggatgaaatagagaaagaaagaacaggaaaaatataattggaatctgttttcaactctgacgtgttagaactaggatttttacccttctcaaaacaaattctaggacacacattcatgcagttggcaaagccatgtgactctagagaaccgtgttgactgattggaaatgggtaaaattctaaacagcatcagcttgatgtggaatttccaattacttaattctggttggttttgaagacacatgagctgactgcttcacgggaatcaggaatgaaggggaatctgttcagaacgtatatgtctccccgcagtaaaagcaattcaaagccataaattacttatatcatctcagcgtcttggggactgcttactaatcttaggacctataaaataagggatcaaaggtaacattttctacgttgatgctgtgagatctatgcatatctatctctcagctggccctacgagtttaaaaattgttaaactgacaatttactaatccttctttttggatgatgataataatgatgattttttgcataaggctcttggaccacctagttttcacaggatggtgatgaatgagtttagggtttggcccgaaaaccttatttcatctagaattttgcaggcagagccaagagagttagcagcctggggtggggcaatggagagagcattccctttggtcgcttgaaaaaatccgtgcctttttgtttgtcagcactactgaaattcagcactgctaggaaacagaaatctgatattccaagatgctcctattggattttcacatatctcatttgcatttggattgtttcagcaagtcttacctcacttctgatacctataaatatctaaggttttagttgacacacgtctggctagcttcacaacaaggatttaagagcttcatgatattatttgccatgaataattgctagtggaacatactggatcaccttgtataacttttgcaggctggttttaatttcaggtttgactgttacattgtagctttgcaaagcaataacaaatcataatgtagatgagcagaaacaaaacaaacgatgatgggaatattaccataaccataattttacagcacagtttaattatttggttcagtaatgttgaataattatttcaccaccaaaactcctccccaccccagcccctcaacaaactaaacaactgtttcactactagcaactaatttatgaggcaatttcagattcttatgacttcttgtcgctctgagatttacagtcactaataaaaggccctaactttgagagacttgaattaaaactcatttataaagagaataaaaaatcagactttttccatttctatccgtaagtgtccatattcctgtagacctggatgtaagtggatgaagcccactatccagtgaataacagatgctcattaaatattggaaagcaaatgaagtcataaatgcgtataaagtaggcagagtcttaggaatggacaagatgacttatctttcttcttacattctttaggatggaatttgatgaaggttcctttcttttgtttttgaataaaccaactgaagtttaattccatgtttcagaaaatcacccctgctttttttggagatggagtgttgctctgtcccccaggctggagtgcattggcatgatctcggctcactctaacctccccctcctgggttaaagtgattttcctgcatcaacttcctgagtagctgggattacaggcatgtgccatcacgcctggctaatttttgtatttttagtagacatagggtttcagtatgttggccaggctggtctcaaactcctgaggtcaaatgatctgctcacctcagcctcccaaattgctgggattacaggtgtgagccaccgtgcccggcctcaaaatcactcttgactctttcctctcccttatccctcatgcccagagatcaactccagtggtttatcccctcttaattactgactgaaactttttgcttctctccattctccttctattctcctggccaaagccactcttccctcctgcctggagtgctgtcaacacttctaaactggcctttcttcctccactcttgtccccattaatctattctccatataccagaaagagtgattttctgttacatgatcgccatcattcttgctgaaatttctactctaccttccgctgattttaggatcaagtctggaaatgttgtcagtggccctcaaagtgcagttgctgcttagcctatcgtgtcctaaatccgcatctgatggcactttgtcacaatccaggctctttgagagagggagagagtctgtgtgtgtgtgtgtgtgtgtgtgtgtgtgtgtgtgtgtgtgtgtgtgtgtttccctcggtagagtatggggatctctgaaaccctttgtatactcaatcctattgttcattatgattgtgtgtaggtatcgtttctggaaagcctctcagttacatacccttctttgtcttttcacagcataattgtaatggtacctgttatgttttaatatgatacgctttcttttccaccaaatggaaaactgtgagagcagtactacgtctgtcttagtcaccaacttgtgctcagcacctagcatggagaccagcacatagtagagatttaataattgttgtgtaaatgaataaaacacatctatccagttggataacttggggtagtttgcttctctgcagtctgtctccctctcttccttcctcccttctctctgtttctctctttttctctttctcgtagtaataatagctttactatgaccatagctctttttttaatcgatcaccttttaacactttaagaactatttctaaaaactcaacttaggaaacagctgaattagccccttgctttaggtttcaggcttccctgaattccctatgattttcttatttgaaagtctggttcctgtttatattggaaacattctttaaaaaaagataagaacgtttggaacggcaacaaaacacccaattaatgtgcaactactttgaatattcctgcagtggcaacggttaaagtagaatgattggacactgtcactgctagcaaaattataatccagggtaagctagatttagagttgtgtctcaaaacctgtgttttttgtccttcaggagttaaaagtgcaaaaaaataaaataactgagataagagttgaattgatgccttcgaacaaaatggttaaattctgtttgggtctttaaaagagttaacagaatataacaattcaaagactccatgttccataaaaattgtgctattaggaagaaagccatacttctcagtaacctccctgacacttgctctgttttacttccccggccgcagctggtcttgagtataatgccattgattttgagagatcttataaagataattagatatactgcagtgtgttctatattctcagcatttctgaggctatgcaaagccacccaaacttctgaaatatgtaccttgtatttcttacttgagaaacttttagtttctatgcattggaaaaaaaaaaaaaagctctatagcagactttcctcctgaagcgtgaagaaggaataaacgaggagtagagatttttgcctcctttttcatttatgtaaataaacgtatgaaatggatttttaatttatacattagttatcttggtcccaaagcataactcttttaacaccttgagcttccttatgttggagggggaaaaagagtgcaaaatcattagagacatgattatgctttaatttaggtctttgagttatgtaagcagaatgcaattaaagaagaagtgctcactatgactacctatttcaaataggctttcaatttttcagttttatgtgtatcttctgcaattgcataaaacttcctcaaggctatgacagtggattatggctgtgttcttgtaattattttcagcttaaaaaaaagaacaactttgctgcataaactattgagttaaacatattacacgtctagtttttactgggattgtgtaagattttacaccagccatgagattctctgcattcataggtttagaaggaaaatgtgagtatttatggcatcatgattgtcactgtcactatcatcctctcattgtcgtcatcaccatgaaaatcagatccacaagtgttatcttgcttaattattgcagcaactctgtgatctttattattgccattttccagataaggaaaccgagactttgaaacattaagtaacttgcataaagtcagacagctaggaagcatagtatctgaaataggaaaccattgctcactttggcagcacatatactaacattggaatgatacagagaagattagcgtgacccctgcacaacgatgacatgggaatttgtgaagcgtttcatatttttagtaaaagtagaaatacctgttgatccattatctaccaaaaggaaaagaagtcattatatgaaaaagacacttgcacatgcatgtttatagcagcacaattcacaatttcagaaatatggaaccagccgaaatgcccatcagtgaataagtggataaagaaactatggtgtgtgcatacacacacaaacacatgctactcagccataaaaaggaatgaaataggtcaggcaaagtggttcacacttgtaatcccagcacttcgggaggctgaggcaggtggataatctgaggtcaggagttttgagaccagcctggccaacatgatgaaactgcatctccactaaaaatacaaaattagccaggcatattggcaggtgcctgtagtcccagctacttaggaggctgaggcaggagaactgcttgaatccaggagatggaggttgcagttagtggaagatcatgccactgcactccaggctgggcgacagagcaagactccatctaaaaaaaaaaaaaaaaaaaaaaaaaaaaatgaaataatggcattcgcaacaacctggatggagtgagaggccgttattgtaagtgaagtaactcaggaatggaaaccaaacatctcatggcttatctcccacttacaatggttttccattcccgagttccttaacattgtgttaatatactaacatattctcgcttataagtgggagctaagctataaggacacaaaagcataaaaaatgacataatgtactcttgggacttgaggggaagggtgggaggtgggtgagggataaaagactacatactgattgggtgatgggtgcatcaaaatctcagaaatgacacccaatgaacttacccatgtaaggaacattacctgttcccacaaaactattgaaataataataaaagaaaaacattgttgaaaagataaaattagaaaccaagaagcttggcttcataacccatgttactaatcttaaaaatgattccaagttgggcagaaaatggggagaagttgtgagtgggagcaagtgtggtcaagaacagggcgaaaaaaatgtaaggactcaaaatgtaggttgtaatcttatcaattgactgtgttaccctaagttgcttataccatttaatcatataatgcctacagtgcttgtgcacataatcatcttctttgtattattatagtgctacggttgatgatgatgatattatcactattgtaattcaggaaatttcagtatctctgaagactcttcggttgtctaaacaatacaactcgttatggtgggggtgcgttttttagagaaacatttatattttaatctgtcctttatacacagctttgacctctcctgtccaatatgacctacttctctgaagctggtagtggtttttgaggtttcatttgcaatgtgtggcttcttcccaggactcacacaagattcgctgagagtcttcgaattttttgaatcacccttaagtgcagtatacatcaattcagtgctctggcaaagactatgaattatgtttatgtctgaagcaaggccgtggttaaggaaaatagtagatgtgttaagaccttgtttatttcagcagagaaggttagagttgatccacatctggataaaaataattttaacctaggagaagttatattttctttataccataagctccccttctctggtagcctaaatgaatcagcgccacatctgggcatggtggcccatgcctgtaacagcagcactttgggaggccatgacagcaggattatttgaggccaggagttcaagaccagtctggggaacatggtgaaacctcatctctacaaaaaaattagccagtcatggtggtccatgcgtggaatccaggctacttgaagggctgaggtgggaggatcacttgagccggggaggtggaggttgcagtgagctgcaattatgtcactgcacttcagcctgggcaacacagtggaacttgtctcaaaaaataataattccatttaaaaaaaataagcaggcatagtaacacacgtctatagtcctagcatctcggggggctgaggtaggagggtcacttgatccagaaggaaccccggagattgaggctgcagtgagccatgattgcaccattgcactccagcctgggcaacagagggtgaaggaccctctcaaaaaaaacaaagcaaagcaaaacaaaaagcatcagcaacacaatccatcttagattcctgacatccagtctttctattcttgggaattgtcctagaatcacccagttgcttcctggtcagcatattcaatggacaatgaatgacttgttgactattccaccatcaaagaaaaataatattaataccatccaacccctgaaatgagcctatgttctatgaagtaaattagctgaaacaaagtcactcttaaaaatgaagtgatatcaaaaatcaccaccttggtttttgtcactattttatcttcatcacatagcgctgtacctagcacacagtaggcatttaatatttgtttgcaaaaaattaagtcacttctataaaaattaatagtgtgagaaaccttggactttatgatgcaccatactagagtaaaagacttgtatctattttttttttctaagagtacatttctcacctagggttctatttcttaatcttggctggaaccaaagaagttgttatctgccgtctgatcaagagagaacccatagtccctgcattgtaatttgtgtgctttttcttatttatatttgcattacaagaaaacatgaaataactgtatctgctaaaactgaccgaaagatggatttcagatgtgagcaatggaagtgggattggcattcatcatagtgtaaatgcaaaagtgcttttagcccaccaagtactgggtacactattctgaccttttttcaagtttctcagtatttatggaagaataatttgtagaataatgaatatagttttccagtggagcaacaaatgcatactatatttctgctattgtttcttattaaatattcatatgtatattttgtgtttgcttcataactggccatttactggtgcttaacaagcataggcagtcccgctgaagagaaataacaccaaacaacagtaaacaaaaaagcagacgaatgaaaaaagatatcttatttctgcagccgttacatttaaaaagtgcatttaacatttttaatacagtccatatttcataaatcccacatgttgacatgtcctagagaaagatggatgggttgacttggaggtatgcttctatctagttttatgtgtgcatctggcagagctaatctttacttccctttagcagaacacaaaaatgtaattctctaataactgacataactgcatcattttccaatatggactgcattattaaatcacagagacaagcaaaaccagagtagtggggaagcttgacttctgcttgatatcagaccataaaatgcctacttactgtggccgaaaggaaaaagagcatcgactctcagtgcttggaattcggaacaacttctgaattcacagccccagagtcttgtgtgtgtgcaacaataaccgtgtctttgcatttgcatattgctttagagttcacaaagcatttttacggacaagcccatactgagaatcagagcaaggattgctattctctgtgtatagtgagaaaatagaggctcaaagaagtttccaatatagtaagaattatttctgtaggacttttaaattgtataaattgctttaacgcatgcagttacattttgcttgtgtaactaggagaataagtcatctaacagtcttcttcctatccccaaaatacccattcaaagagaatagggaaaggattgcttccagactaagaacttaggatcttgcgaatggtagttgcaaaacatacacagagtcttggattagcaaaaagtaggggataagggtttcagagagccgagtcattgtgcttaagcatataggaggaatttaaggatgttgttgcctctaagagggatggagctgaaagacacacaagggtaggacagatagaagagagaatggctgagatatatggtggcgtgtatgcaaggacttctaagagaagtgatagctaatgtttgtgttgctacaatgtaaatacttccacttccccaagcaatatattgtatggtcaccatgcaggctcatcaacaaagattccgtttcttccctgctgagcactgcttgaagttcttgtgatttgagtgaggccatgagagcagttctggctaatgaactataaatgaaagtgacaggtgctggaacattttattgctgatgcaagagtttctagaaatttcttatctctctgatatggtggctagaaatatttcagatgatggattttccttcatccaagattgctgagagtctttgagaagcaacaccaccctgtctcttaccaccaaatccatgatggacatgtgatatgagcaagaaataaacttttgttattcctggaccttttagattttggagtcatttgttgccacagcatcacatggcgcatcctgactgacacatgcagtgtcctcatgtgaacattttgtttgtgtgttgtcaaggaaagtcactgtggttcgtgttagcgtcagtttaattcaaaggtaactcaacagcaagaaacagaaagtaacagaaattcagcaagggcaagaaatggaaacctgatatatcccatgagagtttaaggaccctgacaatctgcagaaattttaaaaagtgctttgggcttttcacaaagtatagaaaggggttttggaaaaacctatttgaagttttaaggatcagagagaaattaacagctaatctttgatagttctcccagtaccatcttcaagttaaagaaaagggtaggattttttttcccctatgttaggggaggaaattaaaactgagataaataaaatgacttgtataaggtcatgcaaatgctaataagcaaagcccagattactaaaccatttgaccacacgtgtagtagtgtttcagcccactcttttaagaagttttcagaaagccaatgagctaatagcttgaatatattacagtttgaccttcatttcagcaggacagacaaatcattgacaaaacggctgcaagaatatcagcccttttaataagttgtccagtaatatgatatttttatgattattcaatgaattgatttttatggaattggctttcagtgaatttatttatcagccagttttctgaagggcagcccaacactatatgccataaattttctttgctataattaacttcagacactctgtctcctatctttcctaatttcatctctctctctgccctgtttatatttattggatgctctggtatgtaattattagaattttccctttactttaaaaactgttctttcatctttgtgtgtatcattgattgatgaccccatcatgaccttaattgcaatttacaaacttacttgctacaaagttaggttaatgagattattcactatacaggtagattcaacataagtttccattatcatttttaaagccagtatcatccactaaacatcaatatgtcatgcgatgttttaggagcttcaagtaaggtccagttgtgttatttcagttaactatgttgtacgtctctgtttaattgtaatattcttttctgtggaagtaaattctacctctggatcctacttaacagtgttcctggctgttactaacccttcctctgatttgacattggaatggaagcatttttgatgttctatttatgatgttaaatttacaaagaggtttgagacattttgaattatctcataaatgtgcaatcttgcctcacagttaaatctgatcatttcttttaaaatattatttaaattttcattgcatcatttcttctatctgttcagtggcatttctacttctttatttgttaatcttctgaaatagtcttaatctttcatacttgaagcgcctctgtttcctccatccatgcaagtaaattttcctccagattcaactcctttctccttagggatgttcctgagagtcccctgacctttcgagttacttcttgtcagtggctggtgttagatgcacagttctctaatcatgggatattccacctcaatctgtgtactcctttaaggtataaaagagcaaaattttccaccggggggtagcaacatgacaagaagggaaagagcagagttaaccttggggaaaaaaatgagacataaggttggctgggtagacgaggcagccagagagacagcctctgttgttcctgaccactgccttggtttttagtattatactttccacttcagtcactgcaacccaccgccctgttgcaggaatgaacatgtgacccaggtgcagccaatcagggtttgctcttcccctgtgttggtcattggtccaaggtggacaaatgatgcaaaagctgggccaggtagagagatttcctggaaccttgctagtcaggttagacagcttcagacacgtgaactcggagaaggccagaatctgtttttctttctggactgtctgaaatgtgaactggaagaggcagggtggggaaaaaatcaacccaaataaaattagcagtaaagaaatctagataaaaagagcactgagctgtatgatgttccagagtcagtttgacttcttggacgatgattattttatgattgtatttgattgcgttgtattaaaattattgttatatttttattacagtatttcttatattattgaaagaataaatcaatatataaatgtgttggaattgctggacagcaaactatatacattttatgtggttgacagaaataagctacttgaagctgttgagcttgagcagagtgacaaaaagatgtaaatgctacattaggagattcaatctaataacagtttttcaagatgaatacacagtgagagcctaggcagggctgaaaaatacgtggcccataccctccaccttcccctcctatgcctgtggcagacattgctaatcaatcatggcacttttacccactgagtctgagctggtcttaccatgcttctcagtgaagcgctccaggcagtgactatagatgatcagagctggcacacaaaatgaaacccatttgctctcccaagctcacaggcaaggagaatagccaggagtctgagcatgaattagatataaggttcccaagattggacctaggtggggagagagcaaaggaaggggtaaaacctatcgttgacaatattagtttgcttggactgccataacacagtgccacaggttgggtggctaaaacaacaaacagttactctcacagttctgcagactagaagtccagaatgaaggtgttggcaagattggttccttctgagggctgtgagcaaagggtctgctgcaggcctatccgtggcttgtagagggtcagctacatagagagcctgtgtatctttacatcatcttccgtctatgcatgtctgtgtccaaacatgcatactcctcttcctgtaaacactccagtcatactggcttacagcccactctgaggacctgactttaacttgattccctctgcaaatattccatcttcaaataaagtcacattcttagatgttggcagttaagacttcaacgtcttaacgttgaatttgcggggacaatttaacacatcacactgggtgcctaccatgagccaggcatgagcttatataccattatccactggagcctcaatgcaacctacatactgggtacttttattctccctattttacagagcaggaaactgaggctgaaaaatcttaagaactgtagtaaaagtttcacagctggagttgctgtatagcaggatttagatgtaggctcctgctggctaattgacatagtgtaaaaagaagggaacttggttatgggttagacataaaggagaaatttttttaaaaaaactaaaatcaccaaagactctagacttcatttctggaaaaatggtgatgtcagtcttcctgcttaatatttcagtggccccctattccctgcaggttaagatgtaaattatttagcaggaaagtcaaggctgctgatggtcttagatgcctcattaattctgtctctagcttctctcttcctggcccctttggtccagcaacactgggcaatttatttgcagtctccaccttagagagatggagagggagaaggcttggagagaacagaggatgatggggaggaacaacctgtgcactgggtctcatccttgttgtttgcaattctggctacttttagcagtgagcagtataattacagtttagtcacctaacctctctgattctctctcttcccagcctggccaacatgatgaaaccccatcttcactaaaaatacaaaattatctgggcatggtggtacgtgcttgtaatcccagctactccggagggtgaggcaggagaatcacctgaacttaggaggcagggaggttgcagtgagctgagatcgcaccactgcactgcagcctcggtggcagagttaaactctgaaaataaataaatataaataaataaataagatcatgtttgcagagtcctcagtgcagtgtctagcacttggcaggtacccattggctgtatggataacaaccattcagtttgggatatttggagtctgacataaccaacggcaaccaaagagacgagttccttaccaagccagaaacgcaagaccaggatgcaagtggcattcctggggggtatcaattctctgtttctttgccccttttcagaggctttatgttcacccccaggagtgaacaaccatcttcctgctctgttcctattttccattatacttaccaggagttatgaattgaatcaggatgtcttaggcggcttcccctcctgctttagcaatcaataaattgccatttctaaaggtgagattgtgaattgttaagtccaatctgcagatattctagataacccatatgtctcctgacattgctgtattcatagatggcttctcaaaccattattaatgatgtaattagtatgaatggctacagtatatatcaagcagatcattaaggcagaggtggggaggtagccatttatattaaagatacgtttaatgttctgaacctaagcaatagaaagaaagtacttagcttagaaatctcgctttgctacactatgggttttcttttttaaagttgtcctagaccttctttttgcttgcttaatgctactttttgttggagcccctgggaatttgaatgagttaataaggcagatctgtttgtaaaagagtataatcaagtaaatcacagcctttaaaatcacagatttcaaaatccaatcaacttaattaatgtgttggttcatagacattgtacaagattttatttgattgcactagccgctttctcttagacacccatctgcaagaatatttacttataacttgttgtgtaaagggatcttcctaaacggcacactgccatatgtaactgctcagcttacctttaagagaaaatattgaagtaacaccctcaagctgttctactctgtgttcagaacttttcaaagctagatttctatctttgtagtaagtattgaaaccttgcctcccacatccaggctgttcaaatatgagataaaatagtttctaagaatgatagagtccaaaagttttctacagttcttatagatgttgtgagctgaaaatacatgggttagtgaagaggtttttttttttcttttctctattattatctcttttttccccctaggaattaatgtcctttgtagtagccaaaatgttaaatgtttttaataaaagctgagacttaagttagaggggaacatctttaccccaggtacaaatgacgttgctacttgccacggtccaaagcgcagaggagatggggagattgtgaaaactggggagtcacacacaaggagggggtgttttttgttcttctgacaaactgatcctgttaagcatccactgcagagcggtggctgctgtgttatgcaagcacctgcgatgcgctgcagaagaagagaggcatctgatgctcgaccgagcagagctactgcagacagaagctgcttccgaggccccttctgctcacagggcatgcttcctggctcatgtgcagtcagccatgctgcagaggccagggacccagggagcgtggcaataagtatgtgtccagctttccaaactctgggtactgtgaagcaactgcagctctgagccttgcttaaccagggctggggacctggcagcttcttccaaagtcacttgacaacagttgctctgccctcagtcaatgcaagcaaccacttgtctacaaaaggagtgaggacagtaaagtctctgccttcaaggatcgtactgtattcttattattagtggctacaaactgttaagtacctaccatttgcaaggaactgtgttgatgacatgttacatgtacatcatctgttacattatcataagacctcaaatatgttttattacccccattttgaagagattaaaaaacaaaaaaaactaaattggccaggtgtggtggctcacacctgtaatcccagcactaggggaggctgaggtggtggatcacttgaggccaggggttccagaccagcttgggcaacatgacgaaaccccatctgtactaaaaatacaaaaattagctaggtgtgatggcacatacctgcagtcccagctacttgggaggctgaggcaggagaatctcttgaactcaggaggtggaggtggcagtcagcccagagtgctccactgcactccagcctgcatggcagagcaaggctctctttcaaacaaacaaacaaaacaaaaaaaccctgcaaatattaagtgttaaatcgtaaaactgagaccgcaacccagatctatcttattctaaagctttggttgttttcatttcaataattactgtcatgttttagaaaagcagcaaaacgtttatttaatatgaaatctcctgcagaaactgatacagagacagatcaaaccaggactgctctgactgaaacggaaggaggaaagtctcaagctctgactggaccgcctcctccttccctaattcccaggtagtaattcccaatgactgagccatcacttcagaaaactagaactgtggtttttcagatgtggtctccagtccagcagcgtcagcatcacctggaaacttgctacagacgcgtgttctctatcctcgctgcaggcaaactgagtcagaagctctagggtttgggtgtctctgatttaaacaagccttcggggggttgccgaagcatgctcatgagtcaaaaccaagaatttacaaaacccattttaataacagctgagttctatagtacctttcagtattcgtaacagtgattcctggagactttcttgacaaagtccaggatggtgcattaaatctacttctgcattttatttttttattttttttattttttttgaaatggagtcttgctctgtcatccaggctggagtgtaatggcacagtctcggctcactgccacctctgcctcctgagttcaagtgattatcctgccttagcctccctagtagctgggattacaggcccctgccaccacactcagctaatttttctatctttagtagagactgggtttcaccaggttggacaggctggtctcgaactcatgcctcaggtgattcacctgccttggcctcccaaaatgctgggattacgggcatgaatcactgcacccggccttagtcatgcaatttttattttagagaaattctagaaatggatactgtttactcaatgcagcattggagaatgaacgttgactttattaacccaataataaaataaaatgatttctcttgatttgtttgctgtcaagaatcacaaaccacatggacttgagaaaagtgaaagttattaacgagatttcatgcatcaaggatactgttgactgtccagtgaaagtattttttttttcttttttttttttttgagacggagtctcgctctgtcaccaggctggagtgcagtgacgtgatctcggctcactgcatcctccgcccccagggttcaagtgactctcctgcctcagcctcctgagtagctgggattacaggcgtgtgctaccacgcttagctaatttttgtatttttagtagagacgaggtctcaccatgttggccaggatagtctcgatctcttgacctcacgtgatctgcccacctcgacctcccaaagtgctgggattactggcgtgagtcactgcgcccggcccagtgaagcaccttacgtgtgtgtcaccattgagaagaaaggttaccaaataaattttgtcccgctattgattgcaaaggcattccaatttccaagatatgaaaatgtaggcccagcgcggtggctcacacctgtaatcccagcactttgagaggccaaggcaggtagatcacctgagttcaggagtttgagactagcctggtctacatggtgaaaccatgtctctactaaaaatagaaaaaaattagctgggcgtggtggtgctcacctgtaatcctagctgctcaggaggctgaggcacaagaatcgcttgaacccagcaggcagaggttgcactaaactgagatcgcaccaccgcactccagcgtgggcaagcaagtgagactctatctgaaaaaaacaaaaacaaaacaaaacaaaacaaaaaaaaaaccagaaaaaaaaagaatgaaaatgtgaagaaacgtttgctttagaatcagtgaaatatggcaaaaataaaagagatgcttccgaaattttgttgcattaggtcacttagccaatgaggtcaggtgtctgtggaagcaaaaccgtgtctttgtaatcaatttaaaataacacaaaatgaaaaaaaatgctcttgttcatgataattttttccactttctggtttgattatcttccatatactggtgagtctccatacttggttgtattgtccaagttggattttccctgcagcttcaaaatcatcatgtccctcaccaaactcatgaagttcctttacattgttattgttgactctgctgttcttcttgttattgttggtatactctttagcacttcttcctcctctatctctaattctagtacttggaaggagactatagagtagtgattacctgtattttgagaactgtgttatctgcgaagatgtttcaaagtgtggtggggttataaagggctttgatggtgggacaggatggcattgagtaaagtaagttgagaagttgacagttctccctggccttatgggttcattgtgatttcaagaagccgaaaggatatggttgtatcatctgtgggctccatgaaaactaatgatcattttctaaacttcgcatcatgttttctggctttttctatccctggaatcattaatcatgtatattaggtgatttccctatatctgtttatagacacaaaaacacatatacttttttttttcctttcgaattctgccatatcaccatagaggtcttcaggaagttagtaaccctagttttagaagggtttggttgtttttgctgtctttccatagtcatttttttttttttgaggcagagtctcactctgtcacccaggttggagtgccctggtgcaatcttggcttactgcaacctctgcctcccaggttcaagtgattctccagcctcagcctcctgagtagctgggtttacaggcactcgtcaccacacctggctaatttttatatttttagtagaggtggggtttgccatgttggccaggctggtctcgaactccagacttcaagtgatccacccgtcatggcctcccaaagtgctgggattataggtgtgagccaccacgcctgtcccatcctcatcatttttattactgcatcttattctgtttggggtttttgtttgggtgattgatttgaggtgtttgcttgtgtgtctgatttggggaagacgttcccaggtaattagtgtaaaatttttaataagcctcataagctttacaattatttccctggaggacaggttttatttaggatttaagaacagtaggcagtagttgtgacattttgaacattttatttctttacccaaaaaataactaacttttgtaaaaccaatgaaaagaaatgaaaagaaaatgaaggaccacaatgctttatgggtttgtgtttctgacagcttaagtcctgctcttgaaagtagttacacagttggcaatatacaatgaatcactgaagctgtttgaaaactttttcgtttttttgtgaaaatccaaacttggaggagaaagagcttactgatgtcaacacttagaaagcagtgttctctttatatagtcacttactgtcttgggtttcattttcggttcagggggaaattaaattcccttgcaattgcactctctgtctaccgagaaattttatctccacattgtttttacttgctgtttgtcctctgggtaaaatattgtgtccgtagggttagaagtgcattttagaggtcttttggttcatcaggctgttccttgcaggtcagtatttatactatttctgacccagatgtctcctgtattctaagatcctagtaaaaaagctgggggaagggagaccattgtaagtacacagcagccttactttgtgagctcatgccttagttaaaagattaaccgaagaattttatttcaccctattgtgttaccaaacattagatcttattgcttctaactatatttttatgtcctttattcatccctctttatcccctcctccccaaaaaagaattattttagcatctgaattcattctcctgccaagcagatagaaacctttaatcacttacttactgtaggtatgggcagacacagcttttctgtttcttaagcctgtccttccacttagattgcaaataagtcttcagggaattgcatgtgttctcaaatttgattgtattttttcccttatagacacgggttggttagagggatatcacagtggacaagaattccaaaaaacctggcttcaaatctccaatctattactgtaacattcagtagatcccattgttactgaaaatactgagttcattgtgagccacccctgtctttgagcctttccatgaaagtgagtcttctcccaccccattcttgcccccgttagccccatggcttgctttgaccagtgaactgtgagcataggtgatggatgtcactttcaagtggaaaatttacgagtatgcatgtgcctcattttgctctcttttccctctgcagtaaggccagtgatatcttacatatgacggctctgtcaacttggatttccagaaaaaggagaacgtggaacagataactttgagaaatgggcttttagcaagtgggaaaataggcatgtattttgagctgtgtgttgggttcttcgtgactgcagtgttactcaccctgtcttgaatgatgatggttagtatttgcaacatatacatgtcgaattcccgactagtttgtggaggaagggaagagtgccaatccatatccgtaagcccatcctcaatccaccagcttccaccatgtagtccagcacctaatggttgtttaataaattcttgaagagctatattgaaattggtttgtgtaatcttggaatagacccttcagtggtaaaaaccagcatttttccaaaggttgggtgagattttaggagttctataagtttcttttaggtggttcacagacacagcaggaaacaagattgaatcatagggtggagaaagttttcctttttgagttttcttttaacacattgtatagcattcaaaacaaaatttctcatagccacgtatttcagtggttacctgtgataactagaattccaggagaccaatgtgtttatatttgtacagttgcttaccatttatggttaataatagtagtgtcccacttatactagaagttgattttatagattttcttttaaagtaaaatgtgtttagcacaaagagtacaataaaggaaaataaataatataggtggtaaggtgaaaatgtgaaagcctaaaggtatggtatatgattgaagttgggagaaacactgctgtaagccttttggtaccctaaaatattgttatgaaaacctaaggagggtgggcatggtagctcatgcctgtaatcctggcactttgggaggccgaggcaggtggattgcttgaggtcaggagttcaagaccagcctggcctacaaggtgaaaccccgtctctactaaaaatacgaaaattagctgggcgtggtggtgggcacctgtagtcccagccacttggaaggctgaggctggaggatcacttaaacccagatggcagagatttcggtgaactgagatagcaccatggcactccagcctgggcaacagagcgagactccatctcaaaacaaacaaacaaaaccaaacccaaagaatgtttgaatgggttgtgaggatggtaaagtgatagatttaaggaatcattgctttggttatcgtttattgtgttggtgtttgtaacagtctttccttcctatctagggatttatctccatcttgtctgtccccagtttcctgggatttccgtatgaatagcatattccaagtggagaagaaggagagtgcctaaattcactgtcaccttctgatttaagcttttttaacctacgtacccactctctgttctgtgtgaaaagtaactggaaccatttgtgtaggtgaaaatagcacttagcagactcagtagaactctaaataaaagggatgaagtcaggggtatgaagtgagcatgaagtgagaaacttgaacagactcttgcttgcttgtgactgtaagtgttccctagaattcgtgtggagtcacctggttctttgtgtctcagacccttcaacactgtgaacgttttgaggacaggagttacgtctgattccccttcatgttccccgtcccttcacaattgtttgttgacaccaggcgttcttccaatatccatccattcattcattagtgactttcagttaaagcctactcatgtcttccattacaggtgccaatgcatccatttttattatcagtagtggctacaataatatttgtagcagctacaaattatagaatatgaatcatgaatcctgctagcactttataagaacaactgcttgaagcaacttagcaaggtggcagtattatctctaaagaggaaaatgaaacttagagtagttaatctacttgcccatcgatataagatacagacactaaatttgggtctacccagttctgaaaacccagaaacccgtttgccttttctacctaatagtaccttgttgatgaagacacatacacacacacactagagagagagagagagagaggagaggagaggggaagatatatcagctacataaacttcccagtcctgccttatttattagtctgtgatggttagttttttccagtgctccaggcatagcattcctcagcaccattgttccaaatcactgaagctggcagcattcctttccttgcttaatctctgcaagtttcaacaaattgttaatgtaatgttttccttgaacatacttaacatttacttttattcatctgaacgtggaacgcagcactccatgaaggtgcaatctgtcttcaatccaatgtctcatcaaattcctgctgcccaaaatagagcaaaggttgagccagcctaatgtagggttggcatatgataccattatagctacttagtggacagcaaggccagcactgcttttaaaacaatccctgctcattcttttcttccctttctttccagcaagtcggttttctgagaaggagctgtggctggttgtattaacatttgcattttgatcctgcttactgatgcactgcaaaaaagaatcttctgtgttgcctacttagaattttctgttgtagtcgtgtgaagttgccaggtggatgacatagatcccatttcttagtttcctttacagcacgttgactcttacccaagtccccaaaccccctggttggtgattgcagaccctctttgcaccccttcccttggcgattttatgcaaagttaatgccctttggccaagcagaacttccccagagctccttcaattcttcacatttttgacagtaacactttgtaacgaatgtattttagacaagactcttcgaccgtaaagtactggatctctctaaaaataactcatttgaaaagggggttattttaaggagactcagaaaatatcttaaaatatccaaagtctgagaccaggcatggtggctcacacctataattccagcactttaggaggccgaagtgggtggatcccttgaggtcagacgtttgagaccagcctggccaacacggtgaaaccctgattctactaaaaatacaaaaattagctgcgcatggtggcacacacctgtaatctctgctactcaggagcctgaggcagaaggatcacttgaacctgggaaatggaagttgcagtaaggcaagattgcaccactgtactccagcctgggcaacagagcagggctgtctcgaaacaaacaaacaaaaaagcctgagagtgaagtacagtgctatttgtaggggtttgttaggaagcagaagtatcagaaatgcatattctcaaagcctccctgtctccctctctctctctctctctctctctctctctctctctctctctctctctctctattctgcttcagggtgttctgtgcccccctcccctgtctgatttctgtctctgctcatttctcaccactcactctcagtctttgctcctcagctattcttgcgtgtgtggcgctggctcctgctctgcttttgccttgatctagttttacttttaattgcaaaaactacaattacttttcattgcaaacactgcagttacctttgcaccaaccgaatacatgatctttctcttcagaacttgtaaaagactgcccacctcacctgaccctcctagattccattcacaggagctcactgtctgcagaatgaattgccattgaaacagctctttcacctcattttgcaggcagtggagtgagtttacaggaaatggacaagctcacagggaagcagagactgtggagggaacacagcttctcccagaagaacaccgtgggaagtttggtttcttgtcttagattactgggagtcgggaaagaaagcccctagagatcaaactcatataggtcatctaaaaatacacgatcaagtcacaaaagcacaagataaaaagaaggctttctttatccctgtaccatgcctttacagaaactacctcattcatcaaaagatctttcttttaaacctgaactctagtagctgtgcgatagagaggtcccttgtcagtatcaacagctggggctctatgctgagctcagaaagtggagttctgaatcaaaccaagtccatgagccccaaagtaaatttagaccacaaagaatctcctctccagtttttatataaggagaaaaggagaacaaaagccctgttcctccaatagagcattggccagagaagcccagaactgtactttatcaatgtggaaactaaaatatcttttcagtgtaatttgtgatgaattttcatttgcatttatcatgaagaccaaaacacatgtatcatctggtgagaagtattctttcaaggtatctaaaacttataatcactaataaaaatatgcttaatacttcagggccaatggaatgaattgtatggggaatagtttaggttgtctgatagggtcagctgtcacacatagagggagcaagctgacctggagaatgaacatagagagaacatgataattaaccaagtgctatgatgtcttctaatatcccaaagacagtgctatgatgtcttctaatatcccaaagacagctctttatatgggttttcttcctttgcataatactggatcaatagatagatactggatcgattgatagatagacgaacagatacaaacatacatagattatggacagagatagaatgatctataattgctacctatctcttgtctgtctgtctgtcctttttattcaaagtaagcttcacttccatcacttctgcattttctgtcacagatggcattggtcattggtcatttcagcacagtttcataatatgtctctatttccaaggggtggtctgttgtgcgtttgaaatcccccagatagctctgtgttctgtgtgactttgacagtcagtctcatggatgggtgaaatgaagttttctcttttgttccattcagcccaagtggcagcacttctctaattctgtgagaatgccttcccgaatttgtgcctttattatcttttggttggactcctgggaatctgtctcatgtttctgttcacacctgctctccatcccaactagaggtactcccaaagtgtacccccaaaacaagaagtatttctgaaaacacttgccccatttggggttctcagtgcaatttcgtgacagttttaaactgacactttctctcactttataacagcaggctagagaaaaataagaaactgatagcctcgacctcactaaaacattcatgaattaaaattttgtaaaaaggttaccaacagattgtatcagtttagttcatttttttctattatcttaaaaagccattttccctgtgtttgtaattgtattttatcattttaggtagtagtccagaataagacatgttgggtttaattctctgccacagttctcaaatggatgtttcataagtagcatgtggctttctcagctaaaattaaatgtctcactgtctccaaatgttttctatctagaatttgcaacatacacccttccagaactaacagagactctgaaaattaccactaaacaacgtcagtctagttcatccttcttaccagcttcaaatgctggctgtagataaatacatctttaataaataatctaatgacttaaagaaataaagtctggtcctcttttccatagaagttcagttcagagaagcaccaaatcaaaaaagatgatctatattaacaaaatcctctagttttgtgatgttctaggaattaaagaacaagtccaaacctcagagaccaaatgtatatcccaaatgtatatccccagtggttcctgattcccagaatcccctggatagctctaaaaaatatataaaactggttccattcatgatgatttactaaatatggaatggaactaagcagataggagaactaactggtttaccctcttcgtctgcctcagccactagttgttagtaatatatgtgtgtgtgtgtgtgtgtgtgtgtgtgtgtatatatatatatatatatatatatatatatatatatatttattcccctattggataacaagctgtcgattcctctcatgacctctacaaggcagctgcacatgattgatgagaggaaggatctatgttcagaaaatttttttaaaggaggaagtggaggagaagaaaaaaatggagagtcatagatccttgacaatgccaatgttttgtggaaaggaggcaaaagtacctgatggaagaaataaaggaagagtaaaggatactcatgtgattgcacaaaagtggactacatctcaacagtgaggaatgagccctaagacaggttgaaatcccagctctgccacttcccgaatgtgagacttgagcaatttgtttaaacctcttgggatcagtgttaccatgtgtaaaatgaagatcatcatagtactcatcctcttatgtcatctttttgtaaaatgtttttttaattatggtgggtacatagtaggtatatatatatatttgtggggtaccaaagatgttttgatacaggcatgctgtgtgaaataatcaaatcatgaagaatgggatatccattgggttgggaggccgaggtgggcagatcatctgagcttaggagtttgggaccaacctggccaacatggtgaaaccccatctctattaaaactacaaatattagctggcattggtggtgggtgtctgtaatcccagctactcaggaggctgaggcaggagaatcacttgaacctggcaggcgaaggttgtagtgagcagagatcatgccactgcactgtgcagtttgagactgtctcaaaacaaaacataaaacagtttatcctttttggtactaacaatccaagtacactcttttagttatttttaaatataaaattactactgagtatagtaatcaaataatatgtatgtctttttctttctttttttctttaaactcatcaaccatccctactttcccctctttcagccctggtaactatccttctactgtctatgtacatgagttcaattgttttgacttttagatcccactaataagtgagaatatatgatgtctgtttttctgtgcctgggtaatttcagttaacataataatctccagttccatctttgtcattgcaaatgagaggatctcatcctctgctatgtaatctgcggacggtatttcaaacgcacttagaacagtgcttgggcatcatcaacgccatataagtgctgctgtggtcattgtgttagaaaagtgcccggtaaattatgctctatgaatgcgaggtctgtggattgctcccaagagcgtgaagacccacaaatgtacatgagaggtgggagcatttgagatcatagatgagtttataggatagaaagaagattgcaggtaatataaaaatcagtggaagagtggtgagaaatgattagggaatttaggtgacatttttaaaaaaaatgcatttggtgaaagaaagcaaagaaactctgccacaactcagaatgcagctgacaggccgtctaaggaaatgtcgtggctaacagcagcaggggacgcacctgtgcagagctccctgtgcccagacctgagctctccacaccttcctgaatgctggcagcacctgaggaagggagcaatggatggggctatttatatttggcacataagaaaaccattgctgacaaataacttgcccaagctgacacagcggctgtagagtagagatttaaacacaggttgttttccagaaccctacttcataacttctaagatagagtagaaaatatttgcattccccgtctttactaaaaatacaaaaattagcttgtaagcccagctactcaggaggctgaggagggagaatcgcttgaacccaggaggcagaggttgcagtgagccgaggtcgtgccattgcactccagccggggtgacagagcgagactccgtcacacacacacaaaaggaaacatttgcattgactggggcatgtcctgacacagattaaaacgtgatgtggcttcccactgtatttaagaaaatggtcaagtccagaagtccaggttgggtgcagtggctcacgcctgtaatcccaacactttgggagtccaaggcgggcggatcacttgaggtcaggagtttgaccagtctggccaacatggtgaaaccccatctctattaaaacaaaaaaaaattagctgggcttggtggcacgtgtctgtaatcacagccagttgggagcctgaggcaggacagttgcttgaacccgggaggcagaggttgcagtgtgctgagatcatgctgttacactccagccttggatgacagagcgagattccgtctcaaaaaataaaaaaaggctaagtccttaacatggattacagagccctgcagtttctgagcttatcatccatctgtcccttcataccctatatccccaattccctggagctctttctgtgtctcagacacgagctaccctctgtgtctcaccaggtcggatccctgtgttataggtaacttaaggtctgtaactctgctaaactacaggctccacatggacaagagaccaggtcaggtttttccttttcctcggtgtttatataatgcctgatacttggcagttatttcaaagaaatgaggtgaaccgagtaaattccacaccatattcaggaccaatctctattttgccaaatcatgcatcataattgaggtcgtagccaacggcattaagaatgcttacagtccattgtggagtttgcacccatggccgcccctttggcatcaagctctgactccagctgtgatcacctgccatcctcaagctgccatctgacccctgcccctccacgacctctcagagcatagcttccccttggatggaggggggtgaggagagcagtcagaggtgaaggctaaagaatgtggagggtattgagtgcaccccagcccctgacatttcagcttgttatgtggctgtggtagtaagcatttggaatcagctctatcaattatttaagtctcataattcagtccatagtaaagatttattgcaacaaactgaaaaacaaagtacagacgcaaaggaaacagaacatggattctgctgtgttacacggtacataaacttctcatgtccgtgggagtaacataaaaggaagtaggttatttttaaaatactggagtgtttctgaaagagataattcagctctgagtttctgtgtgtgtacatgtgtatatacgtgtgtatgtgtctataatatatgtgtgtatgtgtatgatacatgtgtatgtgtccatatatataatacgtgtatgcacatgcatctgtgtgtatgcatgtgcgtgtctgtataacgtgcatgtgtataatacatgtgtgtatgtgtgtgcatgtgtatgtgtaatatattacacacatgtacacgtgtataatacgtgtgtgcatctcgtatgtgtttgtgcatatgtgtatatgtgtgtatgtgtgtatatgtgtataatacattgtgtatgtgtatgatgtgtgtatgtgtgcatatatataatgcgtgtatgcatgcgcgtctctgtgtgtgtgtataatgtgtgtatgcatgtgtatgtataatacatgtattacacacatgtacacgtgtataatgtgtgtacatctgtgtatacgtgtttatgcatatgtgtatatgtgtgtatggacacacgtgtatgtaacatgtgtatgtgtgtgtataatatgtgtgtgagtgcatatgtgtgtatatgtgtgtgtatgtgtggatgcgtgtccatgtgtatgtttgcgtgcatgtgtgtataacgtgtgcatgtatgtgtgtataatacatatgtgtatgcatgtgtatgtttcagggtttccttgcattccattttctatttagcatcaggcattttcttcttccctaggcattaaggccctcttggctcaaaattttcatgaagcatggatacattacaatttttacatttttagttggttgtttacggccattggttggtctgtcaagagcaccgagtcatctgcttactataccatcttgagtggaaaggaatgagtttatatttagagacacctggatgtagattacaactccatctctcaccatctgtgagattttgagcacagctccagaatgctgtcagccttagttttctcatctttgaaatgggaagaataaacgtccatacctcctcaagcaagtgtcaattggaattatctctacagattttctcgcccatggaggcttcatgcatgatggtttcatcttgtgctgtccctcaacatttacatgaatgaagtacatcatacttacatatttgaagtatggacaccttttcattgcaagaggaaagcaaaagcaggcaggagcatttcgttagtaaataatagtagggccatgtccaggtgtgaagttaacaatgagagagatttttttgcccatgttctgaccataaccatttgaactatgtttagtcttaatagctgggtggccttggacaaggttaatttgcctttctgtgcttctgtttccttatttataacaggaggatgctcatagcatcaacttctagggttgtcgggaggattaaatgagttaatactcataaaatgcttagaacagttcctggcacatgaaacaaaggtttatttgagtttttctttagttattgctggtggtggtggtggtggtattgttcatgttcttatgctgagcctgtgtggtgaattggaatgtatctgtgaataattcacttgctatttaagcacgttcaaacatcccatcataatattcaaagtcaatatgtgtatttctctgtagttcatccacgaatatcctgttccaagttgccatcatctccccctggagctaccacaaaatcctttagggatccttctgtaacctctatccatgctcccatcaaggaaaaagattttgaaacatctaatcatgctaccactatctgctctcccacttaaaactgtttattgatttcccgttgctcttaggatgaaagcaaacacgattgcatggccttggatggtctggccctgcccttctctcaacactcatctgcttctccccttactcattatttcagagcctttttagtcttttccagttttagcaatgtgctgagtgtcacagcagatgctattccctctgcctggaattctacccttcttgacctcgtcccaccaacatcactattcattcttctggtctcagaatctgtattgctttctccatgatgccgttcctatctttcgtctaaactgggatcttctgtctacgtgtaagaccctctcctcttccttcacagcacacaatgccattcctaatattccacttaacatgttatggttgttgagtgtttgtctttgtgtgagctccatgaatgcagggagctacatatgtcttgtgaactgctagatccccagcattttgcacatggtaaatgctaatgaaaacatttgtagaaggtgtgaatgccatttaagatgttcccataacgttcattagaactagaaagacttcctgatatccctcccattcaccgacattatgtataccgggtgctgtgttcacagcttggccactggatacttctcagttgtgcctctcaccctgtattgtaaatttcctatcgacaggctttgtgtttcctgttagactgtctctttcatgtctcccatcctagtgtctaacataggtattcaataaatatatacagaaggaagataagaagaaagagaggaaagatcagacttcattccagtgaggacagaattgcttgttcatctcttctgtctaagcccatccctctccgtgggctcattttagcaacacggcaagtcaacagaagtttcaacctggaaatgtcccacctagcaaggccaggggtgcaaaatcaaagtgaacaggacgttcctactacctttggggaagacaataacacagagtccaagaggtcaaagggtgcctggcctatgtctgcccctacgactcttccttagcccatgactctcgacctggaatgacagcaagttcatgtctagttaagcaaatccagagaagatttttgtttatgtagtggaatgttcaactcctcaattatgctgtgagaggctgagggggaaaaatagacatttttgcaaaatctgtttctggtaaccttcaacaaactaaaacagttgagcatacagaattttctgttgtttctgcagagataatttgttacatggaagctcatttgcttatttgaagtaaatactgcttcagacccagtagagattaacactcatagatgagatggattgagaaggaagagacataatacttcactgttatatttactgtgttaaatataaagtgggaattgatgaaaaatgttctggagttccccatgtgagcctaagtgatgaactggggtttatttgccatctggcttttaagcagggattttttttcatgtcagaaaaatggcaccttcagaaatattgcgttacagacatctgtttatcagaactttgcctgaatgaattattcagaatgtgcttaaggttgcactttacctgacatatggaaatataaagttgcatacttgatgtcggcatatatttgtctacataaaatcaggtgtcttacttgaaaccaggagtgctggaacttggtaggtggtgcttttcgtacctgggatattcattgttctacctcatgtggttcttgatgtcttcattttttggaaatcattgtgtggaattacatgtaactcacagtttctgtattgaagccccgtttttgtttccactgtgttccttacaactgaaatggaaagctactcttacttgatatgggtttcatggcaaaactctgttagtaatttcaagttggtgaaacaagtgaatatctggagctatcaagaggaaagtcttccaggccatactcagaagacccaagaggaaaaggtggttttgccaggtgcaaaaccatgcttgtaatcctagcactttgagaggcagggtggggagaatcacttgagggcaggagttcaagaccagcctaaccaacatggtaatgccctgtcactactaaaaatacaaaaattggccaagtatggtggcacacacctgtaatcccagctattcaggaggctcagaaaggagaattgcttgaacccaggaggcagaggctgtagtgagctgagattgtgccactgcactccggtcagggtgacaagtcaagactccatgtagagaacaggaagaagtggtttccatacacatcaagttttaaaggaacccttcaactcatcatgtcatcagaaccaaataaagctttaacattatccatgattgtacactgttttccatctgttcatttatttatttatagattgtttcatcagacattgactaagctcctactttaggccaagtattgaagatgtagattctactctttacttgttcggggcttacaagggagcagagaagatggacataaacaaaatagttacacatcagtcaccatgattgatgtgtaacttcaaatgagatgactgctcctgtgaagtgaaacaaggttttgtgagcatctgttggagcaacctgactcaggacttcaagggaaacttcttggaggacgcgattctgaagccatcataagtgacttcacttgttgaagaaggggaggagcctttcagatggcaggacagccatatacaaagatctgggggctagagagctcatgcagcattgcacaagctatttagaggccattgtagctgccgccaggggagctcatatggccaggagggctgaccgttcctagagaggtcagcagcccttacagcctggagtaaggaaggcggtgcttataaagcaagaatgatgggaaaccattgcacagattctaacatagaggccagttctgcgctccaattaaaattgacgaaagatccgtgaagtctgccatcattgcttatctgtctttgaattctctagtgtctagtgttcagcaagtgctggtaaaataaatacatgatgtgggggaagcacttcaataggatgtgagctcggagtgagttccagaaaggtgccccgcaatcacttatcccagaaactggtggggaggtttcagtcaacctgtataaatgctcctggggactgtcctttggataagcaggtgttctctttacctaaaaagagatgcctttcagaaagtctttaagggcagcagagcaagcactgggagggactaataggacctcaaaagaaagaggtgagaggcagagggctgagggcctttcggagctgccgctgcttagccagaggagggaagcaattgcatccccaacaggcgggctgtaaagggaatgcacgtcattacttggaaagggtggtgaagctgggagcaaacagcttctagatcaagctgccagggaggatgtttagtaattaaaggaggctggcaccatttggaggtacaaatctgcaaatccaaggttcacatcccagggagtgaccacgtggtcacaaaacacagcctacaaatgcccccacctgaggtcatacagagataagctacccccatgggggctgtgcgggtacagcaagtcggatgctcttattcaccacccctatacctaatagtgcagttcgttctcagatcatttttaaaggagaaatgaaagctctgtgtctgtgtgtgtatgtaaacaccatcttaacacattgcatgcacttttgatgcacatgtgtgttctaaactgtcatttgcagggacttctgttgttgaacctgttctctgtgaggcacgagtggtaggcttatgaaacccatccatctttaggccaggtgggctggctcatgcctgtaatcccagcaccttggaaggcccaggtgggaggataagttgaggtcaggagtttgagaccagtctggccaacatggtgaatcctcctgtccactgaaagtacaaaaatgagctaggtgtggtggtgggtgcctgtaatcccagctactcgggaggccgaggcaggaga[132 bp omitted]aaattcatacatcttgtacctgaggactgtttggggaagcagctgctttttcccgtcagtttctccttggttttctctactcacagggaccctcgccttgcacctgctgggaaggccagttcacctgcccgggctacttgtgttacacaaagctggaggagaatgaagtcaaagtggctgattttgttagagaagaattgttttgttctgcgttgggtgaagtttctctctattacacttttctacaaattcccctgttcccaattccctcagacaacaaaactacaatttgctgggtaaacaaaagcagtggggatgaagcctccctggcagccagtctgtcagaggtgctgtgcttgttagcatggtaaaagagttagaggaatttttcaagttgtacaaaattgaattacttaataaacttcgtttaactttcttccctgggagtcagtgttgttaaaaaatccaaaaagactgttttgcagcattagcattttacagttggtcagggttttcaaatcctttattctttatccattttttttctcaataacacttgttccttagccctttcttcctagctaacagtctctgtaactgtttaaaaaaaaaattaaaaaaaagaatggctggcctcagtaggtcattcctgtaatcctagaactttgggaggcagaggcaggtggatcccctgaggttgggagttcgagactcccaggccaacaaggcaaaaccccacctctactaaaaatacaaaaattaactgagcatggtggcacactcctataatcccagctacttgggagtctgaggcaggagaatggcttgaacccgggaggcataggttgcagtgagccaagctgatgccactgcactctagcctaggggacagagttagactccatctcaaaaaaaaaaaaaagtgtagatgtttggttaccccttcaaatcatctagctagtaggttggactttgtgtttattccaattttccccgtttagcaacattgcccccaccatcaccaccaaaaggggaaaaaaagacagtgggttaatcatccctgttagaaagaatttctctccaatgcctgaggcaagtttgcatgccatggatggaaatggtattttcaagagacagactgagccggtcctgcctaggaaacctgctgccttggcacggtggtattagtggctgagggctgtatgtttattccctggccctctgctgatccctggaagcaaagtgagtgtccacaggctttctctgtagtgacattgacttccttctgcccttgtgtttccaaggtgagctttgttaggtgccaggctgcagggtccttctgcagcattctgaagaaatcctctgccttcctctggttgggcagaatgcccagtagaatcaggaacagtgagctcatctccacctgatactttgtcttcgatggaacgctttgctttatcattaaaaaaaaattataatgcctcacttagggctgcaaacagtgttgatgtattcaatagcgcattagagaaaacgtcgaagcagatttgtagaaggtgcccatcctatgggcaaccccaaaaagcaatttattacccccccccaaaatatacattgtcatgtggagcggaaggattaaatatttatgtctgttggctggggtaataaaattgtattcaattgtgtctcaggcactacctaatgattgttgaaaactcggtaataacaccgaaactcataaaaaatacaggataaacaatgctggaagaaaattatgggaaaatagcctctggcctgtggaaatgcgactttattttgaaataatttgaaataagagtgtatgcattaaaaaaaagtgagtttatataaccgcaatctaatctctagaaacttttctttatggttttgttctttgtcaagttaaaaacaaggggtacatcagtagtgtttccagtaaatcctgataggtttggatttccttgaggacaggaacagcgttttcttcatctctgaactcttgggacttaaaaagagcctagttcagagcagactgggtgctccataaatatttgcagaactattttttttttttttttgagacagagtcttgctctgttgctgaggctggagtacagtggtgaaatttcagctcactgcaacctctacctcctgggttcaagcaattctcctgcctcagcctcctgagtagctgagattacaggcacctgccaccccacctggttaattttttgtatttttagtagagatggggtttcaccatgttggccaggctggtcttgaactcctgaccttaagtgatcagcccacctcagcttcccaaagtgctaggattacaggcatgagccaccgcacccagcttgcagaactaaatttaaaacataataattgtttatgatctccatgtcatctccgtattccaaggattctcaaccagagtgatttttgttccccagtaggcatttcacaatatctgtagacatttctgtgttttacaacttggcaggggagtatgtcctcctggcatctgtagggcaggggccagggatgttgttaaatatcctacagtgcgcaggatggcccccgaagcaaagcgtttgtagtgctgacagtgagagtcatctttaccgatgtgcctccttcagtattcccagtgcccagagcttcactcagagaaacagtgtatcgagctgtccttgagagaatggcggtatccatgtattggttttctagggcttctttaagaaagaactaaagacttggtggtttcaataacaggaattgatcgtcttgtgttctgaaggctagaagtgtgagatcaagatgccagcaggggtggttccttctgaaaactgggagagagaatcggtcctatgcctctctcttagcttctgtttttgtttgtatgtttgtttgtttctgtttttgatggagtctcactctggttgcccaggctggattgcagtggcacgatcttggctcactgcagcctctgcctcctgggttcaagcaattctcctggctcagcctcctgagtagctgggattacaggcatgcaccaccatgcttggcttatttttttgcattttttagtagagatagggtttcaccattttggccaggctggtctcaaactcctgacctcaggtgaaccacccgcctcggcctcccaaagtgctgggattacaggcatgagcccccatgcccggccagcttctgtggttggctggcagtcatgggtgctccttgcttgtagatatgtcacctgaatctccacctgcatgtttacatagagttctccccgtgagcatggatgtctctgtgtctctattttcccttttagtgaggacatggtcatattggattagggcctatccaaatcatctttacttgatcttctgcagagaccccatttccaataaggtcacattcacagctactgggggttaggacatccacatgttttggagggaaacaattcagctcctaacaatctacttctctgcatccctacatccgtgcagttcagattattacctctgctcagcattgtgttgcctgagatctggcatttcatcttctctcctccagcctttcgggtgtcctctcctgcggctctgggcaggcctgcacccccagcctctgaccatggcttgggcctgtcttgttcatccaagttactctgcctttgcacccttctaaccccgatgtgtgtctgtctgcctgccttctctttcctcccaggaacctttgacttttccactgatacctctggcctctggtgtgacctcttctagactttctccccagcatgcccaatcctctaggaaggtatttccgggttatagctgacaactcacttatcaggttcacctcccaaactacttttcagagtgccaagcatgtcttatccatgtgcctggcacagtgctgaacccccgtgatttaggtggaaatggttaatgaatcctatcctatttcttccagaatatggccctctaattatccatgcagggtccagttgggatgacgagggcaggctccagggtcagaatgccttgtcctcaatccttgttcacctcattgactcactgtgcaatctgggaccaagtgcttactgtctctctgcccagttacctcattgataaatggaggtgaggttgtgccagcctcacaaggctattgtggggactaaattagtttatataataattttgaacaatgctaggcacatcctaagcattcatgactgcagctgctaggataatttggcataatctgtgcttccccccaacacgctctctctgggggctccgttcttctgcttctgaacatgcttagacttccatttctgtaggaggttcttattgttgctataactaaatgatcaccaatttaggtgtaatttaaaacaacacaaatgtattttcttgcagttctggaggtcagaagtccaaaatgggtcttgctggagtaaaatcaaacgtcaacagtgttgcatttcttctggaggttctttgggagaatgtagtttcctccctttgccggtttctagaggccacccagattacatggctcatggcccttttcatcttcaaagccagcattgtggccttcagactccagccctggcttccagcatcacatacctccttctctggtcttcctcttgtaaggaactttgtgattactttgggtccacctggataatcctggcaactcttccatttcaagatcctttattacatctgccaaggttcttttgccaggcaaggtgacgtattcacacctttcagagattacgatgcaggcatctttggcatgagacaagattctgtctatcacactctctaaaggcgttccacctgtgtgatggctttatctccagcaaacatgcattcatattcaggctcagctacctagaagcgagggacatgtaatctccccaagcctgttctctcttttacaaaatcagacaaagaaattatcaagtgaggatagagaagtcggaatcctatgtgcctaacacgtggtacatgcatgctaagtcgtggcagtcacaatgactgttgttggtttcactttttttggtgttattttctcccgagtgtggttcttcccttattacctgcagccatcggtcttctgttgatctaaagcaaggtgtgcagttgggggtgtctgctcggaccaccctcgtgtgactgaatttgcctgcatatcggttcctttgctaattctgttcgggcaggatttgcttttttttgcttagcaaacttcatgagccatttctgatttccaatattgctcctcaggcagatctctcttgaaaggtgttgtttgtttggtttgtttacctcttgttcattactcttacctctacaggctacaagtctcctaggaagggatattgtgcctgtacgtcccaccctggaccacggaaaaccttggtagcgtgcaaagagattgggcattctagcggggctttgatggaactctaggaagtagaaaaagcagactcaagcagaaaatgggaaaagagaaatcctaagaggagtctcatgagatgattacttcacatttgcagttcaggcattttctccatacttccagaatcgtgtagggagttgggcacagagaatctttttaggggcaaagaaagtgagtgtcttttccactccccgtctccacacccatcttcctatttcccttccacacacacaaagaggagagctttaactttatctcaggaattctgtccccaggttcaatgctggagtaaaatcaaggacttggctctgtgcctgagtgggtgattccccacttgtgttaatcactcaaacaacctacatgcttttccttgtagttctggaggtcagaagtccaaaacggcccctattggggtaaaatcaaagcctcagcagggctgcatttcttccggaggttttatgggagaaggcagtttcccatctttgtcagtttctagaggccacctggattacgaggctcgtggcccttctcagcttcaaagccagcagtgtgactctaaagcaacatcatttcctaaagtagcggagaggaggcctgggaagattacacagcaaaaccatcagatcctacgtctgagaatgagaaggttgtttccttttcagttgactggtatatctaagcttatatccagaagaatgcctccatttcatgctggtctttatacctttgccttccttgctaatctctgttagtaaagaggaaggagggtcaggtgcagaggctcacacctgtaatcccagcactttgggaggccgagacaggcggatcacttgaggtcaggagtttgagataagcctggtcaacgtggtgaaaccccgtctctaccaaaaatacaaaaattagccgagcgtggtggcaggcacctgtaatcccagctactcgggaggctgaggcaggacaatcgctggaacctgggaagtggaagttggagtgagccgataatcgcaccattgcactccaacctgggcaacaagagtaaaattgtgtctcaaaaaaaaaaaaaaaagcaaactgaagacttgaaccttgggtagtgcgttagtttcccaggactgctataacaaagttccacaaactaggaggcttcggcaacagaaatgttttgccttacacttgtggaggccagaagtccaagatcaaggtgtcaggagggttggtttcttctaagggctgggaggaggaatctgttccatgcccctccctgtggttgctggcaacgcatggtgctgcttgggttttaactctgtcagtgtgatctctgccttcacctgcatgtgttctccccataagcatgtctgtctccctgtccaaatttcccctttttatgatgacatcagtcatattgaactatgacccataatgacttaattttgttacctctgtaaagaccctgcttccaaatcacgtctcacagatcctaaggggttgggcttcaacatcttttggtgggaacaaagttcaatccatagcagacaggcaattctttttacctgctatttaataacacttttatttgtattgtgtttattttaccatgcatacctacagcaaataattttgtttccacttatagaagagatctattttttcttctttttcagtaaatgaatttactttttaaaaatctcagtaaagtgattttaagaaaagacgttaactatatcatagtacaggtggtcttcagatgtggccaaatatagaagacacagtgtaagatttgggcaatacttggttcaccaatcctttgaggcttgggagtagaaagaacaagaataaagatgttaagtagagtaagatgcattcttcaaagattcctttttgtggaccatttctttgagagagaagttttcttcctgtgaataaatatgctgttgctttttttagctctatcatttatacttactagtatttcagaactttacgtttgagttctattttcatgccataaagaatgaggtaaataatctgaaacttaaattcccacgtggagtaatttctctaatgtggagtttctcaaacttgagggtacgtcagaagcacctgctggcattgttaaaatgaaggttgctgtgctcagccccagattttctgactgaatagctctggggtggagctctgtaatttacacttctagcaagttcccaggtgatgtggatctcggagtggggacggtacattttgcgaaccacggggctactgaaatgaggtgtctgttctctgtgagtaaagatttttcaggatcctttccagccctgcggctcagatagatcagattgaagtattctgggtgggctaagataactaaactaaagaccttctgagatttaggtttaaattcttttctctttgtttcttttactttttctttcttgctttcttgctttcttttcttgtgtgtgtgtgttattactattttttttttttgcaaggtctcactgtgtcatccaggctggagtacagtggcatgatcatagctcactgtagcgccccaacctcctgggctcaagcaagcctactacctcagcctactgagtagctgggactataggcacatgccaccacacgtgcccgcctaatttttttttttaagacagactttgtcccactgtgttgcccaggctagactcaaactcctgagctcaagtgatcctcttgccttgacctcccaaagtgctgggattacaggcatgagccaccaagcccagcctagagctccttgtttttggtcctcaggggatcttgggcaatatctcacctcatctggctgttacccaacactgtgctttatattctacttcctatttctgctgggtgaggatgggcttctgatgggtggaaaagaacttggaaagggccccaggcaggaaaaccattatggaagcaacgtctgtccacccaccaggccgctgggaggctgaagaagacacgtttttttgttttgttttgtttttttgtttttcctgtgggttacttgaaaaacatttttttaaatgcaaaaacagggtatcggaaattattatctgtccacctatttaactgttataaagtagcacttttaattcatttccataattacagcctgtgtcatgctgttcaaaagattcaactggggataaggagaatggtcccattttaacccccttatgagcgtgttagctcaggccaagagcagctgctgtctcttccggcaagccacggcattgtttgagaacatctttcctctcatatcccccaccagaccctgagcatgttgccatcggccttcttcacacccccacaaccctcggccccatcatctgcagtgcccgatgcccagcactgagcccagtgcctggtgttcagggtgtcttttgaaggagaagttataagtcggtagcatccccaagcttttcccagagcaactcaagccctgaggccaccagattgtttgggcagcaagttggtctcctagaagcccttggtagacctggctccttgcctagctgggccaggctctgtcctcccctgcgtaccctcctagccaagcgtctgggcagccagcggttaagtccactgtgggaagctattgagtctgaaacacacagtgacagcaggcatgctaaactacttcccagccctgcatgtggcgtaattgtattttcagggagggccaatctattagcaaggtgccagtctcaactgtgtaacttttataaagcaaacactaaaggcctcttggggtgaaggatattataattatggatgatttatactccccacctcatgtatacattgcacttgatgagaatgttctacttgacgtagccagaaacattaagcaaaaaatagtgttgcattctgggttagaaacccatcttttgttttatgtctaatctatccagtgctaaaacatttggaatgatacctctgcatgctgctgtgaaggaaatacgaacataatgagtgcatttctgatttcagaccagatcatcatttccttctaaaatacctcactgagtttagcatatttattccttggtggaatgtttgctgtgtattgcagtacgaaagcaaaagaaaataatcattataattataatttccgggctaggagggaccttagtgatatatctagtccggggtgtctgggcttaaattacagggtcggctgataagtattctacttttcatgattcagaatctacaagttaaaagaggaagagagaagagaaaagacagtagtaaaggaggtacttttgcattaataagaacacagacctaggtgtctcacctccacctcctacctgagccacctttgataagtgagaatctctctggacatcagttttcagctccagaagaaaacaaaaataaaaaaaaaaacccaaaacagggatcaaggccaggagcagtggctcacgcctctaatcgcagcactttgggaggctgaggcaggaggattgcttgaggccacgagttcaagatcagcctggccaacatagcaagatcccatctgtaccaataagctgaaaattaacctggcatggtggtgtgcacctgtagtcccagctactttgaaggctgaagcaaggaggcagaaacaacaagatcgctgaagcccaggagttcaaggctgcactgagccaagatcgcaacattgtgttccaagctgggcaacagagcaagaccctctcaaaaacaaaacacagatggataggtttgagacagccctcactcacataacttttagagaagtaaatcggatagtgcctgcgtactattattattacagcactattgccaggcagcaagcaggcccagggtggtgtaagtcggctttgctcatccgtagatgaaggatgcagaacattcctcagttgactaatgtgtgaactgcacactgagaactggcctgcggtcctccagctaatcagtggcggagccatgctctccagactcggggtcaaggcactggggctgagctgctgctttccccaggctcccggagacccactcccttgttctcctagcagctggatgaagcctgtggtcctcagcatttctactaattccctccaagaagggcctgggattgtttccattctctgtgttgcggactagggagctaactgcggttcctttctgcagggaggaagcttgctctacagattagaaaggaaacacgcagcttcccaagcatgtcacttctgaactgtttaataaatccacgtagcccgttttcttatttccttgataacttttcaaaaattattccttaaacaaatgacttcctactatagcctaaatctaaaatctaaacaataactattttttctaagtcctcacccccacaccccccttttttttttttttttttgacacagtgtcttgctctgtcacccaggctggagtgcagtgccatgatctcaggtcactgcaacctctgcctctcgggttcaagtgatcctcctgcctcagccttcagagtagctgtgagtacaggtgcgcaccaccatgcctgactaaatttttctactttttgtagagacagggttttgccatgttgcccatgctgccctcaagcacctgtactcaggtgatctgcctgccctggcctcgcaaagtcctgtaattagaggtgtgagccgctatgcccagccttcattcctttttatagttgaataattctcctgaagtggacatgttccgtgaaagggccgtatttgcaaagtggtccccaaatgctgaagttgctgagaaaccaaagtacaaggcagaaaaatccagtttgacattaaaagctgttttactgggaaaacttaaagacagctgtcttgactggcaggaagacagagctccacactgctactccccagacccagggcttatataccttagggaaagggcataagcgctgtgtacaagacaactgaaggcaaccctccaggagaggcaagaatgatcaaagttgacacgttgttatgctaaggactggaaataaagtaggaatcaggaggcattcacggagctgggactgatcagaagtcaatatggcagattagcatccaagatggagtcactgttgtttccacaggataccatagtttgttcatccgttgatggacagttgggttgtttttacctttttgctattatggctaatgctgctttggacctctgtgcatggggtttggatgtaggttttcatttctcttgaatatatccctaggtgtggaattgctgggtaatgtggtctaatacacctttggttaacgaaataaatagcattttagttgtttttttttttttaattgtcattctacgaccatctccaggaccattagtggcacagataccacagtttaagaaatcccataaatcatcgtgacctacacacttgtaaggccttccatcttgcaacgctattggccgttctggcttgtgtttttctggatggtcatcacgaccttcccaggtcgtccttttacctctcattggccgcagttatgcccattcctacttaaaaactcttgcataagctcggattacttccagcttttttctaccacccacttaaacttttcccatctttgaaggctgagttcaaacttcgaagtttgaatttgtaccttgatcttgtttttttatttgtttgtttttgtttttttgtgtgtataagatggagtctctctctgttgcccaggctagagtgcagtgacataatctcggctcactgcaacctccaccttccaggttcaagcggttttcctgcctcagcctcccaagtaggtaggattacacatgcatgccatcacatcaggctaattttgtatttttagtagagatgggtttcaccatgttgttggacaggctagtcctgaactcatgatctgaggttatccacctgccttggcctcccagagtgctggggttacaggtgtgagccactgtacccagcctgcaaatgattttgtccacagagcagactgagtttctgttcttaatttgtatttaaaatagaaaatctcagtggccaccttggtccccgctctcactgcaaagagtctgtcccagctactgttagggactcatttgtaaccaaacactgaacagaggatgtcacagttagtgactaatcccatctggtgaaatcagtatatgggattgcacatgaaatgaagagtttctgaacttgagtgtagctctatatcttataaagaaatctacaagtgcttttgtccttgatgtgtttcatttggggaatacatccatttctgtctccgccttctttaaacctgaaaggaagagagttggtagaaacactctgtccaaaggaagatcaatgctaacaatgttcatttttctaagtgtctccttcttctgaaataaaagttaggaagctctgacaccggctcccttcctgccttctacaccgaagtgggagttaagatgttccagataccatttgctgttttgaaggagggtctgtgtgctgtgtgatgagtagactcttcccctttgcttcgatgggaacctcggcattccaagtggacatatttcatatcctcagggcttgttctcctcctctgtggatctcagtagcagaccttcagctgcctcttagagaacagggccctgggggagacatcatcctttgtcagaaatcctggaaaaataccaagaaactgacacaagtcgaaagagggacaatggagacctgggtattatccctttagggtgttcttactcaacctaagtctcagggtagcctacaggagagccacttacgaatttgttaaaaatgtacatttgtggccaggtacattagctcacgcctgtaatcccagcactttgggaggtcgaggcgggtggatcgcttgaggtcaggagttcgagaccagcctggacaacatggtgaaacccctgtctctactaaaaatgcagaaattagctgggtatgctagcctgtagtcccagctactagagaagctgaggcaggagaatcacttgaacctgggaggtggaggttgcagtgagctgagattgtaccattgcaatccagcctgggtgacagagcaagactccatctcaaaaaaaaaaaaaaaggaaacacacatttggggactccaccccaggcctaccgaatcagaccactgggcttggtgccattgtttatgaatttttaacaagctacccgggtgattctggggcccactaatatttttgaactgtagctataggaagacttcatacatgcagagtaaaaccatcttaaatccaatcaaattaattgttaattaaattaatgtctgcctgggccctaattcataactttcatgttgcaattccctcctgatatccagaggcatcatttaaagaataagtaaccagggacataaaaatgaattatttatcttacccaaatctcatacccttctcagtgaaaatgtggttgcttgtcactgagtgtcctacccaatgggcatatctctggtcgtttcagagaaagaaatcattctctgccttccgaatgcagacaacatgaagcggcagtctcacgttgatattatggttaattaatcttgggcataggagtatgcaggagcattgagcagaagcgcactcgttaataaacaagtattttcagtgcaacacattgcaggcttggcccttacctgatgtaacagatggaggagaaagtgggggtggggaggaaagtggctgtgatctagttacgcagggtcctatttcaaacaccatttctccatttaataacaacagctaatgatttttgtttgtttgtttttgaggcagagtgttgctcattcatccaggctggagtgcacaggtaggatctcagctcactgcaacctccgttcttgggtttaagccattctcctgtctcagcctactgagtagctgggattacaggcacctgccatcgtgcctggctagttttttgtattgtttttttggagatggggtttcaccatgttggccaggctggtcttgaactcctgacctcaggtgatccgcccgcctcagcttcccaaagtgctgggctgggattacaggtgtgagccatggcgcctggcccaagaggtaatgtttcttgaccaattcctatttatcctgtttacatgtattaatttctccaaattaattcctcacaacagcccagcagtttaggttctcttattagctccattttatagaccaaaaaataaaataaagctcccccaaactggaacatagagggtttttttttttaagtaaacttctcagcatcacacactaataaagagtagacctgggatttgaaccatgaaatcccaagagagatccagaacctactctcttagacatttctccacttcctatggcttgaaatttgttttaaaggaaaccctggtatcttcgaacaagtatctggaaattccgtcctttttgttgatggagagataaaaatccagattgaatccagatccataagacattgtcatcagcactgatatattgtatgttatagataaggagaaaaatttccaggaggctgagtgacctggctaagatcattctttttttttttttttttcattattattatttcaatagttctgggagaacaagtggtttttgttaaatggttaagttgctgagtggtgatttctgagattttggtgcacccatcacctgagcagtgtacactgtacccagtgtgtcatcttttatcctttaccccctcccacttttcccctctgagtccccaaagtccattacatcattcttgcccctttgcatcctcaaagcttagctctcccttataagacggaaaatatgatatttgtttttccgttcctgagttacttcacttagaataatggcatccaactccatccaagttgctgcataggccattattttgttccattttatggctgagtcatattctatggtgtaggtgtattttctttatccactcattggttgatgggcattgagtttggttccttatttttgcaattgcaaattgtgctgctataaacatgggtatgcacatgtgtttttttatatgacttctttcctttggtagatatccagtagtgggattgctggatcaaacggtagttctgctcttaatgaagttcactcctgatattgtcatgatacaatctctctcttctgcatgaaaccagagtcctttctactgtttctcttgcttcctcagcttataaatggcttgtttaagttgatacgaaaaagttagatgtgtcctagacattaagggagcaccgagtccacagaggctcttgtaattgccaagggctaccataacaaatgaccagctagtggcaggcttgaaacaacagaaatttattccattactgtttggggaattagaagtctgaaatcaagatgtggagatattagctccttctggaagctttgagggagaatacatttcatacctcttccctagtttcttttggttccaagcaatcattggcaccccttggcttgtggctgcatcactccagtctttacttcatctgcagtgggctttccctctgtctctgtgtgtgtcttctcctcctcttaggagaacatccaccctgaatccaggatgattccatcttgagatccttaacttagttacaccacctgcaaaagctttatttccaaatagggtcacattcactgatatcagggattaggacttggacataggtttttgcaggacactatctggctagtctgtaatgactatcagagaatggattctatagttactggataagtttgcccttgtttgactggaacacagtatctcaagtggttgtggtgaagcccacagactatggggctcagcaggtgttggtttgagctcctgcaccattcgttagctttgtgaccattgataagtttcctaaactcccccaggctgccatctcttcatttaggaaatggtgatattcatcttaactaaatgcatgagttttctattctgtgttacaaattacccacacacatttagcaatttaaaacagcacacatttgttttctcacaatgtctatgggttaaaattttgatacaatttagctgtgtcctttgttcatgctctcacatgactccagtgaacctgtcaggtgggttgtgttcacatttggaggctcaaatggggatggatatgcttcgaagatcacccaggttgttggcacaatttatttcctgtgaccgtaagtctgagattggtggattcttgctgactgttggccataaaccatgtttaccttccagaggctgcattcagctttctgaggtcacccatagttccttcctacatggcctttgccataggtcctctcataacatggcagcttgcttcttcaagcagtggagaaagaataatttatgtatatacataaattactgtatatatatatatatatatatttttttttttcttagggttgctttcaatcaatagacagtatggcaggcagaggtgatggaaagttataccgtgataatgttcatatatatgagcatatgtatgtgtgtgtgtatatatatgaagatgtatgttgtatatgcacacacacatgaacataatcaccatgtaactttccatcacttctgctgcattctgttggttggaagcaagtcccaggtctacccataatgaagaggaggagattatgcaagggtgagaacacaggaagtcagggatcattggcagtcaccttagcttctgcacaccactgaaatattgtatgaattagaatatacacagaactagcacaatgcctaacaccttgtggctatttaatgtatataactgctgttaccaactggcagctggtattactattcaggttaatcactgcccagattttagcatctacaactttcttcacacaggctgttccctgtgcaacttcaggagcaccttacacacaggggaggatgtgaaatggatcctggggggtaggtgcaattcagtggttcttgctacaatggagaggtctgaggcattggcatcgatctcagaaagacctgagcatcctacattgatataaactgtaacttattcagatattggaaagcactggttttcagttccgagtgtccggtggtaatggcaagtttcgcatgctgcagccccttgcaagcccactaaagaacatctgccacccggcacagcagtggctgctggtttttgctctctgcagtgagcacttccaggctgtcttgcctcttcctgaatttgtgggtggttgctaatcttttagctcattttctttgctgtgtttttccacatttaaaatcttttattttcctgcgtctgtgttttcatttccaggagacagttggcttttttcgtgtgtgtggaataaatgaacatgtgattcttttacttgctgactgttgaatgtgaaatgtgcagccacctgtaagccaggtgagggtggagtaaacttaggccatgttttgggcctcactgcatccaccactccaaaaactggaaagccttctgagattttaaacattttccagtaatttccttattgtatggtgactgtgagtaataaatcaggaggtcagcgttcatcacaggtgggattgtgtgatgatggtgtcacagagcacatcatagtgagcatttccatttctaggtgtaccttgggaagtcttaaacaagggggtctatatgtctgtatttccttttggccatttttgataatgaccaaccagaacatatccaaatcagatgatgtaaggtgcctttaatacacaaactacttataaatctataggcagtgtataagcaaaccatagacagtgcagtaccgtcggctgtttatacaagagctgttattacccctaagcccagaaggcaatgagagaaagtgatttgtagaattccaaaggagataggaaagcagctggtccagtgtgagtctgagaataaataccctggtccctgctcctggtcttcagttgcctgcctgagctctccatcagcccagccccacaggctgctagatgtggtatcctggccaggtgtggtggctcatgcctataatcccagaactttgggatgccaaggcgggaggatcatgtgaggtcaggagttcaagaccagcctggccaacatggtgaaaccccatctctactaacaatacacaaattagcaggcatggtggggaacacttgtaattccagctacttggaaggctgaggaaggagagttgctggaaaccgggaggtggaggaggcagtgagccaatatcacaacactgcactccagcctggatgatggagaaagactccatctcaaaaataaataaataaaaagatgtggtattctgttaatcatggctgaccattttccagggcagagagcagggtggaatgggatggagagtgaatcagcaggggagcatggaagatgcatcagatatacccacacaccctttactctttaccccttgactgccattttctagcctttaaagcagtagaaggccagcaaagtggtcaggaacacagatatcaaagcttaattaatagttagtctattttggagtccaataaaggatttgccaccttctagccatgaaacttcaggcaagtgactgaacctctttgagtgtattagtccatgctgcattgctataaagaaatacctgaaggtcagttgtggtggctgacacctgtaatcccagcactttggaggctgagtcaggcagatcacctgaagttaggagtttgagaccatcctggccaacatggtgaaaccctgtctctactaaaaatacaaacattagtcaggtatggtggtacgtacctgtagtcccagcttctcgggagactgaggcatgagagtcgcttgaacccggaggtggaggttgcagtgagctgagattgtaccactgcactccagcctgggtgacaggaagactctgtctcaaaaataataataataataataataatagcaataatgccacctgaaactgggtaatttataaagaaaagaggtttatttgactcacagttctgctggctgtgcagttatggctccagcatctgctctgcttctggtgaggcctcagggaggttccactcatcatgggaggcatgttgggcagggaagaggaacacgcaagagagaggggaggaggtgccagcctcctttaaacaaccagatctcgtgtgaactaacagagtgagtgctcactcatcactaaggggatggcaggcaccaagccattcttgaggaagccacccccataactcaaatatttccctccaggcccacctccaacattggggatcacatttcaacatgagatttagagaggacacatatccaaactgtatcaccgagcctccatttcttcacctgcaaaataatgaggtgcaagtacctacctcttgtccttactgtgataaaatatttctacctttattcttttttttttaattttattattattatactttaagttttagggtacatgtgcacaacgtgcaggtttgttacatatttatacatgtgccatgttggtgtgctgcacccattaacttgtcatttagcattaggtatatctcctaatgctatccctcccccctccccctccccctaccccacaacagtccctggtgtgtgatgttccccttcctgtgtccatgtgttctcattgttcaattcctacctatgagtgagaacatgcggtgtttggttttttgcccttgcgatagtttgctgagaatgatggtttccagtttcatccatgtccgtacaaaggacatgaactcatcattttttatggctgcataatattccatggtgtatatgtgccacattttcttaatccagtctatcgttgttggacatctaggttgttggttttttttttttttttttttttttttttttttttttttttttgagatggagttttgctctcttgcctagactggagtgcagtggtatgatctcagctcactgaagcctctgcctcccgggctcaagcaattgtcgtacctcagtctcccaagtagctgggattacaggtgcaaatcaccatgcccatttaacttttgtagagatagggtttcgtcctgttggccaggctggtcttgaactcctgacctcaggcgatctacctgccttggtctccgaacgtgccgggattataggagtgagccactgcacccagcctatcctttttaatgcgactaatggactccacatttatttatttatttatttatttattgtcctatccaccctattccactgtgaatgtaaatttccgggggggcagggattttgatctattttattcactgacatagctctagcattaagactagttggtggcatagaggaggcaatccataaatatttgggggcatcagtaaataagatagtggctacaaagggcttagggtagggcctggaatgcgttaacagcttgatatttgagcaagtatttggtagtaaatacatcaaagttgattttaaacacccaaacacagacaagcaaagaacgggaaatcccccaggtagggatgatatttagaaataggaataaaataagcctggcgaaattacctttggtgagttccttgcaaggttatgtgatttaaaaaaaaaatctgtaattacatttctctatgtaattttgttttatcatctatttatttatttacttttgcaattaatttattttagtaacctaaactcatcgttaagtctgtagtcctggaaaccatgtcaaccgtcagatctctgtctatgctcaaaaacctcaacttgctggctgggcttggtggctcgtgttagtcccagcactttgggaggccgaggtgggttgatcacttgaggtcaggagttcaagaccagcctggccaacatgatgaaaccctgtctctactaaaaatacaaaaaactagctgggcatggtggtgtgcatctgtaatctcagctaatccagaggctgaggcaggagactcccttgaacctgggagggggaggttgcagtgagctgagatcacaccactgcgctacagcctgggcaacagagcaagactccatctcaaagaaaaaacaaaaacaaaaacccttatttggcagtgactgggtacacagagttgtgcaacaggagacccgcctgcagaaagtacccactgggatcctcaccacacagcaggcctcagaatttcccctgcctcctgatcggtgttcagatgtagatagtaggttcagtgggttgattaagttaatgacatttgtagcggtgttataggctgcaggccagggagaggctttctggaaaattgcagggagaaatcctgcaggctctgcctttgaaagataatgctagttgcatgctggggctgtctcctccctttgtcttgaaggtgtagaagacacagctttgcgggctgagtaaacatatgtgcatggttaaggtaaaaatgctacttagctcttcttcccgttaattcgttcaagaactggtgaaagagagcacacttcttggagactgaacttttaaatgcttctgctgggtctcttgagttcttaaaattatcgttttgatctttctgtcccgtgcagatacaaaatacataaacatccacgtgactctttttatttttcacttagaacctgcgcattgtcctagcaggtactccctcagggcctgggttttgttgtcactgctggaatgcagttgctcctccttgccttactcaggcctctgccagcttctcagacagctttgtcaagcaattgctactcaaccagcgattactattaacccttcgttacctaaatccacccaccatttttcttttcctataccgatgggcctcaagcttgagtttgcattagcttcccccagagggtttgatcccctagagacttagagggtccccaccctcagaagttctgaattgttaggtctgggtggggctcagggatttcattttttaacgaaaccctaggtcctgctgaagctgccagttcccatctctactaaaaatagagaaatttgccaggtgtggtgacacacacctgtagtatcagctacttgggaggttgaggcacgagaatcgctggaacccgggaggcagaggttgcagtgagctgagatcgcaccgctccactccagcctgggcaacagagtgagacgctttctcacaaaaaaaaaaaaaaaaaaaaaaaaatccgaacgtctcgtgttaacaggctgatcattattttcaaaaatgtttcctctctttctttccacatggaagctccatgtgagcagatatttctttgttttgttttgttttgtttttcgtttttgcatcattcactgctgtgtcctgtgtgcctggaaaagtacctgacatttagcaggggcttaatagacatctgctgcatgttgaataatagtgaggatgtcagcatcacctgctgccctttgggggagcagattttagggcactgtagcaaggctgattataagtcagtgccctatgtaaggcctggaacctaaaatctccaatcattgtttttgttctgttgaattaagccaccaccctaaagagccagaagcctaacactgaaggaaatagaaaatgtggatctcacaacacatcatttcaagtgtgtacatatactaatagcatacgctaaacatcatctaaacactaaatataatgatataatggcattggtcataatcttgaaggtagttgcatctccgtaaagtttcccattgagctgctgttccgctgctgctggcttccacccccagcacccacccctctagatttataatttccccaacttgggttgaagccccagatgactgggagctgcttctttactttggttcccttcagtcccttcggcagatggcacaattcttagtgtgtgtgattggggttttcagcattggctgtgcattggcattgcatggggagtgttagaaaagattgatgtctgggtactgcccccgaagattctgatttaattggtctgaggatccctgggcatccagatttttaaaagcttacagccaaggttgtgaaccatcagatcagggacaaaggcgatctggaggaagacggggcggggaaagaaaagaggaaaagagaatcctgatttctggagccaacaaagggccctgtgggagcagaggttgttgtaggataatgaaggggtgagctggcagccaagagctcaggacatgcttgaggaaagaacgttcaactcagaaataagactgctttcatgcgttaattatgcacctcttgtcttctctaatcgttttatccagggtaaccttgttggcccaaggaaattataaattccttgggatcagcaatgtgtcttacagttaccctgtagctcccaaggtctctagcagccttgcattcatgtgggattcttcaaaagtagccctcaaattactgaagaactgtgaggtcagagtggtaagtaaaagattaaaatgtctgccaatcaatcacggttgcatatgtgtgtgtttcatcatttcacattgtttgatttctttccgctatgaaaagacatatgcacacagaaaaagaacagtaacacacacaaaaaaatcagccagttaaaaccaccaccaccaccatcatcaccacagaaacttagaaatggagcccagtagagcatcagttgtcagatatgggggcttcaagtccccaaagcagatgtcatctcatgtcattgggaagtaaagatgttcacggtgcaagcgtcattcacagacacgcatgcttgagttccaagggagcagatgtgagccagttaggaagacgccaggaaaacaccatgcttgccccactccccagtctagtgtttaattcacaggcccacattgcaactcttcaatactttattaaacacatctcttctcctggataccctactaccttcagagcaaacacattctactctttgaaggcaagtgtgttcttaactgcttggatcctaccctttatgacagagaagaagaagatattgctaagggttggattagaggtaggaaactggggaagctctggtaaatggaagaggggtttaccttgttttttcattcataatgtgaatataggcaaggttagaatcccggtgcacgtcaccattgtcaaaatgacatccacaagcagtattgatgcctccaccaggtaaacagcagttccctggtatatatcagaagcgtgcttttctgtattctaagcagtttttgacacagtgctttgctttattgcaagccacaatattttcagaaggcttaaaaatccagttatgactgtagctgtgagggaagaggtctgcatggggccggggaaatttaatttttagcttaaaaaaagtcccaccaaattcaatttttctcacctttagggattctcagagttatatccagcttgcataactagtgtgttagagaatgtgttactacggggttattttttttaacacatttattatttatgaaatgcagaggaaaatagaaatgatcgtttcagggaatatcctgtagctttttttattgtattcaaagaagttgctcatgctgttttaattcaaatattaaaagttaaatctcttttcatcctgacctacatttaaaaaacactgctttagcccttatggaggacagaaaatgtgtggaaggaaaacatccactatgcattccttaccccatagttcgtcaggaatcagaatgactggcaaacctgtccaggaagtaataggaaaaacagagcgagatctctctcttctctccacatccttgcttatcccctctctcccatagcaaaccagccctgctggttatgctggtttactcggcctgctcttgaatgttgagaagctccatgtgagcccctcaatctgtgctagggaaataaagagaagagagatattatcccatctttgataagggattaatattgagaatatattgagaactcctaaaactcaacaacagaaaagcaaacaagctgactcaaaaccgagcagaggatttgaatagacgtgtctccaaaagatatatacaaatggccaatatgcacataagaagatacctaacatcactaatctctagagaaatgcaaatcaaagtcacaatgagataccacctcacacccatcaggatggctatttttgttattgttgttattgttgagaaacagtctcactctgtcacccaggctggagcgcagtggtgtgatctcggctcactacaacctctgccttctgggttcaggtgattctcctgcctcagcctcccaagcagttgggattacaggtaccccccaccatgcctggctaattttggtacttttagtagagatggagttttaccatgttggccaggctggtcttgagctcctcaccttaggtgatccgcctgccttggcctcccaagttgctgggattacaggtgttagcccctgtgcctggcctaattccccgtttttaaaatgggtttaacatctttttatatgtttattggccacttgatcctccctcagagagctatacagttttctcactttattcagtctatgagcaaatgtcatcttgtaagagaatgttctggatcaatcttaactgtaatagcatgttcctatccaatacccctgccccctcaccatagccgagtcttctgtgtatttgtatgtatattcatatatatatatatagtatcccacccccctacacacatacatatgtacttatttcctatcttctcctttctggattgtaaattttttggatgtagaaatcaggttttgttggtttgtttttcattgctgtatgcctaacatttagaatagcagatattgaataaatacttattgatttatattataaaggttgtagttttaagaaaaattcagaacacattgacctttctttactagtaatgcgctgtgtagatatggcataatatttttaacctcttctctctactgatgggaattaaggggttgtttgctctttggtgctaccaaaaaaaaaaaatctatctatctgtctgtctgtctgtctatctatctatctatctatctatctatctatctatctatctctacacacacacacacacacacacatacatacacatatatacatacatatatgtgtatgtttatgtgtgcatgaaccactaaaggcataataaacgtctgctgccttggaccagcatctctgcagggtataatcccagaagtagaacctactacatcaatgagaacactcattttaaggctggggacatcttgccaatttgttcacccaagggctttgtcaattcacactcttgccaccctacaatggacaacatatcccaccccacaaccaccacaatgctttgtctttgccagcttctatccctatttgagagatgagaaaactaatgaaaggctcacagactcaaagtcagacagtttctagttggtgggtctaaccctccctgttgcttgtgcagatctctttgttgtgatctgtttcctgtggtctgccacaaactgggtaatttataaagaaaaataagtttactcagttatgattttggaggtcggaaagtccaagagcatggcactggtatctgacgagggcgtggtataaggcatcacatggcaagagcgcatgtgagagggaggaggcgaggagtaagcaagagaaccagggggctgaagtcatccttttaatcaggaatcaactcccaagataactaacccactccagtgaaaactaactgacacctgcagtagctaacctcctgcaacaatccattcttgagggcagagccttcatgacctgatcatcttggtttttgttgttgttgttttttgttgctgtttttgttttttcagatggcatcccatctgtcacccagcctggagtgcagtggcatgatcttggctcactgcaacctccacctcctgtgcttgagtgatttccctgcctcggcctcccaagtagctgggattacaggcatgcaccaccacacctggctaattttttttgaattttcagtagagacggggtttcaccctgttggccaagctggtctcaaactcctgacctcaggtgatccacctgcctcaggctccctaagtgctgggattacatgcatgagccaccatgcccagcccagatcatctcctaaaggtctcacctcacaataccattacattggcagttacatttcaaccttggaggaaacattaaaaccatagcccttcttgatggattacatccttaggaggatctgcttccaagtgtctcacctatatggtaggtgagttagtgctggctgtaggtcgtaggcctcacttcctcatcccacgggcctgtccacaggctgcccaaacatctagccccaggcatctttcatggagagttgcaccagattctgaagtgctcaaacacatgtctctactttcactaatctctttctgttaaatttgtttttgagttgtgtgaaataaatacaatgtaaaatttaccattttaactttttattgcacagtttggaggcattaaatatagtcacactgttgtgtaaccatggccactgtacatctctagaacattattcatcttgtaaaactgaaactctatatccattaaacattaactcccattatgtcttcccccagcccctggcaactactattctcctttctgtctttatgaacttgactgctctagtatctcatgtaagtggaatcattcagtatttgtctttttgttactggtttatttcacttagcataatatccttaaggttcatctgtgtcatcacatttgacaagatttcttccctgtctaaggatgaattacattccattgtatgtgtaaaccacatttctcttatccctccattcatctgtagacgcttgggttccttccacacttgagttactgtgaatgatgctatgaacgggagtgtacaatacctttcagagtccctgctttcagttgtcttgggtgtatagctgcaagtgaaattgatgaatcatagagtaatttatttatttattttttagtaaccgacatactcttttccgtagcactgcatcattttgcatttccgtcagcagtgcacaagggttccaatctgtccacatcattgccaacacttatattcaattttcagaaataatggccatcctggccaggtgcagtggctcatgcctgtaatcccggctctttgggaagccaaggcaggcagatcacctgaggtcaggagttccagaccagcctgaccagcatggtgaaatctcttctctactaaaaatgcaaaaattatccaggtgtggtggcaagcacctgtcatcccagctactccggaggctgaagcagaagaattacttgaacctgggagggagaggttgcagtgagtcaagatcgtatgactgcacactccagcctgggggacagcacgagactgcgtctcattaaaacaaaaacaaattggaagaatttaaaagggagtggggaagaagtatggtcagaacattttccaaactagtgttcattttctatatccaaaattttcatgcagtgtttacctctctttatcttaagaaatcaataattgggatttcattattttgttttgtcaaaacaaagttattgaacaacaaaataccagtgtttgagtgattaaaaaacaacaacatggtattgaaaaatcaaagtacttatcactaaagttaatgctcatcctctcagcccaccagccaggggtcagggaggggacacgattgcacactgggctagagctgctgtccgagaggccttgagggtaggcgtacgacagcagcatttcagaggtagttggcaatgctcctctgccacccatagtgagacagggaacttcctgggcttctggtacagagttttcctaacagtatgtgcatacctagctgcagttcctggtctagggattcttgctatagaactacagagcggtaacttgagtcactgtgaaagcagctcttcagtctggactgaagttgctgcgcttgggattttctttttcatgatgttttcctttatttcttttatcaatacagaatacgtatttatgtaataaatatgtgagtatttttttacatgcagagaatatgtcatgatcagtatttgaaagggagacctgcctttacatgtttattgcagcactacttaaaatagccaagacatggaatcaacctaactgtccatcagtgggctaatggacaaagaacatgtggtatatgtatgcagtggagtactatttggacataaaaagaaggaattttttaaaaagataacaaagtcatgtcatttgcagcagcacagatggaactggaggtcattgtgttgtgaaattactcaagcacagaaagacaagtaccatattctcactcatatgtgggagttaaaaaatatgatctcgagatttttttctttaaaggaaaaagctgtgaggccctttgcttagtttggaggatctcagagggaaaggggccacgctttgtgtatcacttgaatggtcaatttaagccaggtgcggtggctcctgcaggtaatcccagcactttggaaggccgaggctggcagatgacttgagctcaggagtttgagactagcctaggcaacatggtgaaaccctgtctctaccaaaaatagaaaaaaattagcttggcctggtggcatttgcctgtggttccagcaagtcgggaggctgagataggaggactgcttgagcccaggaggcaggggttgttgcagtgagacaagatcgttccactgcactccagcctgcgtgacagtgagacccccatctcggaaaaaaaaaagaaaaagaaaaaacagcttatttaacctattcgagtgaccttgagctatatgcctatctggcctaattttcccatcatcgaagtgagataataatacatagctcagagtgtatggtcagaattaggggaggcagcagaagtaatgtgtttagtgtggttcctggcatgtagcagatgttcagagtggtagtttcagacgatctctccaagtctttgatagtttcccttcataaagtagagcctcatctccctccccatgaatagaatagaatgtagcagacacaataccatgtgacttccaacagtagatcataaaaaggaaatctttttctctctcttcttgtcaattttcttttgcaataatgaatgattactgttgtcttaagccattacatttcagggtaatttgtctcatggcaatagataactcacactttcagtagtatttgcagccaagatctgttatccttgaatattcaaaaatctgtgacctatccccattgtgcatgtacacacaagcacacgctcccctacatactttgctgacatcttattcttaaatgtaatgtgccttattcaaagggtgattaggaggtttgagaatcagtgtggcagctaagcgagacatcttccttgttttaatcagaagaatggaaagtgctttgtagaggcgaggtggactgtcaagcacagagcatgcatgtctctaaggcatgccacagagtttatccggggccaggatacctgtggtctagatcctagaaaggagggatgctagcctgcacatcggttgctaatggaacccttgggtttgtgtgactggggaccaatctgtgccgatgtgtgaatatgtctgctttgcttacactcaggcagtgattgcatatctgggggctaatgagctaagtttggataatggcaagagggtttcttctcaatgcgcaagagtattttgcctgcgtcaggctgactgcgggcatttccttagatctgaggttcactttttgctccgggggttcagcttctgtacacttgatggatgctggtcttaatttggtgtgttgcagtcattgcgagttgtgcaaggatattaccttaaggatattcttttgaatattaaattagaataaattaagggatgctggatattaagcctaaatcagagatgagtaattgccttccgttttatgccgttaagtttgttggaaatgcaagatatttgttttaattaccaagttgttgaaccaactctcaatgagcataggcacaaacagaaacaaataaaaacttcttggtgagtttgtgaaatgtagataacacctaattggatgcattttgttagtgcctgtcctattatcattactttcttccttcatccaacattgagtaattgactcccgactatgtatccagaaacgtaaaatgctctggggaggatattaagggctacatttttttcattgcttaattgtttcctgtatatgccagcctaagcacttgacatccctataaaatattcacagaagcactataaggtaattatgactatgaccgctatttcacagatacaaaactaaggctgagagaggatagcattagattaatattaaaacaaaaactcatacagctagaggtagggtaattccatactgtattggtaattcaaagcagataaaattgttgcctcttgaaagcctgtgcccaaaacgctttaaagaggttctttccgaatgctcaaaaacagtgtattttaaaagctgctctctgaaatttttaagatccatcagccagagtgtgatgttccccttcctgtgtccatgtgatctcattgggactgttgtggggtggggggaggggggagggatagcattgggagatatacctaatgctagatgacgagttagtgggggtagcacaccagcattgcacatgtatacgtatgtaactaacctgcacaatgtgcacatgtaccctaaaacttaaagtatgataataaaaaaataaataaaaaaagatccatcagccagtaattttacctttaaaatgttatcaaaaatgatatttttttccaaatttttattctggaaaattcaactatgtctgtaagaaatcaaaatagtataatgaatccctgggtactcagatacccagattcaacaattgccaactcacgaccaacactgtttcctttttaccttcattcccacatcccccgaacaaccaccccacatgcacaatgtatcttttgaagtagatacttttctttgttggtattttaggaaagtcttattaatgtagactttttttttatagttttctatgtgttggccattcagatgtcaatgaaaagagtcaaactctgtaaaacggtgaagatatttattctgagtgacataggagtgacacagacatcaggagatcctgagaacacacacccatagtggtcaaggcacagcctagtttcacacattttagggagatgtgaggcattaatcaaatacatgtgagatttacattggttcggtctggaaaggtgggacaactggaagcaagggtatggtgcgatgggcttccacgttattggcaattggttaaaagagttattatcgatagaaaagaatgtctgggttaggataaggggttgtggagaccaaagttttatcgtgtggatgtagcctccaggtagcaggctgtggagagattagattgcaaatgtttcttttcagacttaaggtctgtgttgatgaaatgctggctggcttttcctgaattccaaaagggagatgggtatcatgaggcattcctatcatggtctgaatcagtttttcagctcaactttggaatgccctggctgagaggagaggtccatttagatgggtgggggtggggggtgggcttacaattttatttttggtttacgcaagtctgtagaaatgggagctaattgtgatatggatatccctcagtttctgcttgctttttagaagaaactgcaatcacataccttaaaaaaggaatctacatatagaaattttgaactattcaagttcattgtttaaaaacaaatttctggatttactttcctagtgtagaatataatctgtcattgtccagattagatcattgtcctataaatatcaggtaggttgcagatacaataatgctgcgcagatctttagcctttgtattttttggtatcgtcacaaggaaagtaaaaatagtaattgaaaccgaagcctattgttggcaagaaggttaagttagcacagcacatagagcattacctggaaaatagtaagggtcggaaaaatgtaactgttacactgttgctgttgttatttttgttgttcttgccatcacttttcttgtctgagaaatttctaagtctcatccataatattaataaggattaaataaggtaaatgcctaacattctagcattaccagacactgaattactgtattttttctcttcatttttttttcctctggctatgtgtggtggatttagttggactgtttataggaggacaatctaggttaaagggcagaaaattgtatttttggtagaattggggctttgccatgttggccaggctggtctcgaatcacttgagatcagaagtttgaaaccagtttggctgtcagggtgaaaccctgtctgtactaaaaatccaaaaattagctgggtgtggtgggttgtgcctgtaatcccagctactcggtaggctgaggcaggagaatcacttgaacctgagaggcagaggtagcagtgagccgagattgcaccactgcactccagcctgggtgacatagtgagagtccatctcaaaaaagaaagtaaaataaaaaatggagaatggagattttgcccaggaatgcactgtaactgttcttgtagtcactttccttagagatctgccttgacatgtgacgaactctggaatatcaatgctaccatggggtttgttcttttcctgtcattttactcttgaagaaacagtggcccagaaaaatttagcaacctgccaaggtcacaccactaactaatggcatagctggaattagaactcaggccaatgaagagaaaaataatttattaggttttgaaatttgatatataaaaaccataaaggtttccccacttctcaaatattgcagacatgagtgtaatatgagtcattattttgggccaattttgcttgaaataacaataaattacctagagtcacaaataatatataaattggtccaaagttttaggtagctttatatatgtgtatgtgtgtgtgtgtgtgtgtatatatatatatgtagctatatatagtagacatctgtttttatctgggttaatgaatgtgctctgctttgcacagaatttaaatagtttcagaatttttctttctttttttttttttcttttttttgagatggtgtcttgttctgtcatgcaggctggagttcagtgggagtgatttcagctcactgcaacctctccctcccaagttcacttgattctcatgcctcaaccacctgagtagctgcgattacagccgtgtgctaccatacccagctaatttttgtatctttggtagagttgaggcttcactatgttggccgggctggtctcagactcctggcctcaaatgatcagcctgccttggcctaccatagtgctgggattacagatgtcagccatcatgctggaccagaatttttcactaagagggtatcatatagctggtggaagatacatgtcaaggctctttgtaatttactgcatattattcaatttcactccataaatgcataatttaatcacaactctggtttaaatgatatagcaggaatgacatgggtggaatttaaagtttgtataatttatatcatccatagcactttgaaaaggcacaggtcagcctggcctacagggcaaaaccctgtctctactgaaaatacaaaaaatagtaatcccagttacttgggaggctgaggcaggagaatcacttgaacccaggaggcggaggttgcagtgagccaagatcacgctgctccactccagtctgggcaacagagtgagactccatctcaaaaataaaaataaataaataaataaataggtacaggtaggttacctctggctatcagaggggcttgggcatgagtccttgttgctgcccatataggaaggggctgctgtgagttgctctgaccaagctaggttttgggagatgcttaaaagcaaaagctcaaactacattgctcacttcccatccgacaattccaggaacttaacaattcaggagcagctaaagctcctttaatcttctctctgtccacacagcaaaaactgacgagtgagtgatgacaatgataatttaggtaaatattgatgaagggaagaataattctctatactttgaatgaaattcctctaaatctaattcatcctcttggagagaagcaaaaaattgggtattcaggggtcttatttgtacacttcttttcttttttgaggcggagtcttactctgtcacccaggctggagtggagcgacgcgatctcagctcactgcaagctccgcctcccgggttcacgccattctcctgcctcagcctcccgagtagctgggactacaggcgcccgccaccatgtcccgctagtgtgtgtgtgtgtgtgtgtgtgtgtgtgtgtgtgtgtgtgtgtgtgtagctgggagtacaggcgcctgccaccatgtccggctagtctgtgtgtgtgtgtgtgtgtgtgtgtgtgtgtgtgtgtgttagagatggggtttcactgctttagccaggatggtttcgatctcctgacctcgtgatccatccgtcttggcctctcaaagtgctgggattacaggcatgagccaccacacccggccccccttatcgtatacttctatatgtgtatggacgcctatgtgcgtgtacgtaagtgtggagggagaaatggaggtgggtagttaaacaggaaagagtcttagttggaatttcatttcaagtctactgggatatggaggcaagaatcctcaggaaatccatcagcagactctcattccatgcatacatatatatatattcccttccttccctcccattacctccctccctccatcccctcccattccctccctcccatttcctctctccctcccttccctccttccctccctccctccttccttccttccttccttccttccttccttccttccttccttccttccttccttctctatggcttccagcaagtagattagccgtgtggaaactcagttttctcatttggaatattaggaaatccctaatttaaaataaacaccaaagtcctctaacatactgtaaaagtgccgtaaacttttgatctattctttcttcccagtaaggggaccctgctggtgggtttcctgaaggttctcacacctgtccaccaagagacttgaaattccaacagggaatctcctctacctactaaattatgcccctcctctgcccttcatacctgttgaatattataagaatgggtttatctataaagcaggtcagtcatagtaatagagctgatggttaggaaaggtggatagacagagagagattggatttggcttctgagaatgtggtaactataccaagcaagaggtagaaggcaggtgaactcatactcaccctattggaggacctaacaaataagaatgagctgcttttttttccccctaactctttcccatctggagtgcagtaagtgcaatcataactcactgtagcttcaaatgcctgtgctcaagcagtcctcccgcttcagtctcccaagtagctgggaaaggatgggcacaatggctcacacctgtaatcccagcactttaccaggcggaggtgggcagataatttgaaattaggagtttgagagcagcctggccaaaatggtgaaaccccatctttactaaaaataataataataataaaaattagccacgtgcagtggtgcacacctgtaatcccagctacttgggaggctgaggcaggagaattgcttgaacttgggagatggaggttgcagtgagccaagatggcaccactgtgctccaacctgggtgacagtgaaccaggatcccaccactgcacttcagcctgactgaccgagtgagactccatctcacaaacaaaaaacaagttgctgagaccactggcacacaccaccacgctcagctaattttttgatttttttttgtgacattttgttgcccaggctgatctcgaacccttgggttcaaaccaccctctccgtcagcctcccaaaatgctgggattacagttttgagccattgtgcccagccaggatgagctttaagaatgttgacaacatctccatctcctgggagatgaagcttcctagtgagactatcagttagagcattttcctgtggaagcatcaagaagacaagagtagactaaggcaagtgattgggtgatcaagacagagtggacttttcagtgcaggagacggtgctaggcagagttgagtggacagcgagaaggataagatggtgtctgacttggatgtgaacttgacactggggcatctctttggacaagtgaccatttagagactctcttgagagacagactcacaagcaggtaaaaaataagggcaaatggtttttatatattgtctccaagtcattctcagaaaagatggctgaccctgaacaggttttgaggaggacagtccttctacatgggtgtagtgtgatgctcgcagtttgcagtatacaaagtacacagttgtggtaccgacagggctcgcattggagattcgacatcaccatgtgcttttgtgacttgtttcgtggttgaaaaaagcaaaatggatcccccaaggctcttcctacccagacccaaatgggcaagcggggagaaagctccctgaatgcctttacgttagatgctgttgggattcagagcaggtccccaggagggagccaatctgggtattcattccttagctgctgtaatactggcttgctaatggctaccagctctccactctccacagacctgagcttggccaaatgggaactgctttgcctataaggttatagagccctcaagagaaagccagcagtcaatgactgatcaaggtgcaaaaagaatagcccatttgtcttaaagagggtgttaaagcaaaccaaatatggcttgaaaaggactgcatacttctatatttgagttcttgtggatgagctgtcagctagcttaatagacagacaagactgaaaatctaacttaagagtatgggcctgtgggccgggcgtggtggctcacacctgtaatctcagtactttgggagtctgaggcaggcggatcacaaggtcaggagattgagaccatcctgactaacatggtgaaaccccatctctactaaaaatacaaaaaattagccaggcgcggtggcgggtgcctgtagtcccagctacttgggaggctgaggcaggagaatggcgtgaacccgggaggcggagcttgcagtgagccaagattgcgtcactgcactccagcctgggcgagagagtgagactctgtctttaaaaaaaaaaaaaaaaaaagtattcgcctgtaacaatagctgagtcttggccaatcccagcagctgaacttcaaccactcatagactgttaagtgttcaaaaactgtgttcaaataaggcaaacgctgagctgtaaccattctagctttttctgtacctcactgctgatttctatacatcacttcccttttttcgtctataaatttgttctgaccatgacatatccctggagtctctctgaatctgctgggattctgggggctgcccaactcacgaactgttcattgctcaaactcctttaagtttaatttggctgaagtttttattttaacagggacaaccaacactgcaaagcctgaaacctgtggctcaggcccaggctagactctacttaagaccacaccctggccaggcacagtggctcttgcctgtaatcccagcattttgggaggctgaggtgggtggattatgaggtcaggagttcaagatcagcctgcccaacacagtgaaaccctttctctactaaaaatacaaaaataagccaggcatggtggtgggcgcctgtaatcccagctagtcaggaggctgaggcaggagaatcgcttgaaccgaagaggcggaggttgcagtgtgccaagattgcgccgttgtactccagcctggcaacagagcaagactccatctcagagaaaaaaaaaaaaaaaaaagaaagaaaagaaaaaagaagaccacacccttgcttggccacttccctgccttacatgacttatctccacataggtgacagtgactttggatcagagtgatagtaaccagaagtggtcacgatctggtatattttgtagacctcttaggaaatgtgtacattaagagactgggtctcgtagatctcaggtggaatcttcagcctctgtctagtttttgtgggggtctggccatgcatcacagcctagaaagtgcaggaacctgggctgatttcatggttcagtacatggtttcctgggcaacctttctgccccttgacatacatggataaagtcctgttgccatagtaccctcatatgggtgtatctcatctatgccaactagagaataacctgaggactggagggctttgggtatgatttgtcagaatccaattagcaactccaattgattgatgatggctgattcgtgggtagctatgaatttgcagctcttagctattctgtctgtaaggatgaagacagtctgaaaagtggctgactgctgtatggagtactctttgctcctcctgggtgaaaagggtcgtgacttttagcagctcttcttcttatcttaacattctgaatcccgtgttctaatgcattattgagggtttgtgaagacagagcaggggccagctctgcacccaacgtccctttgctagggtcacgcagaggtaggggcacagtacatagggatgagagtatggggaaaaaagggctgtgacctcagactgcttaggaaagcaaattggcagcaaagttccagctcagccacttaatcttcacgtgtccttgggcaagtcatgtgacctctgttagcgtgttatgatggtgagaatgtgtacactaggggtctcaaacgcagatgcttacctagggccagacagttaatgttatcagtcaaacatggcccattgctggtctgaacaacctgtgccatttctagatggccatgcaggaatgtagatccaatggtgccagattttatcgttttaaagaaaatatggatattttgatttttttttttgtaaaatgggaaatctaattctcatttttggaaaacactacctgaccatgtaaagccacatctgtgactcatgggcaaccagtttgcatctttgatgtttatttttgtatcagaatccgctggtgctggctaggctcggtggctcacgcctgtaatcccagcactttgggaggacgaggtgggtggattacctgaggtcaggagttcaagaccagcctggccaacatggtgaaaacccgtctctactaaaaatatacaaattagctgagggtggtggcaggcacctgtaatcccagctacttcggaggccgagacgggagaatcgcctgaacccaggaggcggaggttgcagtgtgctgagatcaaatcactgcactccccactgggtgacagagcaagactctcgtcccccacaaaaaaggaatctgctggtgctaaccctaagcccccaggggcgtttaccatttcaaggcattctgcctcaatttccacaagtgtcttttggcctgaggtctttctggagcctctggagccccctttgcctacacagatgcttcactggaaatgtgagggaattaaagcaccctttccccagcaaccttcaatgggtaactcaggatttgctttataaataacccagttttccttgcttctcaagtgggataactcatgattaggggttggcaagtgtttacagtaaaggaccagatacagagaatattttaggatttgggtgccatatggtttctgtgataactgctccactacatccttgtagtacaacaatagccatagacaataacatatgggtgtggctgtgttccaataaaactttatttacaaaaatagtcagtgggccaggtctggccagctggccctgtactgggcctatattgcttatctgtgccataaagcaagctctacgcttattgcctgagttctgtgatgaaaataagctgttacccactatggtaactggcttggtaatgggctttctgcatagcctgttttctcctccttgttttacatctcccatccctactgtgttttctaagaaccttctttcataaaagcttcttgcatttaaaacctgttctccaagaacctttttttcatttttttgagggggaaggtagtaggggttagggtctggttcagtcacccaggctggagtgcggtagtgagatcacagttcactgcaatctcaaactcctgggctcaagtgatcctcttgcctgagtctcccaaatagctgggactacagactcactccactctgcccaactaattatttttaaaattttttgcagagacagggtctcactgtattgcccaaggctggtctccagtttctgaatctcaagcaatcctcctgccttggcctccccaagtgctgggattataggtatgagtcaccacatccagcccagaaacctttcaaacgttgttatttggctttatgtttgggagccatttgaatgtgtatttgaatcccagcctgaccagtttcctagccctgttgggttgagcaagtcccttcacctctctcctggcctcaggctcctcatctgtaattgagagaaggtctgtgctttctcagagaatagttaagaggatttaatgggataagatctgttaaactcttagcacataacctggcccatgttcaaggtccaataaatcactggctgtgatttcaactctttatgtgaaggatgcagtttatggctgtcttttaggaattggccaaaatgatgagtcagaagctcttcttattttcctgtttttcaccttgattttggagtaaggtcacccttcccacaggtagggtgtgatttaacagtctttaagagataacattatgaagacacctgggtgcctgagccttttgcatcttaatcgctctccctggtttcctaagagaaggaacagatgggagaatggagactggcttcaactggccgtatttcatccggctgagaacatatgttcttgggaaggatgtaggaacaccctgaaatagagcgaaaaagagatgtgagatgagagaaatcctcctgaaacatgaatggacttgagttcctgttgcccttccttgcagcttgctgcctcctgccttgcgtagaaggaaaactgttcctggttccagacagaatggatttaagttctgttctatcgttatctccttgggaaagctatatgacttctctgagcctcagtttgctgaaatctatttataaacgtttacttaggtggctttcttttttagctattcatctgattacattttctcttgctctttttcattttttggagatggagtcttgctctgtcgctcaagctgcagtgcagtcgtgcaatcttggctcactgcaaagtccacctcatgggttcaagcgtttctcctgcctcagccccccaagtagctgggattacaggctcaacccaccatgcccagctaatttttgtattttttaaatagagacaggctcttatcacgtttgccaggttggtctcaaactcctgacctaaagcagtccagctgccttcacctcccaaaatgttgggattacaagcatcagccaccatggcctggcctacatattctcattttcttctgcggtttgagaaggagtagaaaacaatacaaaatagaaacatgcctttcagccaggcatggtggctcatacctgtaatcccagcactttgggaggctgaggtgagaggatggcttgagctgaggcattcaagaccagcctgggcaatattatgagaccatatctgaaagaaaaacataaaataaaaattttaatttaaaacaaacaaaataaagccaggtaatggaaacaaactctgacatctttctgctacatgtccttttctttctccctttctttttttttttttttttttttttttttttgaggctgagttttactctgttgcccaggctggagtgcagtttatctcggctcactacaacctttgcctccttggttcaagcgattctcctgcctcagcctcccaagtagcttggactagaggcgcccaccaccatgcccagctaatttttgatttttagtagagacagggtttcaccatgttggccagactggtcttgaactgctgacttcaaatgatctgctcgccttggcctcccaaagtgctgggattacaagcgtgagccaccacgcctggcgttgtgtcagtcttatcagaaactccctcctccatcatttgactatgttttgaaatgttcactactccattcaacaaaaaatgcccatacaatccagaagaggaagcgtcttttctgataattttagcctaaatcctagagagatgatttgatttgtgtcatcagtcttctgtccgtctataaaccgattacagtgaccagagggacagcatcctctgactgtcaatgaggaagggagagtgggttataccatcctacgttgtgtggacgagttgggttgctgtagaatgggatagtttgagacagtttctcaaaggaagggattctcgattaagaaaagaaattcgactctatggagtgtgattcgtaaaagggagagtaaggacaaagctattgtcaaggtttctttatcctctgaaatgtaattattgactttttttaaaacatggatagggatatgtaactgatgccttcccccacccccctgaaaagtctaaggtctagaataaaagctacaaaagctaaattccaggatatagaaacaagcctataaaaagcaccttcatcaacaagaaacaggctcaatttcacaaaacaaacccataaagggagaagaaagacatgtaccagttagttttcaatcttcgctcaccttttgttccttcccttcagtgaaacaggccttgctgatgggttttactcattccatggtgtattagctggctaggggcaccataacaaaataccacaggctgggttgcgtaagcaacacagatttgttttcttacccttctggaggctggaaatctaaagccagagcattggcagggtctgtttcttcttgggcctctctccctggtttactgatgacgatcttcggggtgtgtcctcacttggcctttttttttgtgcctacgtgcatcttggatatctctttctctttttctaaaaatggcagtcaaattggattaaatccccaaccttatgacctcctttgaccttaattacctccttctaggtcctacctccacatatagtcacgttaggagttaagacttcaactaggaattttgaagggacacaattcggttctgggaattgttcattttcttctgaattttttttttctgtgtgtgtatgagcagaacatctcttcacccggacagaatgcaattccaagcccctctgttgctgaactgttctccctttaaaactgtcttcatcctcagcgtaggtagctccttccctgagtacgtttttttgttgttgttgttgttgttttttggtacagagtcttgctctgttgcccaggctggagtgcagtggtgtgttctcggctcgctgcaacgtctgcctcctgggttcaagtgattgtcctgcctcagcctcccgagtagctaggattataggcatgcgccactacgcagaggtaatttttttttttttttttttttttaagtagccatggggtttcaccatgttggccaggctggtctcaaactcctgacctcaagtgatccacctgcctcagcctcccaaagcgccgggattacaggcatgagccaccatgtccggccagcacattctttgtctttgcagaaccatgctcccctctgcatctcacagcctcatgtacacacccattgctttatcccatagaatcacagttacttgtgtggatctctgtccctctgtccacccaccacccactacccactacaccagcatgcactgagaacagggtaatgattcagcagtttggtatcctagtgcctggcacagagtagatgtttgataaatgtttgatgacctgaattggattgaagctgaacaaatagaaattgcatttggccattatttccaggcttagaaatgaatgtgtgttaggagacttatttccatagcattaagataatacaatatatatgcaggtgctgtgtgccttatgtagaagctctaaatctctctcaaggatgcagaaagaggtgaggttcaggttgagttgaagaatgaaaaaagagttgcttaggagaacaatgctgggaaagggaggagatttgcggccatgtaatatgggtaggtgaatttcacttaatattgtggcagaatgctctatcacaacagatgctaaaggactacatttccttcctcagctctttcttttttctttctttctctgtttttgtctctctttctctctttctgtttcttttcactctttctttctttctctctttttttttgacataggatcttgctctgtttctcaggctggagtgcagtggcatgatcacagctcattgcagcctcaaacttctaggctccagcgatcctcccacctctgcctctcgagtaggtgggactacaggcacgtatcaccatgcccagcaattttatcttattttttgtagagacagggactccctatgttgcccaggctggtcttaaactcctggactcaacaaatcctccagcatcagcttcccaaagtgttgggattataggtgtgagccaacaggccctgcctaacttttttttcttaaccagttaagaaaaggcatgtgagtgaaagaaacgtaatagagtcacccatcttctgaggggtcagtttcagctgtctgtaggctggatactggagtcattgtcattattgtctgagggtattctggctaactctttctaccaaataaatcaccctagtataatggcttaaaacaataacgtacatttattttacttaagaatctcataatggagtcagctcacttaatcaggagcttttatatagttacatagtggctgagtctggggtggttttttactcataagtctggcctgggaagactcatagagtaggagcaggaatattggggactactaagatctctctttctctccttgtaccttgttctcatctctccatgtggttttttctcatggtgatttcagggtagtcagccttcgtaagtatagtatcacttttgcctcatggattcagtgagtcacacacaaatgtccacccagattcaaggagagactccacacttctctcttttttctctctctcttttgagatggagtctcgctctttcgcccagactggagtgcagtggcataatccaggctcactgcaacctccgcctcctgggttcaagcgattctcctgcctcagcctactgagtagctgggattacaggcatatgcaccaccatgcccagctaatttttgtatatttagtagagatggggtttcaccatgttggtcaggctggtctcgaacacctgatctcttgatgggggcatggcaacattaccaaaaagcatattaacaggaaagataattgtggccactgttgaaaaaagtggtttctcatacgtggttgatcagatacatgtacctttatctttctgaaaacgattgctttgttccttcatttaatatttccccacaagtgcttcgcagagcacatagtcgttgtgaaggctctatgtggcactctgagagaaggaatccttcactgctatcactgagatgaaagaaaaagagtaggacctttccctgctacgtttctgtagatttctggttctaaaagaacaaacttaaaggtaaagctcttgtgtgtgcaaaaaagtagaactccagttttgacaaagtagttaacttagacctgttagaaagtaaacttgttgggcatggtggttcacacctgtaatcccagcactttgtgaggccaaggcaggaggattgcttgagcccaggagtttgagaccagcctgggccacgtattaagaccctgtctctacaaaaaattagcaggtgtggtcatgcacacctgtagtcccacctacctgggaggctgaggtaggagaatcacttaggcctgggagatcaaggctgcagtgagccatgatcatgccactggactacagcctgggcaacagagcaagactctgtctccctcctccctccaaaaaaaagaaaagaaaaagaaatgaaaaaaaattatccttggtagggccgggcacggtggctcatgcctgtcagctcagcactttgggaatctgaagcgggcggatcacgaggtcaggagtttgacaccagcctggccaacatggtgaaaccccatctctactaaaatacaaaaattagctgggtatggtggtgcatgcctgtaatcccagctattggggaggctgaggcaggagaagggcttgaacccaggtggtggaggttgcagtgagcctattgccccattgcactccagcctgggggacagagcaaaattctgtctcataaagaaaaaaaaattgtcattgtttgaactatacatctttacctcacctggcaatgtatattaagcattattatttctatattgcaggtggcgaaaccaagccacaaatacaaaaacaaagaaggcttgaaggtctgcgactgagtagaacttaggtgtatgtatgcctctttccactgaaggaaaaataaccatgatcattcccttatattttgctaagctgggtatgtgtccggtgctctcagacctgttacctatggtactctttaatcaaataaaaccttaagttcaaacatatacaccgaaataaggcagaactactctgaaacagaagatttatggagtctctttcaccagcaacttaataacatagagatcacaatgtttcccatatacatgattttttttgttgttgttattgtttttttttgagatagagtcttgctttgtcgccaatgctgggtacagtggtgcagtctcagctcaccgcaacctccacctcctgggttcaagcgattcttctgcttcagcctcccgagtagctgggattacgggggtgtgtcaccacacctggctaatgtgttgtatctttagtagagatggggttttgccatgttggccagcgtggtctgaaactgctgacttgaagtgatccactcatctcggcctcccaaagcgctgggattatgggcatgagccacagtgcccagcctcacacgcacacgatatttacacatacatacatataaatatacatattttatatacataatgggtgttggtgcatttcataggcttgtctttgaatatcaagatttcaaactggtttgcaactgatagaaccgagaaaaataactcttggatacctgacttgaatctctctttgcccattggcggccaaagccagttgttgacgtaaagttttttttggttgttgttgctaattgcatctctttcctgacagaggagtaacctcttatttacaaaagtgtttacagttttacatacccgataggtcttacgcacatgtcaagacaaggtattgagccaggcgcatatacccctaatatggcaagagagagaacttctctgtcaacaaggcggtaataaagtgtaacagacaacacttaaggtgtcagtcacctttgcaggcgtattggaagttacaggttagatctagtggttttgatttattttgatgtcaaaaagttactcacatatttatgtaaaaagagagtggcaaatcaacggggtgttgattttgaaggtgctatgtaataaatcagggtagcgattctggtcatctcgccaattttgacagtgagacttgcttatttatggcgttttaaggtctgaggagttgatttatagttacaataacggtcttccatccattagtagttccggcatgcatagatgtgtccctcgtttgcatttaatgattggcatttttaaaattacacgactataaattgtcaagcaggaacaaaactcagtttaaaacgtaattttgttgaaacatttgttttaataaaaagggggtagttgggataaaatacatgccaactgtcctcacctgttgtccaccccaatgctatattaattatgatcctatatcctcctcattatgtagatggagaaactgaggcaaaaagaggcatgatttttctagggcagttctccaatatcaggtcattgcatttaggggctctcttaagtgcaggtgcccaagtctagccataggtgaggagatgagccccagagaacatgccctccagaggatcttaaatcatcacctgacttgagcacccagtttgaaggcaggtagaagggttcgaacctcatttctgtggattagcaactttataaccttgggcaagttgccttttttctatcaattcatgtgtcctcaaataaagaaaggtaattatcctaaacttattaggctattttaggcatcaaatttaatatgaaggctgggtgtggtggctcgtgcccataatctgagtactttgggagactgaggcaggaggattgcttgagcccgggagttcaagacaagcctgggcaacactgggaaaccccatctctacaaaaaaaaaaaaacacacaaaaaattagctgggcatggtggattatgcctgtagtcccagctacttgggaggttgaggcaggaggatcagttgagcctgggactgagatgtttcagtgaactgagatggcaccactgtactccagcctgcgcaacagagtgagaccttgtctgggaagaaaaaaagaaaaaaagaaatttaatctagaactccctagcgtacgattaagtaagttatcaataatttttttctctttcacctttaagccttccccacatatgcacacacacacacacacacacacacgtgcacatacacacactcaaaacccctgtgttctggacttactgattaattttatgagaacgttgttctgtgttccactggttagaagtacttaaaatgatcacattcaggcaagatatgaatctcacggaattaaattagctcattgcttgcttttttcaaagggcagttttactcttctctgtgaacatcttagtgtaatattggttttatatgctggtgcattgtattgcccatgtgacagcaatatgagagaaaattaatagtatttttcatcttttgctacaccaccactttatttatttaggtatgtatgtatttatttatttatttatttatttatttttgagagggagtttcactcttgttccccaagctggagtgcagtgccgctatcttggggctcactgcaacctccatttccctggttcaagtgattctcctgcctcagcctcctgagttgctgggattatagatgcatgccaccatgctcagctaaattttgtaattttagtagagatggggtttcaccatgttggtcaggctggtctcaaactcctgtccgcaggtgatccaaccaccttggcctcccgaagtgctgggattacagatgtgagccaccagacccggcctccatcactttttgtaatgagggtgaggacacatttttgattaagtgagttatcttccctttagtgagttaccttccctttgttttgcttatctgagtgagggccacagaggctggagttgtaaatgggacctggacagattgctaagtctgggaaaagatggaatgaggaaggatgagaatggagatgggagtaccacacaggagatcgtgcagagaggcagaggagaaggactttgctttgaagagtcaggcacaaagagctgggtgaagagagtttttagagagtcttgctaaggaatccccattcgtcatctcccacattaattattccccaaagtattttgctgctggagttcttcagtgtcaagactggactcaaggggaatgagcaggctccgctgtcttccagtgaatacttgaatttgtcaagagtaagctacatgctgggctttgtcatcgtcttctcaaagagatggtattgaagattttaatttcagagtaaacctggagtggggaaggagaattgaaacctaagggccagtgggggcagttgtacctcttgcctctggtcaggtgtgggagacagaggagtgagtggttcaaatccacagcccgtcttcccttcttgtgcctgctatttgtggctgatgttgctccagttatctattgcatcatatcaaaggcatttgctctgcttaatgcctttagaaaacaatttaatatcatcttcgatggtcttgtggtttgaccaggcacagatgggtagataccgcttggggtatctcatgtggttgcagacagagagcagctggggctggagctatccaaggatttggatgggctgggtattcaaggtgacttctttcctcatttgtctggcatctgggctagttgtgttaccaggaaggggtccagatccagaccccaagtgagagtttttggatttcacacaagaaagaattcagggcaagtctgcagagtaaagtgaaagcaagtttattaagaaaggaaagaaataaaagaataggcatattccatcggcagagcagcccaagggctgctggttgcccatgttttttggttatttattttatttttttatttttatttttatttatttatttatttatttatttatttttgagatggagtcttgctctgtcacccaggctgcagtgcagtggtgtgatctcggctcactgcaagctccgcctcccgggttcacgccattctcctgcctcagcctcccgagtagctgggactacaggtgcccaccactgcgccaggctaattttttgtatttttagtacagacggggtttcaccatgttagccaggatggtctcgatctcctgacttcgtgatctgcctcccaatgtgctgcgactcacgctcagccggttatttcttcatgatatgctaaacaaggggtggattattcatgcctccgcttgttagaccatatagggtaacttcctgacgttgccatggcatttataaactttcaccgtgctggggggagtgtagcagtggggacgatcagaggtgactctcatcaccatcttggttttggtgggttatggcatctttactgcaacctgttttatcagcaaggtctttatgacccgtatcttgtgccgacatcctgtctcatcttgtgacttagaatgccttaacctcaggggaaagtagcccagcaggtctcagcgtcattttacccagcccctattgaagatggagttgctctggttcaaacatctgtgactgttgggctgggataccttagggaaagccaggcatctctcttttcacacagcctctttgtgtagttagcctggacttcctcctagcgtgacagttgcagattagtcagagcccttaaatggcccctcccttttccatgcaggacatctgtgacctagcccgagaagtcacacagcatcacttccagcatattctcttggttacacaggaccagctcctgcatagggtgggaagggactactcaggggtgagaataccaggaggcatggttcatcgaggggccatctttggagactagctctcatggatgttaaaggcagcggcttgtgagctgcagaaatgggtgaccggattttgcacgttttttgagaagcaaggggaggggaaagttaacttaatatgggagggctgcaaaagttgaggcacagcattttttccagtaagcttggccgtctttgctgagccctgcacgatgcagccgttagcaggctgggcaatgctttgctttatgaggcaattattccaacacactctattcaaaatacacattagaacttaaccttctgaatcctcaagtagcatttttatcacccaccattagaaaagagatggagtcagcatatttccccccctttttatgatcgggtatcattaataaagcattgggcaaggaccttctcgcaattcctcgggataatttgtgacacaaaaggcgttctgtgatacaatggtctgttgacttattcaataacagaggaaacacatggattgttttaaaaaataaagccaaggaattaaacaaccaaacggaatatttcctttcaacaatgggaacgcacgctcagagtagggatgtgatgctattggctatgcataactagaaatgggaagttaatatggaatttctaattggggtcacatgctaatgaactccctcttcatgttagttttatgccgcttcagaaatcttttatcatatgcttaaaaatttatgggcagaaacattaatgaaaatgaggcgtgaattggaaatcgtgtcattatggagatgagggtggcccggcattgctgattttcaaggaggtatcttttattacctttttttgagaactgagaaatgatacaggtaaaattaatgacaaggcgtattctccatcctgacataggcagcatggttctatgtaaagttataaaagtttgattttaataagattttgaattaattataaggagaatattaatcataatggacagtcatttttcagaataaaacttcaccatctaagtaatattatagttcttaagtgcataaagataggcattttcttttttctatcggctttgtcttttcagaaattaaaatccactttttcagactacgatggattggaaagcctgggccttttcatctgtgaaatactcgctcgatttcagattgtacttaaaaagtacctctctttgctaagctcaggggacaggcagattttgtgaggccatgtttatgtggagggagccagtacagtcatattaaactttttctgtttttaatctctcagaaactattgttttcaatacatctgataaccgtcacatttgaatggattttcagaaagtcgttttgtggggtttctaagagttgtacttcacgcttatcacagcagggatgaaggcagaagttggaataaaatcttgtttctaggcctgatctcaagggagtatctttttttattttttattttttaccctctctcattctgtgtgcatttggacccaggtctcagtgagtctgtggcaaagcaggtctccctcaaggctgaacaggcaggcctctgtaacaactgttccagcactgactgagtggttacgttaaatattaaaagctgaggctgggcgtaatggctcacatctgtaatctctaaacttggggaggctgaggtaggcggatcacctgaggtcaggagttcgagaccagcctggccaacatggtgaaaccccgtttctaccaaaagtacaaaaattagccgggtgtgttggcaggcacctgtaattccagctactcgggaggctgaggcaggagaatcgcttgaacctaggaggcggacatgtagtgagctgagattgtgccattgcactctagcctgggcgacaagagcgaaactccatctcataaataaataaattaataaatgccaagaaagccagtgcccttaaacaaaggctgaaatgtaacaaaaaccccccaagagttttgcctaggcctttcctaggccttgaaacatgacaagataataaaggaattcttaacaggacccatttaggattaaacaagtgtattgggggtctgaagaaactccccaggtcttgagaaataagttttttgggtttctaaaggaactccccacacctccatgatttagcaggagacaagagaaggataatcatcccagcacctggacccatttagattaagtaaatttactgaggctgcagaggaaggtcttcaggcctcagatcttatagatgagaagttaatcacttacgtctttagacgaatgcacacttacaggtagacatatagcttagaagctgtataagctctggaaaactttctaattttaagttggtctggtgatatttcccaggccttctccctgtacccggttacaggaataaactcccttgtctcccagttctcgtgtatgttgttattgggccacgagaataagcagcctgaccctcagtttggtctgggaacaactcttcaggagtcacctctttcttgtatctgttcccctgtgcccttcttacctccttccaaactctgcagaggaggcccccgcctgccttttttcctgccttctctccttccttcctctgttctggagacaggacatactcttgcaggaccagcatctcctgtctctgacgggcccactctctgtactgtctctacctgtcaccactgcaagagggtacagaactcagactttgagctcttcaatcatcatatccctgactgtagggattggcccagggttgggtacctgacccaaacaaagtcaaagagattaaatgcctcaggtccgggtgcagtggctcacatctgtaatcccagcactttggaaggccaaggtgggcggatcacttgaggtcaggagaccagcctggccaacgtgatgaaactccatctctactgaaaatacaaaaaaaaaaaaaaaaaaaaattagctgggcatggtggccagcaactatagtccagctactcaggaggctgaggcaggagaatcacttgaatccgggaggcgggagttgcagtgagccgagatcatgccactgcattccagcctgggcaatagagactccatcacacacacccacacagacacacacacgcaaaagaaagaaagaaaaaagaaaagaaagattaaatgcatgggatagtaagctgataggatgtccctgagctgctgatggccattttctcagaacctggggagaccccaccagaggagaggagagctaagcaatgcagacagtcctggccatgcaagtggagcccctgggtccctgcgtccactccagaccgtgttcaaactgtagtaatttcccagcgctgctatagcaaatagccatgaacttggtgacttaaaacaacaaagattgttgcttttgttatcagaaaggggtcccgatcaagatcccaaaggagggttcttggaaattgcagaagaaagaatcagagcgagtccgtaaagtcaaagcaagtttattagacgagcgaagaaacaaacgaatggctactccataggcagagcagctctgagggctgctgattggctactattatggttatttcttgattatatgctaaacaaggggtgaattatgagttttctgggaaaggggtggggacttcctctggaggtgaggttccttcctcacctttagaccatatagggtagcttgtgattgtttcacggcgtttttaaattgtcatggcactagtgagagtgtcctttagcatgctaatgcgttataattaatgtataatgagcagtgagagcaaaccagaagtcactttccttgccatcctggtttgggtgggttttagctggcttcttcaccacatcctgttttatcagcagggtctttatgagctgtgtcttgtgcagaccttctgtctcatcctgtgactaagaatgtctaacctcatgggaatacagctcagtagctctcagcctcattttacccagcccctattcaagatggagttgctgtggttagaaggcctctgacactttcatgattctgaaggtcagaaatccaaaaatcaggctgtatccaggaccatatttcctctgaagtcttgataggagaatccctcctttctacttccaaatgctccttggtttatggcagaatgactccaactctgcttgtttgcacatggccttctttcctaggtgtgtgtcagacctccctctcctttctcttacaaaaagactagtcattggcccaccctaaattcaggacaatctcatcttgagatccttagcttaatgacatctgcaaagatcctacacattcataggtagcaagggttaggacttcgacttatctttttaggagataaattcaacctgctacaacctgtgcaactttttctgttacatatatgacatttcccctgataaagcagcctggtttaatatagccgcagtgtgtccctggcatcctttcttcttacttcagaagctcagaggtcaaaagcaccttaaagttcattcaattcaacctgttaacatgaggcttggagccaggagctcatgcctacctataatcccagggctttgggaggccgaggccggtagattggttgaactcaggagttcaagaccagcctgagcaacacagtgaaagtcagcctctacaaatagtaaaaaattagtcaggagcagtagcatgtgtgtgtagccccagctaccttagaaggctgaggtgaaaagatcacttgagcccaggagatggaggctgcagtgagctgtgatcatgccactgcactccagcctgggcggcagaatgagaccctgtctcatggaaaaagggaaaaaaagaaaagaaagtgagccttgggatggggtgatttgggtgggctggggtggggttgttggatcttgctttgatcgctcagcagtttgcatggcaaaggagaaaaagaatgctgactcccagccaagaatcagctctgtaaaccttggatttgaaacacagtcactgtgtgaactgcccaagtcaaatgctccaggcccaccttccctctcctttactgaggaagtccgagattcacctctgggtgcaggactctttggggttctggctggtagttgccacccaagcctagcactgctattttttttcggagtccgtcatgccataattttctgtaaagaggtagcatcaaaagcagcatttgtgttggcaaaaagctagcccatcttagggtctttcaacagtgacttttttttttgttgctcttgttgttttaaaataagtggggttctcagctttgagataatgggaatgaaatcgaacctctatttttagaattaaaacacacacacacacttgaaataaaaatgtgttgttggacttctaccaaatggttggtgacaacataagttatctcatgctgtctgaaccactggtcagtaatgagatacatgttagaggatctgatttgtttgcaaaggagtgaatgactcacttgcaatgtaaaatgtacattttggctgtgttctgtaggatttcaactataggccatcctagaaaagcaaaactgtggggatagtaaaaagatccaggggtgccagagattatgtgggagggagggatgaagaggcagagcatagaggatttatttatttattttattattattatttttttgagatggagtcttgctctgttgcccaggctggagtgcattggcgcgatctcggctcactgcaagctccacctcccgggttcatgccattctcctgcctcagcctctcgagtagctggggctacaggcgcacaccaccacgcctggctaattttttgtatttttagtagagatgggatttcactgtgttagccaagacggtgtcgatctcctgacatcatgatccacccgcctcggcctcccaaagtgctgggattacaggcgtgagccactgcgcccagccccggatttatttatttacctatttttattttcttttttcaacatgaagtcttgctctgtcacccaggctggagtgcagtggtgcattctcggctcactgcaacctccgcctcccgaatcaagcgattctcctgcctcagcctcccaagtaggtgagattacaggcatgtgccaacatgcctggctaatttttgtattttttagtagagatggggtttcaccttgttggccaggctggtctcgaactgctgatctcaagtgatgcacccccctcgacctcccaaagtggtgggattataggcatgagctgttgtgcctggcagcatagaggatttttagggcagtgaaaatactctatgtgacactgtaatggtggatctgtgtcgttatatattggtctcaacccacacaatatacaacatcaactgtgaactttaatggaaactctgctctttgggtgattgtgatgtgtcagtgtatatggttatcaactgtaacaaattgcacctctggtagggggttttgttaagggtgaagctatgcctgtgtggggccagtgagggtatatggggaatctctttatacttgctgaattttctgtgaacctaatactcctctaaaaaataacgttagtttgaagaaaataaaaatacattttgacaaactcattccttcccaggatttgcaaaagctgatatcacaaagggtgtctctgatgaggtaaggtccggaagcacttgtccctgcaattcctgttggagagcctttaagaacttctcagcagggctgtttgaaaagcttaaagctaagaaaggcctttgtctaaaagagcctggttgaaatccctgctcccagctccttgctgtgtgaccctgggcaagtcactccttaacctcctccctgacttaagccaggctaatccccatctctgcggattaaaggagataacagacgccaggcacttagcagcgagtgtggcctatcctacgtgcttcataaatgatggtggaaatgattatgattgttgctttattatctctaggttctcctccttccctggagtctgggggtggcagtgttatgtagcttcttcctaggtcatgaggtgggtttatctagactctgcctccatggttctcggggccaagggcaactgtactgctgcagattgctgtggtggtagattctgggagaggtgggtggtgtaaatcactaatgaaaaggaaagcattgctttgcactcatttgggtgtaaaaaatggagaattcaggactagaatgaccaaacataaacaaatccaatttcctttttcttttgttgtgtgtgtgtgtgtgtgtgtgtgtgtgtgtgtgtgtgtgtgtgtatgatggagtcttggtctgtttcccaggctgtagtgcagtggcgtgatctcagcttactgcagcctcccgggttcaattgattcttctgcctaaacctccccagtagctgggattacaggcgtgcgccaccatgcctggctaatttttgtatttttagtagaggcagggtttcaccatgttggccaggctggtgtcaaactccggacctcaagtgatctccccaacttggcttcccaaagtgctgagatgacaggcatgagccactgcgcctggctgacaaatccagttttcactgagttctggaaaatgtgagtccagtgactatattatctgaacttaaaaagtagatgtgattggctccaaatgggaatgataataatcatgtttattatcctggggtgctttctccatagcaagtactcacttaggtcctgttcattagtcagtcttttaatctgtactgaaataggtgctgtcgcatccatggggataaggaaactgaggcatggggggattaagttgtttgcccaaggaaatgccgggaaatagtagcagagttggcatttagcatcgggggatccagtgccaggtttttaatggattcacttagggctttggaatggggagtaaatgctcaaaatggagcgtatcatagaaaatcggagatacgttttcttatcttagaaataagaacctggactttgaaggtagtgatttttactctatcacggggttctcaaccatagactgggggcctaaaaagcacataaggcatggttccactaaaaggagacatttacgctcttgccagaggcttcctatctctctgagccagctgccttcccctctctgtcccagcttctcacatagggccacatccagggccaaggagggtaaaatgagcctcccgttgactgggcactcctgcaggcactgaggataaaatgggagtgaagggagagcaagttttggctctcagagcacacacagtctagtttgaaagaaataataagtcatggcaggacagccaggaggaaggggtacatgaccctggggggtcttccagaggtccctgggcgaggtggaggggtgagctcattctgccatccacggagcatgatcacagtagcttattaggtggcgagaggggcggacgggggaagactgagagagatggatcgagttatgcaatgtctttgagaaagaatggaagatacgttagttaaaaataaggccaatggactggagaacatggggtcacagagcaagaggcaaggtggaatgatgttgctgttaggcatgagatagtgcaagctgggctgaagtgaagcgaaattgatctaaattacacctgtgatgagaagtcactgtaactctgcctgcctctatctgtctgtctgtctatctatctatctatctatctatctatctgtctgtctgtctgtctgtctgtctgtctatctatctgtctatctatctatccatccatctatccacacatccatctatccatgtatccatctattcatctctccatccatccatccatccatccatccatccatccatccatccattggcctacctattatctatttgcctatatagacattcatccatcatctacttatacatccctcttttatttctgtatgtacctatctacttatctgtacgtgcatccaccctccatctatccatatatctatacattcatccacccatcattctatttgtctatacactcattcatccattacttatctatttaaacattcatccattcatcatctatccatgtgtttgtacattcacacatccattttctatctatacattgatccatctctccatccatcatccatttgtttatacattcatctaccatctgtctgtctgtacactcatcatttcatcatccattatccatccattatttatgtatggatctgtctatacatccatccatctaccagcagtggggttggctctcatgttccttgagcagggaagagattagagggagctgaagcctcatgggaaggccagttgaagccagttccaaaaagtaatgacatttggagctaggattaggatgggggcagtggataggataggagcagtggatagacgttatttcagaagaaaaacaggaaccctttcatttgctgaatagactgacttgcttatgtgtttctcctacacctctttacatgtcatcagcttctctagttcaccctgcccctcagtactcagtacacttcgctgttgaacagcgaagtgtgtgttcagtaattatattgctcttctaagggcctggttcaagacattgaacacggtaggtccttggtcaaatgggtcttctttaattgtttgtgcccatctgcccgtgcagctgtgggaccctggggaatgtgtgggaggcagcaggtgaccaagccctgaaactaagaatgtaaggggacagggtttagaagcaaccagacatacttcctgaagaattgggttgtcagtctgaaaaaagatgccccaaatcactgctccaattcctcccaccaactgttcagctgccccgggtgccagaaggataaaaacgctcggggagagaggttggcagttctgctgatgacagcgggaaggtgctgcctctgctcttgtaaggaagccatgtgggctcacagtgctgggaggtgcttgggtctgaccctcggatgcatgagagagccactggaatggatctgtggctctgaacttgcaaccccgcacagacaccaccgctagactcggcctcagggtgggaaccccctctccgtgggtgtcctttagctctcttttcagttcagagtgactgacaggcttttctctggttggtgcctttaactcagcaaagacccccaggcaagctgtcacttggagagaggatatttgaaaagcagcctggtgaaattagcagcgatggaaacaatgcaaacatttcatttcttttccttcttttttcttcacttatttttcctccttcatcaggcattttaatactgtctttttttcctggtctcatctcacgcagctgaaataaaagcatgctgcctgacgctatccggaccgaaaaactgaggcttctccctgctttggctgaagttctcccatagccgtttcctgagagcagtcttaaagatttagaagaggaagtctggcagggaaagtctcagaatgatgtgaaggtgtagatgatggattcctcccatcctgtcagtttcagtttgcatttacacaacgtgccaccatcccacaggactcgaggaagcccacaaggtgctggcctcccatcgagtacacatactaactcctgttctcatggcagctggcctcatctccctcctctccctcctctttgcctagtaccttgtaaagtagctgattaccttcattagctcagaatgtattaatccaggtttttttgtttttttttttttaaagaaaacctgcaggtcttctggcagctgaaggctactcttgactcttggctctgtgtcaggattcacataataagctcattagaggaaagttcccagtcccacagtgaccagattagtgggtgctcaggatgtgtactttgagggaaggaagatatctgagcaaagtcagaatgttagaatctcccactttttttctcctgtagttaatacagttcccatccgagaggtgtcaagagcacttacaggagagaccttctcctaatgcattggttaagagtactgcgtgtgaacttattcagtccacttttagctgtctgtccccaaaataggtaacttaacttctcttaactcctcactacattcccagtccttcacctgttatgtgagaatgataatgaagttcttgggaagaccttggagattatggattttaaaaatgcttaggcagttactcaacgaatcctatttagtgcggggtcaggattagggtgcattgagggaggcagtgtcatgcagtgattccatatttaacttaaaaatttggatattttgttcatgatgcatatttcacaatgaataattgtgattttgtacaacattacattcaaataaggtggccgggtgtggtggctcatgcctgtaatcccagcacttcaggaggccaacgtaggtggatcgattgagctcgggagtttgagaccacactgggcaacaaaatgagacctcgtctctacaaaaaataaaaataaaaaaaaaattagttgggcattatggtgcatgcctgtagtctcagctactcgggaggctgaggtgggaggatggcttgagtctgggaggcggaggttgcagtgagctgaaatagtgccacctcactccagcctgggtgacagagccagaccctgtctcaaataaataaaaataaggtaacgtatcttaattgctgagctctctggtgcccccttcagttgtgttgcctcatcctcgttctggccctaattctgagtgtcagccatgtgtgaaccattgtactaattgatgggtatgcaatgttgtgtcacttgagactctttcagtagtctgtcatagatttcccacatacagaaatgtcacacaataaggacacgtgttattttatgtaatataaagtccttacaagcctgggcagcatagcaagaccccatttaaaaaaaattagatgggcatggtggcatacacctgtagttccagctacttgggaggctgaggcaggaagatgatttgagcctaggggttcaagactgaagcgagctatgatggtgtcactgcattccagcctgggcaacagaacaagactctggggggaaaaaaataaaaaagaaagaaacaaaaaaccccaaaatcaaaaacccatgaaaaaccaaaaaaaaagtcttaacagaataagaaggcagggtactttcaatgacccaacaacatcatcacctagactatttctgtcctttcattttctcagtatagtggtttgacacttaggtttgtcttttctcagttgcaagacaggtagtgcagttcccttaatgtttcactgacttagtctgctcaggctgctacatcaagataccttagcctgggtaatgtatcaacaatgggagtacattgctcacagttctggaagctgggcattctaagatcagagacatcagtagattcagtgtccggtgagggctgagtctctgccttataactggtgccctggcgttgtgtcttcacatggtggaagggaaaaagcactccctcctgcctcttttggaagggcactaatcccatttgtgagggctatgacctcatgacgtaatcaccttctaaaaatcctagctcttaatactatcatgttggatattagatttcaccatatgaatttgtggggacatatacattcagaccatagccccctttaacctgaattgggtcttatgccctgtctacaaaggagactggcaaaagtgactacttggaatattcagcatcaatagaagaaagaaggctgtgctagtaagagacaactgcagtaaggctcaaagacctttgtgctgtgctgttccatttgtctgaaacacatgcacacaggtgcacgtgcatacctacccatttcctcctgcccttatttgatcatagaatgtttaacagtttccttcaacagatatttcttgagaaccatactatctaatctgtccaagacataatgatgaaaaggacacatgcgtttcctgattggatggtagttataatctagcggaggaagacagacatttgacaattgagtgggtctactaatacataggaaggaaattattgggaaaaagtatccgctatacagagattttaaaatatagaaagaggtgtgctaaaaggcagctgaattgttatggggatgggattcttctggaacaccttggggattcatatgtaagctgagataggaaagcgaggacatgtcagccacagaaacatccatggaagagcaatccaggcagcaggaacagatgactcagcctaaagtggggagtgtgtttgcttgtttggggagcagaaagggaagggtggtgtaagatgggtttggaggggttggcaggggtcccgcagtgcagagcttttcagattgcaatatgaagagagagagagagagagagttggtgtgtgtgtgtgtgtgtaccactggagaattttgagcaaaagaaatgtgttcccagtttacattattaaaagatcaccagctgttacatggaatatggtgtactgattgggggcggagaatggagtcaaacattccaattaggaagccattgcaatagtcctggatagagatgactgttgttggggttagggtgttgttagcagacctgtgggagtgtggacggattggggacatcgtggagatgtcacttaagtggagtgtccacagtcctgcttctgttgggtgtggagggcgagggaaataggattcaaggctaagagcagagaagtgtctgatggaagagtctaattccctgcagtgatccgctggtaccctttacatcagcagcctcagtggggtggtgagatgggaactggaccgacttgagatgcgggagaatgtgaatgagcatggagtccgtgccacaggcaatccctgcacgcaagttttactgtgaagtgatatagaaagaagaggggaacagagagggtcaaagacttttgtttccttaacaaagagatatattacagcatttttttcccattgtgctaaaaagcacacaacatctaaccatcttaaccatttgtaagaatatagttcagtagtgttcagtatattcacgttgttgtgatagagatcacgaaagctttttcatcctctaaatctgaaactctgtatctattaactctgtaactcccctttctccctctccccagcccctggtaactgtcattctactttttgtctctatgattgggctacgtttgctaccttgtatcggtggaattatacagcgtttctcctttcgtgactggcttatatcacttagcataatgtcctcagggttcatccatggtgtaggatgtttcttcgtttttcaaggctaagtaatattcccttatgtggaatggatacattgtatttatccattcatctgtcagtggacatttgggttgccgccacttgttggtgtctgaatagtgctgctttgaacatggggatacaaatatattgcagcagatttttatactgattggaatgttctgggagaagtggagacattgatgatgcaggagaacaagcagaaaatttcaagagcaaatgctttggggacagacaacctgagtggagggctggccttgatagagatggaggcagaggtggtctcatgcgaaagtataagtgggagactccaggggaaacacaagggaggctgggtagatttgatgtcgagtgggtaagaaaatttctgttcaaattcatatttttttcaataaaaccagagacaaggggccggatgcagtggttcatgcctgttatcacaacactttgggaggctgaagtgggtggatcacttgaggtcaggagttcgaggccaacttggccaacatggtgaaaccccatctcaactaaaaatacaaataaaaatagttagcccagcacggtggtaggcacctgtaatcccagctacttgggaggctgaggaagtagaatcagttgaacctgggaggtggaggctgcagtgagctgagattgcactactgcactccagcctgggtgacggagcaagactccattgtctaaataaattaaaaatttaaaaatagagacaaggccatcagctttgagagagtgtgtgtgtggtggtggggggcggggttggaggatatcaggggttcttccccattaatagcataaatgattaacagtaagtacttggaatcaagttgatgcattttcttatgtgccatgcagacaaaataaagctcagctttgttgtcagacaaaagcagcacttattacaatggttggcatttcagagataattcaactataagagataataacacatcagtcaatcaggaagcattcttcccagtgatatcaacagaattacatgcaagtaatagactgttgtggacccaactaggaattttcttttgctgaaatgctcctatttctaggagaagctcaacgttgatttttcagcttctgtttggagagtctgtttatttctttcttcccgaggggattgtaaatggtgaggactttttattgtttttgacagttatcaaagaaacattttttttaaagctggaccattgactgaaaaataaacccatttgggatttttcgagtaaagtgtgttgaatcatgtttgtgatactcacttttaagttttggcgagcataactgcactgtgttacccattaaccggtagtttttaatttttatttttttaagttccagggtacatgtgcaggatgtgtaggtttgttaaacaggtaaacgtgtgccatggtggtttactgtgcctgtcaagctgtcatcaacgtattaagcccagcatacattagcttttatccctaatgctcgtcccctccatctcccagcagaccccagtgtgtggtgttcccctccctgtgtccatgtgttctcattgttcagctctcacttttaagtaagaacatatagtatttggttttctgttcctgtgttagtttgctgaggataatggcttccagctgcatccatgtccctgcaaaggacatgatctcattcctttttatggctgcatagaattccgtggtgtatatgtaccacatttttttattaatccagtctatcattgctgagcatttgttttgattccatgtctttgcttaatgggggatagttgtaacccctatgaatgcagagaggcatgtggtacagtttgagttggtgtcattttagtaaataacagtccagtttgtggtgatataaatcacatttttttctttttcttttttttttttttttttttttttttgcgatagagtcttgctttgttgcccaggctggagtgcaatggtacaatctcagttcactgcaactttcgcctcccaggttcaaggaattatcctgcctcagcctcccaagtagctgagataacaggtgcgtgccaccacgcccagctaattgttgaatttttagtagagatgaggtttcatcatattggccaggctggtcttgatctcctgacctcaggtgatctgcccacctcggcctcccaaagtgctgggattacaggcgtgagtcactgcacctggcccataaatcatattctttatttgcatttctggaagaccatcaggagggtagtaacatttattaaatgtccctttccatatttttcttatctcttaactgaaactcaccagaggcaggcaccagaaaaccccctgtgtttgcaaaccttgatgaagtttgccagtcactcccttggcttgtagtccttttacttccattttactcgcattcagtgctccctggaaggtgtttctttctgcaaatagctgcgtgagaaatccagcatgtcctggaccctccctcttttaaaacacttttttaaaaggattgttctaaaagaatcttcctctgcttctgcttctaattctggaagaaagggtggagctaggtgtgttcacatggtagtactttttcttttgatccaattgtttaaaaatatatggcagaataaagaggacgggaaaacctcaacaacacctcaggagtcagagagcagaggaaggtgtttcactctgtgcagatcctggactagctctgtgggttcctgtgatggtactgaggtaaagagagtgaagcatctgcccgacgcacagaatttaagaggccaccacaatactcaaccaagaagaaatcatgtcctttttttattatttttttttttgagacagggtctcattctgtcacccaggctggagtgcagtggcacaatatcagctcactgcaatctccgactcctgggttcaagcgattctcctgcctcagcctcccaagtagctggcgttacaggcacataccaccatacccagttaatttctgtattttttagtggagatggggtttcaccatcttggccaagctggtctcaaactcctgacctcaagtgatctgcctaccttggcctcccaaagtgctgggattacaggcgtgagccactgcacctggccgcaagtgcccatatgttgatagcacctgggagaaaattgatcaggtgtgtttttcccacttgacagatgaaaagactgagccacatgatcagaatttcagcccaagttcataaatatcttcccttggaacatcaatttatgattagcactgctcatatgctcataggctgaaagttttctactcctatgacccctaaagtgtacttggtgggtaattaggagcttgctgagtgaataaagataatggtaatggtaataatagtaataaaaataaaactagctgggtatggtggtgcacacctgtaatcgcagcactttgggaggctgaggtaggtggtcacttgaggtcaggagttccagatcatgctggccaacatggtgaaaccccatctgtactaaaaaatacaaaaattagccaggcatggtggtgggcgcctgtaatctcagctatttgagaggctgagggaagtgaattgcttgaacccagtaggtggaggtttcaatgagccaagatcgtcccactgcagttcagcctgggcgacagagtgagactccgtctcaaaaaggaaaaagaaacaaacaaaaaaactagcattaactggtgctttgctatgatttctacaggagttacaagagttcttatatgagcattctaattattacataggggaaactgaggcacggggcagttaagaaactcacctgtactgagaacaagaatttgaacacaggcattctggctttagaggccacactctaaatttctcctctatccttgttctagcattcagtcctatccatgaatacatgaagcaaatatcattttcagaatccagtttccagaggcgagcatgttttatacatctgtggctattggttttgttccaggaaaggggtcctgatttagaacccaagagggggtttttagatctcacaccagaaagaatttggggtgagtccacggtgcaaactaaaaaagcaagtttattaggaaaggcaagtggtgaaagaacagctacttcatagacagagtagggcgttcccgaaagtaagaggaagaacgcatccaccctaggtacaatgtttatatatatatgatatatatatcatatatatcatacctatagcatacatatcatatagcatacatatcatatatatcatgtatcatacatatatatcatgtcatacatatatatcgtatgacatatcaatatattatatatatgatatatgagatataaatgatctagatcatatataatgtacctatcatatgatgtatatcacatatatatcacatatgtcatatccatatcacatatatggtgtatatcatatatatcacatatattgtatattatatatatcatatactatatatcatatatattaaatatcctatatcacatatcatatatatcacatgccatatattgtatatcatatgtatcatgtatcatatatatcatatatatcatatatcatgtatgagatatactttatcatatatgatctatattttatatatatatcatatatatgatctatattatcatatatatgatatatattatatatatcatatatatcatatattatcatatatagatcatatatatcacatatatatgttttatcatatatattatcatataatcatatatgatttaaaaagatcttgggcagatttgctctgctacaagggtttgtgataaaggattaattttcttaattattgtgttttgcaagaattgatattatgatctttgaagcaaaattaggaatgcctttgttctctagataccgggatatctggacactcgcaagtctggttctgtttagcaaacattatttacttgttcccttaaccatacacatctagaggccaggaatgcctgacttcctgagaatgcagcccagcaagtcccagcctcattttccagccctcactcaaaatggagtcactgtagttcgaagacctctgacaattggacacacgtctgtggttcctaactcaggacagatggatttctgtggactccaagcttccaaacggcaggcccccggctggtcatctctttagctctggcactaaccgagtgccaagcacattagcacttggtgaatattgattgaaatgaattgaaattgtgggtggaggaaggctgaataaaggccatttctctgaagaaaagaaagaaaaagaaagtcatcttatcccgtagtcagtgtggattgcaggcacctttggcttatttgcagtatcttgaaaagctgcttcccaatctggtctgagagaaacacgtgagctgaggggactctctagggagatcccaagaggaaactgcctcttccagcctccccagggaaaaaaaaaaaaaaggcaaacctcctttcccaatgtggctgaatgtgtctttgcaagacactcagcattcttgtgtgtttattttctgggtcccccaagccccgccctccctctaacctgccccgtaccccgccccccttcatgtgggtgtcaattacagctgactttgcaggctccagccctgaacacaacagccgggcatgatgccctgggccccatggcatacggcagtggaggtaattagccagccttgactgggccctcggttgcagttcgaaatgcttcttgaaaaacaagtttctagccttggagagcgtggctttgtacttgatagatgttctgaatgtctttattgtggtactatgcaagaaattgggattcttttatcccggtgctctattttgggctggtctttataattagatctaattactcatacagacgtcatgaggacaatgacagctacctcaccgaacacatgatatctggaagaatagttataagcccttggtgcatatttacttattacgttttcattacaggtaggttgtattattatctccattttacagaaagggaagctgaggttcatagaagttaaagtaactcactacagtcatagagcccctttctcctttctatattctgggtattaccaggttgggtgccttccacatattttctcttgtaatcgttttaatgtcctcatgatgattttgttgtccctttcttaccgacttggaagctgaggttttgccaatgtaatcaggatgtgataaatctcagagtaagtttggaagaaggattcgaaccccagatttgaaccccagtggcctgattctggagttcatgctctgtggctacaatacattgcctatatcgggtaacaaatgccttcaatccccttcgcgcagagctgcttcattgcatttttgccctgatgatgctttcggatgctgcagagtgcattggaagggcacagaggcctggggaccacacccatcttggtggagagccccaggctgccacctgtgctaaggcaggcaaactgttgactctttctgacatccagatacaacttctgaggagaggagataatacaaaagttattatgaaagctagagagaatctgtataaaatagcaccaatatgttcaacatgatgattatgggctcagataaaattgtaccaaaaatcagacctgaattcaaatcttagttctagtgttgatagtattcaggaagttgaaaggttatttaaatccccaagtctcagttttcccacctgtaagaggtgaataagagaaaaatacagttaaatagtaaaaaccttagaggattctatggggtcctgtctgattaaacacgcaggatataatagcattcagttgagggtagctattagctatcagtgtaattatgaaaacattagttgaacctgagcactttccattgtgcgatagacccactaaattaaagttgaagaaagtcctttgaacagaagaaattacagtgatttacagcatctgttcttcccccagtacctttctattgattgaagggctgtatgttgtagttaattaaaatgaatatcttcaattggatacagcaatgcttttgcaaaagaagagatagcaggattgcagcacagtacaggggtgtgactctttcattcacagtttggggagctcagaactttcttttgggttgcagaaataagttatgtttcaatagaattcaaataaataaacatgtgaggcgttattatgcttataaatttgaaggctgtgatcattcctcctaaacagtggatgaagattttctaaaaatgcaaaaatcatctcagtgggtattccacccttttctcctgcctacagaaatgccagatgcactcaggctggtgttgggctctgtgatgtgtttgctttgtgagcctcctgggcatctaggtgtggccacaggacaagatcttgtcaaagagatggaactgccagtttctgagaggtctctggggaagctttcattttcctgttggagtgggtaccttctaacaccgtttctccttcccagccttaatggtgtcattatagtgttaacggtggggctacagaactggatatataaccgcatggcaccttgaccctggtgttagagtgtagtagaacagtcacagcacaggctggacgtatgtcacctgagaaccttaatccctcttcaattaagcctccgcagttaggatttctattatttgcatccaaaagcaattctagctgatataacttgaaaaattaccgcaaaattttatttcctatacaaatgtgctgtgtcaggtgtgagtgtgtgcgtttatgatatgaacaatagttcttccgttaaatattacctattcgttttttgttccagatgaggactaacatgtaaccatttcttttgttttctaatcttatctttttccttcatgagagtttacttgccattttcaaacacagaaagatatgtttacaaaagcaaaaaacttgtcttcttatgttgaaatttttctggtgtttgtttgcattcctaggcccactggttatccatgaacagaaaagtgttttccaagctaacatttgacatgagaatcaaaagcgagtattgaaaaacagctttaataaaatggaggtggcaggttttagctgaaaaactccaattatcagaaggtgttggtatttctcaaggaagaacacaatacagctaaatttctgactctcccggagataatttggagggagcaatgtcatcaaaggagggcagattatatgtgggaagaaaatgttcaggaatggagcaggtacagtagctcatgcctgtaatcccagcactttgggaggccaaggcaggcggatcacttcaggtcaggagttcaaaaccagtctggctaacatgttgaaaccccatctgtactaaaaatacaaaaattagctgggcatggtggtgtgtgcttgtaatcccaattaatcgggagtctgaggcatgagaatcccttgaacctgggaagtggaggttgcagtctgccgagatcacgccactgcactccagcctgggtggcagagcaagtctcagtctcaaaaaaaaaaaaaaaaacactaaaaaattcaggagtggtgagatccagtacttttccaattaagtaaactctttttttatttttttaattttaaatttacaggtacacttgcaggtttgttgcacagataagcttgtgtgatgggggtttgtggtacagattatttcatcacccaggtattaagcctagtactcattcattgttttttgtgattctcccctcctcccaccattcaccctccaaaaggcccctgtgttttgtccccctctatgtgtccatgtgttctcattatttagctcctactttacttttctgtttctgtgttaatttgctaaggataatggcctcgaggtccatccatgtccctgcaaaggacatcatcttattcttacttttggatgcatagtattccatggtgtgtataaaccacagattctttatccagtgtattagtctgttctcatgctgctaataaagacgtacctgagactgggtaatttataaaggaagaagattaaattgactgacagttccacgtggctggggaggcctcacagtcatgatgggaggcaaaggaggagagaagtcacatcttacatagtggcaagccagagaatttgtgtagaggaactcccttttataaaaccatcttgtcacatgagagtcagtatcctgagaacagcacatgaaagaccagccctcatgattcaattatttcccgcctggttcccccaggacatgtgggaattgtcagagctaccagtcaagatgagattggggtggggacacagccaagccatatcatccagtctacactgatgacatttaagttgattccacatcttggctattgtgaatagtgctgcagtgagtatacgcatgcatgggtctttgtattacaatagaactttttattggcacatgaaaatacaaataagcctccaaatagtgtgtaatacaatttctttgaaccctcgtgttttaccttacaaatttatgtaaaattttcgtagtttttcatgatatactcatgttggtttatataacaagaatgtggcccccgcaccaatgactaaaccaaattagtgatacgaagagttatccatgtttatggtattggattgtgtattctctggcatccaatttgagaaacctgagaatggtcctgtggttggctatcaggtacccggggagaaatgtagctgctttcaatttgaaaacccttttccaggtaacaaagattgacctacattattccattttgatctttacagaaacccattcccattgttggccagcatgtcattttgacttttgttggttttattagtgagaacactgaatatcattccagagtcagggctctgatcctggagcatcagtcatgtctacttaagtcctttcattgcagcgagctccttctcattcgttcatgagagtcgttgacgaggtggatcctggagtagtctcagacggcctcgccctctgttcatcatccttttgatggaatctccctgttagtagttccaaatcatagttaccatgagttgaacagttgtttgtaccaggagctgagcaaagccctttcttgcacattgtcacattgagtattcacagtaaatgtaagaggtagatttactgttatctcattttgaaagatgtggaactggccaggtgcagtggctcatgcctgtaatcccaacactttgggaggtcgaggcaggtggatcacctgaggtcaggagttcaagaccagcctggccaacatggcggagccctgtctctactaaaaatacaaaaattagctgggcatggtggcggatgcctgtaatccaagatacttgggaggctgaggcagggagaacaacttgaacccaggaggtggaggttgcagtgagataacatcatgccattgtgctccagcctgggtgacaagagtgagactctgtctaaaaaaaaaaaaaaaaaaaaaaaaggaaaggtgtcgaactgaggctcgagcattttggtaagttatctaacatcacattactggggagtggccatgctgagacatgagttacagttttccagataccaaaactcttagctgttccattgacagcttcctagcagggatagcacaccaagcctctaccctttccttgggtagtactcatcctctgactctgtcacccgctttatcctcttggtgatggcagagctacttggaatcactagtaactgcattagaatgatgtgcagttgtctatccaatgagttttgtccattatttctttagccgtaaataaatgaggaaagtacagaattattggtggggggtggtctttgaaaaagctagggtgggagaatatcgagaatgatataattatctatttgctgcttctggtccgccgacttgctggctttttttttttttaataggattatggaagatgaaaaggaagcgcttacttcagcttataagagcaatgtaagcaattttgcattgcactcactccccaggggtggtgtgaacatgtttctagtaaattaaagtatcataaaagcattggcaacatggcaacttttatattaatttcttaatttttcgcaggcttaattataaatctcttgggagaagaggcaaggcctgtcggttcctgggaaaacagtgttgcatctctaggcttgaaggtctgctcttctgctcagaagtatgtgtgctgtgatgtaggctgggtggctgctgtaggttgcatgcactacttgtgcctagtgatggtagtgatgccctgtggacaagacattaggctgggaggcccatgcatgcagccaagtggagagagtgctcttggacaaggtgttgtgtgactcttagcatgtagtaatgtgtcataagagcacagtctctgcagtttactaagtgtaaaatcctggatctggcctggagtggtggctgaaccctgtaattccagcactttgggaggccaaggtgggcagatcacctgaggtcaggagttcaagacctgtctgatcaacatggagaaaccctgtctctactaaaaatacgaaattagccgagtatgatggcaggcgcttgtaatctcagcaacttgggaggctgaggcaggacaattgcttgaaccctggaggcagaggttgcggtgagccgagatagtgccattgcactccagcctacgcaacaagagtaaaactccatcttaaacataaaataaaataatcctggatcctcctgtactacctgtgtgacctagagaaatttgaccagccctttgatctgtgaaatatgatggtatcaatgtcacctgggatatgcatgaaaaagcctacatcctacagcactactgagcatcctcaccagcctaggggtatctccagtgagacgaaccatcaggaaaacaatatatatccctatggatgaagccactgttaggcaggttttgttacttgcagcctaaagtctcctcacctttagtagtcactaaattagaatggtgcagcagcccattgagttccggattcactgaatgatggcatatttatgctggacagaatcttagctctgcccagtgagtttaccacatgccttctttacttaatatttttattattattttgagatggagtctctgttgaccaggctggagtgcagtggtgtgatctcttctcactgcaacctctgcctcccaggttcatgaaattctcctgcctcagcctcctgagtagctaagattagaggtgcatgccaccacacctggctaatttttgtatttttagcagagatggggtttcaccatattggtcaggctggtcttgaactcctgacctcagctgatccacctgcctcagcctcccaaagtgctaggattacaggtatgagacattgcacccggtaccttctttacttacaaatctactgtaaggaaagtgaaaaatcaggagggagggctccttgaaaaacccagggggaaatatcctggctttgctggccagatcccaatgagttagttcctctggatttcatttctcaagattctggaatttcctctcccctctccttccttcccctaccctaccctaccctaccctaccctcttctttcctctgcccttctgtagcatagtatggtttaaaatgtgatcacattctattttaatcatggaaagatttttttctctggcctcttgtcttttctgggctacatgccacatattggtagggaatatatcttatgtttttacatgtccttcaattaattttgaaatattaattttatgataggttaacttatgctgcacacacatacatacacaaaagatatatggtcttataaataggtatggctggacaaggtgactcaggaggcttaggcaggaagatcacttcagcccatgtgttctcagtctagcctgggcaaaatagctagtccacatctcttaaaaaattaattaactaaagaacactatgtgtggaaaatactggattagaaagattagacagggctgggagcagtggctcacgcctgtaatcccagcactttgggaggccaaggtgggtggatcatttgaggtcaggagttagagaacagtctgaccagcgtggcaaaaccccatctctacaaaaaatacaaaaaagaaaattagccaggcatggtgtcaggtgcctataatctcagctactcaagaggctgaggcataagaattgcttgaacccaggaggcagaggttgcaatgagcttagttggtgctactgcactccggcctgggccacagagcgtgagttcatgtaaaaaaaaaaaaaaacagaatttttttttcttttttctttttcttttctttttttgcaggacttctttgtatctttaatctgcaaatgaatgtgaattgtaaatctccatggagtgatatagaataaggcactttccaaacttaccggacgagagaaattttttttcataaaacatcttgcagaaactcactttagagaacctgcatatctccaatttttaaatttcatttgtctttttaaaaatgtgcaatattttttcaactttttattttgaaaaattctaaacatgaaaaaatgtaagacttgtacaataacccttatatacgtctaccagaatcaccaatttctatttttatttatttatttatttatttatttattttctgagacagagtcttggtctgtcacccaggctggagtgcaatggcatgatcttggctcactgcaacctgtgcctcccgggttcaagcgactcttgcctcagcctcccgagtagctgggattgcaggcgtctgccaccatgtctggctaattttcctgtttctagtagagacggggtttcaccatgttggccaggctggtctggaactcctgacctcaagtgatccccctgcctcagcctcccaaagtgctggtattacaggcgtgagccaccacgtccagccccaggctggttttgaactcatgggctcaactgattcacctgccttggcttcccaaagtgctgggattgtaggcatgagctcctgggcctggcccagaatcaccagtttttaatattaaatattttttactgcatttgctcatcctctgtctccctcttttccttcccttcctctccctccccttctctctctccttctctctgtctttttgcaaattcttgatgggtatcttttcgtgacaagaaagaaggtggtctggatgccagttgcctcctccacttgcctttaagaaaataactgaacacgctgtagggcaggtgcctgtatgtttcacttgtcttggttgatgatttattataatcccatcttagaatcctagaatctcaagttgcagagggacctgaaaggttatctaatccaccccttgctcacctgcccaccccgcctgcattccctacccatgctttcgaatgccatttattgtgtttgccagggtttgttggttagtccattctgagtggaatgaaacttgcaaataaggccttgtggagagcctgccctcttcctgggcatcatccaagcgatctattagcagcttccatttatcagcgtcttgtgtgggtgtagtgggcctaataatgggagctcagtcagagagcagcattttgatagaggactgaagtgttttgccaagtcttgattacccataataacaagaatgaaaactttggccctggttatgcacagatttattgaatcatggaatattcatgctggatggaatcttaggatcatctggttcagtccctgaagttttcaaaggaggaagtgagtggagaacaagagagaatgagtagtttgcctaaaatctcatcactaccatggtttctgattccaggcccaggttatctcccgagccactaggcttatctcaggacagcaacagaaaacttttcagacacacacacacacacacacacacacacacacacacacacacacacacagaggcatgccccacacattgcaaacataatcatatacacgggcacatctatacataagcataggtgggcacaggtgcacaaacttacctgcaatctcattcataaatggaatttccattccgttgaaatatagctcatgactggggcctccactgacctgcagttcacaatctagaagtgtgaacttggaaatagaaactcatccaaatacatgaccacagtttattcacctgtgtggtgcctcttgcagatagcagaggggaggagaataagaacgaacattgtaaggctgttgggatgactggtccgtggagtgacagaagagattagaaatccaggtttattgggagggcatctcaaagcagccacattttatccctattcgggtcagaaatgaaatgtttatgatggctggaatgagatcccacaggaaacttgagtttactaagtgccagctaggcagtctttccttgcataatcttatatagtcgtcatcatggttatgtttctggtgaaaaaaaaattagatatggaaatgctattagttaccccacattccacagccagtaaatggtaaaaccaagaatcaaatgtggatccagagagcactgagaacataggaatacataaaaaagaaaacgcatttcaaagagaaacacagcagagttttagaagtgtcctaatggtaaatctccccctaaatttttggaaacaaatttgcattttcctgctggtttttccaggcaggactttctcctctcagcaaagccctatagacctttagagcagtgtagtctattggagtttcctgtgatgatgaaagtgtttataatcttactgtccactgtagtagctactgtttacttatggttattgagtgagttaagatatatgctggatttcaaagacttagtatatgaaagtgttttaaatagctcattgagagtttttaaaaagtcgattgcctgttgtgataacatattgggctaaatatatttttaaaattagtcttacctgttttattttttcttttccctttttattttaatttaactttatttaattttattttattttatttatttgggaccgagtcttgctctgtcccctaggctggagtgcagtggtgcgatctcggctcactacaacctctgcctcagcctcagcctcagccttagcctcctgagcagctgggattacaggtgtgtgacatcacacccagctaatttttttttttgtttgtttgttttttgttttttgttttttgttttttgtttttgtttttaagatggagtcttgctcattgcccaggctggagtgcaatggcataatctcggctcactgcatcctctccctcctgggttcagtgattctccctgccttagcctcctaagtagctgggattacaggcgcccactaccatgcctggctaatttttagttgagatgggttttcccatgttggctaggctgctcttgaactcctggcctgaggtgatccacccccctcggactcccaaagtgctgggattataagcgtgagccaccgcgcccggcttttttggtatttttagtagagacgggatttcgccatgttgggcaggttggcctaaactcttgacctcaagtgatctgcccgcctcagccttccatagtgctgggatttcaggcctgagccactgtgcttggcctctttttccgttttaaaatgtggctattagaaaaattttaattgcatgtattgcttgcattatttttctcttgggcagtatggatctggataatttgtctatgaagatatatttacaattatatgtgcttctctctgtctatctgtatcagtctgtcttttgaaggacattttattaaacagcattatatagtgtataatgaattacaatttgttattatttaacggtgcaattagaactttttttccccacatattggtacctgtaagttaatatcatcctctgtaattattatatagcaatctttagataaactgatttattagttgcctatcaatttatacgtagtaccagggatggatataaagaatagaaacaggtacagctgtggagaatgcaaccatttaagagtgggacagaagttatctctgcagactgtctggagaataaagaaacaaaggaacagaagctacttggaacagaggtgttgatggaaatgaagaaatagaagtccctaaaaggggtcaggtgctgtggctcacacctgtaattccagcactttgggaggctaaggcaggtggatcacctgaggtcaggatttcgaaactagcctggctaacatggtgaaattccatctctactaaaaatacaaacattagccaggcctggtgatgggcaccgtataatcccagctactcgggagtctgagacgggagaattgcttgaattcaggaggcagaagttgcagtgaactgagaccgcaccaccgcactccagcctgggtgacaagagcgagactctgtttcacacaaaaaactgagaaaatgtctgcaaactacttgaaatatgatttagctcccctgtactagaatatactcttcaagaggtcagatactgcttgtttttatgtgaacatatgtcaccaacaactagtaaacgtgcccaacacacagtagggattcagtaagtatgtgttgaagaaatgaatggaatggcaactctcaattttggatttctttgcttcgcattttaaaaattctgatagtggccagatagcggtagctcacggctgtaatcccagtactttgggaggccgaggcgggtgggtcacctgaggtcaggagttcgagaccagcctggccaacatggtgaaaccccatttctactaaaaatacaaaagttagccggtagtggtggcgcatgcctgtaatcccagctattcaggagtcggaggcaggagaatcgcttgaacctgggagttggagtttgcagtgagttgagatctcgccactgcattcccacctgggcaacaagaaagaaactccatctcaaaaaaataaaaattctgttagtattcacatagaaggatgatactgtgtcccataaaatatatccaagtttaccaagtagaagtagcatatattacattggtgcaaaagtaattgtgctttttgtcattactttcaaaggcaaaagccgtgatcagttttgcaccgacctaatagttgtgaatgtgagcttggacaagtttcttaagcttactggtcttccatgatcttccatgtccatctcaggatagttcgagcccaaactgcttgttaaggtccaggaagctgatacatatcagtgagtgctgataacagaaaaccatgctatgtctagttgctaattttttaagataagataaggctgtcattttttatgatagaaaagtgactctcgcaatttattgccaatgagaaccaccacattgttcattgattgcatattttaaagctctgtgtccagatattctaatttactacatcacagttggctatttctggccaggcgtggtggctcacacctgtaattccagtacgttgggaggccaaggtgggtggcctgcttcagcacagaagttcgaggccatcctaggcaacgtaataaaattgtctctccaaaaaaaaaaaaaaaaaaaaaaaaaagacacggtggcgtgtacctttagttccagttacagaatgaggcaggagaattacttgagcctgggaggcagaggttgcagtgagttgagaccatgccacgtcactccagcctgggcagtagagtgagaccttgtctcaaaacaaaagttggctatttctgcatttctccatttcagctaatacatctgtatgtacaggccctggacaggatgcctgggagacattaataagcaacattccgtttgggcctcaggaagctcatatcccataggggaactgacacaatgattagcacaaatacgtagataagtccttttgaaaaatgaattcccatgtgattattatcatcaacccacttctcaaatgttttttctttttgttgttgttgttttgagatggggtcccactctgtcacccaggctggagttcagtggtgcaatctcagctcactgcaacttccacctcccaggctcaagccatcctcctacctcagctgtccaagtagctgggaccacaggcttgtgctgccattcctgcctgacttttgtagttttggtagaggtggggtttcaccatgttgcccaggctggtcttgaactcctgagcccaagcaatctgcctgcttaggccttccaaagtgctgctaggattacaggtgtgacccaccaggcccagcccacttctgaaatgttaatgtgcataggaatcacttcagggttttgtatcaaattcagtttcttagatcctacccacagagtttctgattcaatcaatagggtggtgggggtgtcccagatcctgtgttgttaacaggactccctgtgtttcagaagctggtgctatgaaaactacaccttgaaaactattgtcagagtgtggtccacctctagaaaatattggcctgtctttgccagagtttcacccattccttagggagaacgggtgtagctgtctcttcctttccagtctgtgtaggaagcagaaccaagctcatagagaagcaattttttgttttttttgagatggagtctcactctgttgcacaggctggagtgcagtggtgcaatctcggcttactgcagcctctgcctcccggattcaagggattttcctggtgcaatctcggctcattgcagcctctgcctcccaggttcaagcaattctcctgcctcagctttcccagtagctgggactacaggtacccaccaccatgcccagctaatttttgtatttttagtagagacggggtttcaccatgttggccaggctggtcttgaactcttgatctcacgtgatctgccttggcctcccaaagtgctgggattacaggcgtgagctactgcatccagcctagcaattccttaagtaccttgttcatcccttccaaggtcagcttgggttcctcagtagtcgtggtatttctctgtggtgtaaaatgcacataaaggacttaaaaactaggtaagaaggcagttaaggataaaagttacacaacttcaaccatattctgttagagccacaaagggcttcagaaaccagctaatgattttagagaaaagatggcatgagtccaagaggtcacatgatctacccaaggtcacttgtgtctagagtttttgtgtatcatgacatgaccaatggccatggcccagaaaggctgattccttccttttccaaaaaaaaaaaaaaaaagatttgtgatacttcaatatattcagtgcccaccgcccaagcacggtgtcattcacaaggaattataatggatttcattgtagaatgcagactccttcttcccaattacttctttgctttaaacataaagccgagagcctgaccctgggaatagttcttgtctgaatttctgatagattttaatttcgcagctggagcctggtcctcacagtcattccctaatttcttttgttagtctactgcattcatctttggttctgtgtaggatccatagatggactgaactgtaacactgactttcttttctttgtctcacttgtcaaataaaatcatttgaggctgaatggtattgatagctgtgcaatgacttgttgctactgtagaggggaccctgcacacaccttcctgggagtcatgtttgttgttcaaatgagtcttctgagaatcaggatctcttgaaaaagataacacatcagtagtattaaaaactaacgaatagggcaaatcctcatttagctcctttcggtaataaattcatttgcttgggttcaggatttgtagagcatattctaaatgcattgctggctgagggatccatcagagtgggaaggggagatggggaaagccatcctgttgcattgaagaaacggaatctgtgatcaggaaacctggttaaaggtcctttcccctttgtaattttattctacatagggaggcaagagtggtgctgcaacatatggagagacttgagtttaattgttaaaattccactcagccgggccacttcttcactgtgatttgcactatttagcatttgtgtgcattaggtaatatatttaatgtttctccctccaatccaatttgcgtgtgtttggcagcagcccagctccatgggcatggggcaggggagatcataaatctgccatcctggagcatggaaactgtattgctgcatttgatagtatgcttgcatgaacactccaaaatgcttgtgaagcaataccacctcttccccgaacgtctctcagggacaacattaatgtatctcatattgtattgattgtagccaataagtgcctaaatgatttggtgcaaggcagaaagattatgcagggaagaggggtggaggtggctttagaagaagtatgtggtttaattactggctgaatttcctcaatccacctccccctctgggagtttaacaaacaggccttagtgcactttagctgttgctgacatctgttgaaatgatatctgcccgtgatgaggggagtttgggaattgcgcttggggtattggcgggatcagggagccacaggaagctcctttccagtctgcaaaattagaaggaggaaaacactgcagtagtactctaaggttaagctatggagagcacagttttatctaatggaattctgccttccgacttaatgaagccatcttcatcttaaatgcagggttggatgtaagtgtctagagtctaatgatcttaaagtcccaggtgttgataacaaacacagagttgagctgaaaacatgaatagtgcatgggcaatgcttcaggcacccaattgtaaaaaccacccccagctctctctttttaatgccatgctaagaactgttaggaaacttcacagtttttaggtaaacaacaagtgaccgattttcttgcattttttaatagaagcaaaagaagccaaaacctagctaaaatttcatgttgggtccagcaccaggaagaatgatgctgtgtatctgctagtgttttgattacatcaataattcaaagaaagtgccatccacttaatctcttttatgcctctccacccgaaaggatcctggttgtattctgaaagtcctgaagctatcatattccacagctttttctgaaatgtgttattatgttatgcttgaaacatttatatatgttaccgaccaaattgcatggaaacgatttgctttcagagactgataaaaattcacttttgatggtagacacaaggtgagatgttatcaaaacaaaattccaaattaacttggatatctctatcagaacatatccctgattgggcatgtgattcttgcattattttgtgtgtgtgtgtgtgtgtgtgtgtgtgttggtcattgtatttaaaaatgtgtttgcatacgtgtgtatatggatatatatgtgccaggtattaggctggctaattattgtgactaaaactctctggggttaagtggaaaattaaaaattcagaacaaccatagtctgttatctgtcacctgtaatttaggctaatatctcaattctcttgttatggacatttctcttacagtgtggctttacataatgggaattggatgtaatgtgatcaattaattagagcatatgatttacattagtcaaacctgtattgattacaaaatgactatgatctgaaagtagccttgtgtgtgtgtgtgtgtgtgtgtgtgtgtgtgtgtgtgtgttagaagtggtgatcctgctttgtatgtggccaacttggggagggggatggatttttcactttattattgtgacgtgtgatagacctatggggtgttttaaaattcccaagcaaataatcttgctggtggtgacagaagaggaaggctttgaagaggggtgtggtggctcacgcatgtaatcccactactttgggaggccaaggagggtggatcaccttaggtcaggatcaccagcatgggcaacacactgaaaccttgtctctactaaacatacaaaaattagctggacgtggtggtgcacgcttgtaatcccagctactcagaaggctgaggcaggagaatcacttgaacctgggagcacagaggttgcagtgagccaagatcatgccaccgcactgcagcctgggccatagagtgagactccatcttaaaaaaataataataaaaaacaaaaaaagggaaaggctttgaggtaaaagctagaggtacttacacttgagattggttcagattttataactcaacagacaagtatctgattctctgcatcctcctatgtttgaaccataaatttattagaaagcatatataggaaaaaacaacccagttcctttgagtctgaaactttctagtccctaattactttttcccattggaagtatatttatagcatacaaatctaaacttctcaacttaccttgataactggtccccatgttgatggccatggggcgtcttgaagaccatcagtgatccaagtatattccattagttttcatgtcaagaacattttattgtatcctaattatctgaaacttggtcatctgaaataacatggcagttcccgataaatcattgcctttttgatttcctagccatcttgaatacaggaaggcttagtttagcctttgcttttaaattcatataaatacaatgatattgagtatctctactttagaataacactgaactagtactgggatttttaaatttgatattcggacagctctttttctgttctgtggttttgtgcatgtgtgtgtgtgcatataaacatgtatgtgtgtgcatgtataggtatctggatacacatctagatgtgtttatatctagattgatacatacatgtgtatatatatccatcctcctatctggacacgcatatttgttacttgaaaataagtagggcttgcatacattgtagttactattgtaagtgctttccaaatatttaactcatttactagcccaacgactttatgctttaggcactgtattttcatttaaccaatggggacagtgacgcacaaagaagctaattagtttgtctgaggtcacagaggtagtaagtggcaggattgggattcaattgataatgcagtgcttcatacaaataatgctttgcaatttttgagcacttttctacatgtcagatagagggatttaattttttactcatttgatttttatggccagtctatgagttgatttccatcattgctagtttgctgaatgggacacagaggctgaaagaataacacatctgtagtcacagagttagaagctgatggaactgaactttgcatccaggaaatcagactagagaatttttaataaattatcaagaaagtttataggcagcattgaagatttcctcatcagctttatacatatgtatatgtatatatgtttatatttatatgcacgtatttataagtacattgtagacagatgaaaaataataaaagcaggaagtaccttttgttgtgttgactgtgttttgcccccaaacttacaactctcaatagttgtcttttctgttagctgaaattaaatagagaattatcttagcattttcccccaataactttaaggtttcttaagagatggtaagtccctttgaagactagagtgatttgactcaacttctccttctagtaaaaaaaagtctgccaccaatacatgtttatatttgttaaaataacatacttatcagtatgaagtggcatcagcaaaaccaatgacttaaaggtacaattgtcaacctatgttgaaaatatgttgaatttccaagagggaaacggctgcttgatcagagttcatttatatccacgagcattgcaccagcaataaactttaagttaatgttaacaattttaatttgtatcttttaattgttgaagtctgaattgctttccaatttcccacagagtttaatgtgtatgcaaattgcacagccagaaatttaagatacaaaagatagactgcgttttgcaaacataccataattattgcttaatttttaaagggtctttctctttgtcagggtattgttcggtttcttgaaactgaacagaagaaaacttttggttaatgattagtataaatcttgtaatggaacttaattgaatattaactttgttgttctcacaactacagactactcaattccctgtttctctgaggtagggtttcttgctctgttagtgcaaataatttgtcttctagtaatagcaggaaacagttatcagaacaccagtttaattgtctgaaggttgtgcactacatgtaagctcttagaaaaaggttaaaagaattctcatgtctattttaatattatatttcgtaatcatttaaacagcttggcagtcctagcaaagtaaaaaaaaactaaaattgaaggtaaatgccgttcttttgttaaaattcaaggtaggaaatgctgagatttagaaaaaatatagatataaatatatgtacattatatttagtgtacaatagcatatgtagtatataattatctatttatttatttacttattgagtgtaaaatgaaagcagccaaagcagtacatttggtggattagtagtgatttagctatgaagcatttatatattcaaatatttgttgctaaatattcctaaagcctatggggttctagaaactggcttaggagaggagactgaaggatgaacaacactcattagtgtcttccattgtgttcaagtgtttacacatgaatccaagaaataataagatgctacagatggtgaaaactaatctgaagggggcaaaatgaagccagtgagacacagaatggtttggggatgggggcagttgtgttagacaaggttttagggaaaagatgatgtcagagctcttggcaatgacttggccctaccagaagcaagagacaaagttctaaatgagaacagctggttgtattgaagaaccaaaataggattttaatttggttatatcattgtgatcgatgacttttgttgctttttggtgtctccaaattgcaatcctgtttcacattttgtgttcctttccctcagactattccaagaatgaaggatgtttgatgatggctacaggttgtcttgtacagaaaacttaatatatcaggctctcttgagagagtaggaagggcattttattacagactccagtctaaaattccttctgagtactttaaaatatacccacaaatactggagtcatgtttcttctttttttaattaattaagtattattattattattattttgcgactgagtttcactctatcacccaggctggagtgcagtggcacgatctaggctcactgtaacctccgcctcccaggttcaagcgattctcgtgcctcggcatcctgagtagctggaattacaagcatccactaccatgcctggctaatttttgtattattagtagagacagggtttcaccatgttggccaagttggtcttgaactcctgacttcaggtgatccgcccgcctctgcctcccaaagtacagggattacaggtgtgagccactgagcctggcctttttattttattttattttattttattttattttttatttttatttattttttttatttatttttttttttagagatcaggtctcacttgttgatcaggctggtcctgaactcctgggttcaagcggtccacctgcctcggcctccaaaagtgatgggatgacaggcatgagccgttgtgcctggccaggagctacatttttactccagattcattggtggaccagagtgatttggtgatacttaaactcattctgattttttttaatttttattttttatttgagacggagtcttgctctgtcacccaggctggagcattctcagttgtttaatggtggttttaaaatgttttattatgaaaaatttcaaaaaaacacaaaagtagaatagtatactgatccctcatatgctttacagcagatttcaacaactaccaatatgtggccaaacttgttttgtgctttaatcttcttctcccttccccatcaatattttgaagcaaatccaaaatatactattattattaaatatatcagtatgtatattggaaaaaatgaaactttttaaaaaaagaactgtattgtcattaatgttattatgcctttaaaattagcaataggccaggcatgttggctcatgcctgtaatcccagtattttgggaggctgaggtgagcggatcacttgaggtcaggagtttgagagcagcctgagcaacatggtgaaaccctgtctttactaaaaatacagaagttaaccaggtgtggtggcacacacttgtaatttcagctactccagaggctgaggcaggagaattgcttggacctagcaggcagaggttgcagtgagccaagatcacaccactgcactccagcctgggcaacagggagactctgtttcaaagaaaaaaaaaaaaaaagattatttaagtaggtgtccaaacatcatattatttttaaagttttcagtacttacaattagaatatgagaattcttaaggaaaaaaaaagtactgtcattagcgttattatgccttgaaagtagcaataatctgttaatataagcaagcattctatcattgttcaagtctacctgataatcttacacatttttaaagttttattatcagaaatttaaacatgatcgatatgtctcaaattaaaattagtcgatacatctctcaagtttcttttattaaactggtaccacctccaactcagtgtttgcaatctatttgttgaggtcaccgggtcatttttatgcaacagtctctacatagtctggttttgctaattgcattctttcttctttatattttctgttgactggtggttaaattcagaagtttgatgagatttttgttcaattttgcttttggcaaaaacacataataagttttcttttctttttttctttctttttctttctttttttttttttttttttttgagacagagtctcgctctcctctgtcgcccaggctggagtgcagtggcatgatctcggctcactgcaacctctgcctaccgggttcatgccattctcctgcctcagcctcccaagtagctgggactacaggtgtccgccatcatgcctggctaactttctatatttttagtagagacggtttcactgtgttagccaggatgctctcgatctcctgaccttgtgatccgcccgcctcggcctcccaaagtgctgggattacaggcgtgagccaccgcacctgggaaacacataataaattttcttgtttacttccattaggaaccacataatgcttttctttattgaagtcctttttggaaatttttatcagtcactagcaaccattaccatcactcctttttcatttattagatagaatacttgtacagagaaaaatcttttactgattctttgcttaccccaaggtagagttcatgtgagaaaaataggggcatctgtatcttccttcatttttttccagttttcaaatccgtttgagttagtttgcttgcatattccaaaggagactaatgatcattctaaatgtccattctgaagctctgttgttggccagtgggaatgtctttctgctgtctccttgttcagatggatggagagattccttgctttgtgaggtgacaaggtgttcctggtcaacttatgtatttcctaccctggccctgactctgtgtgtgtgtgtttgtgtgtatgtgtatgtgtatgtgtatgtgtatgtgtatttgtatatgtatatgtatatgtatatgtatatgtatatgtatatgtatatgtatatgtatacgtgtatgtatattttgagatggagtctcgctttgttgccgaggatggagtacagttgcatgatctcaactcgttgcaacctccgcctcccgggttcaagtgatgctcctacatcagcctcccgagtagctgggattacaggcacgtgccatcacaccctgctaatttttgtatttttagtagagacagggtttcaccatgttggccagggtggtctcaaactcctgacctgaagtgatccatcctccttggcctcccacggtgctgggatcacagggatgcgtcaacacactggcctctattatttgtttttagaagcttttcagaaccaggaggcagctcaatttgggagattttgtgaacatctttattattattactttaactctgttcagcacttgtctcaacttttcttattaagtggggagtccccatagtaagcgggggtccccaaaatagaagatcagttctactttttttctcctggagtttcttcttgtgcacacgattgagcacgtgagtgaactcctggtgtttagagtgacagtatccctgggcatagttgattcagggatgggcatgtgatcaggtggaccaccgagagattcctgggggactttgctcttagacgctatggagaaatttttttttctcatggggttgttgatcttgttaggtgagtctagggttattgtggccatccacctctcagtgtactgacatgcaatctaagaaattaggaaagggaaaaatcttgatgctgtcacttgaggccctggatacagcggtgcatgaagttaatctatctactttggaactttgcaagcatgtgagccagtgcattttcttgtatcctctaaagctattttgtgtttgtgtgagcacatgtgtttacacatgaaattgccctgatatgaaggttttctgtttatccagcaagaaagagatttaaaaaagatcttttcaactattttcgctgggcgcgatggctcatgtctgtaattccagcacttgggaagctgaggcaggcggatcatgaggtcaggagttggagaccagcctggccaaaatggtgaaaccccgtctctactaaaaatacaaaaatttgctgggcgtggtggcatgcacatgtcatcccagccactcgggaggctgaggcaggagaatcgcttgaacctgggaggcagaggttgcagggagccgagattgcgccactgcactccagcctggtgatagagtgagggtccaactcaaaaacaaagaaacaaacaaaaaactattttcaaatagcactaagtggcttaaaatacacttcctgaatgtcggctttgtttgaggaatgtgttgtggtagatgctatataataaagggaaattaggctgataggagtttctctcaacatcccgatacactcagcgtgttaagataaggctagaaatcagaataacacaagacagaaacttaggaagttagaaagtgtaagaatgtaggaaaggcgatgaggtcaacattttattacagttattttctccaaactatgagtggatcttggtggtctttttttttcttcttcttttttctctgttgtgtttggtttcccaaagagaggttatacaatcaggccatgatttacaaagaatagtcttgcaggagcattgcgtaaaatgggtttaaagaagaatgaaagatgctagacagatcgtttaaaaaggagtttctgggccaggcacggtggctcacgcctgtaatcccagcactttgggaggccgaggtgggtggatcacaaggtcagcagatcaagaccatcctggccaacatggtgaaacccccgtctctactaaaagtgcaaaaattagctgggcgtgatggtgagcacttgtagtcccagctactcaggaggctgaggcaagagaatcacttagacctgggaggcggaggttgcactgagcagagattgcgccactgtactgcagcctggtgacagagcgagactccatcttaaaaaaaaaaaaagaaaaaattataaaagaaggagtagtttgtgaagccctgttaaatcctgctctcagggatgcatatttacaccctttaaaaataaaataaaaccagaggttgaaacaaggtattaaaatacctctggagaaaaactaacctcttccaggaaagttttgttagctataaactcaaaggttgatacatgtagcatcaaaggaacataggaaagcttagttgatgctgtaattattaaacacaaacaatgtaattaagttagtatgtattagaaaaaaacatgatatgcacatcaagtctaattttattaatagaactttttgggatgagactaaaggacaattccttgtccaggttctacttataaattgcaaagactcactaatggttttcagatgattggttatttggtaaattggctttcagtgggtcaatgaaatggtcattaggagaactgtcaataaatttatctgctttcttttaaaaaaacatcccattttcccagggtagaaatgaggggtttttttttttttttttataaaaaaagtaacgcttcacaaatttgcgtgccatctttgcacaggtgccataccaccttctctgtatcattctagttttagtatatgtgttgccaatgtggacactagaaatcagttttgttttgtacttaatagagcatctttttaaatcttatgcacagaagaatgatgcatagaagaatctgtaatgcataagaagcatcttatgcattatcttttgaatcttatgcatagaagaatatataatgcataagaacaacgcattatatattaattagattaaattaactccattcggatacctaaggttatatttgtgtattaaactcctcaacatcagggtaaaagcaaagacaacatggcatcagattctttgtccaccggttttatttagtctcagagacccaagctggtcagcatttggctctggtggagtcaccatagcctggatttgaaggtttggagcccagcccaggtttggaggatcagtaagttggtatgccagcactccaagagagagaccatctctttgtcatggacacgtcctagctatgtatctaaggtttattagtacaatgaatttctatttaatggctttaatttagaacagttttcttgaaagcctcaacattggtattccattgtctgggcattttttctatatagggaaaatatacaaaagccacatcataaccaggaagatgtatggtgagctggtattcaagaaaggagaagtagctgtgagacaccaaggattggctgtaccagattaagataacctaatccacgtgtctctataagtggctgggtcagctgttggaacctgttgggacagaacaggttgaatccttgagcaaagaggccaggtgaggtgactcacacctgtaattccaggactttgtaaggtgggccgatcacttgaggtcaggagttcgagaccagcttggccaacatggtgaaaccccatttctaccaaaaatacaaaaattagcagagcatgatggtgcgtgcctgttatcccagctacttgggaggctgaggcaggagcattccttgaatccaggaggcagaagttgcagtcagctgagatcgcgtcattgcactccagcctgggtgacaagagcgagattccatctcaaaaacaaaaaacgaaaaaaaacccaaaactaaacaaaataaacacatatcctcacctttttgtgtgtgggacatacagtatgaaaagatgagtgctaatagctttccccttacctttcaagagaacctaaagatacttgcctccattccagtcatcttcctccctttcaatgagactgtgttcttgcttgctttgggggagaaagactaagttgacttatagaatagagggatggcaaggaaacatcccaatacagtcagtatttcttgtggaaggacaaaaagagaaaagtttctgggttatgtctagaaagataattgacaggaatggggagaaggaacccagtaatggcaggtgaacgagaaaattggtacaatgataagtgttctgtaatttttatcttgagaaatggaaaagcagctcctgaaagatcctattagtgatggcttggtgttggtaggaggtggcttgacactcacagatagactttggtgttgcctgttgaacacaaacaatttcatagaatatcagcatcagacaaggccatctcaggactgtggtgggtcaggacaagacaagaccgctaggtgatcatgtctgaactcagtccaaaacatggaccttgcctaaatcgcaagatgaccattcatcttctttttctggctcacatgagtgactgctgcttcttcaccgactacagctttcgcttcactaaattcttcccttcttctggataagaactatgaagatacccagtgatataattggtctttctgacagcatccaatccagagaaaagccccaattctttaacccctactcaggatcacgtaacagaaaggcaaatcctctaagaagctggacagcatcttactgagatactccgtggttcctcatggtatatgttctcctttgcaataggtagtaaaccctactttgttcaaatacaggtgtacatttaaacatctttggctagaggacatacataatgtcattaaatttatttatttatttatttttttttgagatggagtctcactctgtttgttgccaggctggagtgcagtggcacgatctcggttcactgcatcctctgcctccgaggtccaagcgattctcctgtctcagcctctcgagtagctgggattacaggtacacaccagtatacccagctaatttttgtatttttagtagggacggggttttatcatgttggccaggatggtctcgattttctgaccttgtgatccacccgctttggcctcccaaagtgctgggattacaggcttgagccactgcgcccggccaaacaagtttttttatgtagagacagggtgtctattggtcaggctggaatggagtgatatgatcacagctcactgtagcctcgaactcctgggctcaagcagtcctcccacctcaccttcctgagtaggtaggactagagttgggaaccaccacacctggcttggtttcgggttttatagagacaaggtctccctgtgatgctcattctgatcttgaactcctggactcaagtgatcgtccttccttggtctcccaatgtgctgggattacggacatgagccaccatgcctggcaattaatttgattaagaaaaagtaaaccctatgcagaagagaacacttagcaaagttaagtcacctgcccaagaaccctcagctcccaagcagtggaatcacactttgaaccctgccattttctgtctgagcctttgttctgcctttaacatcacctccccatatggacgcaccgtcttgtctcttccatgttttcgtagtcttagttttctaccactgccagaagtaccacacatttggcaccttgaaataacaaatacatatgatctcacggttctataggtgagaaatctagttggctcatctggtttctacactgtgagtttttctcaacgctgatgtcaatggttggctgtatggactgataaggaggctctgggaagagtccattttcaaactccttcaggttgccagcaaaatttatttccttgcagctgtaaagctgaagtctccatttctttactggctggtagcagaagggcttctcttagatcctgggagctttttacgtccttttgtgaagtgtggactcttccaactcatagtcagcaatggtacgaatgcatctcatccttgaaatctcattgacttcttctgccatatgtacctcattgcagctggagaaagtcttgtgttttaaagtgcttttgtgattagatgggattttccccaataatccagagtcatctccgtatttttaggtgcatacttttgataacatctagaaaatcctatttgtcatgtcacgcatcgtattgacaggttctggggattaggacatgggtatcttggggaagtggggcataaatttgcctactgtacattgttaaacaccctcccatcctccagccatctttgactgttttagtcattctttcaatgtaaatgtacgtttctactctttcttgtttggaagctcttctctttaacatgattttgcatgtacttttgctgctaatttcttgactatacagggtaaactcccatgaaaatcatctcatttccctacatgcaggtccttagaaactgtgaggatggggtaaggctgctgccattgaagcctgcacgctcctgtgcgtttctgtagcccacctagtggacacctcagcattaggaagtatcaacatggacttgtaagaaccttcatgctgtctcctcaagcttgctagctggggcctcctagtacaacaggtgccgtgagaaacacgtgaaatggcaacagatttcagaaatggtagcaaaataaaaccagtataatgttgggcattgtgtctctcacccaacttagcattatctatattcagttgagagcaaacttggatccagttttcagccacagctactcctcttgccctttattgtttcatgtacaagttctcactgaaaaaaatatatatccacagcataatcagaatagttgttaccgaagaaaatgtaacaggatgatatttttggcgaattggctttaatgagttttgaatgaatagcttaaagtattagaaagtaaaattcaggccaggtgcggtggcttatacctgtaatcccagcactttgggagactgaggcaggtggatcacctgaggccaggagtttgagaccattctggccagtatgatgaaaccctgtctctactaaaaatacaaaaattagccaggcatggtggcgcatctgtaattccagacactcagaagtcagaggcagcagaatcgcttgaacctaggaagcaaaggttgcagtgatctgagatcataccactgcactccagcctgggtgacagggcaagactttgtctcaaaaaaaaagtagaattcagtgaacaagagtaaataattcaagaaattcaaggttgatagctataaaaatgaaattccctccctccctcccttcctccctcccttccttcctcctcccttcctccctccctcccttcctcctcccttcctccctccctcccttcctccctccctcccttcctccctccctcccttcctccctccctcccttcctcctccctcccttcctccctccctcccttcctcctcccttcctccctccctcccttcctccctccctcccttcctccctccctccctccctccctccctccctcccttcctccctccctcccttcctccctcccttcctccctccctccctccctcacttcctccctcccttcctccctccctcccttcctccctccctcccttcctccctccctccctccctcccttcctccctcccttcctccctccctcccttcctccctccctcccttcctccctcccttcctccctcccttcctccctccctcccttcctccctccctccctccctcccttcctccctccctccctccctcccttcctccctcccttcctccctccatccctccctccctcacttcctccctcccttccttcctctcttgctctttctctttctctcttcctttccctctttctctctgtccctctttcttttttcttcttgtctacttcctctccttcctctccttcctcttcttctctcttttctctctcactctctgtctcttccttctttctctttctttgtacatgtataatttgaagaccctgcgccaagcagtctcttggaattagaagcaccttaaaatgaaaaaaatgtctcgccactgtgacaaatccacaggccttgcaagaaaccctgcagatcactaacacacggccataggaatatattgactgcagcccaagcacaggagaagattaatcaatccaacagacttgcattaattgtgaaatggaagggatgatgcgatcaatgataggaatgaaagtgcagcagtaacgatgccacatccagctaatccaataatggagaagctgatgtatagcatattggaattctaccgtctgggcacttgtcaccataaagaatatcctagaattatagggaaaaattgagcaggcagcagttgagccaacctaatcagcctgataccacagtagttctcttgattaaacactaaattaagtggcattcagctctgtaacctgcttgccttgtgaaaaataatactagagctaacgtgaaaagtttgtattttaatcaaagcaaactacgaatattaaaatattcctgggctattttggtgccgtttagctgtgaacaagtttaataatttataaatggttcttttgccattggctacaaggaaaaagggtccaaagctatattgggaggtaaggcttcctgtgctaaaaatcaattagacttgatagaagctcagagaactcttaagaaaaaaaaaatgcactcaagaggccctgggagaattcaaatttagttaacttctataacggtttgcctaagggcatgaactctattctttgctgcaaagcacgtgatcattccaggaggggtgagacttaatcagctgtgaatactatgagggtcccttatacatatatgtcattattaagtcctgaagctcaaatacacagacaacctagagctaaatggcaaattctccaggaccaagagaaaactgcttttcatgaacatttagagaacactagagaaagaacttacattgtgagcatcaaacccagtctggttagactttctgtacagactcttacgctaggacacacactggtgagatcttggtgattattatatgcattggccagtgagacctcttagagttgaccgagtccgtgagcatccgaggggctagatctctggtggccagtgaaggagatgtgggttggaaaaggagggagagacactgatcacatctccccttttttttttgtttgtttgtttctttttttgagacagagtttttctctgtcacccaggctagagtgtggtggagtgatcttggatgacttaaaccaatggctctctggtaccgcctcctgggttcaagagattctcctgcctcagcctaccaagtagctgggattacacttgcatgccaccactgcccggctgatttttgtatttttagtagagacatggtttctccatgttggccaggctggtctcaaactcctggcctcaagtgatctacccatctctgcctctgcctccgcctcccaaagtgctgggattataggcatgagccactgctcccggcccacatctcttttcttgagcagaagatagtgtgctgataaagttctcccaccaaagtgagtcttagcagggccttgggcaagaggataaattaactacttaggctgttctttcctgttatattttgtttgttgtttgtttgtttttatttcaagtcaatttgtggccttgccttttaattgaaagcaaattcatttttttttttttcctgggtgggaaagggtcactgaaagaagagaggccatcaggctgtgtcttacatagttgaaaagtcaaaaactgcagacagatttggatttatttgatttcaataattagcagtcattcgtggagtcctcataccattccagggctggttctaagggcttttgcaacattaacttatgtaattcttttaatgattctgaggtcaagatgctatcatcattttcactttgcagaaggagaaactgaagcccagaaagcttaagcaatttgccaaggtcttaaagagtgcaagtgtggcagatggggattgaaaccaggcgggctgtttgttgctatgtgtttttaaaacaggttgggccttccaagttggatttttgtttgtttgtttttgttgtgtgtgtttgtttgtttttgttgtgcgtttgttttgttttgttttgtttgttttttgagacgaagtcttgctttgtcgcacaggctggagtgcagtggcatgatctcggctcactgcaagctccgcatcccgggttcacgccattatccagcctcagccttcaaagtacctgggactacaggtgcctgccaccatgctcggctaattttttgtatttttagtagagatgggagtttcaccatgttagtcaggatggtctcgatctcctgacctcgtgatccgcctgccttggccttccaaagtgctgggattacaggcgtgagccgccgcaccgtgccccaagttgtttttggacagtgatatcagtcatgagaaatgggaaggagtgggatgcctttggatgatgttagctcaagtggtattgcatgctcttccaccccatcttctgcacatttctctctggaaatacgcccttcattaatcctctgacattggctaagtagatcatgatgtggtgttctgatcaatgaggtctagtccagtcactgtaggtcaaatcagattatccagacctccaaaataataagtggactttaggtcagacgtatggagtcaccaatgagaaacagcttcagaatccatccagcaaagatctagaataatcataggatgagactatgatcactatcatttattgaccatcactgaatgctgggagctcttgcgggtgtttttgttcaacttgcttaactcataacatcagcaagatgaaagaaattttcccagttttaaagatacaggatctgaggctgacagaccaaatgtctggcaggtgagatctcataactactagtgacagacctgggactgaatcaggtctcttcaattccatcaccttttgtctatgaaagtactcatccttcaggtttctgaggccacatgggtgtgtcataggcaaggagccttcaatcatagatgacatggaaagtcgcatctgtctcatttcccaagccatgttaataactgcctggaacagacagtgagaaaaacaaggacattggaacaccttatttctggtttcctttctctcttgtacagtgtgatttttaaatgctgctaacaaaacattggaacagaattgtgctccagaaaaaaatgagatccaacagacctttctttattatgggacaattaattttaagctgactttatcagcaaagggaggccagagtgacttgctttgtaattgttgggaagctgtgcacactggattagaggagaagtaatgtttcctttcaagttttgacccattttaacaaactgatatcttagtgtgttcaggctgccataacaaaatgccgtagactgggtggcttgaacaagagctatttattttcccatagctggggaggctggaagttcaagatcagggtgccaagatggtcaggtcctggtggaggctctctttgtggttggcagatggccaccttctcaatgtgtcttcagtggcgtttcctcagtgtgtacaggtggagagagagagaaagcaagccctctctttctctccttttaagggcagtaatccccttatgaggatcttacttttatgatgttatcttctcaaaagtcccatctccaaatgtctttagactgagggttagggatttcacatacaaatttgtggtgtaatgctctgatactcattggctttgtgactgagattgagccatttagttctctaagcatcctttctttggtgaaaaaatgcttgtagtccctactcacataggactgctgaggtaattcaatgaagtaaggtatgctaggagcttaactcagtgttctgctcatgttatacgtgcaataaacataaaccagtccctctcacttgaaggaaaaattgcccactttctgacccagagaacatgtgacaatgtctggagacatgtttggttgctacgactgggaagaggatgctactcgcatctagcagatggagtgaaggcatgcctctaaatatcctgcattacacaggacagtccccaaagcaaagaattgtctgtatcaaaatgttagcagtgctgatgttgagaaactctggtataacctatcattgcaacacaactactaatgttatattacctggaatcagggaggagggaggatgccattaacaaattatataaagtctgttttttaagagagactgtttttctctgttgcccaggctggagtgcactggcacaatcactgctcactgcagcctcaaactcccaggctcaagcaatcctcttatcttagcctcccaaggaggtggaactacaggtgtgcaccaacatgcccagttaattttttaaaaacttgtagaaatggggtctcaccatgttacccaggtcattcttgagctcttgatctccaaaaatcttcctgcctcagcctcccaaagggctgggattacagatttgagccacggcgcttggctaaaatgctatatactctattccgtacgtcagtattctcactaaaagaaggaagagtaggtttcaaggaacttgaggatgaaatatgtaacagtattcactcagtatattaaaaataaatacacaatgtcattggaatggccgatttattgggacaggcaattgtgtatgcagaataaatgctcaaaaagaactgtccaaggtgctgaaactttgacaaatgaaaataacctgttcaaaatgatgtgtaaactgaaggttttgtttgtttttgaagtggagtctcgctctgtcgcccaggctggagtgtgcagtggcatgattttggctcactacaatgttagcctcctgggttcaagcaatcctcccacgtcagcctccctagtagccaggattacagtcatgcatcaccacgcctggcttttttttatttttatttttttgtttttattttattttatttttttttaaagtaggggtggggttttaccatgttggccaggctgatctcgaactcctgacctcaggtgatccactctcctcccacagtgctaggattacagtgataagcctcccaaagtgctagaattacaggagtgagacactgcaccccgtcttaaactgaattttaaaggggataactgtctttgcaaaaatacatttaaaaggttgggaaaatatattttggatttgattctcagtctttcaaggtaatgggaatggaatcttgagtgagagagagtggatgataaactagaagccaagttctttaccaggttgttttttcgagatggagtctcgctctgtcacccaggctggagtgcagtggcactgtctcggctcactgcaacctccgtctccaggattcaagcacttctcctgcattagcctcctgagtagctgagattacaggcatgtgccaccacacccggctaatttttttgtatttttactagaggcacttttgaacatattggccaggctggtctcaaactgctgacgttgtgatatacccgcctggacctcccaaagggctggaattacaggtgtgagccaccgtgcttagcttctttaccaggttctatgcttcctgaatgcagggattctgtttatctttttcttgcattatggaatagcataaacttggggtctgagacagagttaagggtcagttcatgttctctttttcctttcttcttagtcactctcagtagtctggatttgttgtggtgacagcagcagatgcatccagtggcattgtgaaggcattagtatcattataggcgctgaggctatgggtgagcatatggcctgggactgcaaatcagaaactgctcgcattcctgggattgttcttctagactatggagtagatctggagcttggcttcttagccttttctgggcatcagaaccacctcagagttggcaaaaacaaagaaacttgagccgtattatagacttatggaatctgaatcttctggagtataaggcactgagcaggaagttttgctcatcagtgttcagacagaggctggggagaggaaaaagtgtttttcccttcccaaatcaagcatcaattaattctcaggactgctttggatagaaggttgttcacattattctgagattttggcttatttaagagcctattagacaccatttgtggttcatctcctcttgtttaaaaggctcttttgagcaaacaagaagtatttgaaatttttttatgactagcggtctagttattcacatttctattatgttccattccattcccaataattcattttaataacattttctttttttttcttaaagattttttttttctgactaataacattttctgatttgggtagaaagaaatattattccacaataagcaattgtgaaatactaaatttacttggctttaattacatctatagaggtaagcaacgtgtttcagggaaatctaacttctctttgaagggtaaagacccagttaattcatcatttacccattatttggtgtgataggcaacaccagtagttattgctgtgtggtgatagggtttctttcttggaaagactacacttcctagtcactcattgcagttaagtgagaccataaggcttgttcttgccaatgaattgtaggcttagtaaagttcatcacttctgggacaaagcatggaagagtgagacaccaccagacatgaccatcccttgccgcggtgaatttgaagtcctttgttgagatcaggaaatcgccatcaacatgtatccccaagtaattatgtggaacgggacctgcctcatccccaagatctgtctcggacatgtggtagatccttctgccatactattcaaactgaagactgggagttaatatggtgtcatggtataaactagcctatagagttgagttttagaagaagcctttcggatactgaaaacaaggcactgaacttaaattctgcagactggatttaaatctgggctcatgtttctcacttgtttcgggacgtaacctaagtcactgaactgccgtgataacagacacagccacagtgtattcagcacacctatgtgccaagcattgcacacagcgttttgcatatatcatctcacgtaattcctccagccacacttccacttgggtagacacgcctcacttggtggatgtggaaacaggcgtgatacacgatgcaaaaccagaaagtggaaatgctgaacttgaagtcacatgtgactgatgcctattcccgtatttttcttttttctaaagtggagttgattaaactgtctacttcactgggccgttttaggatgctgtgagcagggtaggtgacaggacgtggttacccgccaggtgaggttattgtgatttggtttcggccagcacttgctgcagagaacttaagactgtttcttttctggctgtcacttgaccctgtgtaccaaccttgaaatccctcactggcattttggtaaatttgtttcatgtttttgtcccatcagtagtaaaggtttcaccattattttcatttcctggttgagcgaccctctttctttcatgacttttggcttcatccttcagcctctttctctttttttattgttccatgttgctgtgagcagaactcatttttcaaaagacagatggtggcaaccctgttctctctaaataaaaaagcaaaacagctgttaaggtgcaaacagagtcgcggccagcaaatcgtatctgcttcaagtgttggcgaagtttcccttcagggaatgggagctatctaaacaaaatgtgcagcctcggctgtgctctgccaaggcccaagtatagaatgatggcaaataatggaaatttatagtgtactatagatccagcacctttctatcttggcgggtgcatatttaaatgcagtgctaacggagctgaaatttatggctctctaataacgataaaatgccatcagagaatgagataaatcttggccccaaaccttagcatgcaacgcacacactgacgcgcgcacacatgcttgtaaaatatagccagatactgctaactcaggagtctgcgtttggaagaagccaacggaacagagaaagtagaggaagtgttttatagacgactgcaaattgttgttttcatgaggctggggtcaaggtacattgtggcctcaggttgaaatgagtgttgctttgtctcatggctgatacatgcttgaccttggtgagggaagcttttccttttctagatgttcaatagcttttctcttcacgttttcacaaccctgtgacaggccaacttccaaacaaacactgatgaattatcaccctctgggaaaagaacatcgtggtgtgcttaagcgttttcttctgtttgtttatttatttatttgtgcattcattcattcagagagaattggagtcttcgaggcttagcaacaacagagagatgaaagacatttaccaaaatgctatatttgcaaactgtcggcgacgtgtgaattaggtgtgccccctttctctacgggcagttgtggtcttcagggaatggaattttacaaaatatcatttaggaggttgtcattcacgtttgaaaacaggcgtggccagctcctccagccaacctgcatgtacacccagctgttttctctctgtggagcatctaggtcttaggaagggaagcccatctggaaatctgtcttaagcccttgctgaatttccacgagccgtgcattcgtggatcctgcaagttagtaactacctgaagaagggggcattctctactggcttgcattctaggtgtttcctccagcttctccttatgcaaggggacttctaatattttgggcgagatgtttagtttcagtgagaagcctaacctccgggagttgtttcaggccacctccattaagagttagatacttctttctagatgcttctttatgcataattgtgtgtgcgtgggtgttcatgaatattgtcttaattgctcctgtttttgaaatacaacgtctaatccagtctatcattgatggacatttggattggttccatgtctttgctattgtgattagtgccgcagtaaacatacatgtgcatgtgtccttatagcagcataatttataatcctttgggtatttacccagtaatgggatgactgggtcaaatgttatttctagttctagatccttgaggaattgccacactgtgttccacaacattaggagatatacctaatgtaaatgacatgttaatgggtgcagcacaccaacatggcacctgtatacacatgtaacaaacctgcacgttgtgcacatgtaccctataccttaaagtattaaaaaaaaaaaagaagaaatacaacgtctacagattaaaacccactctaggccaggtgcagtggctgacgactgtaatctcagcacattgggaggccaaagtgggaggatctcttgagctcaggagttcaagaccagcctgggcaacacagtgagacctcgtctctacaaaaaaattaaaaagcaataaataaataaataagcaaagaagaagcaaaaagaaagcgttcttgttcagaactgaaaaaaactgttcctggtttcctagtttttagaagtgtgtgtgtgtgagtgtgtgtatgtctgtgtgtgtatgtgtaaagactgagaggtaatgatactgattgagttgaaaataaccattcctttgtaatatttctaaaattttttaggacactaaattattttatataaaattatataatattaggtggtttggtgtgtttgccttgtttaggttttgttaggttggtgcttgagaaaaaaacaggtagatttggaaaatgctgatgtttaggatgaaaagggatccaatttttcatataaaatgaattctttggagtaagaccttttagctgagattcatggacttcatgaaagtatgtgtgtgtttgtgtgagtgggagagagagagtgggagagtgcattcatgctgttgtaggttttgctaagagattttgtactttttgttaagttgtcaaaagctctcttgtctgaacccctgagcccatggtcctctctctcctcttgtttgtgctgtggatttgcagttactttacagttcgaatgaatgatctgttctgtgaatacgtagtttcattttacagttagaatgatgtgatcagggctgtgattcctaggctaggccattactgggaaaggtgtgacttggaccagaaaaaaagtaaggaagtgaatctcatgctaaagagaacaagcttggtttcaaacactgcatgtttatgggctttgcccaccaggtttagcttgtacaaggaaatacccacgccccaattcccattaatcctgaacatatgattctctctagctgttccacacctcccaatctgtggtccagcaatactgacatttttgcgtgtgttccaactaaaccctgctctcttttacctcccagcctttccacattttgttctctccacctgaaactatattccctttcttctggctctctcttttttttttttttctctgatgaagtgctgctaccctcaggaaggcgtctgtagtgttttctagatcagcttaggtgaacctttcatgtcttcctgtagcctccccacttccattgtcaaggtatttactacaattgtcatgtctcaggccaggtgcggcgtacccggggactcttttatgccatctttatacctctgtgtaaatctaaaatattttcttttttttctttgtttctttgtttctttctttatttcctctttttttagacagaatcttgccctgttacccaggctggagtgcagaggcacagtcttggctcactgcaacctctgtccgccaggttcaagtgattctcctgcctcagcctacggagtagctgggattacaggctgccatgcccagctacttttttgtagttttagtagagatgaggtttcaccatgctggtgaggctggtcttgaactcctgatcttgtcatccacctgcctcaacctcccaaagtgctgggatttcaggcgtcagccaccgcgcccagccaatctaaaatattttcaaaatataatgtttatgaaaattaaataaaataaggaatctaggtcaatatctgtgttttatcaaagcaaccagaagatcagacatgtccacataaagagtgatgaacttgtattaacagaaaaggaaatgacattggacactgtctgtgtcatcacactgcagagggaagaggaagaggaggagggaaatgtccttccctctgagaaccatgagctcagtgaaatccctgcattcccacccacatccttaatgttcccagtatccaccaccctgaccggcttaagtgagcacttaagaatttttctcgaggccagtcttgaaggctcatgcctgtaatcccagaactttgcgatgctaagacaggcaaatcgcttgaggccaggagttctagaccagcatggccaacatggtgaaatcctgtctctacttaaaaatacaaaaattagttgggcatagtggcaggcatctgtaatcccagctactggggaggctgaggcaggagaatcggttgaacctgggaggcagaggctgcagtgagcccaggtcgtgctactgcactccagcatgagtgagagagcaagactctttttcaaaaaaattgttttttgttgaataaatgaataaacgaagcatcacaggacaagggaaacttgtctcttctcagttagttgctgagtaaattgttgtttcttatgtgttgcgtcggcccccacctcatttggttactacttgagtcctcttggtttcattttattttctctctctctctatatatatatatttactttttaatatttaaaaacatttttgaatattttagtatttatgttcttatatattttaaaatatttttatttttaaatttgttttatgtatgttttttatatatttgtatatatgttttatatatcagtattaatttttaatataatttatattgtatatattttatattaatattttatataaatattatattttataaaatttataaaattttataaaatttttatatttataaaatatattatattttataaaatatataaaagtaaaatattttattttttataaaatataatattttataaattatataaaaattttattaaaatttttatttccctcagcctatttgcacagactggattaagtgtccatcatagtatttaccaagctttttgcacataacaaaaatgaccctaaaaacaagagtaacagtttttatttattgagcatgtactatataccaggcatgcttgaaaagcctttatagatttatttctaattcttgaaggtagttggtattatcttcattctaaattgccagaaccttctttctctctctttctttctttcttttctttctttctttcttttctttctttctttattttcttttctttctttcttttctttctctctctctctccctccccttccccctccccttccccctccccctctccctccccttcccttccccctccccttcccctccccttccccctccccttccccctcccctttcctttcctttcctttccacagggtctcactgtgtcacccagattggagtgtggtggagcaatctccactcactgcaacctctgcctcctgggttataaatgatcctcccacctcagcctcctgagtagctgggactacagacacacccctaatttttgtattctttggtagagacgggatttcaccatgttggccaggttcgtcttgaactcaagacattaagtgatccacccacctcagcctcccaaagtgctgggattgcaggcatgaaccaccactgcacctggccgtgaaccccatattcttaaagatggtagagctgggattcgaagtcaggtctgcttaaacccagagcatatcttcatgccccacatttccctctgtctctctgagtttatggagttggttagaaatgtcgtatttctttttctttctttatactccagattccctgtgaggtcaggaactaggcctttttcatgataaccctagtgaagatcctaattttgaaaacttatctaatatttattgggaagctgttgtgagccaagcactgcagtaggctctggatatattaggcccatccccgtatagagctgacatgtagcagatgaaagcagaaaaagagaaaaaaaggtaagtaggcaaaatgaggaaaaacgaagtcttagtatgggccaaacagtttcctaatgtttggtatattagctcattttatccatgagacaagttctattcttattgacctgattttatatccaaggaagctgaggggcagagaatttgaacaactgcctccaatgttcacacagctagaatgctgcagaactagggcttgcaccccattgtctcactcttgagtcttcattctttatcactaaatagacacagccaggaaggaggcagaatgggcagtgaaatgcttttgcagaagttggcatttaatgtgaaggttgaaaaataagaaggaatgaccatttgaagtgtagagataagagaatcctatgcaaaaagcccagccagtgcaaaggcactgaggtaggagagagctgagtaaattcaaagaaaataaaacacatagtgggaggctgcagaaggagggaggtaatgaccattatgaaatgaatgggctgggcatggtagctcatgactataatcctatcactttgggaggccaaggcgggtggattgcctgaggtcaggagtccaagaccagaccgcatctctactaaaaatacaaaaagttagctgggagtggtggtgcatgcctgtaatcccagctacttgggaggctgagacaggagaattgcttgaacccaggaggcagaggttgcagtgagccgagatcatgtcattgaattctagcctggatgacagagtgagactccatctcaaaaaaaaaaagagagaaatgaatgatgggcttgagttgggtggagcacttgatgccagggctttaagaacagcctggccaacatggtgaaacttcgtctgtactaaaaaaaaaaaaaaaaaaaaaaaaaaaaaattagcttgccatagtggtacatgactataatttcagcactgggaaggccccagtataccttggaactcctctgcctaggttatctcccttgtcttaaatcagagatgggtgttacttactctacagtacacagaaacaggtatcacttatcaatccctgtgttcttttccacttagctcaaatacagcctcggcatccttctgaacactctggagtaggctgccatttttaatcacccagatgttaaatttattcatcatccctatatatatttcccacaggatcaaagtatatcgagtttggaaagggagttgaaaacaaggaagactccctgcttttgattcccatgagggcaatagctgtcactctcctaggggatgttttgataagacagccacttaggtttctatatcctcctgataaccgtatgttgaaaaaggatttaagaggaaggtcataaaaccagggatttcttaacagcagggtgtggcttggcttactaagaatatacttgtgatgcattttaatgacatgctttatgttatcatattaaagattgtaaaagcatctagtaatcatttaataaatattaatgaagcatttacaaattgcaccttaatttacagcattggcactcatatcgtgctctggacatgaatgcacagagacatggtggctttgacaaagactaccatggagagcctggttctgtgacattgtgccatcctggtaccataagtgattttttaaaataataattcttggagggcagttgagtgcaatgaagcttgatgcctaaagcagttttagcaattatttttctgtttggggaacattaaaacataatctaccatgaatttataatccatagcttctctctcatgcacttcttaataataagcagtagttataggcccttgtgcaaaaattctttgtagatgttaggagatacttcctcattgtgtaaacactggggcaggtaagggatatattgcaagcgataactgtggggtcgccactcccctgccaccatctttgtttgatgcttagggagatctcctgttctttgcaggcacttagatacgaatggaggagccccaggcacaaattcctcagcactctgtcctgctcttgttgctggacttgattgtctttcagacagtgcattcaatgttgagttcagagccattccctgcaattccctctggaccctgttggatgttaaccacgatggttctcacacggggctgggtgtcacgtggctcacagaaaactacagatggaagggccttagaagtcacctgctgcactcctcactttatagaggaggacactgaggcccagagaggaacaggacattcacaggccacacaccaggcaagaagcagagatgaaactgttacaggcaaggggctggatcccgaccccaagagagcgttctcagatctcccgcaagacaagagttgagggcgtgtctgtagagtgaagcgaaagtatgtttattaagaatgtagaggaataaaagaatgtccactccatagacagaacagccctgaaggctgctgcctgcccatttttatggttatttcttgatgatatgctaaacaaggggtgaattactcatgtctcccctttttagaccatatagggtaactctgtgatgttgccatggtgtttggaaactatcatggcgctcgtgagtatagcagtgaggacgaccagaggtccctctcagggccatctgggttttgatgggttttggctggcttctttactgcaaactgtttttatcagcaaggtccttatgacctgtattttgtgctgacctcctattttatcgtatgacttagaatgcctaaccttctgggaatgcatcctagtaggtctcagccttgttgtacccagcccctatggaagatggagttgctctggttcaaacacctctgacaaaaccggatcccaagacataagattgtgcagtgtgcatttgcatgcttctcagcctcagagctaaggagacctgggcatgtcctgggggggttttggatagaggggggcacctcttcatcaggggtgctggagaaggcctggcctggcctctggagcctgccgcactgccagtcaggacatcctagctgagcaggagccatgggcgtcccggggaatcctaggtactgagaggagatggccagcagatggcgctgcagggattcaaactggagcagccatatctgacagcaaccccaggtcagggattcaaagctccagcaaccaggatgagctgcttaatagtacaggcctggacttcagggatgcctagacccctctcgggagctcccacctggcctggaaagagagccaggtctagaatgggctggtgcaggtatctgtagactggtcatactgggtttgggatcagaccccagaccaagaaggaacaaagggaaaacaaaaggactagcgcagctgctgtgtccaggctggggtgcttgctatgtgggcaggactatggtcacaggccagggtggaaatggcagccagaaggcctccctctgcgtggggtctcccttaaacccaacttcttggggcctactctgaggacatcaagaccgtctcttctaggaaggcaagaggccaacacccatgaagctgctgtttttcctttcctgctcctgacttggaggcgtggagattgccaccaggccatgtttaatgtcttttaattaacggtttaactcgggtatccatgatgcaagggttttgcaaaggaattcaatctagttttcaaaattgcagaattaagtgggtaaagaacagttgagggcagcacttacatttctgaatatttagactctttttttcttcttctttcatttttttcacacttccaatctgcctcttttcttcttctctctgtttctatctctctcacacacatacacaatcacagctgcttcatacggcttctccccgtcccctctcctggcagctgtggcgtttctgcacagaggtgcagggaaggaggaaaggccttgggtcccctggtcaggatccagctgaaacaaccagaaatactgtccctgtacctctcaggtcgggtgacttactgtgcctctgaaccctctttcttccatacctcccctacccaattccgaggcctcaactttgtgctgccagagggcactatgccacctttaaatgagatttagaaaaagtttacacatggcacctgctgatctggacattccagtcggcttgctgtatctcctagttgcaagggagggctttgcttagagcagcctgtgccccgtagggtaataccggagctggcggcctcccaggaaggctgcaaagtgcttgggtgctttgccctctctgaagcatacatcagcacccctaaggtttagctgtgctgcagccacagcccacacactcctccattctccctgaacaataggacccttgctgagatagtctggtaggagaggggaggctctttcctgaacccgtctctcctaaacgctttctatgccttagagtgctaagaacagtctaccctccttacgagactgagtgtttcctgaaggcaggagctgtatcttattgaactctccagcgcacagaaaaaactcataaatatttgttcaactaataaacaagtaaatgaatagagaggatgaataatcttttagggtaagttaattacatctattttatttaaaatgcattatagaattttgtctctgtgccaggaactgcttaaagtattttttagatataatctcatagatgcctaacaaaaaccctgtaagttagacacccttaacatctccttttttcaggtggaataggagaggtacagattgggtaggtaacttgcccaaggtcaggcagagccaggattcaaactcaagcagtctggcttcagggcttttttttctaaatcactccctgtggtttctcttagtcttagaccaagactaatgtacttagaaatacccagccagggaacaagaatgcatagaatttaatcccccaagcccaactttcattattcagctttcaaaagacatggcagggaaggtttccagacagaagaggaatagtcagtttgtttttaattcaccagtaaaacaaatagacttctttccttttatatttgtaacatacagcttgcatttttttttattttaaacaagaaaaggaagaaataaatgagaaagaagggaaggaaggtggaggaggtgggagagagaaaggagagggaggagagggaaaccgggagaaaaaaagaagggagaagagaagggaggaagaaaagaagggaaaagagaaggaaggagggagagaaggggaaggaaaaggaaggaagaaacaagggtggaaggacgaaaggcaagaaggaagggaagaaggagaaggaaagaaaggaagccttatttaatctccagcacagaaagtgttcgcagccctgagaaacgtggtttctcatttgcctgttacttggcacagtttgactgcctagaagcctgcagaaatattggaagtcaaggtccaatataataattggcttacagatttgaagaaggatagatagactcttccatttccaagattcattagtccagctttctccgtaatagacagggcttgctctacgtgtaagccattttctaatcaaattggcacacagttcatgctctgacttggtataaatgggcttctgtgaaattgctctgcctgggctcagggctggagttagatgggatggattttatctctctgatgcttgatcatcttgggctctgcatggaggaaacctgtctctactaaaaatataaaattagctgggcgtggtggctcatgcctgtaatcccagctccttgggaggctgaggcaggagaatcgcttgaacccgggaggcggaggttgcagtgagctgaggttgaagcattgcactccaacctgggcaataagagtgaaactccctcacacacacacacacacacacacacaaaaaaaaaaaaaaaaaaaaaaaaaattgaaccacacatcattgtgacttctatttgtgaaatgttcccaaaggatatttgaaaatgtgaaccaactgtgaattattgcaggacttgatatgcacaggaaatgtaatagggacgtggaggttcgtaatgtgagtttggaaaccatggaacatccaaacattggcgatcaacaaagccagcagtatgtggacagcttatgagaaaaggtgtgggcatcgcttggatctgagtgggaatccaagctctgccactcagctatgtgttgctaggaaagtttgcaagcatctatgaaataatgaaagtttaaatgaccatagcagcaagcatgctgtttggaagaccaatctccagatgaacttaactaacggtttctagtaatgctaagcataaaacagaaaaaaaaaagctatatatatatatatatatatatatatatatatatacacacacacacacacacacacacacacacacacacacacatatacgtatatatatatgtgtatatatgtatatatatacacatatatatacgtatacgtgtatatatacacatatgtatacgtatacgtatatatatacacacatatatatacgtatacgtatatatatacacacatatatatacgtatacgtatatatatacacatatatatatacgtatatgtatatatatataaaatcaagaagagccagaagagattggaaagctctttggccctgatagaagaaagctgatgcgtcacacagaagaaacatgagtcttcagttcttcttttgctcttgtcttctctgtcaagaaaaatcatcttcagtcaggatggaatagagtttggtttaggtgacaaagtcagtgttggtgaagcagaatgaagagagtgctagctcttaagaaatctaatattttacctggactaatatctccaaacaggagagtaacttggacatgagatcattaagtatcattgacaatttgtggcaaaaagcagaagggtatgagatttgaaatgcggaaataggatattctaattttcaaaacagatgaaagaagctgggagactctataattatagggtggtagcatctcatggtgtaaccactattaatggttcacttgttcaatgattaaagtcccatgtgatctgatcttcacatgaatctggacattatgaaaagcatggcttgtggatttcttgaagatgaaagaatgataacttgattcttatgtccattcattgggaataatgaagacccagcaaatgccatttcttctcactagaatgggagatttggagaatggggtagacacatgatgtgtgaattccagcaagacagtcaacaaggacacacttttcggtcacgtgtgtgtgatccctttatgggaaaagtggaggatggtgggatagatagtcagaaaagtatgtgggaaagtaaaacattattacaaattggtgccaaaaattataatgagtagattggcccataaccctggtggttttaattgtagtgatgtcattgagctttgttctgagatatgtcctgatggcattttttctaaatggttggatcatgatagagaaggctgttcttcagtgacacagatgggatggagtggagtgcctctgtttaatggagtcaggactttcatacccattttacagatgaggaaatgaggcatatgaaatgtattcatttcctagcattgccataagttaacgccaactggatggctttaaaacaacagaagtttattcattcaaggttctggaggccacaagtctgaaatcaaaatgtcagcaaggccaagttccttctgaaggctctagggtagaatccttccttccttctcccaccttccagtggctccaggcgttccttggtttgtggccacatcactctagtctctgcctctgtcttcacatgctattgtctttgtttctctgtgtgttctttgctatttcgtatgtggacactccctttggatctaggacctactctaatctactatgattttctcttgatccttaccttatttacatctgtaaagactgtatttccaaataaggccacattctgaggttctgggtggacctgaatttgaagagacactattcaacccattatacaaagttatggggtctaattaaggccctcaaataagaggcaggtccaggacttgacttcatccgtgtctgactctaaaccacacattttttcttttgtcttaggggagataaggatagggaaatgaatccaatccttgtcatttgacaaagagtggaagggaatgtgggtatttatcttggaaataaaatgatcaagaaaggacatggggtgtgtggagcagaatgatcctgcagaaagaggacctttatgacctagttggtttgggatgggagatggtgtatgatgctgatgctgcttcttccaaggagggtagccagggttgtaagtaagactgtagactgggtggagaggaagcaactgcaggtatgctgcaggatagtggctacagctttgcatgtagagagtcagcaatgccttacagttaagaaaataaagctaagcttggctgcctggcctggaatcctgactcctctatttactcatgatgtcaactttggcaggttgtttaacctttgtgactacactgtagagataaaagcagtatcatggctgggtgctatggctcatacctgtaatctcagcactttgggaggccgaggcaggtggatcacttgaggtcaggatttcaagaccagcctggctaacatggtgaaaccccgtctctactaaaaatacaaaaattagctaggcatggtggcacatgcctgtagttctggctacttgggaggctgaggcaggagaatcacttgaacccgtaaggtggaggctgcagtgagccaagccaagatcatgccactgcactccagccgaggcaacagagtgagaccctgcctaaaaaaaaaagaaagaaaagaaaagaaaggcaatgtcaacgacatcgggcagatgtgatgaataattttgatgggattggcgagataatccagtactttataaatgctacctattgtgatttttaaaatactatactctgtgccctcaaacaacatcccgtgttttacccactgcagagaagatgcagatggcttgtgtctcatggggcctggctcacatgtaagccaacgtggtccttgctggcctgctggacacacagggagctccactaccttgccttctaactgatctctccctgatcagtataattacggaggccctgctttcttccagcagccaaattgttgggatggacttcctcgttatttgaagcatttgttactgaagttagtatggcctcctggctttgctcacatctgggaaagaaagtcgattctcctttgtatttagtggcttggaagctgccagcaactttcggatggccgtagtgtcccctcttgagaatcagagaatttcattattatttttaaaaatcttatcttggcggggtgcggtggcccacacctgtaatcccagttctttgggaggccaaggcgggcggatcgcttgaggtcaggagttcgagaccagactgaccaacatggtgaaaccccatctctactaaaaaaacaaaaacaaaaacaaaacaaaaaaatttagctgggtgtggtgggaggagcctgtagtcctagctacttgggaggctgaggcacaagaattgcttgaacccaggaggtggaggttgcagtgagctgagatcccagtgcactccaatctgggcaatagagcaagacttcatctcaaaaaacaaacaaataaataaataaataataaaaatcccatcttaattttttaaaggaaaaaaataaaacctatggtcatgagcaaattacagatcagctaaatcttatgtgggaacatctccccatctacagctatttctgtttgtttgtttgtttgtttgtttgttttgctagacgagtattttccctcctcaagctaattgcttgatggaattaaagacgataatctctaataattccagtgaacacatggttcattttcaggtagttttatcctcgaatttcacttgttattttgttgtcggtggcaaattttccttttaccctctatgagacacccccgccttgggtctacctgaactaaaaatgcgtttggtgtctccaggctcatggcatagccactctgggaaacttgtctaacttccagattctcaaatttctgcagctgagagcatgtctctcttttgggaaggaggcttttcctggctggtgggagaacagcttcaatttgggagacagtgtgagtcagcaggaataacgctaaatggctggaaatcagctcagcaaaaatagcaggagcacctactgtgtagagactgtccactagccctgtcttcagaaggcaagaaaggaatgccaactctctcctcttgggctgagtggggagatgagacagggcagggaagaaggaaagtgcagtaagcaggttctgatgacgaggcggtaaaggtgttgattttagggattatagggagaccacccgtgccttacctcctccttaaaagtccaaaaacaggacgggcacagtgggtcacgcctgtaatcctagaactttgggaggccgaggcgggcagatcacccgaggccaggagtttgagaccagcctggctgacatggtgaaaccccgtctctactaaaaatacaaaaattagccagatgtgatggcacatgcctgtaatcccagctacttgggaggctgaggcaggagattcgcttgatcccgggaggcggaggttgcagtgagccaagattgcgccactgcagtccagcctaggggatagagggagactcagtctcaaaaactgaaaacaatggtgaatgtgaacgtcctttaagaggacagagctgatcatcatgggtgatatgcttaggataactttaaagacacagaatggctccctgtggggcaacttaacagaaacaaaagcagatgaggaagggaggctgggatggggcttggttccctattgaacagtagaaagacattttgtccgggcgtggcgacttatgcctgtaatcccagcactttgggagcgtgagctggggaccagcctgagtaacatagcaaaacctcatctctactaaaaataaaacaaattagcccactagagtggcatctgcctgtgggcccagctactcaggaggctggggcaggaggattatttgagcctgggaagttcaagctgcagtgagctatgattgcactgctgcatttcaggctgggtgaccaagcaagaccctgtctaaaatgtctaaaataaaataataaaggcatttaattcaatacttagtgaatacttggatttctctccattgcggagatgaggtaggtatggcaggggatggggacgcggtggtgcaggtgtccatgccatggcttaagtgccatccctggagcaacaggacgttgtctgagtgattctcattgctggttctggattcaaatagcctgggtttgactcctggctctggtttttcctaacttggggcaccttgtttagcctctctccatctcagtgctctcatctgttcaaggggataatgataatgacagtatctactgggtaaggtccctgtaagaagtcactgtaggatgaaggcagaaagctagatcatgcctggtaatgaccaggttggtgctggaggagagggggctgaggttggagatcatcaatgcaccaggggtctcgggatgatgaagagagtcgctgccctctgcttcttcccccttcttccttgctgggctccagctggctgaaagtgtatgaccatctatctctagggcacttcagaaagatggatgggaagtgggaagaggggatgaggctgcctagagagccttgaaattttaacttctgtgaaatatccagagaagatccctggcaatgtttttgtgtctatctcattgaagacacatcagtgaggctagcagagggccctctttattggggagcagaacaggagacattcgcctttcagtgaggacacctcacatcagtgcccctgtagatttattgtgaattacctggggtttgggggaggggtctcagaaaatgcaatttctaattcacttggtctggggtggagtctaagatattgcattactttttttttttttcttttttcttttttttttttttttttgagatggagtcctgctctgttgcccaggctggagtgcagtggcgtgatctctgttcactgcaacctctgcctccccggttctatcgattctcattcctcagcctctgagtagctgggcctacaggtgcccaccaccatgcctggctaatttttgtatttttattagagacagggttttacattgttggccagggtggtctcaaacttgtggcctcaggtgatccacccgtcttggcctcccaaagtgctgggattacaggtgtgagccgctgcaccgggcctctgagacagtgcatttgtaatgagtttccaggtgatgccaacgctgttggtcctcagtctcactttgagtgttaagatcctgcaggatactccaagtgagaactgtacttgggattccgcaccctccccttcattcctcacccaggcttgcccatttgactgtggtgctggcccatttatcctagttaaagggttccacagttccctgtgattatccctcatgatacggatcacgttatacacttaaattaaataaaatgcaccctatcgaatgcactgcacacaaaaagaatatttatttgaatattaagtacagataagacttcccctgggattatttcagagcgcatttgcagaatttaattgcaatattttcccactcagtttctttctgaacgctacttgtgaaaatattttctttctgaaggtaaagctctgcgttgttggtttattattattattattttaaatctgaagagctctctgagctcggtcattacttccagtgtctaattaatcctgatgatgataaagtaaacagccaggtgacctagattttccttttaaattgctagcaattaacatgaatgcctgctcattgttgcagaacttttgggaatctagtccttccagttaggattccttaagttgggggttttaagagttcattttgtgtgaagcatatgtcttccagcactccttccattaagctttccaggaagaatgtgaacacagacacacacacacacacatatacagagcaacagtcaccaccaccacccagccaaccctttcagacaactgaactggaaaattagaaaatgaatactcctcaagtttctcaagctacagaatccttcccatttcttaaataatgacattttgtaaagtcatagaaatcagcaatagaaaagacctcttgtgtaaagatctcttcagatgcgaaagtcagaatagcatggaaagacagcctggggatgtccaccttgggtgccttctatccctatttccttgtctggagaattggtcccatgggacttagttcaccttgacatttttttttttttccatgacagccttgtagttgttacatgatttatttcttttgacattctctacaatgtgtagatgtggatttacagtgtcccatcctaaaactttcagaagcagtagccaatttttcacaatcttggttttctaccgctgtgttataggaaaggggtcccaatgcagatccccagatagggttcttggatctccctcaagaaagaattcagggcggccgggcgtggtggctcacgcttgtaatctcaatactttgggaggctgaggcaggcggattacaagggcaggagtttgagaccagcctgggtgtctgtactaaaattagaaaaattagctggatactgtggcggctgcccataatcccaactattcgggaggctgaggctggagaatcgcttgaaaccgtaaggcggaggttgcagtgaaccgaaatcgtgccactgcactccagcctcgtcgaaagagcaaaactccgtctcaaaaacaaacaaacaaacaaaaaaaacaaaaaacaaacaaagaaaaaaaaaaagaaagaattcagggaagtccatagagtaaagtgaaagcaagtttattaagaaagtaggggaataagaatggctagttcatagacagagtggatgaagggcagaggagcccctcatcagagtggatgatgagccccttggggctgcttgtttcccatttttatggttatttcttgatgacatgctaaacaaggagtagattattcatgcttcccctttttagatcatacagggtaacttcctgacgttgccatggcatttataaactgtcatggtgccagtgggagtgtggcagtgaggacaaccagaggtcaccttcgtcaccatcttggttttggtgggttttggctggcttctttactgcaaactgttctatcagcaaggtccttacgacctgtatcttgtcttgtgctgacctcctatcttatcctgtgacttagaatgccttagccatctgggaatgcagcccagtaggtcttagcctcttttttttttttttttttttttttttttgagatggagttttgctcttgttgcccaggctggagtgtgcaccggcacaatcttggctcaccataacctccacttcccaggttcaagagcttctcctgcctcagcctcccaagtagctgggattataggcatacaccaccatgccagaggtcttagcttcattttacccagcccctattcaagatggagttgctctggttcataaacctctgacaattgtgatgctgtctgctaaatatctaaggaaacagtgaggcacgtccagtccactgtcaacttatgaaaagaagaaatcacaacaacaacaacaaatggactactgaattcagtttactttcttgtagtgaaaaggcacgttatatagtgctttccgtgtgataggcactcttctaattgctttgcaaatattaactcattcaaatcatgtgatgaccctgtggggcacatgggtagacccaggcaaggaatttgttcaaggtctgtaagctaataaggagttgagttgagctttgaaccttggaagtctggctttcgattttgttctctgaaccactgcattttagatgcctctcaaatgtctctcagttaatatgatcaagatgactgcccagataaggccatggcctgtgtgtctctgctgaatctatttaattgggatgcagattataaaattatcaacttctgataaaattattattagagctctgtaatatccaatgagaaagaaaaaaaattacagttaaaacatcttaacttgaaaatgtcttgagaacatatattctatcccagtagagagattcaaatggtatgtaaatcccccacttgccctcccctccacactctttcccacctctggatgtagagagggggatgatgggaaaatcttcgctgagatgctcattctacacagagtttcctggctatagggtaacgatggtcccaggagaccggttcagggaagcatgccaagcccttttagttacccaggacattttggtgagtattgcttgaattttcttagactgagcaagggtttgggatgggatggggttgaaggagggcaattataacccttgatcatgagggaaagaaatggtgattgctttcgctgctgaaacaaatagaaatcatctttgtaataactgcaattgttttctccagccctcctctgccttggttcacaaaataccttattaaatctggagaataaaaatgtacctggggtaatggtttattattagaataaataataggcaatatgtttcttccaccctgcaaggtatcagatgccaagacatttcgtggtttagcttgtaaaggtgcttacatgtgtcagaccagccaggctcttcatggccaggggctgccctttcatttcaagaccagcatcaagcctgaagtgaacaactccacgagactgcattcttgcagaaagcagatgtgggaggccgaaggggatattggccacgtgctgcctggggctgccatgtcttgctcaatgtttgtctgtctgattaatctgtctggacctgggggacttcttttgttgataatggggtctttaccaagagggtgcatggcagagcaagtgtgaaaagcacttcctcccaagaaaacacctcattaaaacgtgtaatttgaggtttgttcaaattctgtgggcatcctgacctctgacatccctttaatcagataaccaacacttgaatctctccagtgacttatagccagagcagtgactctcttgatataagtaccattattaccaaacaatatgatgtttaaaggaatatcagaagtgctcactaaatgtgttgtcctgcctgggagatagcaccccataggtcattcgagtgctaagaatactaagtgttttgagattttaggatatgctccataaagtattcccgaggactcttagccataaattaaatatgttagagctttcagcatttgggtttattgtgcaagtttacgtataacaacaaatccattattattttttctacttagtacttagccttgacaagctctttcgtccgtctcccttgaccctccaaagctggcatcctttcaaaaccagacaagatttttacagcagataatggtcttccccaaggttaagaggaaaacatcgtgggagagctgggtgtgttctccaagctattttctcaagtgtattttgttcgtttatgcaacatgagacagaatcaagttcattaatcatggctgacttgagtcattgttgtgactttttgtttttacttttttaattgattatttctcacctcctttcctgaaacctaagcatttactagtgtaacacacttttgttcttccttgtgacaaaaagtaacaaccgccatgaccggtggtgggatctgtatttgcttatctgacataaactatcctgtcttcttagaatcagaggacacactttattgtgtgatacacttgcaagaagcagtgggtatgattacaaccatacgtcggattataggactgtattatgttcaaagatttcaggcctttataaactcaggtatctaataaacattacacatgagaccctagaagcagacgaggcaaagcgacctctctctttttattttctgtttgtacttttactttcctactgaagagaatccacacaaaaatacttatgtccctgcagaattggagcttttgttttgtttttcaagatagccaccctacatttactcttttggtgctatggggagttattttattattattattattatcattattattattattttgagacaaagtcttgctctgtcaccaggttggagtgcagtgacatgatctcagctcactgcaacctctgcctcccaggttcaagcaattctcctgcctcagcctcccgagtagctgggactacaggtgcccgccaccatgctagctagttttctgtatttttagtagagacggggtttcaccatgttggccaggatggtctcgatctcttgacctcatggtcctcctgcctcagcctcccaaagtgctgggattgcaggtgtgagccaccgtgcccggctgagttattttatagccaccattaatcacatacttactatgtgccaggccagatttggctttgatgctctacaaataacatctcatttaattattacaataaccatataactcaggcatttaaattatattattattgctgctcttagtatgaatttataaaactgatgcatgctcattgcaataagttgaagtgatataacagaatccaagattaaaaatgagaaaacctgcttctctgtcccttcttctccactattggtctggttcccaggacatcatttttctgcttttgtctgaagtttgttgtttatcattccagacttttttccaggtataaatggatatttttctgtgtgtgtaccttgtgtgtgtgcatagttttttatacacaaatggattataggttaaaaatgattttaacttgcttttgttttattttgtcatagacatcattcctgaaatcattcattttctaatggattcataatattccgtagtataggtcaaagtttggcaaattgtggccatgggccaaagacagctcactgcgtgattctgtaaataaagttttttttttgttttgtttttttgtttttttgtttttttgctggggggggaaggagtcttgctctgtcccccaggctggagtgcaatgatgcaatctctgctcattgcaacgtccacctcctgggttcaagcgattctcctgcctcagccccctgagtagctgggattacaggcaagtgccaacacgcccagctaatttttttttttttttttttttttttgtatttttagtaaatacggggtttcaccatgttggtcaggctggtgtcgaacatctgacctcatgatccacccgccttgtcctcccaaagtgctgggattacaggtgtgagccaccacatccaaccctgtaaataaaattttattggaacacagtggcacccatttgtttacacgttgtcagtggctgcttttccaccataatgggagaaccgagtagctgcaacaaagacaagagagtctgtggctctcaaagggcaatgcatttcctatttggctcttaggagaaaaagtttttcaattcctaatgtagatgaaccacaattcttttaaccatttcattacttgtggacattggcattcttctcagttctgggtctgttctgtgacaagcgctgtccttacttcctcattcgccgttgcactctggtaaagtgattcctagaatactaaccattgaattaaaggaaatggaagttctacatagtgataactgccagctgccccctcgaaacagtcagtaccaatttaccacccttcttaaaaagataatatcaaacctttcgaaaggaatctgatgctacaaaagtgtcattaatttagccaaattcacaaggcctcttggggaacaaagccaggatttggacccaagtcatttgacccagtgcttcttgtgaaaacctcctgtgtcattaatttgaataccaattgctggtatttgctgaatttttaaatgtgttaagtgctttgcttagtaattcttatagattatgctcacaataaaattagacactttgcaggtaccatattatctctatggtacaaatggggaaattgcctgcagagattatataatatggctaacgttacttaggagatgttcaaggactggacttccttagtctgattccttaacctccagtctccattggggagaaaactggatctacagaagggcccagtgctttgatatcagagaaatctaatttggtggaaattatactggttcttacctcaataagccaagtttggaaatttatgtgttttatggaactagacaacactagctagtcggtgcatgtcttgttttagagaaacacaagtgtgtaaacagcatcttgtcagggcacagtagctaatgagcacctgctaaggacaagtgaggcgcagattggggaggagggctaacagtgtaggtatccatggttttgtttggtttacctgaccctggaaactgtgtacaatggtgattcagagaggaaacctagtcaacccatccagatggtaattccctcttgaatatttcctatctttacggttttaggaattcactcactctgtgcctcagtttttccacctgtaaaatggagctaaaatcaaatcagctaatgaaatcaattgtcagctgcttacaaagttctgagaattaactaagcttataactaggaactgtttagcacattttatgacatattacaaacattggatacattttaacgaatgttagtgtgcaatttatttcagcaaaaagtgattaaggccaggtgcagtggcttgcgcctgtaatgccagcagtttgggaggcccaggcgggcggatcatttgaggtcaggagttcaagaccagcctggccaacatggcaaaactccatctctgctacaaatgcaaaaattagccgggtgtggtggcgctcacctggaatcccaggtactcgggaggctgaggcaggagaatcacttgaacctgggaggtggaggtttcagtgagctgagattgcgccactgcactccagcctgggtgacagaggaagactttgtttcaaaaataaataaataaataaagtgattaaaacaattactttcctagcagcatagttaaaattgagcaaaacctaaatattttgcaatcccaaagttccttcgcttccatcctccaccccccacaatctccctgactttatcctgcttttgactgtgccattcacggtatcttgtttctgtatccttggggaggtcctcccgcccaactcctatttactcagtaagggttagatcaagggtctcagctccagaaacaactgactgatgtctcctccactgcttcccgtccttcagcaggctgggttggtgcatctcctttgagcacccctggaaccctgttttttcttttctatcacatacgaccctgtatcatcatcattattttattcatcactcctcccctgtcttttttaaataaaatgtacaatgtgtcatttagatacacaccccctttcattagcacagcgctaggcagttagtaccctgagtacatatgtcaaatgtgtatcatagtcctgaaatgcatcaaggaaaacgcaaactccagggctcaccctaggtacttggagacgtgcgtttataggaaaatgccatcttgtttcagaagagtttataatgattacaaaaacagcaacgctgagaaataaagctaccaattgatttgatatattgagttctatgctggtaaacttgtccagtgttttccttctaagtgattcataattgtcctgaaaactggattttccaacattctattattgtggacatgaaaacatgaacatctatttatccattcatttattgtgtgtcttctgtttctttggactcctactttccccagttcaagttaatctctcaccagttccctcttgcacttgactcttgtgtcatattcaattactgcacttccataatctcactgagctttccacacatcctcctgcctttcctctgaatatatttttttcattctttacctggatacattgtctaaaagacaaaacaaaaacaaacaaaatacactaatacctttttcaattctccaagacaagttgggccacctcctatgcactgcaagcacctcttacactttcactgtacaaatgttctctgtattgtaattatccatagactcatctttttccccacctagacaatagctccagtagccttctttgctgttgtattcctggcacttaggacagtgtctgacatccagaaggtgcttgagatatgtgtatgtatatgtgcatgtgtgggtatgggtgtgtatgtgtgtgagtaaatatatatgaaaggatggatgagtaaacaagtggattccaaacatcgtactcatctctagaaaaggaaagccacctaaggctcagttctagttcttgcagagccagtctgatgtgtgggagagaaaaatcagactgaaaacagggtcagaataaagcaggaagaactgataagagagaactcaaagtcaggagaaggatgaaaaaggctgagtgagaaagcgtctttggccctgttggctaaatgaagataggagacggggaagatgaatccctgctattaaacatctcgttcaaccgggagagcaaagggtctcatgctgaagtttattgcttcagtttctaacctttcataagtgcttacttggcagccctttcaagagtggtatttgattctggaagcatcttaaaggaacagcgcccgaccttccactttactttttttcatttaggccataaaatatattggttttgtgcattactgccatgggagaaaaaaaatatcacatgttagtttccaaatgaaatgacatttgataaagtgtacatttaagatatttttcaaggctagcttttaaagaatgcacaggcagggtctttcttcatcacagactgtagggagttacaggtgcctttttttccacctcccctctccccacccggagcctctcccataatggttatggagaaaattttttaagagcctcattagttgcagcaataacttactgagtcttccaagaatcattacaccctgtttggggtgctgtttgatgagcaaggttgcagccgaaacacacaactcatgatgggattctgccgttttgtgcaatggacagctctttcttcacggaagatgtgaggaaagcatggatctgcattcgatgatccctacttaaaggaggggaggtcactggccacctaactcatgagatgtgtatgtcactggattgactcaaattggccagggactcccacttccaaacaaaggggttggcagtaggtggagtatggtggtggtggtggcaaccagtttactaataatttatgaaatggaacaggtgcatgacccaaaaaaagaagcaggatattgtcactagaatataagcaaaataatatgggatgctgtgcagggaaaaataaacacaacaaaaacaaacatgtctactatagagattacttgaaatatcctttttcttattcccaaatctcattttccttatttggcttcatttgaaggacagcatggctatttccttggctactgttggattttgcattgtctgcaataggaatatgataatgtggtgccacttcacatggcacaagtcagaggtcagtaggccccctggttccttcagtgtcgtcattgtgcttttgtgagtctggcaaatccttgtgatatttgaaggcagatgttaaaaatattaatcttgttatatactttttttttttcaatagagcgagacattgtctcgctttgttgcccaggctggagtgcagtggcttgatcttcattcactgcctacctctgccacccaggttcaagcagttctcttgcctcagcctcctgagtagctgggactacaggcgcattccaccacgtgtggctaatttttttgtatttttagtagagacagagttttaccatgttggccaggttcttctggaactcctgacctcagatgatctgcccacctcggcctcccaaagtgctgggattacaggtgtgagccaccatgcccggccaagataaactttttattaattaacgaaaatcaatgctatcactattactatacatttttaaaaacacttgtatttctgcaaggtactgatattaaaatacttgctgattataaatgccctgtatgtcacaaaggatagtttgaaaactacagaaagcattaagaaggaagcattgccctcagtctttaattgcatcagccatttagtttatattttacatgtagacaggtgttccattttgacttaatttttgtataaagtgtgaggtttaggtaaaggggtgtgtgtgtgtgtgtgtgtgtgtgtgtgtacacatccagttactctatcattatttgttctggatgtttcacttttttcggttttcttaaaggttgtgttatagggattatcacacacatatttctctcagtctacaagactcagtattttgcctctttagttggaatgcagaaaccttatcacccatgttaattagcttgacttcggtgattgtttttacaatttatacatacattaaaatatcaagttcaatacgttaaatatatgtaatttttattttttaattgtgcctcaataaagatgggagataataaagtttatcaccacgtatgcctctttgtttctgtagtctttgtgttttatctttttttttttttttttttttttggagttggggagtacagagtctcagtctgtgtgcaatggcatgatctcggctcactgcaacctccgtctcctgggttcaaacgattctcctgcctcagcctcccaaatagctgggattacaagcacgcgccatcatgcccagctaatttttgtatttttaatagagacggggttttgctgtgttgaccagactggtcttgaactcctaacctcaggtgatctgcgagcctcggtctttcaaagttctggaattacaggcgtgagcccctgcgcctggcctatattttgtttaacttccgtattgtatatccataaattaaaaagctcttcatgcacttccctcccccccagttttttgctttaagccattaaacatattttaatgaactcaagagtatagaaagctcttcatgcaatttcctttttttttttttttgctttaagccattaaacatattttaatgaactcaagagtccagtcacctattaacatttactcatatgtttaccatttccatttccagctcttcctttcttgttgtttgaagtttccttcaggtatcctatttcctttatctggaaaacttcctatagcgattattttagggcaggtctgtctgcagtgaattttcttagttactttcatatttcaccttcatttctaaaggatattttcattggatgtagtattctcagttgacaattattttttcagtatttcaataactgtgtgttattttctgctgacctctctggatttttgtttgtttagtttggattttgttttaaatccatagttctttgaattgttgggcccttacaagcattgcattgtttgtctctggttgttttcagtgttttaattttaggctttaccaatatgactgtgatatatgtggttgtggatttcgttgattttaactcttttagttccttgaaattgtttatatcttttgtcaaatgtaggaagttttcagccattatttcttaatttttttttttgcagtgaactctttatccttatattctagaatttcagtaacatgaaatattgtacgttttgatatttgttccacaggtcctgcatttctttttttttttttttttttttttttttttgtcttcaatttttttttcccctatgttgtttagaatggatactttttatgtactcaagtttacttctttttcttctgttgtcttcattctgtgtttggacaccttcagtgagattttattttattccgttttaattaattaattattttttttgagacgtctcactcttgtcacccaggctggagtgcagtggtgcagtctttactcactgcaacctccccctgccgggttcaagcgattctcctgtctcagccgtctgagtagctgggaataaaggtgcctgccacaacgcctggctaatttttgtatttttagtagagaaggggtttcaccatgttggccaggctggtctcaaattcctgacctcaggtgatccgacccgcttggcttcccaaaattctgggattacaggtgtgagccaccgtgcccagcccaatattttatttttatttttttaaaaaaatttagttatttttatggttgtaaaatttccttttgatttttttgttttgttttgtttgtttgtttgttttcgatggagtcttgctctgtctcccaggctagagtgcagtggcacaatcttggctcactgcaacctctgcctcccaggttcaagcaattttcctgcctcagcctccctagtagctgggactacagtcgcgtgtcgccacacccagctaattttttgtatttttagtagagacagggtttcatcgtattagccaggatggtctcgatctcctgacctcatgatccacccgcctcagccttccaaagtgctgggattacaggcgtgagccaccgcgcccagctccttttggttctttattatcttttgtttctttgctaatgctgtcaatttttttctcagttattttcagtgtgttttttcttaccgtttggagtcgttttataacagctgctttaaagtttttatttgataattccaacatctttgctatgttgatgttggtgtctgtgaatgtcttttcccatgcaaatttagattttcttggttcctagtatgctaagtcattttggtttgtattctgggtatattgaatattgtgttaggagactctaggtcttgtttaaaatcccatggaagttgttgatatttttgttttaataagcaatcaatcttgttgcattcaggctgaaagctcttgcttttcttctgtggatttgtttccaatatcagttctgttgggtgtctcccatatatatatcaagtctgggacatgggcagtagtctattccttagttcaattctcaaagcttatggaaacattttagggtcagatacagacatgagcacagaggtcagtgcaggagtttataaaaatactgtttgggggtgattttcccaaattattttctctccgggatcctcaaagtaatatttgttttctagggttccctgtttgttgtcctccacccagaaagctggtggttttttgtttgtttttaatttttctgttcacctgcttctcatctgagtctgcatttagggcaaagtgtcaagagaagagaggaaataaagaaaagcaatgggaggtgggagttgtttgcccaacctcttgagaccacagtcctagatgttaagtgtctgcagccacccctgttgccactgttgtttatacatgaacactaccctgagattgcctggagactgcagcataagaggacacacaaacttttaaaaagaaagaacagtaataaaaaaaaaagaacaatggggattttccctattctcttagtgttaagactcatctgtcttgtttttcaagacaaaaccagagtgcttctcctgagtctttatatggctgggtgtctgattttcagcccttggctaccttgcacccacactaaggggtattggtggtgggaggtggtaattcaccacttatgtggcggtactttaaattttggtcgttttgttcccccctccacttgctgctttttaattttcagagatctcaaatagctcccccatgcattctatacagatttccttgctgcattcagtgggggaaacaggatgaagtgttttcgctccatcttgtcaagaaccgaaacctcaccacccacttcatttattttgtgttaaaatacacataaaataaaatttaccttttttatcattttaaagtatacattttactggcatttaagtacattcacaatgttgtgcaaatatccagtttgagaacattttattcaccccaaatagaaacctcatacccattaagcagtcactcctccttttccattaacccagtcctctggcaacatttaatttgttctctgtctcaatgaattttccctacttcatcttttaacagtttatggagacataatttacataatataaagtcacctatttcaggtgtataattcaatgtgggctttttttttttggatatttatagaattgtaccagtttcttttttaattttttggaatatttctcccagtcttttcctctttagcttctttttttttcctttatttttatctttttttttttttcttttgagatggagtttcactcttgttgcccaggatggagtataatggtgggaactcagctcactgcaacctctgcctcccaggttcaagtgattctcctgcttcagccaactgagtagctgggattacagatgcccaccaccatgcccagctaatttttgtatttttagtagagaagaggtttcaccatattggccaggtttgtctcgaattcctgacctcacatgatccacccgccttggcctcccaaagtgctgggattacaggcatgagcaaccgtgcctggccttccttcattttctttaatgatctgtttcactgtatttttaacccaagataggaaccataatattgtatatttctgtggtttcttttcttaacaactaaatggtgtcttttgaacatttttcatatctctatatttaaaactatgtttctaaatggtacatgttatgccatactatcagtatactatattttttaatttttccattatcacacataatgtttataatttcttttttcatacataatgttgttgttaattgacatggaaataaacatttgtgtgcctctgcatatttttttaagagctaatcttagtggtaatatttctgggtaaaagggcatagaaaagcactgatttatagatttggggctctggtgcatccttaagtaaatattcttccttttttgtttttagagaaagtcaaaacaaactttgtatacaaaatgcgtaaaatatacatcaaaagttggttcctaaaccttcatatcccttagtaaaagtttcaaaaacttacagtatattgtctggtcctggaagtcgggagttgtttcactggttaaaaaaaaatactggaaagatatagaataaaggtgaatgaagacctaaattttatttcagcttaactattttagttgacagtggagtctaccagctcctgatgacagaatgaccatatatctcaaaattccttctatgtgttcctttttatttgtgtccttagcataatcatgtaatacgactccacccatccccttaacccacctatgttttcttgtttggataataaattatatggccactccaaagaagcgtccttggacattaagtaaaacatgtcagtagggcaaagataattaatgcatggcatatgtattgctaatacccactttcctatctgatggccgataccagaaacctatcaggatctctttctgtgattgaaggattggcttcacaattctccccagcacaatcctatggggacttactaccatctgattagaactggaccataaaatgtaacccagttgccaaggcatgacaactgacactactggccctaaacattggagaagactttgtgtgttttccactgacttatcatgaccatctggagtgggcctttatggaggaattcttgcacctgtgatatagggcaagctggggttttcagggaaaagggtggggagtttcatgacaagaggggaggtgccctcatcccaggcagatgctgcctcccacacatactcctgcacgtctctcctcttcccctttccagtctctgacttatcctagctgtgcttctgaatcacacaattgaactccaagtgaagcttgagctatgtagacctaaagaaaaattaaatacataattaattaattatgggttttctttgagctgagtaattaaaagtaactttctgttttctttcatgtttttctgatccggagccttctgacttttccccttcattttcttttctttctaggtttcaagacaacagatgaattgtgaaagagagcagctaagggtaggtgcacctgcttgtaaaatgcttcctgattctcatttttgtgtgataagcaaaaatttccttgtctctcccaagacacgggttctaaataacaggcttcatcttaagactggtagagttgaaaatatttatcccagcttatttagtattgattgagctgttaaatacagtatatcttctttggaagtgccgttatagtagatatggattttttgatttagattcagcaataaatacttttcttctggaatttgtttgacatcattgtactctttttatgtacaacacgaggtctaagtaataacaaaggtcaaaaggatggctggctgccttcttaatatgaataccaggctgtttgctgagtggctaaaatgctctttggctgttgactggggtgggtgagcaaggaatatgtcaagggcgttttctgggagaatttgtgttatctatagacctcttggttttagtgacatttgtgtatatgggagagggagacaaaattttaaaccttatattctgtttccccacttaaaaatgaaactgtcttggtgctcaggcatatcggtgtaagaagtattccctagatgtgcagggagtgtttggttataaatggagcttggtgacattgttctgctttcattgtgtcagagtggacattcttcttggtatggggatggcattttaagaaactttgggatttcttcccatttgttttcttctaaatgaattcgtgttttcagtggatgagatttagattatgattggtgtatttttcatgtcactaatggaagttggcagtttttactggacaatgtgccttatagccatgttttcaaattgttataaaaatcagagaaatatgctgcttttaaaaccacaacagtgggatttggcgttaggaaactcctgtgcccaaaggtgtctaataaataagcataatgtatttaacaggcctaatgccttcatacactgccctgtaacttttcagagcatttacctaatgatagtctcatgatggcaataatttgtagagttgcttccatttcacagttgctgttggcatcaggtttgtgaagtacttgggtaaaataaacaacagaatccaggtgcatgaaaccgagaaagtgagacaaggttttctgtttcttttatgcatatttgttttatgcagtatctcagtatggccctctctacccactttcctccaagtacctgtgccgacattcgttgtgaccctttccttcatggaacagacttcaagatttttaagcttttctgaactgtcttactgcttttttcctgtagtctgaattactggttcatcctgttaaataatgtattacaactttagatttctcttgctgtttggatggggacgatggtcagaactaggtcagagctagataaagagaaatatgtgcctttgtctccaggagtccctgataaatgcctgagaattaagataatattgaaatctctattgcaaatgacacttgcttggcaagttaaggacgcagtaggtaatgaaggacctgtttgcattttgagggattatttcccatttatgagtccattgtcgacaggagtgtggtttaggttcaagaatggagtcttcccctctctgttacataaatgcagggagtggcttgatattaacataatggttcatttagtttagtcccaagtatggctccaatagccccatctctaacatcacgaaccagtgctttgtttgttgttacttttatggtcactgttcttgctttttaaatgaatttatgttttgaattgatagatggcacatttgattggatagagcacacatatatagggttcaaaatttaaatagtaccaaagagagtgcaatggagttttcccttcccacgtgacttaggcgtctagttccctctgggagacccctagtgtgattaagtactggtagctatctcatctgtagatattttcttctgccctcttcatttttgttctctgtctttccatctctttcttcttcctttcctccctccctcttttcctttcacacctgtgtctgtaagagcccttccatcacctcaaaagaaaacttcccttattaaggtgattttttttttcggggggggggggcggggagcttttttttttttttttttttttttttagagagagtctctttctttcatcatgctggagtgccgtggcgcaatctcagttcaccgcaacctctgactccctggtttaagcaattctcgtgcctcagcctccagagtcgctgggattacaggcacgcgccaccacgcccagctaattttttttgtacttttagcagagatggggtttcaccatgttggccaggatggtctcgatctcctgacctcgtgatccgccagcctcggccccccaaggtgatgggattacaggtgtgagccactgcgccaaacctgggtgggggggcattttttaagggtttctgaaaggaatttagaactggaaggtaaatacctgtccatctcaatgaaatgcattttcctcaatctcattttgctttcttagaaagagagtggaagaaaattagaaatctgtttagttaccacatcgttgaagggtaactgtctgcaagccacaataaaaatgtgtcctaagtgcagcagtcaaaatgcatttccagatttgctatccaggatgactggactgtggccgtgttatcatgtcgagggtccttcattagtgcattctgttgtcagaattcagggatataagtggatagttgtcaaatttattccttttccttggcctcctggaaatagcagatgatttagaaagataaagctgcgctttctgttttgtgccccatcgaggctgtgtaggaattggcgtatccaatacttggtgttaggatctcctttctttttctcacgaagcctaaattaatttttccaaaacagacactgtgaagtgcttaatatcttgaagatattaaggagtctttaaaatgatcatatgattaattttaggaaataccatgttaaaaaaagctaaacagtttttattttttaactgcaggtcttctcatagcctttaatttgcaaaaatgaaatacaaagagttggatataatatacaacgtttttctaactcagctgactacgcaacacttttgtttatagaacatactcttgagatcatatcagtattatcagttaagatgctattatctgtgagttatagacaagctaagagttatggaaaagctaagagttatttacaaaaataaataactctccacctcccagttccagggttgattcagaggctttttggtatcagggcagtggtttgcaatccctgtgcttccgttggcctttctttccttcttccaagatgtctgccatctaccccatatcacgttctcacagggcagcactctcatcagaaggaaggagaagaggagtttctccttcacacgtcttgcattttactgcaggaaaataattcccagaattcgtcactgcagtcgttttcttagatgtcattggccaatctctacatcaatcactggcaaggtgaactggaatctcagcgattggctacagcagttatgattcatttgcagcatcaggcacattgttacctgcacaaaagtaggatttacttaaactggaggaagcagaaaatgcactccagtgttgttacccaatggagtctgctacaaaaggaattcacaggggtccactctgtttgtcagggtgctggtttcctgtcattagttttcattactctctttcatcctacatgtgtgggctcagcaactttgtgaattctggtttgtggaatttgacacagatgatttctctgccaacattgaatctcacaggtcacatcttccatcctaacctatatcctaacttttctacccatcttggcattgtctttgtattttgccttgtgtaatttggactgcactggatatagtctttggtcatatcccctcagcattaggtgtgggcagcaggcatggggcatcgtgcattagtaaccagctcagcccacagatgctgtccatgagcttcctgtcccctacccttccccaaagaagggcatcagccagttactcccaacagtagggtcactcttctcagagaactattgggattacttacatcgctcggttgttacgcacactacacaacagggaaacttgttcattcctccgtcccaaggtttgtcaatctagagtagactgagtgttcttctgagcttgcaattcacattattggctggattcttctggggacatggtcagaggagctcactatggaatctgtgcattaaccactcctgatcctataggctgtatttaccagcttgttctagcatcagcacaggttatggtgatagtcgtacagtgaccatatccaattatcaacatttacctctccagcatctgcaccaacagatggacaaataaacaactaagagagaaataaaatgatcctgggggcctgttgtttccctgaactatctaccagttgagggagattgtatgttcatagggtgggagattccaaagcccacctttctgagcactcataaaatatttgattacaaagggatctttgtgcttgagtggtagatgttggtttgggggctgattaacgagcttagttagaaaactactaggtagccaaatgcatgactgccagattctgttctgtggattcaaatactgatctgcaatatggcaatgtgactctatagtcagcatactaggaagggtggttagggctggtgaagcactggtatggacttaggttcagatcccacttctaaatgctccttagtgtctcaaagctttactttacctatacgtaaaataagaatagctttctcataggattggtgactggataaaacaacttcgttaaagcactgaaaaaaaaaaaaaatgcaggcctgatactcaacaaggtgagctactgttaatacagtgttattcccaataattatttcacttctcttcctcctagaaataccaggcatgagaatacagagaacacatatctactgccaccaaactccccacaaggaaagacaacataaagggcaggctctgtatttgatttcatggtgaagtatttaggagataactccctctcagttaaggttgtttggaatgcaaacaatagagacagattccagctatcttaagcagaaaaggcatgcaaccaggcctcccaggaatcagagcttagaatgggaaagctgcctgaactcaacgtatgtcttgctcatctcctgtctttgtttctgtttatgggtccactctggatttttcttttgataaagactccctctacctttatgcacacatcacaccttctagcccctaagatgtatgttgcatcgctttccaccggtatagggactaaccatcagtgcatcctcgttacaaattcctggaaaaggagcctgattggcttagtctggatcagttgttcactctgggccagttggatctgtccagggaagtggtatgaagcaacacagttgcccagggccaactcttgagggaagacttcattactggggaaaaggagccattgctagctgagtaaataacaccatagatgccgggtgcagtgactcacacctgtcatcccagcactttgggaggccaaggtgggtggatcacctgagatcaggagttggagactagcctagccaacatggtgaaaccccgtctctgctaaaaatacaaaaattagccaggcatggtggcgggcgcctgtagtcccagctactccggaggctgaggcaggagaattgcttgaccccgggaggtggaggttgcagtgagcagagatcatgccactgcactccagtctggtcgacagagggagactgtggggaaaaaaaaaaaaaaaacacgaaaaccaccagatatagatctctgctatgctttcaaaatgtggatatcagctgaacaaaggatcctggaaaatacatgtgctaccaccaactgctagctctgtatttctcaaaatataggacacctaccgcacgtcttactcacagctttcaggcgaacactaactcattaagaaagggggaatcacttagaaagttactcccctttccattgtctctctgtggtttttatgccaatcagaaatgctcagtttaaactaaagtatctttagcagggctgtaacactttctaagctttcttttttaagggaaagggagtgtgcctcaggatgagagcctccagccccagagcatctctttgcactttgaaaacattgtttgcaaaatacactattaagaatcaggggcctggagctacgcctactgagataaaatctagactttgcaacttagcactttgtagccttgtacatgttacttcaatcctctctatgtcaaattcctcacctgtatagtggagataatcattgcacagatttcataagtttgtgtgtgtgtgtgtgtgcatgcgcatgtgtcttcgtgtttgtatttttgcatgcaaaaaaagattaaactaattaatgcatatgaggttgttagaaaagtgtctggaataaaaaaggttcttaattattgttggatattaatggatttttttcattaacttttatgtgtgactgttgatattggtttttcatttaccgtggcaatacaaagtttccttggcacacatcgtattttatgttccatttattgttccacttatttaagttaaaaatgggttgctttaaagataaatattaacttcataatgttacatattgcccgcagttatgacaaagattgtgatactggaatgcaaatgactgagttttttagaaatactgaaatcatggtacccgccttgtgaaagaggttgtagagcagatctgcattatcaatatttaatttgccagttacaagcgagtttctcatttctgctagatatgagagtgatgtggattgcataatgaaaattgctaatgatcttcttggcttaaacccatcgccttcatctggacatcagataatgaaacttcccaactgccttgcaattgagctatcagaatcagagataccttctcccgctgtgtctcacccctctccactttttaaagcccagcttttcattccttagtggctcttacgatagcacggaagaaaatgtaagccccccttctccccaccccttggtgagacctcacaggatccatgagttcttcctgactataattttaggatggttcgttgtagaaatgcctgcttctgttcagttatttattcaagaaatattttttgagcagaaaccgtatgccaatcactgtgctaggcagtagaggtataataatatactaaaacttgcaccactcttattctcttatacctcacagcctagtggaaaagacatgcatttgtcaaataatcattgacaaccattggcaaaaaatgttcaatgtgaaactgatgaatatgagaaacaagagatgctgtgtaaaagggtatgaatagaagaagcttacctgattgaccttcacttatcaaacgtaccagattaatacatactgtcccatctctttataaagcatattggcagatgtgcacagcatcctatgtagtgactgtttggtacaaatttacctttctcttcacccgttgcagtgtctgcttgccaagagtcagttgtatttgttcccagggctgcttctgccagctgcacttttcattgtaattacattagttagtggaatattatgtaaactgatgaaaaatgagtgcagtaagaaaaagagctgtttctatgaaaactaaatgctttggaaacattgtatgaaaacacgattcaaaaattattttgcttagctgtgggtgagaagactgtaaaatattagtggaaaaaagccctcagaaatgtggaaagattctgcagtcagattcttttcaatgtgtcttgacattctcattccactttaatcaaacccagaattgataccatagagttaacaaactttaaactttttctgaaaaaagccagattgtgactattttaggacctgaaggccatagggtctccattgcccccactcgacactgccataatagcacaaaagcagccatagataaaatgaatgattgaggctatgtctcaataaaactttatttacaagaacaggcagtgggccatagttagccaacccctgctggtgactgaaatgttagtgaggtgtatgtgggaaggttaatgagggatttttatcaacagagaaatcattcaaagaaaaggccttagactcacatcaaagatcaataaatgcatgcacgttcatatgttttacattaaaacaaaagcctgaagttatttctatatcactttaaaagtgatttcttgctttaaaggcttccagttaaataccttctgccattctcaaatgaaatggcttttaaagaacagaatagctacaattagggctggaaacacaaaataaaattatgcttatttttatgttccaaccctaatgactcagaaccccatctgtctataatggaagaacaaatttatccttttttattggatcccccagcaagtaatttctgggactccccaaggagggtgacatttccacgtatacatcctggtgcttgtcctatgcaaattgttgttcggctgttccagaattctcccctcacttaagaaaagtctggtaagttccctctctggattgttctgtcctcaaaagcattcctctgtaagcatgaataccattctttgcattaactttccaaatgatcagctaaagccagacttcagtgattagctcaggggttagcagaaatcccaggtaggtggtgacttacagagaaccctcaggattcaggcctgagatcttcatggttgatgagatttcatgtatgttctcctgtgtgtgtgtgtgtgtacgtgcacgtgcacacatacaaggaaaaaactggcagaagtttgcttgctttaatcttacataacgaatggtcccaactttgtgattttctccaagcaaagggagtttgccccaaagtaattagttctctacttctagaagctgcaggaactcaggcaaatgatccccaggggcagcttctctagtaaaataagaaactcataagtacatttaaaatgttttttaaaatgttttttaaatgtcatcttcacaagacctgttccatacagagcttgtatgttctccagtctttgcaagaacattaattgatgaacgcaaggaaatcaacttcttgattgattctgatcaagaaatcagccaactagtcacagattttaatttctccaacttcattgtgaaatatgattaaataaagaagtgtacaggtgtccacttttcttcatttttgatgctgaatcttataattcacatatatgttaattaattctttgagtctccccaggcatttgaacactttatttggagaagactcaaaaaaaagttcacacatttaggatatttggcctaatattcattctccctttcccttgctttaatttagcctattatccccagtcctcatgcccctttccagggaaaatctattcccatttcttgctttatcattaaatctgtatcaaacagctccaagcaaatcgctaataatgctgacattttaatttgtcatagctactcttcatttctatgactgatgcctcagcaaggacttgtcttcctgctctgttcctttgaggtctaaataccatttcaggagaaaaaaaaatacgtgataggcaagggaaatagggcaggaagcaaataaatagggcatctctagttccctccagttgggggtaggaaggggcaagtttcagtgggaatgagtaaggagcaagaaactctcctttcctgatgatgcagacaaacctgagatggtcccaggaaaaatggcaacgaggccgggtgtggtggctcacacctgtaatcccagcactttgggaggctgaggtgggctgatcagcaggtcaggagatcgagactatcctggctaacacggtgaaaccccatctctactaaaaacacacaaaaaattagctgggcatggtggcgggtgcctgcagttccagctactcaggaggctgaggcaggagaatgccgtgaaccgagatcatgaggttgcagtgagccgagatcatgccactgcactccagtctgagagacagagtgagactccatctcaaaaaaaaaaaaaaaaaaaaagaaaagaaaaaaggaaaaatggtaatgagatataaaagctttctgtcttccttcatggccatagttaaaccttatttaccctgtgcttgtatgtggatgaatcatgggtacagcaagcatgtgcttccttgttgtctgcagtatatgcttccttgttgtctgcatccaacagacatttctgcctatggtagctagtactttattattctatttgggttaaatttcctctttcacgtgtgcagtcttggagagaggataaatcacaacacctgtccctagccaacagatgtggatatggccaaggcaggacagttgaattctttctcctgagactctgaatattgagtagggtaatgctaaatatggtgaagaaaacaagcatgattgaaaacctggagttcattcatttcggtagtgatattctggtgaaattgagtgaagagacggttcccagggctagacctcagattcaccctgattcctgcctttatgtttaaccctggttatccatctatccgtcccttaagctacctcatctcattcaaatgatcgccatttttttttttttttttttttttttttttttttttgctgaagttagtcagacctattccttttttctgtgatcgaagaatccctactgatacactggggaaatgtgctaaacttggagaactgcagagccaagagtttggttaaaggtttgctaaaagccaactcttcatcataccctgcaatgcctccctgatgcctctgtgaatcggcgctgactttatgtattgacagctaagagaaaggagctcttggtttagggcacacgcagggctagatgcttacctgaatttgtacatctttttgggtcagttctcagtcatcaagagcaggtaggcacaggaagagaggtctgtgcttcagggtctttggaactctgtccttccctgtaggagtaagatattccccccaaccccaggggaccacccccgtgcccacagataaaggatctgtatcagtatcaaagatatatcagtatcagaggaacttgtgatgttacgggatcatcacatgtctctctgccaacttcttccttctcagagtacccttcaaaggccactgagaatgtttataacaagtgccatttcctcagctctaccccagacctactggatcagattctggagatggacccaagggactatttttaagccatttctcaagtgggaatgagagttgagaatagtacttttcaaatttagctggtaaaatgttttgatgtctcagccttatcctaggaatgctattggcccttcatatctgtaggtttcatatttgcagattcaaccaactgtgcttcaaatatatttagggggaaaaaaaacccaacacacacctgggtctgcacggaacatgtgcagactttttgtcatcattccctaaacattctggataataactgcttacatagcattcgcattgcatcaggtattcaagtaatatagagatgttttaaagtatgtgggtggatgtgcataggttatatgcaaatatcactccattttatatcagagacctcattttatatcagcatccatggactttggtattcgcaggaagtcttgacaccaaggtccatggatatggaggaacaactatactaaattatcatgttatatgggctgagttgtgtcctgacaaaagtcatacatggaagttctagcctctagtaactcagaatgtgactgtacttgaagctaaggtctttaaaaagataagtaagataaaatgagtccataagcgtgggccctaatccagtatgactggtgttctttttttttttttttttttttttctgaggtggagtctcactatgtggcctaggctggagtgcagtggcgtgatctctgctcactgcaacttccgcctcccaggttcaagtaattgtcttgcctcagcctcctgagtagctgggcctacaggcacccgccaccatacccagctaatttttgtatttttagtagagatggggtttcaccatgttgcccaggctggtcttgaacccctgacctcaggtgagctgcctgcctcagcctcccaaagtgttgggtttacaggtgtgagccaccatgcctggctgggtggtgttcttataagaagaggagattaggacatagacacgcacaaagggcaaactacatgacccaaagggagatgatcacctaccagtcaaaggaggatgatctgagaagaaaccaacccccctgacacctgagtcgcagacttctggcctccagcactgtggggaagtaaatttctgttgtttgatttccctggtccacggtactttgttacggtagccctagcaaacgcacatctaaacctcgtgagaatcaaatacattgctactaaaatcaaaagcaaatgaacaaccaactaaccaacaaaaagccccccgaacttgatagttcatcctgatgtgtattggtacctctgatttaattacatattctaaatcctattgcccttttgaaatgcaattttaaactagctgtggtatgatactccctctgtatgtgcattttcttgtttacttaaaaaatagtggactcccttgggggatagagatgatgtccttggctccctgtgtgtcaccaccacatacaacaaatcagatggacgcagcaatcctctattgttcgatatggatggagaaaggaacagatgagtatgtgagtcacagcgtgttacttggtttcatctctggagtttacagcctcctgtgagaccaattctgtatggagacgcatttgtaaccttacctaaatgagcaagcaactggtgtttggaagaatgcattctaatatttcatggtttagtgcccctagcttacttagaaattttgcttctatctagctttcttgtagcgaaggtagaaggtgcccgtgtggtccttttagggatgatctgatggagccgtgtaatctgctttcttcaggtgcacgtctcatcttgaatgccacctttcccctgatacactccacctgcccactcgtgttcagcatcatctccaagcaccctgcctcgttcctctgtccacatgctccatggttttgcatgggtttttctgaacctgcttctgcagcaaagctgccatctatctaagacgctgaccctttttaataccatttttctaaaattgacaaattaaaatggtatatccttattgtatacagcatggtgttttagtatgtgtacattgtgaaatggctaaattgaactaattagcattgcatgacctcacatacttaccttattttttagggtaagaatacttaaaatttacgctctcagcagttttggggaatataatacgctgtgattacctgtagccgccatgttgcacagtagatctgatgaactcattcctcctgtctaagtgaaagtttgtattatttgaccaatatctcctaaatcctccagcctccaagcctctggtaatcaccattctactcttgcttttatgagtttaatttttttagacgctacatggaagtgagttcatggggtacatgtctttctgtgtaaggccctgatccttatgtgtttttcccccacagtaacttgtgtaaaaccctatacccagagaataacaaataaataacaacaaaaaaaaactattaccaattgaaatggtttaattcactccaagggggaaaaaagttttgcaaacatctaagtcacttcagagtgttttgatagtatttgcatgagaatcttaaagcctatagtcattaggcacaaacaaatgctaagcaatgcacatattagtccagagattctctttaattcacacttagagaaaaagggaggttaagagttagaaccatagctaattgtggagctgggaattgaacccaggtctatattcacttgttttgacaaacatggtacgttaccttgatgtctattgagattgccttagctcaaggtaagaatgcatttgctttttagaaaggagctaaaatgatcagtcccattgtgaggctaagatacgagaagggtatggttttctttattgatttggactttggggttagacctagcattgaggcccaacctttgtaggatccaactatgacaggtggaaaatgcctcccctggttagttagaaatttaaatagctaccaaatgagctgagtattttatgtgcaaagttttaggtgctaccagttaaattatttaacatctaccttcttgaccctgactcataaagcggggggtgtttttgttaaaagtgtagacaatttcccaaaactatagcagcaattatagaaatctatgtgttctaatttaaggtccttccacagtcaggactgaagtcactgagtggattggtggttgaaatcatttcttctttgtatgccagggttttccagggagaaaagtgaaagaaaacacaaaggtttggttcaataagaggagcacttgatgtcaactctgtcttcccagccagtgagtggcagaatccttctatttctagccatttacttattttgaacccagaccatttattttctaaaaacagattactcatgtggtagtttatataccaaactgtagaatttttcattccaaagacacatggaaatgcctctttatgctcctaacaaacagtaacagattatgcacacagagcatctactgtaagtaaataataataagttaagctgaagggacacacacagaatctataccaggcatatctgaaggggaactcatatgccagcggcagccttccatgcttgtgacatgggcccggagaactgaacaggtgatcctttcaccaaacccagagggtgatcttgaaaacttaattaaagcagagttcttccaggcagccgaaattattagttcagagttggtactcatgttgaaatctgtgttagttttttattgtggccctaacaaattaccacaaaaaaaatagtggtttatagaacacaaatttactattctgcagttctttaggtcagaatttcaacaagaatctcactgaagtaaaactgaaatgtcgccaaggctgtgtttcttttggaggctctaggagagaatccttttttttttttttatcattctgattgcagtcagagtccaattccctgtagttgtagaactgaggtccctgttttctttttttgttttctttttttattttattatattttaagttttagggtacatgtgcacaatgtttaggttagttacgtatgtatacatgtgccatgttggtgtggtgcacccattaactcatcatttagcattaggtatatctcccaaagctatccctcccccgtccccccaccccacaacaatccccagagtgtgatgttccccttcctgtgtccatgtgttctcattgttcaattcctacctatgagtgagaatatgtgttgtttgattttttgtccttgcgatagtttactgagaatgatgatttccaatttcatccatgtccctacaaaggacatgaactcatcattttttatggctgcatagtattccatggtgtattttactgggtgtgagctgagggtcattcctagtgtctagagggcgccattttttttttttttttttgtaattcatggctccttccttcatctttaaagccagccatggtttcatgaatcactctcatggtttgactctctcgtgcctcttcttctgttgtatctgtcggactggtttctctcctgcttttaagggttcatgtgattacgttgggtccacccagattatccaggataatctccctattttaagatccgtaattataattccattggcaaaatcctgtttgccatgtaccatagcatacatagatctaagatcagccagccaagattgtcggtccaaaatcatgccacactagttatgtagtatccccactctaagtagactgattctccatgtgtattcaaacactgcagacatttgatttgtgttctgggatggtccacctccattttcatataaaatatagaaagtcagagaccagagcattcagaactaccatccaaggtagcccagggtggccattggcccaggactcacctctacctgccttttgaacttcttcttttgcagtccctactggcattcattgcttcaccatttaagtccagctgttacaaaagaagcattgttagaatgtctaccataatagtactgactctttgatactattattattattattatttattattttgagacagagtttcactcttgtttcccaggctggagtgcaatggtgcaatctcagttcattgcaacctctgcccctccgggttcaggagattctcctgtctcagcctcccaagtagctgggattacaggtccctgccaccacacccagctaattttttgtatttttagcagagatggagtttcaccatgttggccaggctggtctcgaactccagacctcaagtggtccacctgccatggcctcccaatgtgctggggtttcaggcatgagccaccgcgcccggcctgatactattttattacttgatagttctgttgatttctactcacgaagtgtgtcaagtaaggtaatgagaatgtagaaatgtaaaattattaaaaccagaagcatttgtatgtgtcacttaagtgctaagtaaaacacatgaatgaatgagtgaatggatgtttctaaagactctaggagatgtctgtagcagatggcatcagatccctgacattattttatcacccactcctttatgtcaaaagctggctatgaaaaacacctatgaacctatatattttttaatcctttaatttatttattttttaattattgttttttaagttccaggatacatgtgcaggatgtgcaggtttgttacataggtaaacatgtgccatggtgttttgctgcacctgtcatcccaccatctaggtattaagccctgcgtgcattagctgttttccctaatgctctccctcccatcagtctccccaaagaggcccggtgtgtgtggttccccttcatgtttctgtgtgttcgttgttcagctcctacttacaagtgagagcatgcggtgttcagttttctgttcctgttttcgttcactgaggataatggcttccagcttcatctatgtccttgcaaaagacatgatagtgtgcttttacactgaacctcttcataagggctatttttctggctatgggacacattcctttcacggcctgggtaagcaagaagcatcatggaattaacaaccctggaaaaagcactcaactgaggataaatggggacttagtggatcgtgccccagcttcctcatgcgctagagtaagtggggcagcatcgaggtgtgttctgccatctcccagagctctacaatgggattaagccccagttgcccatagtgggcacttgctcgttaacaaaaattgtgttcctcctatccatgtctcaatttccattccccattgatgttcccttacatcactccaaaatgtagaatttgcgcttgaattttaccccagctctgctttcagggaaacggaaactaaaatagtacattcgccataatgagaaacaccatagcctaataattccatcaagtaaggttttctgatcagtggatattctcatcatcatccttttgccatcagtcttttatccctcctcctctttttcctctcttgcacagtacatcactgctgttgtaggatgtggattcttggattattgaataggtttgcaagcaactgccgctgtgctcatggtgcatttcccaaaagttaaaaaacttgagtttggctcactgagcgatcagagcacgaggttttgatggcacagtgtcttgctcacatatgaggagactgatgtatttgctgccacattccactcatttatacttgcctcagtgtggtttcttatttgcaggttgcttttaacaatatagatgctttcctggatagagaacatggaggcatgattttggaaaacttgtctgcctcagatgcacccacgcatacacagatatatgcatataccgagtattctgataacaacttagagatttaaatatttttggcaattttgtggtgttattttcaggggttgtatattcttaatcttgattgcatatgtgtcttgacatctttacgccaaaggcatgtttttatagatgtctgaattaaacactgaactcttttcaagatagctgagtttacgtttaagtggttttgattaacctgggtttgcttatttgctcctaaatgttctaatgcagagccatctcccttggcatgaagtgatttgggagcacagctttagtaataatacttttctaagtaggcaagagcatcctgccctgaatgtttcccaaaactggccttaaactgaagaattgaggtttagccatcccccttccccttagccattcaggtggtgcggattgggaaactggaacctaactgcacagacaccaaattgaccaagggtgacaaaaccagcactgacaagactgtggttgttgggtaggtgaagggttcatgagctagtaagcaggactcagcttggaatttggaaaatccttagtgcaagcaattttgcccagagtggcatgttgtcaagttgtcctcaagctacatttgccattaagagaaatgaacttcaaaaaacagcatagcccttcacaagcctatctttactcaaagcctgagaaaggagggtcccatctggcttaacacattacaatttcttcacaagtggagcttctcggctgctaccctgaagcttccgttttgactagtattggttcttaggtatcacagaggaattagattattctaaaagcttttattgagcatatactacatacaccactaggagaatagtaatgtcttgctctcaagggctgtgcattctggtaggtggtgtgaaaaggtaggtatatgtaattataatgccaggaaaaagaaaatgcgatttgttagtcatgaaattaggtgttagaaaagcgcagaggagagtattattacccctcctagcctcctagctgcaggaagtgtggcagatcatttaaaggatatatatgtattacatacatattatattttatgtatctgctaattcttggatttttgaatagatttgaaagcaactacaacttgatcacaaattgttgttggggtcacaactgaccccaacactaatttgcccagatatgtgtgtgtgtgtgtgtgtgtgtgtgtgtgtttgtctgtatacataacctgggtaatttatacatacatacatacatacatatatatatattttcccagtattgaaatactacctgaattctaggtccctatacacaaaaagttactgtttattttaacttaaatatcacttagacatcttaaacttcatatacccaaattcacactcatcatctgtgtcttctacacacacacacctgcccattaatctgctcttcctcccttatcatgtctttttacaacagctcctaattcagttgttgagaccagaagctcagctgttgctcttcactactacatctttttcagctctaccttctcctttagatttgtgattcctaatatctcttaagtctatgaattcctctcaaaattcactctcgcaaacctactcgaagtcataacgatttctaaactagattatttcaatagcattccaactttctgacccgttctctagtctttgttccttttacggtaaacatgtatcttgagctgcctggaacaatagtagttacaactgttgtcctggtataattattaatagcactttcttctttccccagaaagtcctggtttggagaataaattatgatcactgaaccttctattcactccttagggccagaatgacctttaaagagcttaattaatgctactcttattcttcattcatcactttcattacagtgcttatcaccttccttacgcttacccacaatctgttattccctcgtttgttttgtggtttacttggtcatggtttctcgttctcctgtcttcttactccctttagattgactcctcttaagggtaagagaatgcttattttgttcttaactctactctctactgcctataacatagtagaaactaaatattaatacatgtttgcaaataccagtggctattgttttttgttgttaatacaatgaaagaatcagtatgcaccaataacataatctggctacaagataaccgttattctagaaagctgccctaggaagagatttcagaatatttcagaggatcttctgttttttgccatgttagaataacttgtaccataaacaactttaatactggacaaaatatatgaagcatcattttcaggcaatgggtacaaagcagcacagagctgtgatccttcagagaatcggagacatgtgagatgaagctaccgttggcccagttttattcctgggaggaacgtcttgaacataagtgctctgagatgaagaatttacaagttggggatgaggaagtagctggaatttgtggaaccggttgctacagaaaggacagatctgtgtgggaaggagaagtctccatgccctgagttcttggctgaggaataagccacttatgtgcagggtcaggctttgtgagtcctcacagggagggttaactgtgacacagaggccagggtagaggtagtacaggttgtaggtattcagttgagactccagaaagatcagactttaggagtaaagtgtgtatcttagggcaagggtcagcaaattatgctctgcaggcaacatctggctatgggctgtctttgtagtctgtgatcaactaaaatgggttttagatgattaaaacttaataatatgtgactgagactattttacctgcaaagcctaaaatttctactatttggctcttttcagaaaatgtcagccaatcccttccctatatgaaggggcatggcccatgactgtagacaaatcctaagaagatcttcccaacaaagcatgaaaatgagctttacagggtcaagagcatgcatgagttagccgagcgctgccagaacaaaactcaaccaccatttaaagaaagacgatataattcagaccccctacaattcgttctatgtattgaaatccacacaattgaaatgtccaatggtaaatgtccagtaatgataaataccatggctggtgtggaggctcacacgtgtaatcccagcccctttgggaggtcgaggtgagtggagcacttgagcccaagacttcaagaccggcctgggcaccatggcaaaaccccttctctacaaaataataaaaaaaaatatatacaaaaaaaaattacacaggaacggtggcacatgcccttggtaccagttactcagggggctgaggcaggaggattgtttgagcccaagaggtcagagtgagctgtgatttcatgactgcactccagcctgggtgacagagcaaggcattgtctcataaaaataacaaataaataaatactagatgtgtagaaaagaaaaaaaaattgactgacaatccagagcagtgtttggcaagccacagtttatgagacagctccctgtttctgtaaatattcttatttcattggaatatagtcattcctatttgtttccattttgcctatggcttcttttgttttgtaacaagaaggttggacagtttcaacggagaccatatggcccacagagcctacaatatttgttttctgtctcttttaaggaaatgttttgtccactgattaggagaaaaaacagtcagtagaaagggactacaagatgacccaaatgttaggattgaagtagacaaggactttgaaataactgtttgaaatattgtagggtttataggaaaagatggacatgatgagttcgcagatgggaagtctcagaaatcgaatgaaaaccataagcaagaaccaaactgagattctgttaggttgatgcaaaagtaattacggcttttgccattaaaatgataataattaaaataatggcaaaagctgcaattattttgcatcaacctaataaaattgacagtacagtatctgaaatgtaaacatcagattgtaaaatgctgaatacagaaatctgttaacttgaagacagtgaagaatagaactaaggaacaggaagaagaaaaatattgaaaaaaattgaaaaaagcctcagtgatttatgggaaatatcaagcatttaaatacatataattggatttctgaatggagagaagagacagacaatgggacaaaaaaccattttaaggaataaaagctaagattttccaaatttggtgaaaacatcagcttatactccagagagcatggggaaaaacaagcagtataagcataagaaaaaattatacctgaaaacattataaagaaatgcttaaaaccaaagataaacagatgcattttcttttggaaaagagatctatatttgtctattgcgcaacatatctctgtaatgagtacaggtaactaagttctctaaagccatcccccagtgagacattgtgaaaacttctgggattggaaatggtgaggttgggaagaggtaggggagctcattgagagtagaatcaaagggaagtcaaagggtgagaattaaagaaaaagagaaaaaaggggcaaaggaactccccaaagcgtaaaagcaacatacggcaaattcgatagtagccaagatgaagttctgtgttatttgaaatgtgtactcatggggctgaggctgtgcagttgatcttactacagacaagttggttttgttctgttgcataggtacagactgcagtgatgttgcatatatagggaatccacttctgggtaccaacagtaaaagtgcttcattgctcagtgatgatcaaaccgtcttcaaatgcaagcagttattggttttagttaacaattatttatagagcactgagaggttgcccaaaagaactctaggagaagagttgggaagtcaaaaactttcagttgctgtgttgccttgtaacagtgtttgttagcatacatgattaggggaaagaaggataaaacagttgcaagtatttaataatctggaagttttacagaaatatctagattttttttggcttctctttaaaacaataagtattaaaaaataaaagcccacacaactttgggtttgcatttctttttattttttcttttttttatttatttttctttttttatgagacggagtctcgctctgttgcgcaggctggagtgcagtggtgcgatcttggctcactgcaaggtccgcctctcaggttcacaccattctcctgcctcagtctcccgagtagctgggactacaggtgcctgccaccacgctcggctaattttttttatttttagtagagacgggatttcaccgttttagccaggatggtcttgatctcctgacctcgtgatctgcctgcctcagcttcccaaagtgctgggattacaggcgtgagccaccgcgcccggcctgggcttgcatttcaacatgtaaacaatttcctgtaactgaataaccatggctttatttgaatgaggcatactacactttgccaccgtccttgcacttccctattagtcccctaaactgacaccagttgtcagtttctatttatcctcacacttgggctttttttttttttctttttttttcgagacgagtcttgttctattgccaggctggactgccatggcgcgatctcggctcactgcaacctctgcctcccgggttcaagtgattcccctgcctcagcctctcgagtacctagaactacaggtgcactacctgctaattttttgtattttagtagagatggggtttcaccatgttggccaggatggtcttgatctcctgacctcatgatctacctgccttggcctctcaaagtgctgggatttcaggcgtgaaccaccactcccggccatttttttctttatggtagaattaagtagaaatgaaatcatttattttacccgagtctttgtcaaaaccagcaaaagaaaagaccaagaagagtcccatgcttgagaaaaaagttaagaaaataggatataccagatttcttggtggaagtgtaaaatattttcatatgcctaatatacaaaaaataatgccatatcccttctcacttgactcaaatggaacacctgtgggatgcctgcagatacttgaatttcttcaaattactgctttagcaaaactttatttttgcacatgaaatttttttcctcccaataatataccatcatactaacaaaggttaacaacacaaagtgtaaacaattctaaataccaccttcccatttctaaccaagatgttcactcgtaacagtgtatgcataatatgaaatgaccagtttaaacttccattccaatgtcatggtttatatgcccactcatatacctcctgtgagccctggggataatgacacagtttcttgtacaatttaagtggtgtcacctctctggagaccagtgaacagactgctggttgttgtcttagttaaacacttactttctaacaattttctaacattgcatttctgaaacagcttggaaatgtgcagtgttattgggtgtacgcgagagaggtgggcaaagacatccatctgatttcttggaacagggccatttagttagtggacgagacctcagaggttttctttgcacagacttctcctgatgcacttataattttctgcccagaaatctcttcaaggcctgtggagttttagctctgggggaattattcctctgaataagcggtttcccagctgcgcacataatgctccaatcaggctagtctttgttcagacaatccatgaggggaaatgttggcattggtgggcaaggtactgttagccccactgtctcaaagtacatcggtgatgtccatgtgtaactgaccaaagtaaatgcagttttgcaaactgcaatgagttttacgtgatgaattttcctacaaaagtcaaaatgggaaattcaggttagtgtaggtggtgaagctactacatttattagcatcaaaagcacagagtctcaaagacgaactaatctgtgaataactgtgccattagtaagatcataaacatggactaatggggatatggtacagtgaaatgctggtatttgcagcctgtcatcatattagtacaatgatgaaatttgctgctaagttcctcagcaaatgttcagtatcatgtttgtgcctttttgttataatttgtaccgtattagtagcaacttaccatattagtgactttaaaatgtttttaaaattatatctgtcgggttgatagaaatggaatgttctggggttgtgcaagtattagtcgtattaaacttgtcctgttagcagctttcccttgaactgatacttaaatgaggttttgatataaacaaaatgtgcttctgagatgtgcttccagctacaaccaatttctcccagtccattagctactttgtatcccttttaagcaacttgagattgtgcttttattgaggagccaaaatgtttgctcaactcattaggccaaacagagagaaagtaaactcaagggctgtgctgtctcctgagttactctggggcccggtgaatggagcattacctccatcactgctaagacagacaaacaccttttgagattttcctgcctttgcctctctctaccacttgctcctcctcctctttggctcatgagaaaggctggtaactccactgttcattctttctcatctttagtctctggatttcaaaagtcatcgttttcctgcagaagaaggagaaaggagcattgaataggcaaaccagctgatgtccactatacagagttttttggtgttagaaaagctggtttagaaaccaccttaggaagtgacctaacccagaaatggtttatctttgtaaaatggctttctcttgtttataaccaaccccatatactttatttatttatttagatggagtgtcactctatcatccagtctggagtgcagtggcacgatcttggctcactgaaacctccgcctcccggattcaagcggttctcctacctcagtctcccgagtagctgggattataggtgcctgccatcacgcctggctaatttttgtatttttaggagagtcagggttttgccgtgttggccaggctggtctcgaaaccctggcctcaagtgatccacccactttggcctcctgatgtgttgagattacaggcatgagccaccacacccagcccgaccctattttttattttatcttattttatttattttattttatttttttttgagacaggctctcgctctgtcacccaggctggagtgcaatggcatgatctaggctcactgcaacctccacttcccgagttcaagcgattctcctgcctcatcctcccgagtagctgggattagagtaatgtgccaccacgcccagctaatttatatatataccttttttttttttttttttttttttttagtgaagatggggttttaccatgttgtccaggctggtcttgagctcctgacctcgtgatccacccaccttggcctcccaacaagaccctattttcaaatgaggtcatattgtgaggcactgggagttagggtttcaaaatatcttttttggggggaaacatggttcaactcatgacagcctgaagtctttatttacgtgtatctatcccatatggtgtaccattctcaatcagcaggagccatacattgtctgttgctgtaggattataatcagactcactgacttcacttcctatctctgcaccatccaggcgcgggactgcatatgtttattggccaaacccagttttacttgctcatcatacatctggctctgccccaactggagcttgcaaactgagggttgggcaggggaggtttgttaagaggagaccagtgcatgttcctaaaagaaggggagcagaggaaaggtatgctgagcaggtacaacaaagaaaacacagaatgcttcatatggaaagttctgcctgagcagaaccacagtttacactgtgtacctgcattttgtcatgcagcacaagcaagaatagagggagctattcagcaactcacagtccttctttgtcaagttcagattgtaaattcttggagtatttagaggtggtgtcacatctgtttctctccctctgtataaagaaaaataaaatgccatattgaataagtacctcataaagccttttgcgttatgatggagagacagccaggaagatgagagtgaaaagtaaacattttcctgcatggcaaatggaggcttttgagggtgcttgagatgtttaagctcttgtcttgatctaggtggtggttacacagggtggtgtttgtgtgtgtttgtcaaactgtacacttaagatttgtgtgctttaaccccatggttgctagtggctgtagggtgataatgggaagttattattaagtgagtgtagaattccagttttgcaagataagaaaaagttctgtgggtggatggtggtgatggttgcccaacaatgtgaatgtacttaatgcagctgaactatgcatttaaattagttaaaatattaaattcattgtgtatatatatatacatatatatacgtatatatgtatatagatgtatatatatatacatattatatatatacatatatacatatgtatatatgtatatatatataaaaccacaatttaaaaaagactagtatactttactatatcaatattattcctcagccaaaaagtaaaagtaaataaaatgtcccattcccatttgtttttgggagtcacaagaagggttgaactgacctctgatttcatgcagcgtggacaggcaattttagggatctttactgcaatatctcagcagatagctgaacactggcataaatagattatttcctccaatgccttgcctatcattctgtaccttcttcggcttcctaaatcctagcaacaagtaacctgtctttatcctggcagaacggtcttcactatgatttcagtgccaaagtaatgactgtttgtactgaatacatgtaacagagcctcattccttagggaatgtgtgtttttccccttcatgtttgttataaagtttgcagatcaccatccctgtagtcacttaagctctctgacctgttcagagattcctcagcaatttgctctctgggtatccttttttcatggtccatgttctcttggggtacactcacaactttatttttctagctgcatgctgccattttgggattggctgccatatgaaccctgggtgttagggtatgcttcccatcacagatgacattgaatagttcaaccctctccatctctcctcttgcaaggtatcatcatcattcattgcgtggaagaccacaacaaactcttgactggccttttcgctgtcactttgcctcaaggccacaatccatcctcaggaccaagggagcctttgaaataagtcattccctccttgacgttcgttagcagtttctcattgcttgtggagcaaaacacagatagcacctttagtaactaaagctctgcatgaactggtctttacctcacttcccctcctcagcccttgcgagttgctggccgtagccacactggctttattttactttttttgaggcagagtctcactctgtcaccaaggctggagtgcagtggcacgatgttggctcactgcaacctccacctcccaggttgaagcgattctcctgcctcagcctcccaagtagctgagattacaggtgcacaccaccacacccagctaatgtttgtatttttagtggaggcagggtttcgccatgttggctgggctggtcttgaactgctgacctcaagtgatccaccagccttggcctcccaaagtgctgggattataggtgtgagccaccacgcccggcccacactggccttattaacatgcagaacatggtaatagtgttcattctactaaacctgtttgtgtgtttgtgtcctaaactttagctattataacttggccactcctcatgggggaatcaaagggaagctgttcttggctttagagaaattcacctcccaaggctagaaaaatagaagcactcatttctcactaatgatgggaatgagagtagtgggagtttttatatggaggacattatttatgtactttttaaattaatttgttcattgactcagtacaaattgatcatctcactacacctgtgttgtatatctcaagagttgggtagtcaagtgatagttttattattgtctatatttcataattatttattttaaatatttcataatgagtaattttttaaaattatactgatcaccctggccttggtaacatggatgatttgaacacctgcctggagaatccaataataggattgctcttattgatgaactaatatgtttaaccatcttcctgttgaggtcagtctttttagtggcataaatattccttccaggcagtggagtttgggataatgtagtagaaattgctggagtttctcctaaaggagaagaatctgtgcttgctcctgtggccacagagatcacaactggaaatgagcagccacgtggctgaaagtggaagaagcgattgaattcctcccatcctctctggttcatagtgatggtcggtggtaaccaccccaatttgcaggatctgggagaaccactctggagatcactccttggtatcctaattccctgttatctatcttggtaaactccagccttctggttggatattttagctactgcaacattgaagacctatggttcaggatgaatctaccttctcaggagcttcagttgtacagaatacattgtcaagtgatgtcctgtaaacacatattaaatgaaggttccaggctgggcgtggtcgtttctgcctgtaatcccagcactttgggaggccgaggtgggtggatcatttgaggccaggagtttgagaccagcttgggaaacatggcacaaccctgcatctaccaaaaatatcaaaaattagctggatgtggtggcatgcacctgtggtcccagctacttgggaggctgagatgggaggatcgcttgagcctgggaggtggaggttgatcaaacctccacctgggtgacagagtgagaccatgtctcaaaaaaaaaaaaataaaaattaaaaaaagaaggtttcagcactgattcagttgagtttatcaagtcatttttcacatttcgttcagtgtttagtaacacaactgtttaatgaaggcttgcagactttctttcataaagtttaaagttgtatgctgattgctgtatataattaatgtatcacaatggcattcaatttctgtagcagatcagaagccactgaaacagagaggccaccagtagcttaatcagtgttggtttcaggctattgctttgcagttgattaattattgtgttgagttgataactgataactggattaattattttaaaataatttctcttgaagcttgacaacaagagttgtaaatgtttccactgtgaaagcagctctggacctaccagcctgcttgtaaatatggaaaaaaatggttttgaattgaatatttgaatatatttactttgttattaaaatgatttaaaatggaaggttttgggagtgacaataaatagaaaatgtcactctgctcatttcaaggaacaaggtttgaggaattgattgaatcatcaatttggttatgagcagaatttaaaacatagaaataatttgctgacaccccccgaggggacagtccacggaatgttccattccgtctgtttaacctctggactccagagtacagggattgtaacacctcccacacttgattaatgggaaacagctgtctcctgcttgtgtcacagtgataaaatgtttctccatcttagggcgaatctcattccttgcagagggaccacatgttcaagcaggtgggagaatgaatgggtgcaaactgagcagaggcaggaagagcataaccaggggactcatttaggctcacagaagcttaagattaaatataaaaaaacaagaaatgacacataccaatccactggtgtatcagaggccatgaagtatagcctgtgtacacccctcaccgtggatcaaatgggtttctttgttggctttctcagagcttgtaagagaactcagtctgctaactcagatgcacaagaaacaacttattacattattcatttttaatcagtttaattttaaatccagattcttatccctatcaggcaaaatgttcactttcagctatttcactcctttcccttttcctagagatgggcaagagcctgggagaaggtagtgcccagaaggcaccgtgcatgggtcagttgttagtggttgccatggtgacatttgctttcaggtacacatagtgcatcttggcttggtggctcccttggttctctaccatcctgaggaatggtgactctgtggtgaagctaggaaccctatcacttagcatcctgcccacctagaggtaccatgcagctgtttttttcctgggacccagagctgtttgccccgctcacagtcttgataccctgtgacctgttaaaggccctaacactctcctgatcatctttcaggtcatttaccctaatcccacccgggggcttctgatcaaacgtctgcaaagcatgggcaaataaatgtgtgggacagacctggtataatacaatcaaaatatggaaggactgtggtaaacaggagagcatgattcaggtccaaaggcattcagatgcaattaaatataacagaacactgtgctggtcaaatggactatatatgtatatatgtgtgtgtgtgtatagaggtatgaactaatatatatgtatgaaatacatatatacacacacacttatatgtgagggagtagtggaggagggaagaaagaaaaaaatgtggatagaaaaaagcatattaatatttgaacaaataatcttgctatgtacacctcgaagaggaaaaaagaaaatgtgaatttgcatggacctagtaatgtcttacttagagagatccattctttcctttagctgatttcagaaggccacttgtgagaaatagtgccccatgcagcaatgccccaaaagaaaggggaatgtcaaggtgctgcctcataactgacttcagtgactatgtgagaggtataaaggatttcagaggtggtgatacatttcttcaaattgagcttcaaagaccagaggctgattggtctcctgtgctcacttgccctaagtgaaatgaggtttctccgtaatgtagaataggtgacctgtaactctcattgcagaaaatgagcattgagtgaatgtaaaatgtacacacaaccatgatgtgttcatattcccccctctctcatgtctgtctgtatctggcaatcttgtctgtctgtctgtctttctgtctatctatctatccatctatctatcttctatccgtttgtccaaccagccattcagccatccatccatttgtccatccatgcatctattcatctatctatgtatctgtctgtctgtctgtccatccgtccatccatccatgcatcccactaatatgtcagtgtcttactcagaatggaaatactgaagataaagtaggtattatattgtaaaagttctatatgaacgccgtatctaaagttgtgtgtgtgtgtgtgtttgtgtgtgtacttacatctcagatcaaataaagaggctacaaacataaatgcctccaagggccaggcctataaaggaaaattggttattctacttgccaaataacatctgattccatggattgatgcaaactagagaactggaacatgtttgtcacctaaagagaacagctgccactcagcaccggctcatggttatcactttgaaaatgtagaccttaccttgctggatcagccagtacttcaaaaaaaaatatatatgtgcaagttatttgaaatctcttggtttttaaatattggcaaataagttatgtttcaaaaaagtatcgatatattggccaaatgaactgcaccgtcagggtatttgctggcatggatttgaccgattcaccaccactgcatcccgggtgcctccacagagatagatacagagcacgtgttcagtagaatatttgtggaatcaatgaatgaacatatgcctgcaaaattttaaagagtagggtgcttagttatttttccctaagttttcctatcagaaagggcacattttgtccctgtgcaaattgagaatttgtggggatcatgtccggaggtgatctctgtcaccggaaaccataagaaagatgaattttcggttttttcttcactgtaatgacagagtgtgttcagaacttctcccaagtaggagaaagcaatcaatcctggtttgttcagatggtcctggttttagcactgaaaatcctgcatcccaggaaaccgttctgccccatcaaaccaggatggttggtgattcggttcttgatgctctgtgctgtgattcatgggctctaaaatgtactaagcagattggtcagtgtatgtgcctgattgagaacttgtcagttgagggctgtgttgttattttcttacctctctgagatagccagctctgaggctgtctccatcactgcttgttttatggcatggcttggtggtgattctctccatcatgcttagccagtatgcatcttgatgggactacctataggctattttaacaggttactcgccacccgtctcatgctgccaatgattccacagtttacctaatgctttttaattgtttaggttgacattttgccatgcgcagttgtaggtaaaaatttaaatcaacaaggggctcggttaagcagttttctctgtgtgccatgtaaaaatatcactaatggtcaaaactcagacctgagcaagagataatatttccccctctccccttctgtacattgtatgttttaatattaatttcttctttatccatatatcaataattgaacactgcatcaattaatatgctgggcaaattgcattccccatcctctcattcatgatgtgtttcagtaatggagataattttcaagataaagcatacaatttaaaatggattaaaaagaaaaactaataaaggaaaagtgatttatagaaaaaaattatggatactttcaggaaatcttagctgtgcttccaagccgatggattttgtaaggagagcctattgaaacgatcaagttttatgcctgctgcaaaatttcctaggtctgcgattgcaaagagagggagggaagaatgtatacacacacacacacacacactttaaaatttggtcttctaatgagggcgtgtgtatcatcttcatccttagattaggaagccacagattcatgctagcaagtcttcttgaagctttccatttgctgggcttagttggtggggcttggttttttgcttttgatttgctgaattggcacacaggcttctgacggcccatcccccggccctccttcccttttcccggtccacaccctggctgagagccctgcacagagatgggcaggcggcagctgcagcgatgggcaggaccgcagcctctgagcccgcaatgacaccgtggcgtcggtagatggctgtagacaagtgtgctgagctgtgcggtgtgaagagtaatgagtctggggaggccttgacctgactggatgctgcttttatctgaagtacatttaaagagataaaggggaagccgggttgctgcacatgttcttttctctgcggctggagctttactttgagtttaaaaaaattctcagatgctggcctcccagagtcaccggctctgtgcagatgggcttgcctcaagaggatcggccgccttcctgtaaattccaccagtggggcttccgtgaatctcccacccgccatcaggaaatggtgtagtgcctgtctgttgatgatcaacaccatcgctagtattatgaatattgctagtatcatcagtttttgttttcgccactgtggctggccgcctaaagtgtctggatttgctcattaaacagccaaaccaagaatttgttacctaagcaggcttgacagaaaagagaagaagggcaagagttaggaagggaaaagagagagagagaaggagggagagagggagggagggagggggagagagagggagagagagagaggcagccagaagcaagtcacatcacatacagtgccactgaaggaatgttatcctcataaactcataaacaagcacaccaaatcttgtgtaaggaaagaagagggtctctaaggacttgacaggaaaaggcaagattttctacccactgctttcagtttttcttccagatactcttggtgaagtaaggagacttctgtttgctgacagagcccttgatttctctttcaagatgatgatgtatttgtgggtaggtagtgtctcttcctctgtctctctttctctttctctctctctctcgctctctctttctctctgattaataaattgactttggggataaagattgcagcccagagtaatcgcattttgtgtaaggtgattatacttgtggcagaataatcttgcactggtatagtacatgtgctcgcatttccagtgggagttcaggcaagacctggttcattagcattaagctgcaattttattttcagttgcaaaaaggaatgacaaaaaaatgtgtatgtgtatggggtttggggggatgtacggttttctgttttttgaaaacattgatggtggtgaattcagaaaaaaggtctagggaagtcgggttagacatgaagcaaatcctacatcacttgtagctgtgaggtatttcatttaattaccaagaatgaactgctctgagtagtgatggctttgtttatttgttttgtttttgtttctgtttctctctcacaagtgactacttatttgtcattttggggttgagtgctgtagaggagagtagcgtctttcatttgctttaaccagatgtgtgtccgtatgtgtgtatgtgagagtatattttacaagattggtcttgaaaaaggtagatttacatgcacttattctggctttctgataaatactctgtagttgttttttgttgtttttttttctggagatcgtattaaaataagagcaatgaagtggtaacccgtagttatgaattacaatatttaactcttgaagcaagaaaaaaatagtaatctagcatgaatggtttagaaaaaattacttattatgttttgggagacaaatatatatcctagtgtagtttagccaataaagagcatgtgtgaatttcttatgccagtaaccaaagtccttgctctgtgatttcaggtttagagcaggtgttccctgctttgccaagggagggaggcgttttcgaggttcaactcaacctctgtctttcatcagcatcatcatcactgttgtttttcgttgctcggcaggcttagaaaatcctctttatccgcttccctccagtccctgctctggttcaactcagatctatgaactctctttgctgtaaaggaagaaggcctttttgttgaattctttgttaatcacattggttctttgacctctgctggtctctaggtctgccttgcccctcagtgagccttgtcatttacacccttgccccctttctttgggacattttcctttgtagcgactttagctccatttccacccggtttagttttgcacaatttagtacaatgaattctggcagctggagacagagtttattattattttgtcttcatttcagggcaagttttctcttcgagcttgcgtatcacgaaagaggtattttgaaatataaaatcactagttaaaactgcatgaacttaatagagagttctatctaacaacactgaattctcataacatttatttttgacagtggaggttgaagcaattaaaattttgaatgtttacaaatgctgatttttaagcattaaaaaaaagtagtcacgtgggattgtcgcctcaataattaaggaaaaaactatactagcatttcatggaaaggagcctttttggcttttattttgtgaacagattctggttaattataaacaaatatcaataattcctttaggctgtggtgagttggttgctagtcacactctttctctgagttgttaagtagtgtctgtgatattatttatgaagtttgttagctcttacatatgtacatatttgcaactcaaagcagaggaaaaatgatgcgtgtcccagacccccttccacatccgaaaaacttgctgatttgtttcctagtaattaatcttgacttaaaagcagcatccctcaatttctattttcttctctcagaccaatgcattttagggctacatggctttattaactgcatttatcacattgaaaaatgggcactaccttcctttcctgtgctcaagtattctgtttacatctttaattcagattttttttctgcattcaaaaaaaaaatggcagagactttaaattggaacagctggatgcaggctgtttaaggagatatgaattagcaagctagcattaacactgtgaggttggaggggttttccattcttttcttcttcttcttttttaatgcagaggttctgctcttgccttctagtctgtaaataaagatagtctaaatgtggttgatatctctgtttaagagctcatcttgctttaggaaaatgagcctcagctacattgatgtgtgaaaatagtggttgctactgtctcatggatataaaagtgaaaatgaagagacaaggagagacaataaaatagaatccatattcagtttactcctgtcattgtttcttaaatttgtaaagtaacctctttatatgcacctatctgtgttaatagcacacgatttcagtatgtttttactaagatggaaaactttttgctggggggaggtgtggggtagatggtatagtctcccttctctagactgactttgtcattttagtctataaggatggtcctgtgtatttgaaaggtaaagaaatgctttggaatcgtatcaattaaaaatagtgtggccccattaagccagtccaattaaatagttacagatgcttaatatgtccatcatttggtgtcatctcagatttatacatttttttcccttaaatttctttaagaaggttttcctatcaaaaataaattttgtagttttcgttgtattttattttccctgagtgagtacaggttgctgtacaggggaaagaaagttgagttctctgcaaccattggctgacttccgggcggttttgattcaccaaacttggccacggtaggagggggaaacagccttccctacggacttcttggaaaagcagggaagtcacgtttactgaggatgtgatctgagctgagcaccaggctacacttgccgtagaatgaagtaaaaccctcttgaccagcacaacctcccttgaccagcacaaactcctgctctcctgtggttatttaattccgccaggattagaggttctttggaatacaattgagctgtttctcctagggctggaaagtaggcaattggcacctactcatctaattcacaaacaggatacaaattcctctgccactcaagtcttggaccaaatggtccccgcttaaactctactacaataggtatttgtttgactttataaccttttcgtttctctttactttttagttggttgaaacaaataactctttccattttattatttttactcacattttctcatttacattccaagtacacttcctctgtttttactttaagttaaaatactgcaatttttaattttaactttactttttttttttgttacaaatttggtgttccatttattcactgaaaataacttttcttcactttatcgtttcacacttcatcctcaccttttaaaaactttttttttttagaaatatcattttatacaaacatacctgggtttaaaatgggagaagagcaacaagtcaagtcaagaatttctgagggatgttgaaaagacggggagagagttatgccaggcggcagcatctctccttttaccaatgtagttcagtcacttaaaaaaaaaaagaagaaaacgaaaatgcatcattttttctacaggatcctgagagtcctctacctcccagagtgtgttacacttggcagaaactccaccacccagacagctccagttctcagcctgctgtaagcaaacttgtgaagtagctgcctgtggcttatctctgctctttcaccccatcctcagtactgggggagcctcctctgaattctgcattttctttcctgaatgctaaagctttttctgatctgtactctacattctagagcttcgttattaactgagtatagagatggcctgatttgtagattctatgtggatcagagattatgcagaagttgcagatatagagttgctttattgtcttggatcatcatgccagtttaatttaaggtctttcaggacagaaacaacatctgcccattttgtttgacattctcttttcccctttatttcaaacaatacacgtgccctttgtagtaaaattagtcaatgagaaaaaaaataaatagcaccacctcttctagcacctaagatatatgctggaacactggttaaactcttaaagatatttaaagacatcttaaagatgtttttataacatgcacacacacccttcttttctcaatttgaatatagcattgattacaaagttacaaggtataccactgttttattagtagggtttgttgttgtttgtttctcttgtttgtttctgctttagtgtgtgtttgtggagagccagaaatgctatcgcattaaaagcctgtatcaattgtaaaacacatctccatttcagatacattaaaatgtgaagaaggaaaaacaaagcctctgagaggaaatactctgtttcaaaaaatgagatcacactgctttagaacttactgttttgtaacctgcttttatcacttaacattttgtaccattcaatatttttccacaacagcctctttaatactgtatagacagtgttccagcgaatggcgattccagaacttatttaaccaattctttgattatcagttgtttctgcttataaaaatccttgctagttcctggtatggtgtgaatgcattcactaatcatatatgtatttgttcagtgggttggttattgacagagcctttacggacttgggcactgtctatggtactgcgccttgggggacgcacagttaagttaaaagtatgttaaaaggtatgaagagctgaaaacagaggattgcttgttaatattaatcacctgttgattgcagttcacaagtttggtaattattttttcttcaagtattctgtcccctttaccaaatcgaaggctgggacatccgccttttcacagtgattcttctttccgccttggtgcactggaggcctaagtgtcatctgtttttttccaagttagttgacgcattcgttgaatggttccttttcgtaggaacttgtgctggaaattgcctctggcagtcaaaggaaacatttttgttttggagagagaaattttcgttttttattccaaagttcagcatttctgtgtttcctatgagtgcagtgctttacagcaaaatgcctcaggaatacaaagatgacttcttttaccccagtgaattctgattcagaaattcgtttctgttgacctggcaagttcattcagcacccatactggtcaccgtgtatctcagttagggggctgagaaaatggcccagcagactctgattactgtgatgaaggtgttcattatattatcccttatctttcttgactgtgatgtatactgagcttgcctctcttgtctgtgtcaccaggagatagttcagagccctgaatgttctctgttgtctcgaatattccagccgccatgtttttcttgcatacccagcccacttcttctttgacactctgacatagtcacatctttaatgttgcttaaagatgtttttgaacatttggaaagggctagtttcccagcatctttaagtcagaggtacccacttatccagatactcttcaggcagaggaatgatgatggaccctcatgaacatctcaaacttctcgttgattagagggaaactggatggatcgaaagttaatgaatgggagctcatttgtgacttacatcttccccctctagcttaaccattcatggcctccccactcactgcagactttgtctggcagagggagtaatacgctattttccgcttgagcacccagaagctgttgatgtaaattgatcagtacttttttgtgttttcctgaaattctgtttacatgcacatttcctctttgtctgtaaagtgatttgtatcataaagccacatccattttttcccactgtaataatgacacaaaactcattgaatatttgtgtttaaagattcttggaaaacataatggtgtgactatataaggcgtatataatttttttaaacaaaacctggtgagtattaataaaaacaatgatgttgtctttatgattgtgttttaaacatagtaattggtcaagtggatgttgcttagtgccagaggatcagagcaaaacatactagatgtgaaatagcccttctcttcttcattttacattttgagtggtgtttcacttacctttagaaaattttccaaaccttcagacaaatacttgatcaaatgatgcgggtttgaaagacataagcaaattagtttctgtgcaaacttgtgtccccattcagagaagaacaaattgaaaaattgatattcaataccaacaagataatttcgggaagcaatagagcattgttttgaccactaaggaacatgaagcttttaggagaagtagagagagctttgcccattgtcttccatttattatccgaagacattccaggtgaaaaaaaacatgggaaggaaaggtaggaagagaaagctttgaaaatgatttggagacatgcaatgctatttcaagtggttctggggactggatagaatacatcattgctttctttgcattcctatgtcatcttctcctgatgttatcattcgaagtcagactgtcaaatcctgtgtattgggaaacactctttgttcccttgacttggggactcctgcatttcttttgaagttttttttttttttttttaaatcattacattgttcaccctactccaatgtcttgttagtggttgggtggtatggctaagatggctgatgaactgaaataagggcagactgtacagctgtgtgtgtgtgtgtgtgtgtgtgtgtgtgtgggtgtgtgtgtgtgttgagagagagagagattgagacagagggtaagagaatttttctgcttacatttaaataactcacttatggataacatttggataacgtgttctctttaatcacacagacttttgccccgtctcttaatacctgtagaacaaatattgtatctgtaaacatctattgtaaacatcagtgtaaacatcaaaggtaaacatcaattgtggaataacctttttactcttacagagtgatttgcaattctgttatttgcaaatctgtctatattttgttgatgatattagtaatttgttttaactagaatgttctttctttctttcttttttctttttcttttgagatggagacccactctgttgcccaggctggagtttcactctgtcgcccacgctggagtgcagtggcacgatctcagctcactgcaacctccgcctcccaggttcaaacgattctcctgcctcagcctacccaagtagctgagattacaggctgtcaccactgtgcctggttcatttttgtatttttagtagagactgggtttcactatattggccaggctggtctcgaactcctgacctcaggtaatcgacctgcctcagcctcccacagtgctgggattacagtcatgagtcactgcggccagcttagaatgttcttccttaatagaactcatgacaaaatgaaaacatgcttaatttttatctgtgatgtggagttgtgtgtcctcttttccacttggttgtttcttttctcttactttgagttacattgtgagccctttcacacaaagaagggtctgagctttctctatacttggatgtcatgatacataccaggtgggagcttggaatgtgtttacagatgataatcatgttggtaaggtcttggttgatcactcgataagtagcaatttgttttttaattcatttccttgttaagaaaatatggagctgggcatggtggctcacgcctgtaatcccagcacttcgggagaccgatcatgaggtcaggagatcgagaccatcctggctaacacggtgaaacaccttctgtactaaaaatacaaaaaaattagccaggcgtggtggcgggtgtctgtaatcccagctacttgggaggctgaggcaggagaatggcatgaacccaggaggcggagcttgcagtgagctgagatcgcaccactgcactccagcctgggcaacagagtgagactctgtctcaaaaaaaaaaaaaaaaagaaaagaaaagaaaaaataaaacatggagagcatctaatgcatgagatattgtgtgtgctaagttctgacgacccaggagacatgatatgatcccaatcttcatataacttacatgtagtgaaggagacagataaaacacaacacaataacaaaactggtaaccatcgagcaaaagtagtcgataaaagtgttattgctaaaactcatggttgcagagctaagtggagactcaaaggggatatgtaggctgagatatctgagaagtccaaagatgacaggcagtcagaaccaggtggatgcagatcatctcaccatgtcatggaaactctgactcaatttctcggacctatttttctccgtgtcccccagcaggatgtctgaggcaaccactagtagcttctggctgacatgccactgttaacagcagccctggtgggtggaccacactcatccaagaagtagtaggctctaggaaaagttttgaggccaattttcttgcacctggattgaattccttacctacccctgaacccatccctgatactcaacatccaaccctgtgtaaaatatttgctgtttggatctaggagtggacttagccccagtaaaacggggactgagttgagcaggttggctcatgcctgtaatcccagcactttgggaggctgacgcaggtatatcacctgaggtcaggtgtttgagaccagcctggctaacatggtgaaaatctatctctagtaaaaatacaaaaattagttgggagtgatggctctcccctgtaatcccagctacgtagggggctgaggtaagagaatcacttgaacccgggaggcggaggttgcagttggccgagatcgtaccactgcactctagcttgggtgacagagcgagactccatctcaaaaaaaaaaaaaaaaaaaaaggactgagaatagggaagtggtggtttcccaggaaatattaaagagctgttaccagaaagcgaaatgaatcctggtttggtaaaaacaacagatgcctcctatacaaataaacacatgtgatcatttgcaaggagatctaggacaaaaacaaaaaatgtgcttgggaaatgcaaccgcgagagaggtattgtgaatggtgacttcgagcaagacttttccaagaaggtgtcttctcagctaggacctgagagttaggaaactgctatgaggtaggaggatgctagggaggtgtggtggttagaaggccattgtgtacgtggaaattccaggaggctaggctggctcagcctcagatgtgaggagtatggtcagagagagagagagttctgagacaggcaggaatcagagcctggtagattagagttgcttgcatcaaccccagtatcaaagatccccatctcccatgcaacaccctggcattaaagcagggaaagagagaagaaccctacagaggaggacagtaagagagtgagtggagttttcttttctgttttaattgagaagtgttagagaattgtggaatcatttctttctaggattttaagcacctctccatctgcctcaaataatcaaattccatccaattagatgctgttgccactcataatatgcaagtctacatatgtactaaacccagggcctctctgcatctggttttgatctatattttcaaagaaacctgctccccaaacttgcacaatgattccttcacagatgctgagtcagcagagagctagtgcatatttatccagagattctgatgaaaagagggagaaagaaaaatctaaaagcagaaaaatacgaagtatatggaaattttgaggtttcctgctgagttagggagaaggggttggggaatccttgaataaatcatagtgcctcacacaatggcctgctttgtctagtaaaagcacttttggttgaggatcagaaatacaaaacagtttaataatagtgagtgttgtgaggagtttcaagaatcttcgagggcatttgacttaaatgagctcagtgatggagtattcaagtaaagccagtgttgtcaatatgctaacttaaaaggctaatcaaacaggcaagtggtacaagtgaggaaaggaacacaattagttaatggaagatggagggtaatatggaagggacaaaaagttttttatttttatttatttatttagagacagagtctagctctgtcatccaagctagagtgcagtggcacgatcttggcccattacaacctccgccttcctggttcaagccattctcctctctcagccaccagagtagctgagattacaggtgtgcatcgccatgcctggctaatttttatatttttagtggagatggggtttcgccattttagccaggctggcctcaaactcctgacctcaagtgatccacctgcctaggcctcccaaagtgctgagattacaggcatgagctactgtgccaggtaggcaaaaactcttattctattcattcatttgtaaaattaagccaaagatagcatactttactttattgaaatgtaacacacacacatcagcacccttaaacatatacattcggttataatgtattggtaataacacaggaaattcattggtttcttatggggatataggacattagagtggttaaaatagtgatgatcttggctgggtggtggctcatgcctgtaatcctggcagttttggaaactgaggcaggaggatcatttgagctcaggagtttgagaccagcctgggcaacatagtgagaccctgtgtctatctttaaaataaataaataaataataattaaaatcgtggtctttctagtgaggcacagctatattcaaaatttggtccttatcctattttttgcagtaaccctcagtttcttcatctttaaaatgggactgttactagtgcctgaggttgtttttcaactgatattgagctggttgcttatagccattggtctttttgattgatggctgcctctttttggtgggtcagtgtccaaactctctcttgttaaatagttcacaaactatccttgcatagtatctttctcaaacagttatggtgaaagtttatattgcaaaaatagtacttagaatcagagatggcagatagtagctgtttactaaaagttagttgtaaccatcaatactgttgtcattacaaaaaaactgagtacaaacaatgtcttctgcatacgtgtggatgtagaatgagggagggtagatacagggcaggagagatcactctagctgcagtgggaaatggctcaaaaaccaaggaatttcgtaattcctggctggtgtaaactcattttgtaccagcttctcctcgtaggatctttcttgggtgttttatttaacccctctttaaaatggggctaataccagaaggggaatgggatgaaataatagaaccatatttagtgtctagctgagtggtttgcactggtatgtgagactttatattcttctcttctcctattacttataaaccaacaagtatctgagacaagtctcagtcaacttagaaaggttattttgctgaggttaaggttgcacccttgacacagcctcaggaggtcctgaggacacgtgcccaaggtggttggggtatagcttgcttttatacatttagggagacatgagacatcaatcaatacatgtaagatttgcattggttctacctggaagggagggacacttcaaggaggaaggtgtttccaggtcataggtagatttacacatattctgatgggcaagtggttcgtagagttaccgggagaaaagaatgtgtgggtttcaataaagggttatggagacctaggttttatcgtgcggttacagcctctaagtagcaggttttagggagaatagactgtaaatgtttcttatcagacttaaagtttgtgttgatggtaatggtggagaggggtataatgaggcatgttcacccctcagttctcatcatggtctgaaccagtctttcaggttaaactttagattgccctggtcgaggagggggtcctttcacatgatggggggtgagggtggtcaccttcaaattttatttttgatttacatactaaataaagctctctggtgaagggaacaaaaaaaaaagctttagagagggatgcagagaaaacaaaattgaagttgaaaggaatttcgaaatttgtgtgttaaaggaatgactattcagtgctgatatcagtgttgtgaaaaatggttagaataaaatgctcatgaaaatttctctttttaaaaagaaccctgactctttctgaaaataaaagtcatatttggacattatgaaaaaatttgctatatgaagtagaatctgactccccccagcctatcactcatcactcaacatttttgacgtatttcctcctcttttaaaatatcagtatatttgaattttcatagatacccattttcctccaaaacagaatcatactataaacatattttcatacaaattatctcataaacattttctagtgttactgatggtttgggaaaacatgggtttttaaaggttgttttttttttttttttttttagcatatggctatactgtagcttatttacccatttgcctactgttggatgtcaggtttttcttgacatagcctgtgataaatattaatgaaatgaacaataacaactttaaaaatgtacaaaatggacaagggagagtgaacagaggactcagagggggaaaaaagatccaatggccgtaaatataggacactgtgttcaccctctccaatgtcagatgaatgcaaactaaaaatgtgttgtcaaattgagaaatgttttgcaaagggcaatactatactgaatgcttgtgaagttaaactgctaaacatttttagaggttgctttgcaagtacaagggattttttttaagtgaaagtgattgtactttatagcctcatcaaggattattttttgaggaaacactcagagatatagtgaaaaaatgttgcatacaaggatatatggtacaaagttacctatatacactaaaacatctctcaagttttcattcaaagaataaaagctagtattctcatgctatggtacttttaaggcactaaacgatgcctgccgttggttgctgagtattaatttagtcagagctatgcatgcaggcagagctggcctatgcaggccccatttttgtgactaggaatttattctgcaccagcgtggcatagagagaaaccgagtgagtgcagtgccagctcgccgctagcttggatgaatacatgacacaccattgcgcttggagaaaatgctattcattgaaaataaaagggaatttaggaagaaatgtaatactcatcagtaattgcaaggaaactcttggatttcgttccagagtcttggtaatagtggttacataatatagcagtgaatgtatgcgtgagattagagaattttagaaggaagaaactgagattcagaaagagaccggctgtaccaaagtgtatccaaccaaaagcattcacagagagggggcagatcacatattgaacagtggtgcttttggaaaagatcatatgacagctataaagactctgatgaaaggttactagcaggttattcaaaggtactttttttgaaggcaagattttaaggcatgttagggtaggcattcaagtagggtgattttttaaaaatgtatttgcttgccgcagaagacaagtacaggttctgctctgatgcctgtcctggtcctctttcccttttaatgttagaatgtggcaaatgctcagtaatcactgagctagggatttccaaggctcttgtctttgtctgcatcccaggtccagggattgtacagttggtaaactgtaccaaagcatggagaccaggtgtttacgaggattgaagcatagttggtgctcctttcaccaagccttgtaccacaagcctagtgctgtatccatccagagacaagggtgccgttttccttactccaaatttacataagctaccagtgtttgcacccatgctgggctggccccacccagaggagggtgctttttctaactcacaaccaaacatacaggcagaaatggtcctgcctgtgcctacttctctgttagaaaagaaacactcctcttactcacactcatcggattccagttaagccactgtttgcaggggcattccctgaggaaattcgggctggagaagagagatgaaaatatctttctcaattctacctttgtataggaactccattctttgtctatccatagactattggattcccttagcctatatgtgaagaaggatctgatacagagcctaagtcttactgagagccttagaattgtctttagtgaagtgttaaatagtcgctttcaagcattcacttttgtagatgtcttcgcaggatttaaagaaagaataaaacatgccaggatatttatgaatcatgagatttaatagagaccaaagtagatcttattactgatgtgcttactgcttcattaaattccctttaaggtttgcggcttggatatggatcatttgcaataataattaggcagtgatcgattgattgggtctgacattgcacttgtcaccttgaaatgcaaaatccatctattttcaacagtgaacatttctcgctaatcttgcacaccagcatgtgatagtttattttatggagaaagtacaatttataaagtttggagacttaacattaaccttttactaagaatgaagtatcacttgtcattttacaaagaaatgaaaatcatccaaccagcaatttttttgagattagaaaacacagcctaatttcaaaagaatttttcaaatccaaaacgcatgcacttcaattgagtgctacaagtatattgtgagtattggagtttactaaaccttcacatggagtataaatgataaaattgtgagcttgagactagctctgctgtgtgtacagacacacacacacacatttagacacacacacgtctatttgtctatctatttccacatttaattccctaattctatctttgcctcaaaaaaaaaaaatgcaacactctgtttctgaaaagtgtgggtgctttccaagctgtcggaccaaagtattactgaaagttattccatttgaggatttgcacatttctttccaagttgtgatttttaaagaggggataaaaaaccaatgacctcattcttttgcatttgtatcaactttgatttccagaactttaactgttttgagtttatgacgtgtccagtctcaagtcagtatagcaatgagtaatcattgtagaattgcctattaaggggcaggcatcgttcctgatgctggaataaaatagcaaatgaagctggcctggcccatttctacacagaacctacatactagctaggaagcagaaggccaccttcagtcctgctgaatttagaaatacagtatatgaattggtatgaaaagacgttcacaatgtattggtatgttaagagatgatcagtgacaaaagctgtgtatcaaatgtatagatagattgataatctacacaccaagatgctaaaagtgattagtttgaatgatttctcttcttcacctctctgcagtttatagttttttgttaagtacatgtcttgtttacataataaaaatgacttaaagaaacgtaaataataacgaatatgcctcatacaggacaaactaagcaacaagtctggtggtatcagaatttgtacagaaaaacctctaaggtacccagcaatatgtcagaaattaccagactcgtgacttcaagtgcctttaactcttagtcatgagaaagtactattacctagtgataccatttgcaaaagaacacacaaacagatgtttctgttgtttagctgagtctctctttcaaacatccatggacaattgaaatcttccaagtatccgttggtttacacaacttgctccctattattaacaacaagagtaaaatagaatttaaattttgttttgtgtttttccacatataaaatctaaaatagttcgttactaaaagcaatcctgcaatcccacagatgtcagaatagtaatttaagaaatatgtacctatctgtatctgtatggaaattaaggccaagataagtaataacaaagtagcattgatttgttaaatgtctttgctagtgactgctgtctggaactactgaaaactgcagtattaacctctaaattgtatccctgagaccctcttcacactcacacccattcactggaattgaggatataagacagtcctgttagttgatgtaacttctcctaagggggaccagtgtagcttgaacatctacttaatcagtctggtacctcatccccatcaggacagtatgcccctctgattaaaacagactattgtcatcctgagatggagggaaattgattctaattcatggacaaggaaagagtaaaatttaaaaacataatctattcaagatcctgactttaaaagcaatggcttacctaagattacgcaaataatttatgataaaggtgggctgaaaatgttgggcttctatagtcaagtcaggacctcttgctgtgatattgctaactcctcagcctgggtatttacatcgggacaccagaaagacacatgttttcctgttggttacatattcatggtcagtggagttaaggacaattaaccaaggaactctaatgttcattttcttcaaccacttcatcctttcttgagtattgctctaccttttttgttgtgacttgcaaaaataaccaacacaaagaggctcagacaaaacacattcttcaagggagaactcactggtgtacaaaacagaaaagtccaagagatggatctcaggtacagccccaaccatattcagaaaatatactcagaaatctctgtgcttgtgtgtgtgtgcacgtgcttctgtgcttgtgtgtgtgtctttatgtttctcagctctgctttctttgattcagtcacagaaaagcccttcttggcacctacagatctccacttacattcttctagctgagccctttgagctgaaagagagcacctctgccactaaagcttggatgtttaagcaaaagtctcaggactgcctgtcattgcttcagcttaaagtataggcccatccattaaccagtcacattggcttggcagtagtctatggagattggccaggtctgggtcacatggcaacctatggaggccaatccttaatctttttctctggaaccatatggtctgattttttttttttttttttggcttcacctattttcttttttcttagttttttattttcataggtttcggggaacgggtggtgtttggttacatgaataagttcttcagtggtgatttgtgagattttggtacacccatcactcaagcagtatacactgcacccaatttgtagtcttttatcccttactgcacttccaccctttcccctgagtccacaaagtccattgtgtcattcttatgcctttgcttcctcatagcttagctcccacttacgagtgagaacatacaacgtttggttttgcattcctgagttagtctgcaatctcatccaggttgctgcgaatgccattgacccattcctttttatggctgagtcatattccatcatatctatctgtctatctctctatatatatctatctatatatggagatatataggtagatatatagattcagtcacagagatatatatctatatatctatgtagatgtatatagagatagatagatagagatatcacaggttctttatccactcatttgattgatgggcatttgcgttggaggaaccatctgatctgagaatggaggaggtattgtttcactcaggagaggtatacgtagacaatagatgctaaggaaggaaagcaattgttctttgtccagtctttgtctgtgctaatgacaactctatgaaactactcagtccaggaggatttcttacagcacaactctctggtgttcatgggactgacagttctggaatatttaaaactattcagtacccccacctcctgtcttgaattcctccttgtcctttgaaactcctttaccgtgaatctatagcagcatcatgacctgtgaagacacagtgcactttgagttcatttttcctgtgggctcttttttgttttcgtgtgtcaggttcataatgactgtgtgtgcatgaatgtgtgcatgagcatgtgtgtaaacacatacgtgagtttccatctctagaaattactgtcattcatcctggtcagagaatgtacagctttgtttaattaaatggtgaagctagttgagaattggcaaatggagtcagattgaaaaatattttacagctctttattcttcattttgtatttcttgtgttaaacagagaaagaaaaaaacacccttgggattgtaagtgatgaacttaagtctttgggattcctttataattcagtaggtcattaattctgcactacttgttgccttttggcttaaacatttgtgttttctatgtgcttagggacttctttttaatcttttagatatctgtctatctcaaggtcctggcataataataataattttatttcttgtgtaatgatttgatttaattcaaacattgtggaaatcctacgatgtgtgagctccatgctaggtgcttgagatatgaattcatgacacataatccctgccaccaagaagcacaaaatttttaaggagaattagagagtgacgtgaccagatgccctaaaaggtgtctgctggacagcattaaacagatacacaagcaaacaaaatagtatattaattaattcatgaaacaagtatttatcatgcaccagacactattcttggcagtgggcatgcaacaaggaggacatggacacgtccctaatcctacgaagcttgcattcccatgtaagccacacagttaaaacacacacacacacacacacacactaaatgaacaaatgcataattgcagcctgtggtaagtgctatgatgtcaggaaatacttctataaggaactgatatttaagcctgtttcgaaagttgggaggaccaactatgcaaagagtcagaatgcaagaacattgtatccagggagaacagaaagtgcaaagccatcgaggctgagagagattgctgggttcaaagactgagtggctggtgggtattaaacctgtgggagatcagcacactgtgagctggagagcaatgtggaaacctttattcagggatgtaaatgccttctggggcagacagacagtagatattctcatctaatgcagcatattctggggtattattagctcaaactggaagggggccactctagggtggaggctggacctcaccttaggattcctcgattcttgtacaacactcctctccttactcaggaggctttattttcttaaacacagctttattgaggaaggattaactgtacatatgtaaagtgtacattttgataacttgacttctgtgcatacctgacaaacttgactgtaatcaaggtagtgaacatctgtcaccccagaagcttcttcctacgtcgctgacatccttctttccgctcctccccttccaccctccccaaaacaaccaccaatccactttctatttctacacactagtttgccttttctagaattttatataaatggaatcatagaggaggtggagttactttttatagcttttaagcccacacagaataaaagtattctaatcttttttccatatgtctttttgtgtctgaaaaggatcttaaacatctctaacaataacctccttgttttctctacccgtggtctaaaacctgtgtttgcttgatgctaaacggtggagggatttttctgacttgaaaaaggcagagtttacctctccttttcttatctccattattattttgaaaaatgcaattgacctaggaaagaaaaagggggatgacagtgacataagattgggggggagagggtagagaggtgaaaggatgaatcaagcaaagatgctgcttcatcgttctgatcccagaaattagatgtgtggatgaccaattttcagctaattagcataaaacaaaatacatttcaggaaaattgtgctcgacacaatttaatctctgatggttcagaacagtctctgggtcatcatgagcatcagctctggaatcagaagcactggggagaaggattaatggggaactggtattcagggagctcaacatatatgctcacaatctccccattaacaaacaagaacttctttctattttatttcagtacagcttgtcctttgtttgcttcctgaataatttgaaaacatgtacaagttgaagtgtaatgcaatataagactttcagatattaaacattacatagtttaggtatacaattgattcatccattcattgatctggtaaacatttattaaacatgtactgtctccaggatatgtttctaggtactgagtatatggtggtgcagaaggtgattctgtatgtgcctgtaattgtttgtgtttgcgtatggttcagtgggatttgttagagatatgattaattgcttgtaaaataggaaagtctaccctgagcataggagtttaaagcaatgcaacaattttgcaacatccaccacagttaaaagtgtccatactctttgatcctctgatagcactagtggaaatttatcttggagatacactcacccctgtgctcaaagatgcatgtattacgaggctcatgaaggcttgtttgttgtacctaaatccccgtcaaggatggactagtgaaacgagtcatgatatatatttatggttgaatactatgcatctgtgaaaagaaggaggttggtttgtctgtactgacattcaacaaactcagacatatggtcaaggaggagaaaagcatgaagcataacgttatgtgtggtaggtttgcatttgtcaatgggatggaaaagagggcagtatacgtgcagcataggaaaatacaagacactgctaacttctgaaaatttattgatgagcaggggagtgaggatggaaaaagagccacctctttgaattactttaaatatttccaaggtgaatgtactggattttcagttttggaaagctaatcttaaaagtggaaaaatagataaaacaagtataaaggataccagtagattttctaatgttaaccttgggacctcatatattattggatgcaaacgtctacaaaggttgctattctgtcccccttctcccttgaccatgccgtgaaacaaagagaaaatgaacaaatccctgcaaccaaaccctctcaccagatttgactactgccaatgagattattgagttaccaactgcctctcagaaccctaaggcaatttggagcccagaaggaaagtgaggcccccaggtggatgtatggaaggaaggtggtgcacctttgggcccttgtgatccaggtgagtgacagagtgactcacctaaaaagagagggaggtctctgcagttggaagctgcaaatgatgatggtagaattttgcacaacccagggatcacaagcccagttttaggggaaagggctctaagagtagagacatccatataggcgcagatagtcctcctttatttaaatacaccagcagctgcaaggagtaaagggtcttgaggtggaaaagaagaggggtcattccagatccaaaaaatcgagatgactcctttgagcaatttcattcactcgtttgctgaacaaacctgaattgacaccttcttggcacagccttgcactacgtgatgaggtgaggtgctaggaccaggtcactagcattcactgaacttttcatttcatgcaagggaaagagccccctatcaggtaatctcacagacaaatatacaattaaaaactgtgataggggttattaaggacactgcagagtaaaacaaacaagcctgattatcttacagggaggaggagttataattcacctgtttatttagaaacctgctaatactaatcactaagaatctctgtgtggtggctcaggcatgtattcccagcacattgggaggctttggaaggaggattgtttgaggccaggagtgtgagaccagcctgggcaacatagcgagaccccccgtgtctcaaaaaaaaaaaaaaaaagaaaaaatagccaggtgtggcaccaccctcgtgtagtcccagcttctcggggaggctgaggcagaaggatccccggaacctaggagtttcaggctgtggtgaactatgatcatgccactgcactccagcttgggtgacagagcaagatcctgactcttaaaaaaaagatcgttcccactttacagttgactacattgaggggttgaaagatgaatttgcttgcaaaacacagcaaatatgagtggagacaagacttcagccaattaacacagggctccggcttaaggagagcctgagcacagtagttgcatagttggttattttaacaataaaatctaagaacttcgagtacacagtggctaatagctaggagggatctctgggcacgaagattagtgtagttgctctggtgacatttggcatattaacatgagacatgaagaaacctaaaccatattcattcaccatagttaaatgaggcaggagtcaacaaaatacagcctggcattaatagcctaaaaacaagatttttgagtttttcttaaaattgtgcacgtaatattacaaagtggtcatgtcacaggagaaaattttagtgactaaaggctggaatgtctgtctatatttattctagtatataactggtaaagaatatgtgttccctcccatcccagggtcagctgtgatatagaattaagatttttaactttgggtagtaaaaggacaccagggcatccatgctctccctgaaattgtgtatcgtacagtatttctggaaagaagtcttcatttgtttgttgtttttttctcctagaagggcatggcacacacacacataaaggttaagaaaaaatactgtttttgaaaagccaaataactgtggttcactatgtcgagacatgtggccaatctcattttcctacagatgttgttggacataaattgatgatttcaagaagcaaaaagaatattctgcaatgctcagtattaaggagttcagtgtgatcagatgggcctttgtcaaactgaagtattttaattaacttacaccgtaaaagtgaaagtgtaaagctttgcttttcttcctagctaatcaatgaagattaatattctatgggaacccgactttgcagacggagctgagcggcactgttttccctaccattttttcctcatagtaaataaatcatttttattatactgtatgaatttacttagctcttttaatagcctttgtaagaataatgcttcctttgattatattacatttttaaatgagtgcagtgtggaatacagttctgctgttgggggaagggtggtgagaaaaggaaagagatactgattatatcagttttatcagcttatcctgtgtgttttaaaccagataaagcagtgtctgagtatcctgggagtcttaggagtaaattactaagtatttgctaggattgaaatggctcatacctgtgccttgtataaaactacttctggggaagatgaggttagtctgaaaggacctggtctttataaaattattctgattgttattttgtacttttttttttttatcttcaaggttctggccaatctatttgattttttttcccccaaaggagagaagtaaactttataattccagggctaacatccacttgtataaattgatcagttgaattgaaaagctgctgactggctgatttagcatgttcttcaagtggtctcattcacaattgataagctgacttgtcaccctgaattattggaggcttaacccttgaaggacagatacagtttggcctatacagattgtacttttcatgagacaggaaaagggaggaagggaggtaagtgtgtgtgtgagagagataaattaatttcattagaaacaaaaatatcctgtgatcttatgcgttagaccaagtgttgaaatattaaagttcctgatgagaaaattcagaatcatacaaactttgtttttctatgtcatccatcttgtacatagtcagcaaaccaattcatttttttgagatggggtctgtcttccaggctggagtgcagtggtgcaatctcggctcactgcaacctccaccttttgggttcaagtgatcctccagcctcagactccaaagtatctgggactacaggcacatgccaccacacctggctaattttttgtatttttttttttttttgtagagacgtggtttcgccatgttggccaggctgaactcctggcctcaagttgtccgcccgcctcagcctcccaaagatttgggattacaggcatgagccaccgtgcccagcctaacaaacattcttttaacatatattgtccatcaagtcagaacctttaatagctcctattcagaacctataatagctccacactgtttatggaaaataaataatggctgaggctgaaaatttaaggttatcttaaatgcagcctcaatatgtaaactctgtgtgtgtgtgtgggtgtgggtgtgtctctctgtctgtctgtccgcaaatgggtcaaagtgaaaagctcttgtgaccttgattcacaagactcaggtttgagcttcatttctgcagtttgttagttgtgtgcttactcatctgttctaggcctctgttttatgatttgggtaacaggaatattagtaatgacagcaataatggggatgactgggctataatgctacttacctaatttaactgatgttttctggaaagaatgaaatcagaaagcatatctgcaagtgctggcaccctctgtaaggcgctgccgaattggttggttgttcttacatgaattcaggggtgagtcagacccatcgaactggagtcagagaaagccttgcaacctggacagaatggaaaattaatttttcctattgcttcaggcacatgttgaaccacggtcaattcaagtttgagatctctgcagatatatacgtttttaatttgtcaactaaataaatacacagatacataaatacattgagctttctgaggagacctggagtctgcatattctgtggagttgatttgaatggagacccaagagtgtacctctgagtcattttgggtaagagtaatgctctatagttttttatctttttttggactttgaggacttatacaatataatgaaaaacactgtttttaagtctttccgcagtaaagattcttacaaagcaaaagataaaaagtttcccttctttctcatctacttgccatgttctcctcctgttgacaatatcctcccacttccctttcgatcttgttatgtatttggttgaatcagattccattgctgatatttgactacttagatgtattgtaacaggaatatattatgcaattatgcacccgcaccattggagccacatgatgaatgtatgcaaattattatgttagcatagagtgcaatactacacagtgtcttctgactcaatatccttccacccaagaaacacatcttggagattgttgcatgtcaacatgtggagatctattttgttctttgcaaggctgcataatgtcctatgttatagatgtgttctcttttttttgtatatttgctcccttattgatgatgggcattaaagttccctcccgtgctgatggacattaaagtggcctcccactaccaagttttcacagttactcacaatggcactctcgggtcatgcatctcagtgtgtgcatgggtgatttctttttataggatatattcctagaagtagaatacttgagctttaaaaaaaatcacttgtgccttttgcatcgtgagtgcttagtgaatttataattatttgatcaataatgaatgtgcaatgaattttatgagcaaagaactgtcacctcatatttggcaaaattttctctcacctcagacttgggctattttaagaaaaaagaaacctgaaacctcttgagtttttaactttcagttgtacttaagagatcagagttggtgttcagaggcagatcagtctttacgtggaggtgctaaggttgcaaattacaaaataattaggaaagtgattgtgtgtgcacatgagtgtacttgtgtacacattttggagattttatattcaaactgcaatgaaaaaaatatgaatacctgggtagctgccattttgctatggaggtccaaggtcacatatttaatagttctaaatttatacccctgggaaggaagtatatgctcactgtaccctttaataaaggcacagaaatgtaccgtgcagtctgcatgaaagcatgagtgagtgctattcattttaagaagcactcaagcactgtgaaaattagcagtggaacatggttccaaatgaaagtgacaccatgagcctaatgagaaattgaataccatctatttatctcctctagcccaagatctttctcttctgtcatttgaatgtttctgaaacgccttttcttcctgggctgagaagtgcctcatgccttcttcccctgcctctctggaaatgagagtccttgtgctgttttcctttctacgctcatgaagagtcctgctaggtgcatggaaactttgctttctgtttacatgtgcttctctgtcttgctaactcgttgtcctaagttttaggtgtgatagctgtagtggttttcatgaagccaaatcgtaaaggtctgagaaatacacactgtgtgttgcttggcttgtcttagagcaaaccaaaatttggaaaattgtctgggaagggtaagatcacttagctgtgaagcctctgcttttaggaactggagaagtgatttgagggtgaaaatagggtaagcgtatttactctttagctccttaaggaatgcttcttcaccttcttcaactcactgagtttgtgtttgaaaaatattccaaagcctttgcttaaaaataatgtattatataatatccttcgattaagtttccaacgtgtagattcttgttagcacttagtggtgcaacttttataaagaaacctggtatttttttaattaactgatgaaaatggatgtaagtaaggggtggacattcccatgtcaatgaatcttgatggtggcctccggtcactcatggaaaaatgtatttttgattacttgtgtgccagcaacgttgctaggctttggatgcatggaagcgaataagaaatatgaaagtcctacctacatagagcttatattctaatggaaaacagaaactaattcttttgccttagttacctattgctatgtaattaccacctcatagttgctgtggactgagagtccgaaagcatgtttgctgagtagttttggcaggtgttggcaggagctaaaatagtgtcaaggctctctttgagggggaccttcactgagctctctcacctggctgttagcaggctggaagtttgctgcccacagatttacctctggaaaggtgtcttgggacaaagtacatagctcctccagaataagcaattcaagagagaatgaaagaggggacacccaagacagagaatccagtcgcttttattgctgatttaggaggtgacattccatttctcatgctgcattcttttcatccctataattaattaatctagcctgccccgaaggggagggagttacacatgaacagggatcactggggaccatgttacaggctttataccacatttattaaatgcctacgctggggagcactgagaaaagcataaaatagcagtgatgcgtataataggcaatgacacttattgggggcttcatattgtatcagctgtgtaccaagggtaaggataatgaaagctcacatatatggagtaaccattgtgccaggcactgtactaagtggccatgtgccctttctcatttggttttcataacagccctttctcagtgggtaccgatcagtacccattttacagataaggaaactgaggcacagacaacaatggcttctgaaattctcttctccgtgtcatgcactgcatttttctcccgttcaccagttgcatcttaggtctcagttcattttcaccaccttcctgaatatatagagagaaagcccatgcagtaaaccaatcaaatcctggctatccgagctgctctatctgcctctgaaagcctaggagtaaaggaaaattgtcctcatgagcagttcatgaggtgtcattcaaagcacttttgaggcaaagtattatgtttcacagccatggttcccagtagggacagcaatattgcagtgaaatgcaccaacatctctgcccatcccaaactctcctctcaaaccagtttattgaaatgaggcctcacttcacaagtaaataagtagtcaagctctggatttgtctctgctccagcttactgtatatttccactaaatgagtccattaaagcttaaactaaaccttttggaaaagaaaaacaaagcccacagcagctgtccagggctgcgggagttagaaaatgcaattcatgtgacttggtggaatgccagtgaagctaccattagattattctgtttactgttaaggtacgtggagacagacaggctctggagatgtccgacctgcatttggatgacaggtattgaccacctccttgatgccaggcatggtgctatgcagaggcatataacagcacacacaggacacagaccatcccctcaagggttttgcagtctcgtgggagtcatcaacacaagatttaaataatgtgtcatgtgtgctagggagaggaagtttggggttctttgggaggatataaccttgagaagaatcaggtagggaaagtccatagagaagggtttgtttcctctgagatacgtaggccaagaaagagttagggaagtgaagacaagaggggacagttttgtcaaacatcagctataaatactcaaaagcagctaaaataatgatatatctgcaaaactggaagcagttcagtagggttgaagaaaagatagtaaagtgagggctggaatgggagggcagagaggtggcaggttggaagactagctaagcattttgggctttgtaacaagggcattgacacatgttaaactcgggaaaaactgatcgtttcattgtacgaacagcctagcttataaagttatttaattagaaaattttcagaatacttttgattcggtggtaatgtgtcaacaaccctaaaatgttatgtgtttttctgtaaagtatgtggatgtgaagggaagcaacatggggcatgattattaagagtacagcttctggaatcagagatcatgtaagttggaattctagcttatccaattacttaatgtgtgagtttaggaaaatatctattaacttaccaccaattacttaatgtgtgagtttaggaaaatctattaacttaccacaatctatagtacctcatctgaaaaatgggaataattaattaatactgagctcatagagcttttggaagaatcaggttaggtttttacgctgcatagcacattaccacctgcagaagcttaacacaacactcttttgttatctaacagtttctgtgtatcagaaatttgagcatggcttagctgggttctctgcttaaaatctaatagactgcagtcagggtatcagccaggactgggttctcattagagactcatctcgaacaggatctgctttcaagctccctcaggttgctggcaggattcattttgttgtagctgcaggattcgtggctgcttgcttctgcacatccagaaatgggtggagagagagacagagacagagagggagagagatccagcaagagagttgctataatcttatgcaatcacttaggttgatttcctctctttgcaattgtgaattgtgctgcattaagcatgcacatgcaggtgtgtttttttatacagtgacttgtattcctttgggtagataaccagtagtgggattaactggatcaaatggtagatctatttttagctctttgagaaatctgcatactgttgcatactgtttgccatagaggttgtgctaatttacattcccaccagcagcatataagagtccccatttcaccacatccatgctaacatctattgttgtttcactttttaacagtggtcattctggctgggtaaggtggtagctcattatggttttaatttgcatttccctgatgattagtgataagcatttttttcatgtttcttggccatttgttggctattctcatcttctgagaaatgcctgttcaagtcagagactcagaaggagggaggcaaggaggagggtaaaggatggaaaattacctatcgggtacaaggtatgcaattcagttgacaggtacactcaaagccaagccttccccactatacaattcatccatgtaagcaaaagccacctgtgcccccaaagctactgaaattaaaataaaccttatataatcacatacatgtaatcacacttatcttatcacctctgtcatattccattggttagaaacaagttgtgggtcctgctcacattcaaggagggattagtaaaggcgtgaatgttaggatgtggggatcatggtgagaagaatcctcaaggatgcacaccacaagaatttggtaaaattgtacacataaggacagaatagaagcatttagccttgtgaagaattaccagggcaccgaaagagagaatggaagcatataccaaatagagcacatagagaacttgctcagatctcttaactgttgttgttctggttatgatatgatttttaggaacatgtggcagagtgtttctgtgagtttggtagcaaatacatattggatgtacttgcttagtcagttctgtgtgccagaggacactcatggggagagatcaaggttactttttgcaggtggggcattttgtaactgaataaaacccagtcagtaaaagtaagcaacatgcggaatctaggcaagtgttgcaatgtatgtgtgctcttgatctgaggaagaccatgcatttgactcagactagaaacctacaccacagaaatcccacccacaagcaatgctctattactgtaggtacaaggcagtaatttttttgtgtccattcacatatgcatgtgtgtttgtgtgtacataattgaccaactatcctcaggtttccctatggtgaatgatttattgagtcatcagacttgtggaacacctactctgtggtggccatgatgccagcctctagagataaaaagtacaataaacgagctatcttaaggaaactcaaattactttggcagacagaactagtaaactgaccactgacaattcaaaaatccatggggggagttccatttcgagttagatgggatatatttagggcaattcccatcctgtttcacttagatatgtttcactacatatcaaagtaaacttcagaggaaaaacaacaacaaaaaaccacccagacatacaggaggacattatataaggataagagggccaagtcaccaaaaagacaaaacaatcttaaacaatcatgattatttatgcacaaactatgggacttttaaaataaagccaaaactgatagaactgaaaagagaaatggagagtctacaaacataagtgaagtctgtctcactatttgataaaattaatattgagaaaattaacgaggctgtagaagtactgaacaacaccatcagccaacaaaacatagttaaaatgtgtaatcaacaccatccaacagcagcaggatgtccgttctgttcaagtccacatgagatatttaccaagataaaccatattctgtattataaaaaacttaacaaatttaaaataattgaaatcatatagttgctttcctctgacaaaattgagttaagctggaaatcagtaacataaaataaactggaaaaaatctaaaagcacttggaaattaaaccgcaaagtctaaatcacccatagttcaaagaggaagtctcaaggggaattatagaacttaaatgaaaatacattttacaaaatatatggtgggaagcgaaagcagtgcttagagggaaatacataatgctaagtgcttctattagagaataagaacgttctcaaatcaacaatgtaagtgcatatcataagagactattaaaaaaagcaaatcaaaaactaatacatgcaaagagaaagaagggaatagtaaatgtaagattaaaaaaatgaatttgaaaatcaaaaagcaatcaaacctaaatctggctctttcaaagcatagaagtgatgaatctattctagcaagactgacaaaaagcagagatgacaaaaattacaaacatcacataaattaaaaagattataaggaaataatcaaataatctatgcacatgtagtcaacaacttacatgaaatagactaattccttgacaaccattaccaaaacttattcaaaacaaacaggataagctaaatggttcaatagacttatttaaaatatcctgccaaaataaaaattttcagacacaaatggtttcattggctattccaccaaacatttaatgttgggaaaaaaaaaaaaaaactatacacagtctcttacagaaaatagaagtggaagatatacttctcaactcaatttatgagtctaacattaatctgatacgaaaaccaggctatatgtaatattttatatatgtatatatacacacacacacacacacacacacacacatacgtaaacatatatcatggaatacatataatacagaaaaataataacatagcatgaccacatagtattagtcccaggagtccaaggctggtttcatattgaaaaaaatcaatgttatgtaccatattaacacaataaagaagaaaactaacacatgaccctgtaaaatagtcctgaacagtattggaaaacaaaagctaatctacattgatgataaaaactctcaactaactagaaatagaaggcaccttctgcaacctggtagaggatgtcaacaaacaaccccacagctaatatcatacttattggtgaaaaagtgactgctatctccattagagcaggaacaagggaggagctccactctcaccaaacttatgccacatagtactggaaatcttactcactacaataaggaagaaaaagaattatagagcatatcggttggaaattaatatataagggcatctttaatcacagataatagaattgtctatttataaaatcccaaggaactctaaaacctcttaggtgaaaacataaatatcaatcatatatctatatactaggaaagaacatttggaagtcaaaacttaaaaacaaaccatttacaatagctccaaaaaatgcaatacttagctataaatataacaaacatataagagatctttatgctgaaaactataaagtatttgtgaaattaaaaaagcaaatctaaatatatacatagattcaaagactcattgtagtaaaagtattaattctgtacaaattggtgtataagtttaacacaatacaaatcaaaattctagcaggtatttttgtagctataaacgtgaagattctaaaaattataaggaaaaacaaaaactagaatatccaaaataaagaagaataaaattaggtgaatatatctaatttattttatataagcctatagaagtaaagatagtgcaaaccagtaaaggagaagacacattaatcaactggacaaaatagagactccagaaatagacccacaaaatatacttaattaaatcttagaaaaggtacaaaatcaaaggagaaatgattttgttttcaacaactggtgttggaataattgcaaacacatttgccaaatcatatgctttacaaaaaaattaactcaaaatggatcatagatctaaatataaaacgtagaactgtaaagttttagaagaacacatgggtaaaatattcacgtccaaaggagttaaaataagaatttttggccatgacaccaaatgcacaatctcacctccccaaaaaggtttaatttgacttaacaaaattgttaataaattatatgtgaaggtctctattaaaagaaagaaaatacaagaatctgtaaagaaatatttgtaaaccactcttgacaaatgttcagtatctagaatatattttgaactctcaaaacataaaagtaagaaagcaaacaaactatcttaataatgggaaaaagacttgaatagtcacttcacttagagtatattcatactcctttcttattgggtcctgagtggggggaaaagaagagaagaggatattcatcaggcaaaaacctaaaaaagaaacaaaaaaccgtgaaaaggtatttaacatcattagctattcagcaagtgcaaatgaaaactaggatggaataccattaaacacctagtagaggcataagataaaaaaaattgacaagacttagtgctgtggaggattcagagaaactggatttctcctgtactgctggtaggaacatagaacaatgcagacattcttaaaacattttgacagtccgttacaaagttaagtatatgcttatcatagagcctagcaatcctactcctgggttccttacccaaagatattgtatatttataaaaaacatgtacatgtctgtgtatagcaactctaccatagccccctagaaacaagccatatgtcttcaaatagatgaatttgaagcattacatgtacacgtggaatactactgaacaataaaaaggagcaactattgatatatgtgacaacttggatctatttcaaaagcattatgctaagagaaggaagccagtctcaaacgatgacatagtgtataaatccattcctatgacatctgcaagaaagaaagctgtaggtttggggagaaaagatcaggggctgccagggattaggggttggggggagggtagttgcaaatgaatagcacaagagagtttttggggtgatggaactcttctgcttcctaattgcacagccgttataagaatctgtaaattatgttaacatttatgaaattgtacatccaaactttcaaatttatggtatattaattccaaataaatgcaagcccatagattatatgaggataaagtctctgcatatttttgttgttatatctccagcccatagcatcattcctggcaaacattacacatttaaaaatatttgtggatggaataaatgaaaaagtgtagaattaccattgttattattatttatttattattttttgagacagcggcttcctctcttgcccaggctggagtacagtggtgccaatacagctcactgtaaccttgacctcctgggctcaggtgatcctcctgccttagcttcctgagtagctgagactacaggtgcacctcaacataattggctaattcttttaattttagtagagatggggttttgacatattgtccaggttggtctcaaattcctggcctcaagcaatcctcctgcctcaacttctcagagtgctgggactggaggagtgagccaccccacctggcaaaaattatcttttaaaagccatatgttaggagctagtttaggggaaatatggtgactacttggacatatatatttatattgtatgatgatactttacagctatagattactaataatttataaagtacattgttttatatttagaatttgcaatataagaagaagggttttgcacgagggtggggctgtggtcatttgatccagtttctgttttaagaacatgccacagtctgcagtggagaagagaaaggagagagggaaagtggaatctctaagttgtattaatgctacatcagtgactattcttctacataggtctttgtgcatatgatgtctatttaattctaaaaatggaattactaggtcaaaggttatgtatatttagaaatattacacatatattacatgaccctcccaaatgcccagtgttttatacttttaccaagtctcaggagagttttcaacgaacttgtacataaaataaaagctggtggcatggtggctcacatctgtaatgacagcacttcgggaggccaaggcaggaggactgcttgatctcaggagttgaagactagcctgggcaaaaatattttttaaaaaattgccaggtgtagtggtgtgtgcctttggttctagctactcaggagactgaggtgggaggatcccttgagttcaggaggttgaggctgcagtaagccaagatcacagcactgcacgctagcccaggtgacagaatgaaactctgtcataaataaatagataaagctgatacagtatctgtaatttgaaatatgtactgtacacttctgaaccaaccatcctccctcccttcctcgctccccctcccctcccctcccctcccctccttccttccctctctccctccctccctccctcccttccttccttccttccttcctgtaataagttgtgagttttctcataatgtcttcaccaatagggcaacacatgatagccctcatttcacattctacctaaaaacgtgaacctcacaatactcgaaaatctccccacatacacaaaaagactctatatcacatacggaaaaggtagctggctttagttcagtgatttttcaatgaggaatgctgcacttccaatgaaaacagacagccagtgtagagacagtccgtatcctgtttctactgtatgactctgattcataaattactaaagtgtattcctgacaaataaatatttcaccagccagtgacagcgttatgagctaattaaaatctgagccctggaagaagtggtgccattagctcaattcacaggactggaaagtatgtgtctgctcacggactgagaggtagacatttacatatgggaaggagggggccggcttattaagagcaacattgaggtttggatgaagagagcactctgtcaaagctgagatatttaaagaaaagccaaaatgacaatatgagaggtttcttttgcccttgggaagaaagaggtaacactgcatggtggtgttaagtgtaagggcttgggggacgggccacactgtcttgagttcagatcccagatctgccatttagcagagatagaactttggggttgtcgttcagcctttctaacctgcagcatcctcatttgtgcagtgggcatagaaatccacatagtggcaagggtataaaatcagatactacttttagatcctcagcagagtgccaggcaaatcaatagatggttgataccttgtcactagcgtcaactcttgtatccacaagaagtcatgtttaaacgtccagttttctgttaaaaatttcaaacctgtcggatgctaagcagttttctagtttgaagtttgttccttcagaaaatatggttaacacacattttttgataacttatgatgtgccaagtcatggatggttctaagcattttacggtcaacatctcatttcatcatcgcaataatatagaagatggatatcgttaactctacagaggaagctgaggaacagcagcaatgagttatttgctctaaaatttaacactttttttttttagacagatgcctaaactccctttgtttcacacaactatgcaaattgtgaggccaaggatatgactgcaaacgattaaggtttaatttacatgaatagccaggcgaagtgcctcacacctgtaatcccagcactttgggaggctgcggtgggtggattacctgaggtcaggagttcaagaccatcctggccaacatggcaaaactccatctctactaaaaatacaaaaattacctgtgcgtggtggcacacacccgtaatcccagctgctcgggaggctgaggcaggagaatcacttgaacctgggaggcggaggttgcagtgagctgagatcgcaccattgcactgcagcatgggcgacagagccggactccatctccccccaccaaaagaataaaaaataaaaaagtttacatgaatgagctttcttccccatgaaaataactgtgtcacttctcccttggtctaacccacacaaaatccccaccctgtctggcacagatacacttaacatgcaatattaagtacaatttccattttatttttctccagagtatcgtgtgtcttcagtcttgaaggactcagctccttacatgggctttggtgggggtcatggggcagcacccgcaggtctaaatcgaggtgggggtttttggtccctgtggggttcacaagatcaattcctgactactttactgtgaactgtgcagctcacacagtaacgtggcttcacatacagcttgggaagcacaaaggcatcgaagacgcttgcttcagaaacatccctgactgctgtggcctctactatgttttgaatacaaatttcttaatggccttgtctttgggcacgcgctgggcacagttcgtgcagcaaataggctgcatgtggctgcagccctttttggcatgactgttgttcttccttttcttagtcatcttggaggcaaggaccggagatcctaagttgttcttttaaatatatatgtatatatatataatattcgtctgggtacattggctcacgcctgtaatcccagcatttcgagaggctgaggcgggcagatcacctgaggttgggagtttgagatcagccaaagattttcttttagcctggccaatacggtgaaacctcatctctactaaacatacaaaaaaatgagctggatgtggtggcaggcacctgtaatcccagctacttgggaggctgaggcaggagaatagcttaaacccgggaggcagaggttgcagtgagccaagatcgcgccactacactgcagcctgggcgtgacagagcgagaatccgtctcaaaaaaaaaaaaaaaaaaattattgcagacctaagagaaaatctggttggtccttcctagaccccttttgtttaaacagctatgactgaggggagcacttcatgtggtcataaatggtggctggtgttctacccctgactgtgattataatttcagagaaagaaaagtctctgtgaactagccacaaatgcctccgaaagcataaaatcgttattcagcattctccatactttcctgtatccatggtgttgtcagcaatatgtaatattatccatagtacttatgatactgtgtttgcttggtctcaagagagaaggttaaaagtaacaatctcaggtctggttataagcattttgtaaataataacttatttgatacttattatcaccctatgcacttagccactattatccccatcttatatatactgttatgtcaaggtagggagaaataaatatgttaagaaataaatagagcagtttttgatgacagggatttacttacaggtcttttggtatatggtgtgtactgtatgtgtatgcacgagcgtgcatgtgtgtggggaatgtgtacattctgtatcatggtgtgaataagttgagagtgagagtcgggagtaagggagatgacaattgtgtggtgatgatttcaagttaagagtataaatgtggaatgaatgagtttctttcagaggactttgggttgtatatgcttcaaaacgagcttttatcttctgcattcttcctcatagccccgtggaggcaggctgaagccttggcacatcttggtaggatgacctgactgagagcaaaggtcgtttgcaagcatataaggactttattaagcagcatattaatcaggcactgttggttgcaagcaacagagtcacaatgcacctggtcttttgtttagaagagggagttcattggcttacacaactgcaaaggtccgaaagaggctgggttcagatgcacaaatacacggtttgaaatctggttctttgctgtttcttggctcagcttttcagtcttgacatcgtcctctggcaaattcttccttaatgggggctcaagtgatgcagcagctccaggcttactttctatgaaatggacagccctggtgaaaagcaaatgtctccttcctaaccattctgacaagaacaataaaatcctcaaagattttctttcaaagaataatagcatgtattaagtgccagacactaagtcctttttgtatatgaactctgttatttccttgaatcctcacaataattctgcaagataggtactatacttaaccccattttaatatggtaaaacttagttacagaacagttctgtcacttagctattgctgtgtaatgagctagtccaaagcctagtggcttgaaagagtgaccatgagtctgataaattggcaaaccaagagagcctgaatcctccagggtgacatcagcggggatagttcggttctgtacgtgtgtgtctctgatatccccagcaagctagcctggttcacttagtgaggtagagatacagcagtgagctggcacaattgtacatgcagaaggggcaaaggtactcaaagcctggagaggctcatgctaggaactgacacattctcatttctaccctattgttaccagaatatgttacaagtccagtttggattcagagggtggggaactaaactctaccacttgatgggaggatgttcatggtcatatcacaaagggctagaactggggaagaatcggaggctattttggtaatctgtctgacataatggtaacttttttttctttttactttttttttttttttttttttaagacggagtctcactttgtcgccaggctggagtgcagtggtgcaatctcggctcactgcaacctccgcctcctgggttcaagccattctcctgcctcaacctcccaagtagctgggactacaggtgcatgacaccacgcccagttaatttttgtatttttagtagagatgaggtttcaccatgttggccaggatggtcttgacaccttaacctcgtgatccgcccacctcagcctcccaaagtgctgggattacaggtgtgagccacggcacgcagtcataaaggtaattaaacttgcccaaagttagatttttagcaggattcaaaccaggaaagtctggctccagagtacaagttcttcctcattgcaatgttctttatatagtttttattgattcggcttggatagtaaccccacaattgaaccaatcattttggccaggaaaacaaagtgtttcatcggtttggttagatttgggtcctgtcttcatttctaagatgaggtacaggagtcagccctacctaaaccatgggtactggaagtggcataggaacagtagctcaaaggaaagttattttcagaagaagtaatggatagagatcaggtgacaaaataatatcccccactgatagggatatggtaggggcaattgggtaaatttcaaggataagaccttgccatgatactcttggattacaatggagagacacatttgccctatctcctggggaaaaaaattgaggaattacagttggctttaagtgtatgcatctgattgttgactagatcatgaggaggataatgtggacattaggaagaggggccttgcagaaaggggcagaaatagcaaatttcaagtgcctgggagcccccaaatcgggttgtgtgtgctatttttaaagtaccaggagacacgacaactcctagctgcaaagagacatttatcacactgaaaaaaaaaatgagtgaatggttagacagatagatggatgatggatgggtgggtgggtgggtgcatggatagatggtggatgaaaaaataagcaatgaatgaccctctagatgataagtggaaccctgctttgttttccatttcctgcttcaaatctcatttgccagcaataccaaataggatatatactcctctacttccatctatacctggcctctaatcttcttcatttttgaagattttttttttttttttttgagacagagcctagctctgtcgcccaggctggggtgcaatggcgagatcttggcccactgcaacctctgcctcctgggttcaagcaattctcctgcctcagccttccaagtagttggaattaacaggcacgtgccaccatgcccagctaatttttgtatttttggtagaggtggagtttcgccatatttggccaggctggtcttgaactcctgacctcaggtgatctacccacatcagcttcccaaagtgctgagattgtaggcatgaagccaccacgccaggcctgaagactgattatttttaagccagctgaatgggttaagtgtttgtccattgtgctctggaaattctctgagcgtattcacattattacacttaacacttttgtgaaccacatccttttaggcaaaagtgatcatctctgtctcactcattgcagtactctaatgcctaacacagagcctgacccagagagagtgcactgcaagtatattctgaatgatggagtgaaacagtgagtcagtgtgcaaataatgtgtgttgataagcatatgtagggtctgcagtggtgatgtaggttttatagccaatgacatctccagtgcctttttacttgataaatataagactataattttcttaaaagcataaataataggaagtgttctcgaagcccattcctggccaaattctttgcctttaatatcgtgcttaaattttgtcaacgcatttcttttaaaaaatggaggaaaactgagtggggaacaagaacactttctcatctcattcataatctatcaggcaatcctggggtgccatcaagaagagatgatgaggcgacagtgacacagcaatgactgccttcagttttatcatcagtcctggatagagaaggtgcaccacctataagtgaaggtgatcagtttttccatttccaaagagatgggtatcttaaaagttagaaatttgtgactttgaattgcctttttaatcataagaatcatagcttctggccgggcatggtggatcatgcctgtaatcccagcattttgggaagccaaggcgggcagatcacatgaggccaggagttcgaaacaagcctggtcaacatggtgaaaccacatctctactaaaaatacaaaaagttagccaggtgtggtatcgcacacctgtagtctcagctactctggaggctgaggcaggagaattgcttcgacctgggaagcggaggttgcagtgagccaagaccacaccattgcactgcagcgtgggcattgcagcgagactgtctttttttttttttttttttttttaaaaaaaaaaaaaaagaatcataggttctgcttagtcagtgcctacttatgttttaagttatagttggccactttacatctcttgcttctgctccggtaggtttcataatctccattttatagttgagggaatgagtacctgaaaggatggaataaactcaccataatcaacctagctggcaagtgattggaactgaggtttgaaccatgttcatttgactctgaacactgcagtctttcctgaataccatccctcaagcagagagttgggcccagatgagataggcagagcttccttagcataaagtcaatattgtctttttgccagacagtaagccaagcataaccgcatacatctgaccagaggctcttgtacaaattggccactcaggttctctgaaggagcttgatttggggcctgtgaatagtcctgtgaatattgggatacatgagattaatttttccctacatctaaacatccaaatggcttaacttccagaggggcacatcttagcttctagggggtgagaggcttcccagtatcttaaagaagtggttcttaatctcactggcaagttagaatcacctggagaactttaaaaaacattgatgactagagtcctttttttctttctttttttttttttttttgagtgtcattctgttacccagactagagcgaagtggcacaatatcaggtcactgcaacctctgccgcccgggctgaagcaattctcctgactcaggctggaattacaggcaccttccaccatgcccagctaatttttgtattgttaatggagatggggttttcccatgtcagccaggctggcctcaaactcctgacttcgactgatctgcctgtctcggcctcccaaagtgctgggattacagtcatgagataccctgtccggccagagtccaagttcatcattgcaatgttctttatctgtatatatttttaattgaactcctatgttcactgcagcattatttataatagctgagagatggaagcaacctaaaggtccattgatgggtgaaaggttgaagaaattgtgatacacagacacacacacacacacacacacacacacacacacacacacacacacacagtcactttatcttgaataacataagacaaatgtattcaggtataagtattaattcatggtgccttgcataatggtgagaggcacacatgtttatgaaggcagaagtaaactatttgtaaagctgaaaaaaaaaaaccacacacacacaatggaatagtattcagccctgaaaaataagggcagcctgacgcacacttcagcatggatattccttgaggaaattatgctaagcgaaatcaaccagtcacaagaagacaaatactgcatgatttcacttatatagctatttcaaatactgaaactcttagaaacagtgggcttatcaaaattgaaaaaaaaagatacatctttcagtaactgccataaagcaagagaatgctgccacgtggtgataaataggtcccctgacatatgtgcataaaaattgtgcccattttaacaggatacattttttcacttgtgattctgatgaaactgcaaactagagtcagaaaacaaaccgttataccaggaaataaaccagaaaataaataaataaccagaaaataaatcatgtgccttggtattttcttgcgtttcagaagtgaccttattatggcaaaactattttttgatattatggtttgtatgcatcaaaaatgcaggttttaataccaagatccatgacctagaaagaggttttagtatcagattctcaatgtttttgatgaagagggaaagagaaaacatatcatttaaaaaattattttcaatatatgacagaattttatattttgaacaagatattgttttgtatataagccatggagagtacacttgaaaagctttggcttttgagatatttggtttctggactcttgtttctgtaaattagaacattccgatgtgagatgaacatattggttgaagatcattgcaatggtcatgtttttccaaagagaagtagttgaaatcatttagtagcatgtgaataaaagcaaggtttttagaggcaattcagtaattttggtagcttttgttgcaaccaacagagaatcaatgacaagacaaggagaagagagagagcagctcttgtcttaatttaaagctgaaagatacacacatgattaataccaaagaaactttccattttattggtggaatgaaagtaaccttgtagagcttttctgtattggtagaaagcaaaagcaaaaaaattaattgtttatttaataagtggtatttttctgagttctgcttatagtttctttagacgtagaataacacatcattaagaaaaataataattgatctgccatgaaaaaaaaagaatgactgacacagcttctttgctgtcagcccttttgtactccaaaacgtaatgcccattttgaaatatcatggctaatccaaaaaatatacagctaaacagaaaaacaacatcagttccaaatatgaatacatgatctgctacttaatatgtcagggtatttgtcaggttgataacattaggctctgcggcattcaattctaagccttgcaatatttgaagtgtgatactgtgcttcagtaaatttaatacgtgggcctcagtaatggagggaatcacgttagcacttggcagtttgttatgctgtataaaattgactgccctgcaaatacaatagcgatcataaaaacggtggtcagcagagaggggtgtaatgcatttttgaggtttcagtaaaggtccagatgaaatttattgagatttttgccatttggatggtgatcaatagagctgtgctaataatttgttgtgaggatgttctctggggatatgacattttgctgtgaaactttggaaattcagaaagtagactaagtgatgatactgctccagtatatataaccgtcaaagactttaacatcgctctgggagaggatttatagtgatggtgattacttcttcaggcattgaggatgtgatgcatccaattattgatatgttttcatgcattttccagtttggactcacagtcatttgatcgtattgctgtttcagcccagagttttgtgataggtttgtttttaatttcattcacagtttccaaattgctagcctattttcttaattatatcattgatttcccctgcctcctctcccttcaccctgcccacatccagaaaatgatcgttgaagaaaagaattccgtcagctttcattcacatcaacagaggctacttagaaatcctgactgtgaaaactacttttgttgtgttgtagttgctgttgctgctgctgtagatggcttgtgtgctgtaccgaatttgcaaacaggcttctgagttaatgttaaaggagtacatagcatgcagataatgtttgtgatggttacagttttaatgcacatatgtcagtggacctgttaaatcactgtgaggcagcattctttggctttatggtggttgccgttgaatttatcttttttttttttcaattttgattagccgcgttccaagagagagagatgaattatccaatctttgcaaagtgggattccacactgacaatacagagatatcattctgagaaaaataaaataaaacaaaataaagaaggttttaaaacttcacatttggtaaaactgacttatcctgaggctgtttttatgtctgttctgtatgttagaaaaggaatttctgagttcgtgtttatttccctgttacattgttctgtttcctcagtgtatttcatgaacctgaccaattaagtttcagccctgtctaggaatttttttgttgttgctgttggattaaagcaactaagtaactctgcagtggacagaggcttagagagactccacattatttgtttgcaagaggaaatttgtcagcactttgcagaaagaacactgagactaggcacagcagaacaatttattttcaatgagcatgcacaaagtaagatttatgactttgcatcttcgatgacatttcttacattgttaccaagctacagcaaattaaagggatccgtgaatactaaggggtgtgtttttgtaatgaggaaaaagagacagagcaataagaagataattaaggtaacaacttgtgaaaaattaaagtgtttccatctttcatttttgaatctctgagcataaactttgtagttgttaatttaattgccgctgttcgcggcatccctgaagaatattgaggattaatcgtctggttcattccaacaagagataaggcctaagtgaattgaaattttaccaatttaaccctgtcttcctcctaatatgacatgattaacatttttcaattaaccacatgtaattattctgaaggcctcattccacttatttctagtctttttgactgcagattggccttttcaggtagtttggatctagaataattcaaagaaagctctgtttgttctattttgcatctggcacacaggttcatctgcattgtctttggagttgccatttcatcggaaaataaagatccataacagttgcattcatttttgcctaggtgctcttcctgtaaagcacagtgctgctcattgaagcctgaaggagtaatgtggtattgttggagcatatttgtaactgagcagagtgaaagactaaacaccttgcaggcaagaatgtcaaaggaagagattggctggaaatggttttccacagtaaatggaaagacctcaagattcgggagagtttggcatttccaaggaacagaataaaggctagttctttgtgttcgtccatatggtagccagtaatcacagtggatattgaaatgtaaattaattaaagtttaatgaaatcaacagttcagtttgtctcatattagccacatctcaagtgtccaatgacccccctgtgactagtagctgtcatattggagccaatacctagtagagatacagaacatctctatcatcttgggattttttttttttttttttttttgacagggtcttgttctgttatccaggctggagggcagtggtgcaatgatggtgcaatacagccttaaactcctgggctaaagtgattttctaacctcatccgctcgagtagctgggattacaggtgcacgccaccacacctagctaattaatttgtttgtttgtttgttgtgtagaggctgggtctcataatgttgcccaggctgatcttgaactcctggcctcaaacaatcctcctgccttggcctcccaaagtgttgggattacgggtgtgagtcacttcacctggccccatctagggaaaattatcggatagtgctaggccagagcacagtcatcaggtggatagtggttagtattaaccagggcattctaaattctgatatggcaacaaaaatctctgtaccagaggggttaatgctacatgggtttatttctctcatacacaaaatctactgcatgcctgggcaggaaggaggcatctagaagtttgcgctggggccctttcattcctcgtcatggcccatgggccaggactggatgcccatgccctgcctccctgcaacaggacttttatttcagtcttttgtttgccaactggacactaagttcctatttgtatcaccaaacactattattatttctattctataaaggagaaactgaggcccagagaagttagatagtctaaaataaatacctaaagaatgatgcagtgggtttctaggtacatctgagtccagctgcaaagtctaatctttactgagctagctggactcttctggtgcacactaggaagtcatcagaggctttccagctttagaaaacctattctgaccagcacaggtgatacggtttggctgtgtccccagccaaatgtcatcttgaactgtagctcctgtaattcccacatgttgtgggagggaactggtgggagataatcgaattgtgggggtagtttcccccatactgttctcgtggtagcgagtaagtctgatgagatctgatggttttataaggggaaaccccttcacttggttgtcattctctctcttgcccgctgccaatgtaaggagtacctttcaccttccgccatgattgtgaggcttccccagccacgtggaactgtgagtccattaaacctccttttctttatacattacccagtctcaggtatgtctttatcagcagcctgaaaacggactaatacaaaaggaaacttagaagggaacctcagattaggggcaagctccttggttagaagcctgatacgtgacaacagcaacttaactcaaaggaataatggtggtaaactcgaacacataacattatgcaacagtccctacctggtcctggagtagaaactccaaaaggggaaggttgtagttcatctgcaaatgtatgtgcacaggctcactacatgttttggctgatttttattgagcatctgtgatttgccagatattgttttaactttttagcttgatgtacattagctaattaaatactcaatatttcagtgagttagcctctattttcatggttttacagatgagaaaatgcacgtagagagaggttaggtaacttgcccgaggtgacacagcagaggagctggaattttagtcaccatcttaagaatgaagcaatgtttggagagaatggtgactcagagattcgtatcacagccaaatcatacagaaagcgctgttgactcaaatagggtaaacagataatgcaaatccaaagctttgggtgtgaggatcagatggggcaatgaggatggcgaaaggaatacctgaagtcatgagagatggtaagattgctgagagggtgcagatataaagggagaaaaataagaggccacacatgagatcttcagcaacatgactcattaaataagaccaagggtttcagtgttaaacggacttctgtaaatcttggctttggcactatgtcacatgggcaagtcatgtaactttctgggacaagatttccttattggcaacgtggaggcaaggatgctcaaagcaccagacccaaccaggacaaagaagagaatgagcatgcacatctctgcccacaaactcagtcttggaataagaagcacagttttgtgttattgtgaaacaacgttaattttatcctcatccccacttttccttcatggccaggaaatgtaaccccccattatgcaaaagataataattctcacctggggcctacaaaggtgaaggggatggggaggacctgcctaatcatctaccttcatcatctcccagatatataggctgcatttctgcaggccgtatgcttgagacttgaatatttcactaaaacaaggaacacacatccatttccctttggagagctctgctgctggataaactcagactttttttataagatggagtctggctctgctgcctagcctggagtgcaatggtgtgatttaggctcagtgcaagctccgcctcccgggttcaagtaattcttgtgcctcagcctcccaagtagctaagattacagcctcctaccacctagttaatttttatatttttagtagagacaggtttttaccattttgagcaggctggtctcaaactcctggccccaagtgatctgccttccttgccctcccaaagtgctgggattacaggcatgagccaccatgcatggtcaacttacagattttgatattcttaccagtgtctggacatctcttttataatgcagatgaaatcaatctctctctgtgtgtgtgtgtgtgtgtgtatgtgtgtgtgtttgtgtgtgtgtgtgtctgctcctcctctcttctctttctttttctattttcattatagctactctgtcactccccatgcagaacatccaacataatcacttcaacaaccagcttttggaaaagcaaaagcttcttacagacagaattgtctttctgccatgcttggcttcatccctccactaactctattccttttccttcttgagttcagagacaaagagggtcctatatacctacctgtttgagtgatggaagagaggaggaaaatcctaactaaatagccccagatagtttgcaaccaggtttttaaaatgcttaacatggttcctggcatattatctgtgctggatcaagggtaagggtaacttctactactactacttttatcagcaatggtgaggaaaggatcagagacctgagtccaccctcgacagtttcagtttttggtaaagaggcaagggagaggagaatgtttcaagaatgttgggttggtgaataaaaccaaaggccatgaagaggttgaagactgagaaatacattgattggattcttttttttttaagttcatcggtgagctttcagggggcagttttagttgctgtggacagaagacaagcattcatgtcttaaggaatgaggaattgaggaggaagctaagacccttaggatggggtgagcttgtaaaatgttggctgtggaggaggaagaaggtaaagacataagcctggaaggaagaactgacatgagttttagttgctgacttgatatccaagtcaagactgcagtggatcccaggacacctggaaaaagatagctgtctgggcattaggggattaggaatattagccaaagaatggtaggctctgtctaggtatttatggactgttctctctttctctctgcatgaaactaattcattctcattctcttattctctccttctctccctctctctctctctctctctctctctctctctctctccctccttctccctcccaatttgtccattttctgaatggacaaataaattttgtccatttttttttaaatggcttttttttttttttttttttttagttttttaaaggtcaccttctcttggttatttttctgaccacacaaagtttcttttccccactctgagtctgtatgataggattttcttcattttctgtgccacttcgctcagtttgcacttatgttttcatggctatattgtctaacttcccaaatatgtagttttgtaaggagagaaatgatttcttcaatttattgttggatacccaggacctagcatatagtatgagtttaataaatacatcttttaagtgcataaatgaatgcattgatgaatttgggggcatctttctatttttttaaaggaatgaataaaagaatgtggcatatttctaggcagagctcatcaatatctgaaccaacaattcctgtgtgaaacgctgaaagcagaacctctcagagtgatatcctgtgcaataattattggaactgggagtgagagacggagacttgaatgaggaaatatttatggggaaggtagcgttaaactttccaggatgtttccttggtatgctcataatggatttcaaagatccacacctcttggcggactccaggagcaggatttcatgaagctcttttgtgaaatgcttccattaggcgttggcatctttcccaaagggattcaagcatggtttctaagtgtctcagagcctaacgtggaattgggagagagaaggagggagtgaagaggaaccctcgttggaagtaataatgaagcctcctccagctttgcagagctctgccaggaagccaccctcagcaaaccagggaacctcctgacgatgagctggggtggtttctgaaccatgagtcatcttgtgcaaagtggctctggctttatcaggatgatgtgtctagacttgcagtcagctggggagcaagtaggaggatcctggggaggaggccgggaaataatgggtgagtgttagtgctggatccagatcgcttcctgcccttcaaggagttaagttcagggcatctattcacacccaatatttattcattattcacccacggaataccagacacagtgcttggttctgggaatctaatgctgaccaagacagataggaccccttctctgatggaccttaaaatacagcttgggcggcagctagaagaccttatcgcatgattgttaatccaagttctcaggtgtgctctaaggggaaaatgcgcagcagtcaatgagagcataaagcacggaaatggagttttgctagagtgcatcaaggatcattgttattttatttttatttttattttggaaggtggggccatttatggctccctgtaccagatgaaagattgcatgttcattaacatattaatgccatttgtagtttggatgagttaaactcatctaactttagtgtttacaagggatgagctactatagtcttttggatcccttcttctcctttacctcatcatcctatccaccagtaagttctaatccatctttcctactctgtccctgctgtcaccagcctggtcacggtccatcatattgacgaccgcaccagccttctgactggacaccatgctactgctcttgtttcttctcacctattctctgcacagcagccatagtgaccttggaaattcataaatctgtcatgtcagtccccttcccccttaagatgtttcagcgggatcctatttcttattttccttctccttcttctccatcttctccttcttcttcctccttcttcttccttcttccttctttcttctttttatctgagacagggtctcactctgttgcccaggctggagtgcagtggtgtgatcatagctcagtgcagcatcaacctcccaggctaaagggagcctcacacctcagcctcccaagtagctgggactgcgagcacacaccaccacacctgaccaatttctgtatgttttgtaaagatggggtttcatcatgttgtccaggctggccttgatctgctgagctcaagcaatcttcccacctcagccttccaaagtggcgggattatggacatgagccaccacacctagccaagtcccatttcacttaggaaaaaaatcagactggttaccatgcccgtgaaatgaggtccatgtcctgagcttcttgttgatgtcatttcgtgtcactcttccatcagcccctgtaccgcaggcgactctggcttcctgagagtccctggaacaatttaagattgtgtcctacccctgagtgtttgtatgggctcttccctatactgttctccgcatggccggctctttcttagccattgggctgtgcctcaatattattttctcactgggattttcccttatctactcatcttctggactgtcaatcagagcattttgattgataacagtttaatcagtaattatcttgtttgtatatacatgtctttaatatgtgtctccctctctaaggtcactgcattccagtgagaaccacctctactgttttgtatatgacattcccaatgccttacaccgttctgaacacagtgttgcttaaaccagtattgaatgaatgaaagatagaaagaaaatggtcagccctgagtaattttctcttatttttcttctcttttccttaatatcatctgcagacacatctgcagagtattttttttttttctgtgagaatccatttctacctatgatatagctggtttctgacccttgagatatgactccaaaattgggactgggtggttgagagtgctttaggagaggtaaaatttgtcattaatactattgtttatgtgtgcagtgtccttcatattttttcctttcatatagcatttgacatttgcaaaatgttttccatttatttttatgttggggaaagcaaaaagccgtacgtgttttttggtgtaagtgagcataaaagcaaggcatctgattcagggtgatattttttgtcattttctttgtgttttgatcagggaaaattagagagagagagaggaagagagaggagaaatgacaatgcgtccaactgttttccagccctcctccaccgcattcccgacccagctctcagggagaggactgagccactgtagaaaagtgggaacattaaacgacccaagaaaatgtgaaatggtgtggggtgtgagatttctttattagtcaatttaaaataaaatgtgcctcagtaatttagaatctgtctggagtcaagcagaaaattagccatattcccatatcctacccccgcccctggaggcagcagaagcaccaataaaaataaaaataacaataccttgtatttatggggtagctttctcccagacctccttctcactcaccctttttatcttttctgtgtccttgaaggggagtgagtgagtctctgaaacctgggagttcagctctctgcagatacgatcctcagcattaaaacttctccaaagtccttcatttgatcatacattcatccatgggtttattggttcatttatactatttagcagtgcttactgagtatctacactgtgcttactgtgtatactgcttatacacagtatatcttacaggtagtacaagatcctagcaggtactataagatcctagaaggtaagagctactactatatagtccctaggagctattactgtaatgtctattcacagacaatggaataatcttgttagttttttttctgaaaacaatcataactctctttaaaccatggtgttgtctttggaacattcatagtttggttcctgtgtagttttcaaggtccgtaaaggctgagtttcgggttgatgtgtctgtaggctttttcccttgggggaaaacgtcttcatagaatttgctcctctaggtaatagatcatgaatatctctctagtttgcaaaaatgattgtttaagaaaggacatggatagacggatagactccatttctcctcttaaagatttcctcattttgaggggtcttggaattatttgagtgtttaatgaaagcaaagaacttcctccccagaggaattgatatatgcacaaagataacaccattttgtaccgtcactttagggttcacactttctggtacccatccttggacactatccatggccacccaggttaaaacttcttcttttctctttctttttctttcttctttttttttttttttttttttgagtcagggcccctctgttgttctggctggagtgcagtggtggcacacacacagcagctcactgcagccttaacgtcccaggctcaagcgatgttcctgcctcagccgcaaaaagagctggaattacatgcatgagctactgcgcctgaatctagacctatttagaaagttcaagtctgaacatttagtgatgccatagagagccctcccttcctgccagcattcattaaatgatggttttcactctgcagagcagcttccctccgctttccccagatagtctccctcccacctacatatgagaaaataaaatgttttcctgcatcactatgaaaaagagccctaaatcaatagcaaatcaagctatggaataaaagagtctttatggcccgagaaggtgattgctgaaggttgccatttagcagtattgggtttgtgtctccctggggtctccagcagcccagtgtctctgatgtgaggcacctttgcctacatgaaagtcagcccctctccccctcccccagtggagtgcagggagataagaattctgaaacaggtcagctgacgttgttttttaaaaaggttttgttctgggcaaatcctagccggatgtgactggtctgctcttttggtaccaatcctagcttgacagtgatccctttccagacataagcacctacaagtctcaggatggttttgctgcaagcagggggtaccatcccaatcatttctttaccccctacccttttttgtttcgttttgttttgttttgttttttgtttttgagatggagtcttgctctgttgcccaggctggagtgcagtggcgcagtctcagttcactgcagcctcaacttcccgggtacaagagattctcctgccttagcctcccgattagctgggattgcaggcatgcaccaccacatctggttcatttttttgtattttaaatacagacggggtttcaccatgttggccagtctggtcttgaactcctgacttgaagtgatccacctccctcggcctcccaaagtgctgagatgagaggcgtgagccatcacacctgggcttcttccccttttgccatgtgatttttttttcttgcacttaaagcaagtgcagaacctcatatgatgatctatatgcacttactgtgttttacccctctcggttatgttagtgggggtatttaggaaccatgctcattttctgggtgtttaatagctgaattctgtttcatttagatactgataagggtcttgaaatttaaaaaatgtatctttaagcttgacatctcccagtggtatggccctgtattagggagatataaaaatcatgtatgagtctccctatacctctctctgtttgtgttcccgcacacacactacttctccatggctcctccatatggccagtcctcttccttcatatacagcctagttctctgaggttcccatcccctcaagtccatgaccctctggcggagtagccgtagtggacaggtgcaccctccttcactaccttcctttctctgcaactagtcaccccatctgtgtccacagtttgatgactggctaggggctaagagtgctgtgattaaaactgctaacttcccacttcttttgactgttccaaatgggggcaagaatgaattttaaaatgaactttgcctgtcaaagcttgtctaggttaagggatgagcaatggcacagtgtcgtttaccccagagcatgaactgtttggtcctggttcaagccccttccccatttcccatgatactgggcctcacaatccatatgcaggaacagcagatgccacgtattgaaatttctagtttctctgccactaaaaatgatagctctgcttgcttgcaatatatgttgcctttgaaatgcacttgcagtgatggtctttcctatgcaagggcagagaagaaattgtctcatcagtatactttgctgaaccagctgaacccctcgcctacccagcagctctgtcacccccactgaggctggctttctagtgacgatgaacaaaggtggtcttcagctttctgatactagagagagctaggatgcataggccatcagagttaacttttgtatttctttcaggtcttcttgggtttctcattgaaacaaagcaagaagaataagcttatgatacccagcatattcttcagcactccagaaactcagaacccagcagataacgtaaaaataacaatgcggctgggtgcagtggctcatgcctgcaatcctggcagtttgcgaggctgaggcagacagatcacttgagcccaggagtgtgagattagcctgggacacatagtgagacccccaactctagtaaaaatacaaaaatatatccaaggatgtggcacatgcctgtagtcccagctacttgggaggtggaggtgggaggatcatctgaaccaggaggtcgaggttgcagtgagccatgtttgcgccattatactccagtctgggtgacagagtgataccctgcatcaaaataatgataaaaaagaacaacgacttttttttttttttttttttttgagatggcgtctccctctgttgcccaggctggagtgcagtggtgcaatctcggctcactgcaacctctgcctcccaggttcaagtgtttctcctaccccagcctcctgaatagctgggattgcaggtgcctgccaccatgactggctaatttttttttttatttattttttatttttttgtagttttagcagagacagggtttcaccatgttggccaggctggtcaggaactcctgacctcaagtgatccgcccacctcagcctcccaaagtgctgggattacaggcatgagccaccacacctggccctatttttaatttttttttcaacttttattttaggtttgagtggacatctgcaggtctgttacacaggtaaactgcatgttcctgaagtttggtagacaaatgatcctgtcacccaggtggtgggcgtagtacttggtagacggtttttcaaccccggccttcccactcccctgcatctcatagtctccagtgtcttttgctcttatcctgatgtccatgtgtactcaatggttagctcccacttacaagtgagaatatgtgatatttggttttctgttcctgcattaattcacttagattaatggcttccagctgcattcacgttgctgcaatgaacatgattttgttcttttttatggctgtatagtattccatgttgtgtatggaccacattttctttatcctatctgccattgatgggtatctaggttaatttcatgtctttgctatggtgaatagagctgcagtgaacatgtgagtgcgtgtgtctttttggtagaacgatttatttttctttgggcatatacccagtcatgggattgctgggttgaatggtagttctgtttaagccctttgagaaacctccaggctgctttcgccaggggctgaactaatttacattctcaccaacagtgtaaatgccttcctcaaggagtaatgcctagttagaaccttgcagtcacacaagaggtatacaaaggtaagagctgccacttcaagatcagaggccaaatgaaaaactttctctttagcagaacactcaagatgagcagacaaacctagtcacagccaatctctaggaagtgacgcacaattgacttaggaaaacaaagcaaaaaatgctgttctcagggctaactcagaggatttacaccaaatactgcctggggtctgttagatcaacaattaagatgaaaacaaaactttaaaacaaatggaagaagtttaaaggcacactctggcatgctcttggtattatttacaaaggagttttcctttcaatgttgtttataaggaaactccaagaagcctgattttagcatctatacaggccattatcatattaattttttgcattaaccaacactcccctcttttgaattttcacctcatcttaagttccttctctatgtattttaaaacctcttttgctgtttacatctcaacttcggatctttttcacacgccggcaggaggctgtatacatttaacatattaaggccgcagtgccgagttccctgaacagacaacatagctgtttgatcgagaatggagattttccaagtttgattttctaacaattcaccctttcccttgtacttgtgataaattccagttgtgtagtttaaatggtcattgaatagatgtgccgctctactctctacagttttaacatggttgaatgatctcaaaatgaggcaatcgtttgagcagaaacccgaagaggcctgggaggcagagctgcctgagactaatcctgagttcggcagccccaggcacttgccctcagacaggctctgagtatgtttgtagcaaagtgaccctcgggtcaccatcacctttttcattcttccttatgctcggagatagtcatctgactttgcatgtgcctaaaatcagtttagtctgatgcatttcatttcaagaaggcacaaagataggaaacctgaagccatagtattttgcttctttcctggcttagagaatgcgtcaagggaaggggccttctggtctaccaattctgcccttgttctttttttctaaaacatttcctttctcacagtgggagacagtctttgaaaacccaggtttccagacatggaagagagaaaccaagtattggaaatcatttcctactgcccagtttccccaattctcctccttcatgtttttttattcagagtcaagactgctggacttcctggtgctgttttgatctggtggaagagagagttgcaatatgactgtttgcttgttaaggagttggcagtagtcataccactcaggatgcagggtaaagagtcaagtctcttggttttatctctcaataatcataaaagtacatccattgatcccccactccattcccactggtgagagacttttgcttaagaccactgtctttcatggattggtgcaagcttcctgtggctctttctttttcttttctttctttcctttttttttttttttttttccccgacagggtctcattctatcacccagctgtagtacagtggtgcaatctcagctcagtgcaacctcctcctcccaggctcaaaagatcctctcaccccagcctcctgagtagctgggattacaggtgcacaccaccgtgcccagctatatgcccccgcaggcctcccaaagtgctaggattacaggcatgagccaccaggcttatcctcctgtggctctttccttccctctctacacccgcctctaccccattctgacaactgtagccccagtgacttttccattaagtaatgtctagccacattgcttcctactgaagactccccaaaggctcccagtcggagcacctcttccttaatgtagccctttctatctgacccctactcactgtctcatctaaactccagccacatcccgtggcttgttatttgcaaaatatgccatgtttttctcatactcagacttttatgtatggtatttcctctgctagaacccttctccacctctgttctgactcaacagagattacaactcttaggggaagctatctgtgaacctcctgccccagccaggttgcctgttcttccctctctctttccttgtgcttattccggtcatagggctttcatggtctgttgatgtttcctattagcagcctccttctgctagaacatgcacatccgaaggacaaaaaatatgttttatttacctattggctggcaaccatttaaatgtaagaggtaaaagagacgcctccacctatctgtacaaccttggctgtgtctcttaattctttatggacctctttgtatgtcttcacggttgtgtctatattagacagtgcccaccctacgttaatgccctatgatttgagattatttgagaacgtcatgaattggtccccgggctgtatttgaaaactgctgaatcacactccattgtgcaatgtcagccacaacttccaccattattaccactcaatggtggtaacaattccataaatgatgacaccatgaagaaagtaagggatggctaccgtgtgatcaactcttaacagatattttctctattacattacgtggctcactttcaggatattttcttctctattgacaacttaattctttacgactgctgtctcctccaggaagaattattgaaaagtaaagtgatgtttagaaagagataagtcaaagattgtttggatatcagctgttaactttttgcttcttacttgcaaaatagaatagaaccagcagtgttcactgcagcatttgtgggttattaataatttactcaatctattgatgcttgttaattgaagtcgctgagaaaagttagttaatgatgtgcctgcttacaccacattataattatgatggtagttcccctattattagggctgagtaggtgttcccattagaaaccttaatttctgagctgattgtcttcaccattttaaattacattgggccacatcttggcagacactttctgaaagcagatacgctcctttccaaaattatttttgtggtagcacagaagttctctccctcaaatgacagaggctgttaagtgtattctactttcaggaactgttttattaagctccaaccagcaatgtcctatgtaaacttatcccaaaagaaagatggttgctgaactagaggctaccttggcaaaaatcagatctcactgggaaagtaaatttttaaaagtcactcatagaatgggagatgggccacatttttcttgccttcacttggattcagaatggttctgattacagtcaacagaaaccaaattccaacgtatttaaactttatattttttgacagtgagatttattggctcatgaaattaggactgcaaaagatatgttgtcttcaagcagggcagggtaaaggggttaaactaatgtcactaatgtctttacttgttcgtcatccttcaactccctcctgagtgctgacttcattctggagcagatcttcttcacagggctacttgtagcctctagaccagcactccccaacctttttggcattagggactggtttcatggaagacaattttttccagggatgggaaaatggagggaatgatttcaggatgatttaagtcctttacatttattgtgcactttatttctattattattacattgtaatatataatgaaataattacacaactcaccataatgtagaatcagtgggaagcctgaccttgttttcctgcaactagacagtcccatcttggggtgatggtaggaagtgacagatcatcaggcattagattctcataagccacatgcaacctagctccttcgcatgcacagttcacaagaggatttctgctcctatgagaatgtaatgctgctgccgatctgacaggaggtggtaatgtgagctatggggaatggctgtaaatatagatgaagctttgcttgctcacctgctgcttacctcctgctgtgtggcctggtttctaacagaccatggactggtactaggccatcgcctgaggtttatggacccctgctctagagtatattgttgacagtccctgtattgaagcaaagcaaaaccttctcacacatgggttccatatataaaacaaaagaaggtgtcaattctgtttggatcacatcctcacccctgagctgattcttggagttagaaggagagtgaattttgatttccagtctataccatgcgtccatagcggtagcacaagtaggctgtgcatagctttagtaaacccacccatggaaagtattctatcagtggaaagagagatgttgctaccagaaaaactacagaagggataatggacaaaaattaaattataaatttactactccatggttgcatccagtacctaatcccaacccttggctgacccgatagccaaagaaattgccatcaattgttaatggttatcatagttcaaaactccattaaagattttatttcaactaggatctttaaaaattgtggccttatggtctggtgctaccaaagagttagctgtgcaatcttgataaagataggcagttaggttcactggatttcatttgcatcattgatagtggcttctctgtggtgtctgtcttattggaaagatgtgagtctggtatgcgcagatgtcagtgaaaaggaatttattttgctttggaaatgcagcatgggcaaaataagttgtgtcctggttatcttgactcctggaaaaatagtttagaattgttcctaatggggtccaggtacgatattttatgtctaagcatggtggaccattttccctccctagaagagacaatggaaggtgggtggcaccgagtcttgcatgaaggcacttaatcatttgcaagactcaagtggacataaaaatgcaacagagatgttttctgagaacaaacaaaatctaggcaaggagggaaccaaggagtggccattgctggtgcataaaacctatttattcttatgaaagagagtgtgttcatttgtgattctaatatatttttttgtttgtcatttggttaattatgtagaaccatggcatggtctaatattttgtacaaaacttgtctcttaatgttataatctggctggagagaaaaattaaagcagctgaatatcctcctttcctcctgttatgaatccgtctgtgtcactggtggacataatcattttttttttaaattctgcaataactcaactttgagtctggtaatgtctctatcaaatgcatacctggaggcatgggtcagaatctcctgaactttttcatgtttattgatttatttcatttgataaacatgatctgatttactctgtggccaaactataaatgcaaccttttattttagtctttccttcctgtcccaccttccaggaaaaatttggtttagggagggaggacatgtattggattgaaaggacatctgttggccgggcaaggtggctcacgtctgtaatcccagcactttgggaggctgcggcaagtgaatcacaaggtcaagagatcgagaccatcctggccaaatagtgaaaccccatctctactgaaaaaacaaaaattagccaggcatggtgatggtggtggggggaggggggcgcctataattccagctacttgggaggctgaggcaggagaatcgctggaaccctgaagtcggaggttgcattgaactctagcctggtgacagtgagacagtgtctcaaaaaaaaaaaaaataaggaaagaaagaaaggaaaggacatgtgttttattgttctgcttgttttcagttatcatgagggggaaaagtaccatgaggaagatgccctcaaacaggctatcagatgtttttgttcttgataccaggcaggaaagagatagaggtaaattgttctagttaggcattaaacctggttttaaaaaaaacccttttaaatgacgagaatggagataaagagaaaaagcattctgttgacatctgtgtggatttgattctcaatttatccatcatcattatcatagttgtttttgttactagtatttagcaacagatttgcttaaataatgggctagaacttacaggggaatattagcaggtagaaaagcactcaagattgtttttgcacatcatagttcatcatccaaaagttatttgttgagcacctatgatgtgccaagtgttgtgagactaagaaataaccaggatcatgttactgccttggaggatcttcattcagtcggaggaagacatggcagagatacttagttacaagctctagtgctgtaaaagagacaagtgaaagatacagaggaaagggaatcactcatccatctctgcctgggagattagaaaaactaccactgaagagtgtgacacacatttcatgtgaatgtgggaggaagtttgaaagatatggtcccatcacagaaggacaatagatctttcctaagatttacctgacaagaggtcatttgcttgaatctgctcagtgacaggaccttcctacaaggcagccatttttgcaggccttgagttgttagatagtcttcctcttgttaaaactatttatatttaaacttgaaggcatttagaagatactgaaaatagtgggcagttgtaagaaaatgtgattggagaggcataaaacttagtttgggaaatggctagaccctcttcctttgtgtgtgtgtgtgtgtgtgtgtgtgtgtgtgtgtgtgtgtgtgtgtgaatatttgcatgtaccacatgttgtatacatggagcatcagtgagtatgggatacatattttaccaaatgctttatgagtattatttaatgttttcaacaactgtatgaagtttgaagtttgtattgttatgaaacccacttcataggtaaggaaactaggattacagagttttataactttgcataatgagtgagagaatagggatgttaacttttctttaaataactgtatcctcagaataatattttgacttgaattaggtagattctgtacagtataaattgctattgagctggaatattttgtgtggcggagggcatcttatgtgtgtgtgtttcttcaaggtatcaatgcaaactctccaaagcctcttgtttcagaaagataaacaactgttatcagcctacagatttttgaagaggctgagtactaccacaagatttattttaaaatcaagctgaaacaaagtttttagctttttaaaaaaattaattttgagagagtgaacttcatatcatcacctttagagttccagaatagcaagtcttgagaaaggaatcgagagttggaggattggccaggtacagtggctacttgtgatcctggcactttgggaggtcgagttcagtgggtcacttaagccaggagttcaaaaccagcctgggatacatggaaaaactccatatctacataaaatgataataatagaaaatagcaaggcatggtggtatgcacttgtagtctcagctccttgggaggctaaaatgggaggattgcttgagctcgggagttgtaggttgccatgactggagattgcaccactgccctccagcttgggtaacagggtgagcacttgtctgaaaaaaaaaaaagagtagtggaataagagaaataccaatattcccaggaattgggccatggaagagctatcagccacttgccttcctcccttctcctcccaccaaaaaaaaaaaaaaatatatatatatatatatatatatatacacacacacacacacacacacacacatatatatacagacacatatataatcattcagctattctaatatttgtatatgtaaatgtgctctatataatacctatatatgtgatgaaccatatgtagtggtcataaaattggatataaattttatgtctctataactggacattaaatctcattcctataccccattaaaaactgatctatttttccaggagccaaaataactatgtaatatacagatatgttttatatatatatctacacacacactcacacatacacacacgcacacaggtatataggtatacatgtagatagagtttcaccatgttgctcagggtggtctcaaactcctgggcttaagcaatctgcccactttggccttcaaggtgctgggatcacaagtgtgaccactgtgcctggccgatccctcaactcttgattcctttctcaagacttgctactctggaagtccatatatatatatacacacacatatatatgtatacatatgtatgtgtacatgtacatgtacatatacatgtagatataggtagtgtattatacatatatagacttgcagcatatgtatatacatatctgtacatatacatgcacatatacatatgcgtgtacatatatgcacacatacatgtacatatatgtgtgcgtatagttgtacatacacatgtagatatgcatatatgtgtacatatacatgcacatatacaggtagatacacatctatgtgtgcatatacatgtacacatgcatgtagatatatatgtgtacatatgcatgtagatatacatatgtgtacatatgtatgcacatttgcatgcagatatacatatatgtgtacatatatatgtatatacatatgctggaagtctatgtataatacactacatttaatttttaatagttttagtagttctatagtattcccttctatgagtgagacatttaatggattccttattgatgcatgttaaatggcttgagttttgttgcttttctacttcaaacactgcatctgtgtatacttctatctctctgtacttgtacatgcacaattataggataatttcttatttaatggctagatcgatttacttttcatagatattgctaatatttgccctccaagaaagttttatccgtttacattcctataatatatgtgataacctgttctctttacagcaaaaagtgcctttaaaaaaacacttcccttataacaaacatacatcctctgctgtcagattgtgaaaggctgaaggaaatttacaaggagctctcctgtttttcccctattatacttgattatgctactaaatattcagccacttccatgctattgagtgtgggagaaagcaatcgtattctcattggcacaggataagggaagcaaactcacctgagcatcgtttcagccttagaattgcaggctggaaagcctctccttgtgtgtgtgcattggctggcagctgcctgccatgaatgctacccaggctctcaaaatgggaagaagaccatatgcttgattactaaatgaattcacaggacaaactatcacagaaaacatgtgtaatatgagataccatttcaatttggcaataaatgtatggtaaatggaaggttgcagcccatgtaaaatgcacttaggatctagtgttgccatggagtcaaaggaaatgttatggcagcagataggtgcaattctgccctggaatttggcactctgggattcgttgggggcctgtggaactattcagaatccagtgaacaccaaccatggggctttgcatagcttaagtccaggcacgtgaaaatatccgaatagggtctgggagctctgaatttcaaatatcattggttatttgatctaaactggattaaggtggtggaaatgacagtatctctacacgccatagccactctacatgcagtcccacgcatcacctcattttgtggtcactgcagctcttcactgggcaagtggaaacagcttcacaaaaatcagactctaggcaagaaattggatttacatgttttccctttggttttaaagaaaatgtagataaaaatctgatagtctacttcagggaggacaaatatatttcagcttctctgttcactttgacccattggtagagacttccgaggagctgtgtttgctttttcttaattaagcatttaatgttgagatgattttagatttgtagattgacaaaaagctgtaagaaataatacagaaaaattctatgtagcttttactcaggtttatccaatagtaacatcttgaaaaactacagggttggctgggcgcggtagctcaagcctgtaattccagcattttgggaggacaaggtgggcggatcacaaggtcaggagttcgagaacagcctggccaacatggtgaaaccctgtctctataaaaatacaaaaattagccgagcgtgccggtgggctcctgtaatcccagctacttaggaggctgaggcaggagaatcacttgaaactggaaggcggaggttgcagtgagctgagatcacatcactgcactctaccctggtcaacaagagtgaactctgtctcaaaagaaaaagaaaaactacagggttagggttatcacaaccagtgattgatcttactgatgtagaaagatatactggtcttatacagacattgataccacctactgatgcaatctcctgacctttttcagatttccctagttaaatttgtactcctgtgggatgtatgtttgtctgtgtgatgtgtgtgtgtttactgtgtgtatctatgtctgtgtggtgtgtgtttgtgtggtgtgtatgtgcctgtgtcctgtgaccatgtgtttgtatgatgtgtctgcatgtgtgtgttttgtggtgtgtctatggtgcgtgcacgcacgtatgtgtgtatggtgtgtctgtgtgtttgtgtggtgcatatgtgtgcatgcatctgtttggtgtgtgttgtttctgggtggtgtgtgcatgtctgtgagtagtgtgtgtgtctgcatgcatatgcgtttgtgtggtgtttgtgtctctagtgtcagcacttgtttgtatggtatgtgtgtgtgcatgtgtgtgtatggtttctgtggtgtgtctttgcacacgtgtgtgtaattatttgtattacaaacatttatcacttgtgtagtttcatgtggccaccaacacagtgaagatatacaacagttccatcaccacaaggatccctcagattccccccatttctctcacccctacccccgtccctacctgctggcaaccactaacctgttcttcacttctgaagttctatcatatcaagaatattatataaatggtatcatacaggatgtaacctttggagactggcttctttttctctgcatactgccctggagattgtttcaagttgttgcatgtgctaatagttgattgtcttagattgctgagtagtattctatggtgtcaatctaccacccaagaatcttttttcagtagacaccctgaggctgagcaggagagggtgccattgtcactgcgtcatgcctatcccagagacagggattgagaggggtggcaagcccctggtgaacctgcttggcttacatgtatgtgctgatatttgaaagagaatcagaaacgggacaggattagcatctatgtcactctagagatcagtatccaggattcagaagggtcatgagggctgtcactaaggggactagtgataggctggaaatcacgctccatgcgctaggactatagcttccatggcagaaggcaggatttgaacatgagtccccagccactttttcagtgatctctctactccgctatagcttcagtcatctcccgcttatcgtgtgtgtttgtgctggttctggagagcgcacaatttgcagaaggcagttttgtttggatctgccaagtacaaatgtggctggctagtctgttggatagcctgacaagacccagaaatttctgtctttcctccctcccatcaaataactgggctcctccaagagccaacgcatacatcccacctgtaccaacagaatgttgtagtttgcatacttggaatggaaaaataatatttggcttggctttgatcatatatactaattattgctaatataggcaccagatgattgcattttattatacctttgtttttcactaaatatcagaattccttccttgaggggggagttgtcatactacttaattgttttgtgttttcttgacatatctaagcattatctgtgcaactgtgtcagtgtgcctgttgctgtaaatattcaagggactcataacagtattagaactaatttcttaccacaacagaatattatccctttcataattttcaattgtttcaaaggaattctgaggattcttggtttccaaacttcatatgacttttgactttttttttttttaataaagtacagcaaagagttttatgactatgtgctttagaggccagatggcattgttttcttcctgtctttggcaggtttcaggcaagttgcattagtcttctggactttgactgcctagtgtgtaaaatggcaatgaaaaagtaaacgaataaaccagactttgtttcttcttctcttctgtacttttcatcttcttcctcctcccttttccttccttctttcgtaaggttgcacaaaataatgtacattaaatgtgtaacgtgcagcatgaactacattttatacatatagataaaaactgttatacatatttttttatttgtgtcattaacttgttcttgttgattcaatgaagattacctgcagttagctgaaaagtcgtaatacaaacaattattttatggctttcttttttcagtatgatttacactgtccagttatgtctttttgaggcataatcttcatcttagttttcctggggggtttttctgtaactcctgtgctacattttcaggcagtttcttaacataggtacctatgtctattcctcctcctcctccgcctcccccttttttctccctcctccgtctccccctttcttctccctcctccctcctccctcctccttcctcctcctcctcctcctccttctttttcttcgttcaatcttggaagctttccaattcaactctaacttcttcagcccgtcttttacttatgtgtagctaataccacatttatatcagcgacaaaccttcaatggttaggaaaaagaagctaaccctttattttctctttagatgtgttggtccatttgttgtcagtgttttggttcaggttgttcccagctacccagatgactacctttcatcatatttgcagagtgtatttagtgtttacatcaagaccaacctctgggattacaaaataattttataccactttctatctctgggtgattggaagtggctatctgcagcaggactatgtggatgatgatgaggtcataggcaggttcgtggagaaagagtgctatgattgattaatgatgtctgctgtgaccatgagataggggaatgcagtatgtgtaaggaatatttgctaaccgttttaaatgaatgttctttatgcttttagcattgctttaaaatggataacaaaattcatcatatatttgctaaatacacattatacctaagtgtataaataacatttatacctaagtgtgaggcacttgaaaaactcttctagtcattattgcctgtaattctttcttcactcttaggggttaggaatcatttttaattcctattttacagattcagaaagagaggtacatgtcagtgaagtcctttgctaaggctgtgtacctactaagaatcagatttaatgtttgaatctcggctaagtaatcccagggagctttctatggaggtaaggaagaggatcaggttcacaaatgcagaaataagtgagtttttctagtgagggtttctgtccttcatttgagcagcttcctttatgactcatctttctagaatcttgcaagaatacaaaccaacatttatagaggtgatttcagcacaagcactggatgtttagaagtttctagtcagtcctaaagtgagaagacagaacacgttcaattgatttccatttgcagtgcccagaatgagaaaggtgatgtttattctccctggtaaacacactcaaaggttttggggttacccaagttgagctttccaggcaatgaaccactaaaaacatatttgttcccagaacacagccagctagtaaggttttcccactggggctgacatttactgtaacaagagcctgtttccttctctcagagctgcagccagctcctcacaagggagttggtgtcttgccagagaaacccctctaagctccaagagacgtgccagggaagccagtgcttttccctttagctgaatgtgccaataatggcagaatgatgtctgctttttaaagtgacaagttaaaatattatctacaatttatctgtccactcatccatcatctacttatatttcctctctctccatatgtatatatatgtatacacacatacatgcacacatatgtatgtatatatctatttggcgaaatgaatatatttgctcatttaatatcacagtaattctataaatataatttagcaaattttatgatgctccattgtgcaggttctaaaaatgataaaagaatctagacttctgggcgcagtaactcacgcctgtaaccccagcactttgagaggttgagggggatagatcacctgaggtcaggagtttgagaccagcctggccaacatggtgaaaccctgtctctactaaaaaaaaaaaaaaaaaaacattgccaggtacgcgcctgtaatcccagctactggggaggctgaggcaggagaatggcttgaacctgggagacagaggttgcagtgagctgagattgcgccactgcactccaccctgggtaacagagtgagaccgtagctcaaaaaaaaataatccagatttcatgatttctagataaatacaaggcaaattgaaaacagctctcctcctcctcctctttctccttcttcctcatcttttgttgttaaagaattatagacttcaaagctggagaagcagtgtggggtattccctggtcctccttccaaatgcatgttgaaatgaagacatgtgggttttcttcccgttttggccatcacctgacctaatgaccttgggccagtcacctggcatctccacgatcctgttacattgcatataaatgcagacttctttgtatgatgtctaaggtcacagagcaggtattatgcccatcttgtttatctgccaagcacagtagggcacccataaataattcctaagttactgaatgcatctgcagctcaacacttttgacatttttttttctcattttaatattggccaactgagatttgaaaaggttttgacttgcctgagttaaagcagggggagtctactggccaatttcttttgactattacgttgtttgatttggacgaaggggcagggggttgtataaacgtcactgtggagagcccttgtcccctggtgatgagtaaccttatcaatccagagcaaagaggcatgtgaggagattttgctttggaaaatggcacacagttgaggaaatttcatcaatgtgtatgaagcggctggtctggtgacgttttgctttgcaagtgggtgactgacatccttcaccctctgatctgcccattctctcctttggtccttctgttcccgttagcactccctttaacatcagtctctctccctcttcttccacctagaatctcaataagctctttcatcatctcagtttctacagagcagaataagctgaggacttttttttcaagttttatttatgtgtttttctgtttttttaatttaaaaatttaatttttttagacagtcttgctctgtcacccatgctggagtgcagtggtgcaatctcatctcactgcaacctctgcctcgtgggttcaagcgaatctcccacctcagtctttcaagtagctgggactgtaggcgcatgccaccacacccagctaatttttgtattgtttttggtagagatgaagttttaccatgttggccaggctggtatcgaactcctgacctcaaatgatccatccacttcagcctcccaaagtactgggattacaggtgtgagccaccgcacacagcctgttttttctaattttaatttcagcaggtttttggagaacaggaggtgtttggttacacgaataagttctttagtggtgatttctgagattttggtgcactcttcactaaagcagtgtacactgtacccagtgtgtagtcttttctccctcaccccctcccaccctttacccagagtccccagaatccactgtatcattcttacgtctttgcgtcctcatagcttagcccccacatatgagtgagaacatatgatgtttgcttttccattcctgagttacttcacctagaataatggttttcagctccatccaggttgctgcaaatgccattattttgttcctttttatggctgaatagtattccatggtctgtatataccacattttcttgatccactcattggctaatgggcatttgggctggttccatatttttgcaattacaaatagtgctgctataaacatacgtctacaagtgtcttttttgtatagtgatttcttttcctctgggtgaatagccagtagtgggattgctggcagaaatgatatgtgtcttttgcaaaaatccaaaccagaaaagagtaaaatttatatactatgtgtgaaaagccccctctaaatcctcttgtctagagaaaaccacttttaataacgtgtaatttcttttctgtgtatacacacacacaaatacaaacacacacaatgacatttcaaaatcgtgtgcacatcacatttctattcagttttcccctacctcatggctgtatagaagtctgttgttaaggtggtattataatttaatcaaaaatccaccttctgatcaactaagttgttctcaaccttttgcttttaaaaacattgctgttgtacttctttgtagacattgtcaggtaactgcaggagaggcaataaattttaaatggataagagaatgaattgtttgcttcttgaattaatgctttgaatcatcaactggaataggatatggagttggcagcgtgtatcacagtaacctctccctgaatttggagccctataaaacaagttgtgataatttcagtcatttcagaaaagcttctgggtcataaaggagagctactattccaaattcccacctttgtctttggtagccaaggatgcaatcctgtcagtagtcatccattttcgcaggtatctgctgggtccctacttgtgttgaatatcatgtcaaaaactgagcaggaagggattagcaagacagtctctatctctgccacaggtgtgacatgcagtcgtgaggttgtgcattgctccaagatgcctaagcaagggggcagagagggtgacacaccttgctcacaagccatgcaccctggaatgggctgtgcccacccagggtgaaaaaatggacttaatggctactagaggcccagatcataactcttctgtaataataataataataataatgataataatcattattattattattattttaccatttgagatggagtttcgctcttgttccccaggctggagtgcaatggcatgatctcggctcaccgcaccctccacctcctggaatcaagccattcacctgcctcagcctcctgagtagctgggattacgggcatgcaccaccacgcccggctaattttgtatttttagtagagatgaagtttctccacgttggtcaggctggtctcaaactcccgatctcaggtgatctgcctgcctcagccttccaaagtgttgggattacaagtgagagccactgtgcctagctcctctcctggaatgattagatttaactttgttctccaattcttagacctgtgactctgaatagggtggggatgttcatcttgatttgccttctgctagaccaggaatgaagagatggatgatattactccttttgatgtttttattcttgaatagatatgttggattctctgtctcttgccccctgcaccccaccgcatgcacatacacacacacacacacacacacacacacacacatacatacatacaccccagatttcctttgaaggagtgcatagtctatttttgttgttgttgttgttgaggtggaatctcattctgttgcccaggttggagtgcagtggattgatctcagcccactgtaacttctgcctccgggattcaagtgattctcctgcttcagccttccgagtagatgggattacaggtgcatgccagcacacccagctaatttttgtattgtcagtggagatggggttttgccatgtaggccaggctggtctcgaattcctatcctcaagtgatccacccttgtcggacttcccaagtgctgggattataggcgtgaaccaccgcacccggccggagtgggtagtctttattcaagaaaattcccaaatcagcaaatagcttgtgagcttacaggtgaggttctgagggagtgggttgtaaggaaagatagaaaactatagaggagtccatgaataaatgtgattcagaggggagggggaatatgaaagagaagaacagggtgggtaggaagatcagaggttggagaagaaggaacaggatggcctcaaagaagcctagagctgaggtggccagagcatggttaaggacagcctcgtcatcggttatgggctgtgtgccttgttgttgtcatggactggccctccttcgacacccctgagcagtctggtgaggaaggggtgagtgtaaaccatctttgccccagtctgctgtcagccgatgcactaggatgactctaaccggcatgtcaaggcagacttcagcagcatccttggatgagtgcgcactgggtggatacaggacagacagccaaaggagtgctgctccaacccatgcggcatctctcccaggttgtgaaacaactcgggggtggtgcaggatccacgctggggactgcacagacacagccaccagtagccttgctctcatttgagtttttctttctttactgatgacatcagagagaaagccccagattgctgcattggtgttctttttttttttttttttttttttttttttttttttgacagtttctttctgtcgcccaggttggagtgcagtggtgtgatctcagctcgctgcaacctccgtcccctgggttcaagcgattctcctgcctcagcctcctgagtagctgagactacaggtgcctgtcatcatacgtggctaatttttgtgtttttagtagagaagggatttctccgtgttggccaggctggtctcaaactcctgaccttaagtgatctgccagcttctgcctaccaaagtgctgggattacaggtgtgagccaccacacctggctgaaaataggatttttacggatgtcactcattaaggatctctaggtgaaatcatcctggacttagagtggaccctaagtccagtggctggtgtttcaataagagaaatggagggagatttgaaaacacagagactcagaggagaaggccacgtgaagaccaaactagagctaagagtgatgcagccacaagccaaggatgccaggaccaccagaaactggaaggaacaagaaagaccctcccatgcagtctttggagggagtgcgaccccgccagtaccttgctttaggatttctggcctccagaactgacagagaatacatttcttttgtttcaagccacagtttttgataagttgttactgcagccctaggaaactaattcactagagggctgcaaactaaggcctgagagccaaatccagcctgacacctgtttttgtagattttattgacagaaacacagccttattcatttacgtattgtctatggctgctttcactctgcaagggcagagttgaataactgcgacaaaaaccatctggcctgcaaagcctaaaatatttactatctggccctctgcgaaaaaagtgtgccaaccgctcttctagggaggtgtttaatttatgtgcttgtctggggatgctgcggggtaggggatgtttgtagtgagagtctgtctttaacagcgcagaaccacacaaggtaaggattttttttaaacttacatttcaatttttatgaagcaggttttttcctccttagaggaaaaacatgaaatgttccagaatagttgacagcattagctacatttaaaagattcaaggaagcaaaatggttttccgtctgttgaatcagtcagcattaaagttcacttatcaatgatggcttttctatgagcagcagctttgtattaaaatggctaatgggaatgtggttcccctagcaagctttggtttgatctagaatttttggagagtctgagtgggttttcttcttctcagcatgaaatggaccaaggtctgttttgcagctgagacataaaggaagtgaaaccttgtctgatatgtgctagggtgcagagccaggtaggaaatgggaaagagtgtacctcaaacctcaacagccacattgtccaccaattctcattgcatgtgaattcgtgaacctcattggcgagctcaaagaggtggctataggaaacctaattataagcatcatttggctcatactggtacagaaaaccttcaattaagttgcagaaaaatggccacacacagaagaaagaagttagaagggtttttctggtattcttggtttacatctcagtggaagcaatttttatgtcttctgcatatttcactgagaagcctccaccacttctagccataacttcctttccttcctgttacaaattttcttcctagatttactcttcagtccctaaaaatatccataacacattatttattcactccataatgtacaccatccaaatacaacaattttgccaataaactgttattctaatgaataattcatgcagtcttcattctcctgacatgaacaaatatactttcaaataggaggagtgtgcctctatttttgtcttaactccatttcttaatgtcatatatatttttaaaggtttgtgatgtccttccttggatgaactccatggggaataattctgatactctaattaagagcaataaactatagcacagaaatataactagatttatagacagtgtttgttacagtgacagtgtagtttgcatgtggagggaggaagtaggcaaatcattcagtgtctcagggcaggaaaaatgtgaagttctcacctattaagaaggcaacaccaataattgtttcaaattttgacaatattcatggccatagtttcctcatatttatatgaacaggatgtgatgataatggtgacgatgaaaatcataataacatattattatgtgatgtaatgctaagaattttgagtttctatgagatactagccatttactaaaagctttgcatatatcagggtttctgaatctcagcactatgggtatattgggtcagataattacttgttatgggccaggggttgggggatccactgtgcatttgcacgatgtttaacggaatccctgacctagggtatctgctagattcagtagcacctgcctcttcaagttgtcacactgagaaatgtctatagacatggcctaatgtccccaggagggtaaaatccccttgtagaaaaacagtgatgtacatgattaattgcatcttcaacacattcctaccaggtaggtgcattatcagtcccatttaccagtgaagaaacagaaattcagagtgaatgacagaaccaaattttggtgcagggtttactactacaccaatgtcaagactattttgttgcatatgatgatacagagcattaattcatctgccttctcctcttacatgggtattttcacattttaaaaatgtataattgcagggtgcagtggctcatgcctgtaatccctgcactttggcagggccaaagcaggctgatcgcttgagtccaggagttcaagacctgccctggcaacgtggcaagaccctatctctacaaaaaaaataaaaaaaatagctgggcatggtgacacacgcctgtggtcccagctacttgggaggatcaggtaggaggatcacttgagcctggggaggcagaggttgcagtgaaccaagattgtgccaatgcactctagcctaggtgatagaggaagaccctgtctcaaaataaataaataaataaataagtatttggtgtatgcatgctgggtaattaatatatcttatgttttgcacagacagaacttcaaatttccaaaaccccttttatagaaactgtagcatgatgaccagattaatactttttaaaacaatagcaataataacagtaacaatttatcctcctgctcctcaccactgttaattgagcactctgtttttagagatggtgtcttgctctgtctttcagactggagtgcagtggagcagtcacagctcactgccgcttgaactcctgggtgcaagtgatactctcacctcagcctcctgagtagctgagactacaggcacaggtcaccacacccagctaattaaaattcttttttttttccaagatagagtcttggcgtgttgcccatattggtctcaaattcctcagctcaagtatgagtagatgggattgcaagtgcgagccaccacttctggctaatttagcactttccatgtgagaaactaaaggatttgactggatcacctgtttaattctcacatcttagaggtacccactttgggtatcttttagccctaagctgtataattcagagttgttttgttttctttgggtttggtttctgctgtatcctcacatacagtgaagtttccatacaccttggttgaatgaatgtcttcatgagcagctacagtcttagggaaaacatgtagcttattaaggtggtgacagagcttccacttaaatccaggagatcccttgcccttaaatcctctgctgtctgctctgcgcagttgagggtttcatcaaaacgtccagctctgctctcagccatctggttgggtctgtcttttatgactttatttgtatatcaggtttccttttgcaggtgatcctaaaacacacactctcccgtcttgctccagtctgctcaccctctgcctctcacctgcgatgtctccttcatttccatttgtctgaatcttatttcttgttggaggtccagctccatcccagctttcttcccaaaccctctccctatgtcttgggcactctcaaggccttacttgccaccattgccagtcggcaattggcgaggagctgcacaaatcacaggcacccagtactaactcccaggtctaaccctccatgaactatgctcttaggaaagcagcttaaagtccttgaaaccccaatttcctcatccctatgatgaggactgcagtgtcattgtacatcccaatttgctgtgagggttcagtgggaaaatgcttagctgagcacttgacacatagtattttcttgatgaattcctgccaccgctaatgtcactttatccctgttttgtatgttccctggttgctttatgtatgtgtgcttttgaactagattgcaggattatagaaagagatttctttcagtgtgaatccttaatgtgacacaaaattcagcacaaggggtaaaactgtggccaagaggccgcctcagtgtttagaatgtaattttctctctttatgttctgaaccgtggtgtctttatcaatgacatggaaggggccatttccatttacttcaccatgccagaagggccattgcaaatggatttagttatagggtaagcaatgagcttgtgttttctgaacagctaagcctcagaactgtaataactcattatcaatctgtctccatacttcatcaaagttcccaggtgctttgaattttggcttggccattgtctttttttagctataaaattttgcttatcgcatagtttaaagtgggatgatgactgagacacatctctgcttatgagtaccacttaagagaggatatatcctcaggtagaacaatttccagagaggagatgtgggcacggggtctgtgcctgccctggaagctgtgtagtatagtaggaagaatcctacattcacagagaggctgatttttgcttccagttttgtcacaattcacatgatattgggcaatttagaaaaaaatattgatttgctttaacgttctcatctgtaaaatgaaacatcccaattagataagttataaatgacctttcatttttagaattctgcatcctggaattaaagtgcattggaatgagccaataattccatattttcttatattacctaaaatccacatactcttcaataaatttaccaccatagggttttcaaaccccatcaaaaaaaccacttctttcatgtaaatgcccagcagtttatctctttttactcctcagtaccctacacatcttcctaataaagtatataataaaagtaaatcttcccactagtgtgtttatagtgtgaaacacattgttattcccaccatggcagtggtggataaaatatacatatttctctgtctcccacaaccaccctttgatccccagccttttatcagcaaatccaaagtgctaccttctgcaaattagcactacctcctgagaaattgtgccaagttccattaaatgtaattagcattcctgttgtttccttcatattggagaaaaaaaaaagaaaactctctcttacttactgggaacacacatcatgccaagttgtagcaacagaggcagcacaaggctgaaagcaggaggcagagggggatcttgacacacaatgatgagttcacctacatgggggctcaggtggcagacacagaggtgtcagtcttggcttttaaaagtaaaagttggcttcccaatgtagagttaaacagatggcagagtgccttctgaagtgagggtttagagaacatggggagatggttatctgcctcaatttgaaactgacctgccatgagattcccaaggaagagacttgaatatcctagagcagttaactacaaaactaaaatttgccccctcagtatggttttcgtgtaaaagaattgcaaaacaaagaaaaactaccacgtgtgtattttccctagaatttcctggtagaaataagatattagtacccaacaagtagaaaagaatatgagttcagaagaaagactagggtttagtatcagacatactttttgattattcatatttcataaaatcttattttcttgacttataacaaaaatcatacaactgttttattattaacgtaaaattaaagaaaaacatcactacttttctcctcccccttttatttcaaattacgccactgactacgaaaacctggtcaaatccaacgtgcatttagaaaccataatttgaagaaactaatagctggagctcagtgccaccatccacaacagatgtccttccaaactccattcactgtcatgctataaaacagaattcagaaacaacagggtatacgtatatatctgtgcattcagtgactctgaaagggaggcactggtttcgaatgttttgtgtgaacacgagttccatttgacacttttttttttctctcagaagtcattttgtctcattccttgcttacttcattgtatttcagcatttgtcatctcaattacagtagtgcatactacttttacacttcaactgcaatattcagaaacaccagggaaagagcagtaaagatattaggaggtggtaattaagactgagaatggctccagaagggtggaaacacatttaggatgttttttattttaatcatctgtaaagaaactaattccataggcccatctacagttaagttccacttgcagcacaaagcatcataaattgaatagtaatattctttatcccaatgtcatacaactgttgtcctataatactgtgacgttgaatcataagacacacgttaaataacctattatgctcagtggtttctctgacagttgaggatgagaccaaaacgtatcccaccctgggtgacgcagagaaacgaaatgaaagacaaaccatttggtcttccaagaaagagttcagtcaatcacagtgaactggttggagtatattcattaaacaaatatttattgagcatctgctttgtgttaaatgctgaatggtgatttaagctctagatttgcctttcctggacaggttgtagaaataaatccacacaatgtgtgatctgcatctggattatttaatttagcagaaagtttatccatgataaacttttttttttcgtgaacatgaggatgaacatgaggttcatccatgtggatgcatgtatcactactttgtttctttattattgagtaatattccatggtatggatggaccacattttgtttatccatttacccatttattgatggatacgtggattgtttccagattttaactattatgtagaatgttactatgaacacttgtttccaagttcttgggtggatatatgctttcacctttcttgggtagatatttaggagtggaattgctgggttgtatggtaagtttaagtttgagcttaagaaaccactaaactggctgggcgcagtggctcacacctgcaatcccagccctttgggaggcagaggcaggccaatcacttgaggtcaggagtttgagattaacctggtgtaggtggtgaaaccccatctctactaaaaatacaaaattagccaggcgtggtggtgggtacctgtaatcccagctactcgggagtctgaggcaggagaatcacttgaacgcgagaggcggagattgcagtgagccaagattgcgccattgcactccagactgggagacaaagcgagactcagtctcaaaacaaacagacaaacaaaacaaacaaaccattaaagtatttttccaaagcggttgcgttattcaatatccccaccagcaacatacaagcatccaggttgtgccacatccttgacaactatttgtattacttatctatctttcaaattactgccattctagtgggtatgtggtgatatctcatcatcatggctttaatttgcattttcctgatgtctaatgatgttgagcatcttttcaggtgcatgatctttatgtttgtttattttttatttttaattctggggtacatgtgcaggatgtgcacgtttgttacataggtaaatgtatgtcttggtggtttgctgcacctatcaacccatcacctcggtattaagcccagcatgcattagctctttttcctaatactcttcctcctatccaccccagcccccaataggccccagtgtgtgttgttcctctccctgtgcccatgtattttcatttttcagctcccacttataagtgagaacaaagtgcatgatctttcaatgaaataaccttcttcgcctgtgaaatgggtctcagtgaatcttgaggaatcttacattactacctataatttcctttcccttataagtcagcaaaggcatgggcaggggcctgaagtgggagaaagagctcctccccctttaacgtggattcagaaatgtgtgacagggagctgagactttcgctgcctggtcatactcattgagcctatgggctggttgtgtgaacatgccacaggtaggcacatagggctcataggcaaaggatcccatttgtgcataaggcacactttgaaaggtagggtttggatccattatctcaccccaacagctgtgtgcctccagtgtgcagcttgaaagccacgtgttaccctgtcagttcaagcttcccgaggttacctcttccagccacgcagtagttggtattatttctttcatttttttgataaaatgtcttcctctctccttctcagagtaaagcaagtctctgcacatgtttctcagctgggttgcagtaatctaggaaaaggtcactctttagaggagttgaaaggactccaggttcttatattagccctctgagcatataaaggcccaaagaaacagacaccaattcctctgctgcacagacttttaaacctggaaagctgtaaatgcagaaacttaagtatctgggaggtgcgtgcttagcagccatccgatgtgagtgtcagttcattttgacatgtaaccaagatggacctcagccaatagcagtctccactcacagaccgctggtgtggttaggagcatgtacttttaatcaaattttttttattggaatcccggtgctacatgctaggtgtgtgattttggacaggctccttaactgtgttagctttggttaatgaaactgtaaaatgagattaataataattcttggttcttaaaatcatggataggattacatgagataatgcatgtaagtgcttagcaccattttgcatttctttagcttttatcgtttttatgttatatttgattttacatctttggcactgggaagaatgcctggcatatagagtgtactttgtgactataatttgaccacacacagttaagatattcatttatataatagatatgtacgaggtatctattatgtgtacgaggtatctattatgtcagtaaactatacctctcgggaaaaatccagctctcctcttgtttttgtaaatacagttatagtggaacacagccacaccccttcatttgcatatcgattatggctgtgtttgtgctacaacgacacagatgattagtgacagaaactatatgggtggcaaagcctgaaatatttaatgtttgcccctttactggaaaaggtttccgatccttgttctaggtattgagaatgaaacaatgaacacaataaggtgatattcctacttttattatagtcaaggtaagacagacacgacacatataaataaatatgtacttacctatacacatatgcacaaaacatctgtggtaataaatgtaaagaaaaaaatacagaaatgtaagacagagagaaagcaggaatggggggagaggaaaattttttagatatttcccatttaaatgcctctaatctcagaatagaattttatagtatcgctttagtaattcatttacaaggtagttttcaatagaaaaataaaaactcactaccccatgaagtctcattgagcacaaaattcaggaaccaccccaggttgcaaataaattcagacattgcctgtcataaaaagctggttcggagacaactccatttagtattgtagaactgtgcaaagaacacgacactttgctgactggcatgcatttttgtccaggagtagttttccccacatggagaatagcgacaatacaaccgcttccaatcaaaggggaaatttgtgctccttatctagcttgattgtccatggataagaccaagttcaaaagtgtcagttctacaagcaaacaaacaaaaagccctgaaggcctcaagagctgaggatgcaaggaacaagtagagtttccaacacagaggaatgataaatgctggaggtgatgggtagtgtaaataccctgacttgatccttaaacattctatgcatgtaacaaaataccacaagcacactgtaaatgggtacagatagtatgtatcaataaaaaaaaaaaagaatacaaaaagaagtagatcagggatgctttatatggttttctaccttgtgtcttattttcaggtgtgttttcacaggcactacctttgtagaacaggttgcttgctgtgacagctcctatctgagcaaattgcattattaactagattgaaccaggaggtagggcacttccacaaaattctaggacaggggtcagcaaatctcttctgtgaggagccaggtcataaatattttagattttgcaggtcttttggtctccgctgcaactcctcaactcttctgttgtagcacaaaagcccctgtggacaatgcataaatgaatgagcatggctgtattccgataaaactttagttacaaaagcagacaggatttggcctgtgggttgtggtttaccagcttctgttctagtgtagtttttccttttgtaggtgtgctcagaagatcaactggagagcagacacaacatgctcacgctctggttcctttcttctgacctattgattcagaatctctgagagtaaaggccagccatgtacacttgtactgttgtacagatgcagaaagtcagtatgtgtcaggatatgctgctgttacaaataacccccaggatgtcagtgacagcagcagcagcaacaacaacaacaaacaaaaaacatgtttattccttgctcatgcaaagcccaccatgggcatctctagggaaactttcctccacacagtgacctagtgattcaatttgtcagaggcactatcagcctgtcgctttagtttctgcaacacacagccttcttgattgacgtcactgagaaaaaccaagaggagaaggtcttccaatggtaattaaatgactgggtcactaacaatttgggcatagctacttgcaaggacatggcaaacacaatcttcccaagttcgcaggaggagagagaaattggatatgggtaaacactaaattttttttattcgttcataaattgattcaattgatgtatcgattgactgataatcattactaaacaatgtgatgtgtgcatggcaaagaacctatctgcatggtatttatgggtatatttctgtttccatcaccagaatttaaccagttatctacataagtgaaatctgaaaggaaactactctttagacctggggtcaggcaccttttactttattatactcttctacttgatggtaaaagtcattatcagttttgttaatcacatgccggacctcagatgtattgctgtcctaaaaagtcaagcacattatactgaccaaatgtgctttgatcacaggtgagacatcgggtttcacacctgttattctgcaagttatgtataaggaacatacttcatacttctttacttcctgtactgatccagtttggttggttttactgatttggttaacaagatcgtaaataatagtgaagtctctctctgtttatggttaacactgctggcccattataattttcggtggcagtgcatatggcgggtgataaactaataaagctgcagtaggaagaatagttctgcttttatttttatggctatttctttaatctgatgcataattaatgtacaaagttcaacttcgttttggtcagatcccagattactcgaggcatccggaggggttaatattttttggtgcatttgggggtaggaggttgggataaaacaacaaatttttatctatatggaaggatgcttaaccgggattttttttttttttccaaaaagaaaatacttaagttatccttgctttcagagttcatgtccattggaagtgtcaagagattctgtgttcaaacattctcaaagcaccgctttccccttaccccttacctaagagaacataattctaaaaatccctttggggaataattttctctgccttccatctctctcaatgatgtgtccaatctccacaatttgtctggcctcctcttgaactgatttacggttcaccaaaatctgtgagaggatttgccaggctgcagaccaattaattatgtttgctgttagacctgttaggtgttggcatttccattttgtcagacattttaaatttaacgtggacacatggtttccttttttttttatatattaaattaggaagctgaccacatagggggagattccaacagcaacacaatgaatttatttgagatgcattgtccttcatttgtatatagaactctttaaaaagaaattcaccatcttcccagatttttttttctttttgtttgagatggagtcttgctctgtcactcagtctggaatgcagtggcatgatctcggctcactgcaacctactcctcccaggttcaagcgattctcctgcctcagcctcctgaatagctgggataacagacatctgccaccacgtccagctaatttttgtatttttttttttttagtagagatggggtttcgccatgtttgccaggcagatctagaactcctgacctcaagtgatctgcccgccttagacccccaaagtgctggaaatataggcttgagccactgagtccagaccttcctagatattttgaacagagcctgcttttctcagagaaaatatttcttcttttgtccacagcagccctgatatccatggtgaatagtgtgttagccattttctgccttgcagaactattattataatataataatatccaaagaacagtagcaatttttatatagcatttactgtatttcagataatttttaaatgcgttttacatatattaactctttatgtccttatgtaatgctctagggagggtgctataattattcccatttttcagatagaaaactgaggctaagagaagttcagttacagataccacacacaagaaagggacagcatctctggaagtctgactcctaatcatgggtcactcttgtcatcagatgccgggcaaggtgaagccctacattctacagacgtgttttcagaaagtctacaccacgtttatgcactagtattcatttatctggtagggtcctttgattttattgggtagtgctttatgggctgataaatgaggtgacattaaggatagtaacactgttttcttcccttttctgtaaaaggtgagatggttgcctatggtgttagaaaggattgcaaaagatttacttggggaaaattagcttcctctgcactcccctgctccatttctactgtaagttattatgatgaaaaaaaaaaaaaaacctgccagaacattggcttcaaggtgaaaatatttaggcaaaatattaccacagggaaagtttattttaagcatcaaggttaaaaagacacatgtgtcagatttaggattttatgcttaaagctcatgacattgccacaaagtatttggttggcaaacttttcctgcagagggtcagataataaatattgtagggtggtggaccatacggtctgtgtcacaactactcagctttgcagttgtagagaaaaagcagtcataggcaatgcaaaagcaatggaatgttgcggcattgcagtaaatgtttttaaccacagtcagcgaggctgatttggtccacaggccatggcttactgaccccctgctatcaaggaatgaccagggatttggagataggctttcaatccttccttgtcatgtgccaggtggacggccttgtggttcaaagacttctttgaaccttgcgtagtcacaatctctctagatgttaaatagggaaactgctatgccccgatgagcatggtcatgagaactgaaggagtaccagaactgaatgaatgaagtactggattcagtaaaagaaattccatgtcatccttctctgccctctccaaacccctttggttctacttttccctaccttgtaatatttttgttaacaagtggtaagagttaattaggggtccctgagatttttagggtgcttttacattttggtaaggctagtagtagaaaagtactacctaaaagagaattaactaaattccttccttccttcttccctccctccctcttccctcccttgctctctctctctttctctcatctctctttctctcttcctctctttctcgcttgcttgcttgctctgttgcccaggctggagtgcagtggtgcgatcttggctcactgcaacctctgcctcccaggtccaagcgattcgtgtgcctcagcctcccgagtagctgggactacaggtatgcacgatgcctggctaggtttttgtatttttggtagagacacagtcttgccatgttacccaggctggtctcagactcctgagctcaagcgatctgcccatctcagcctcccaaagtgctaggattaaaggtgtgagacaccatacccgggccccagaggagagctttctgagtcaccatatgtgaagtggttcttacgtaatttctacggaaaaaaaactcagccgtcgaaatacaggaaggaaaagggttaatttctttgtaacagagatagtgaataacaagcataccactgattccaccaatctaatatacatgacacaaatcactgaaagataataatcttcactgataaactgaatgagtcttcagaagcttgttcatgacagttctttagtcattgtcagtgattcgtagttgtctcataaaatgaaacctattaggtatctttgacctagttaccttttagggtcagagactttggagattttttcagattataagctacatgaagttgttacagggttgctagtttaccttcgctttgtaaacagtgatgctcctctatagggatgtgaggttgaattccgagagtcacctgcccccctgcaaaaaaaaagaccaaaaagtaaaaagcatcttccattcttcctgaagccccctctcttcatgaaatgtcctcacattgaagcctgatgaattcgttcatgttcttggctcgaaagttcttagcagcagcagcagctgaatttctgttgtctgttcttgttttccttgtttttaccattttctagatattttatggtgaactgttgttatagaaatatggaaacaagggatagtcctaatacatcctgttgcaaagaacagaaacccagtttagactcagttaagcaaaaagggaaaatttagctttaaaatattccatagattccagaggattccagaggaggaagagcggcaggaagtacgatgaagcaaagaccaggaaagggatcagcaccctggacagcatctctttcatttctctttggaaatggagcccatcagatttgcctcacccctgacttagcactttgtactaaatcccttagaaatgccttcccttaatctccacattcctgagttttttatggcaattgcattttagctcaacttctatgtcttccaaagatcttccctgttcacaacaattacatgccctggtcataaattatcttattttctttgttgcttgtttatcatatgcaccttcccacactggaatctaagcttcctgagagctaagccttatttagaacaatgcctgacacataatgggcacacaacaatatttttgcttaaacacatgtataagtaagcgaatgatcccctaactgccaatttcctaggagagagaattgaattgccccagctgggatcagtattcaaccctctttttattagttgaggcagagtgggttgagtcagatagaacagccacttctcctggctgcctgtgtctgaagggaggtgtacttgatttggggagaaaaagaagccatggtgaatcacgaaaacatattccccaatgacaagtgtatcgtgcttgtcaatttacagagggtagtgagggtaggggttgatctcaaatttgacagaagaaacagaggtaatttttttctacctgaaaatctttaccagcacttgaggccagtgggcaccatgaaagtatcctgaacgaaagtgttttatttctctattgttattaaatagtgaaaccttcgttgggttcatccaaattttagctataagagatgctttatctattttttctttactttgtcaatagttctgaataaatgtgtgtgcttaagtgtgcttgcacatgtgtgtattttttttccaggctttcagaagcctgcattaataatctcttagggtcccgaagcaggaacatgtatgagaatacagaaccagatgatatcttcaggcagaaatttaggaagagttgactcacactgaacacaagctagttcttaggcttactgtcagaacaaaattgataaagcttaggaggacatttcatctcctttcagtgtggttcagcaaggagctatttaatgcctcctattgtcaggtgtggttttaggtaccattcgtatcaggtctctgccctcatggaaccaccattctaattgagggagtagtttaaaggggatagatgggaattaataaaccaataaagagaggctaaaatttcagactgcaatgatgacgtcattaaagaactgaaataggatgatgtgaactgaaatgatgaggggcgatgcagatggctggaggtggcctaaagcccaggaaagtggtggtggagaagaaggcaggattggtgagaagagcctggcagcacaaagatgtgtgtaaaatcactgacaggaaagggctttgtgtatttgaagatcataaaaagagtagcacagggctggaattagctccgtgaacaagtggagagaaggaagtggagaggcagatcaaggaggacttctttgcttatagcaagggggttgaattttagttttaggacaataggaagctgtggaatgaccttagagggaagacatcatccaaatgacagtgtactctgttccttagctgaagagagaaaaaaacagatgcaagtgcaagaggttttagtagaagtctaggggatacatgatggtggttatagcatatccacaaacacctcatgacccagggtgtctgttcatctgcattgcatgcatgtttttacctcctctgacatagttatttgcagccctgtctcatggtcaaaagttagccaagtgattgaagtatgacatattggctgtgcctttgtgacaatccttagtcttgtctgtttagcaaacagtatggcaagttggaattctagagcagtcacagtataccatgcttgatcacatgggtatacctaaacagttacaaacccccaaacctgattatgagctcttgtgaaacttctctaaaaatttggggcaatgtggagttacaggtagaacttgagcttttcaagtcagaaaccttagttctgaatgtttgtgcctctatgtatcaactcagaactttagaggagatccttgccctttaggtgtgtttgtgtgttgaagtgttactaacactattaataatgtttacacatgggtaatattaaccataataatgcttacttggtgcccaaagtacgtttgatactttacatatgttacctctctcaagcattacagtaaacatacaatatgcataggatagccccactttgccaataaggaaattgatccttagattaaataacatacttgaaattgtgcagtaagtacatggaggaatgtccatacaatatatctatttaaaccacctaacagtggggtattatggaagagcatatgggagcactttgcaaagtgtcaaccgcagaataagtgcttgataaatttcacattatacctctctctctctctctgcagatttcagtcacttatgaccacagaattaattctaaagaaagcaaattgaaggaggtgtttgcacgtatttttttttccctaatgattctactgtaccctggagcattttcacggtttgtgtttaatcacagaatctcagccatgatgtttctgacaggcaatttccttaatgcatttgacagagatggattacatggagggccattggacgccatggttttgtctgcaaatggtaagactagattagagctatctgggtctagtgcctccagtgatattgcatcctaataattcttatgataacatggatcacctttgtggacacacacattcttggccagatgggatacagtggttttcaagaaaccctgccacttttattacactttgagaaacatctggactaatatttgtgtgtcagaatcataaatcaatttagtttgcggagataggcctagttatgcggtttatcttcaaaggcactcttttttgctaccactgaaagtggtaaatgaggcacataaatgtcgagatattgaattccttctgaaactgtaaagtctttacactggcatatgaagatctgagcatcagtcagactctcaggtacttgatgaacaagagtgatttggattccatggcattttatccctagataacaacaaacccaacccattcttgagcaatgatacaattcccactggtgactcacttcctgaccctttctccccgtcctctgaagtatgtctcagccattagttcctatgtttattggcgcactttagtatagatcaaaggcacacagacaggttcagcgatatttgctaaccctgggaaacatgaatgctactattttgaaggatattctttatttgtcactggtatttaattgcacagatatgtacaaccattgtaaaggagattcctagatatcatgatacttatctctaatgacataaatatgtatataaatatacataaatataaatgtgtatataaatatttatataaacataaacatatttatataaacataaacatatttatataaacataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataagcataaacatatttatataaatataagcataaacatatttatataaatataagcataaacatatttatataaatataagcttaaacatatttatataaatataagcttaaacatatttatataaatataagcataaacatatttatataaatataatatttatatacacatttatatttatgtatatttatatacatacttacgtctttaaatataagtttcatggtatctaggaatctttgtgtccttagagattctatatgaagcaatgacattattataactaacagcattaacttaaatctatcctgccatcaagtatccagtctgtattaaaatgtattcagtgttttgaacaatattctttatgacttatttttaaaatatagctctctaggccaggcacagtggctcacacttgtaatttcagcactttgggaaactgaggcaggcaaattgcttgagactgggagtttgagaccagcctgggcaacatgaggaaaccccacctccacaaaaaaaaaaaaaaaaaaaaaaaattcagaaattagctggacatggtgatgtggtcccagctacttgggaggttgaggtaggaggaccactttagcctcatgaggtcagggctgcagtgagccatgatggtgccactgcactccagcttgggcgatggagtgatactctgtctcaaaaaataaataaaaaaataaataaaatgtagctctctagtcattttgaagtactgaaatcatatgtaagaagagtaggaacaagtagcataacacaggatataaataattaaagtaattttttcttaaagtgcatctgtccttccttaatccttctgagagattatcgatcacttaaaaaattgtgtgaagtcttacaaagaagtatatacataatatgatactataagaaagcccttggccaggcacggtggctcacgcctgtaatcccagcactttgagaggccaaggcgggctaatcacgagatcaggagatcgagaccatcctggctaacacagtgaaaccccatctctactaaaaatacaaaaaattagccaggcgtggtggcgggcgcctgtagtcccacctactcgggaggttgaggcaggagaatggtgtgaacccgggaggcagagcttgcagtgagccgagatcgtgccactgcagtccagcctgggcaacagaatgagactctgtctcacaaaaaaaaaaaaaaaaaaaaaaaaaaaaaaaaaaaggaaaagaaaagaagcgcttttaaaatcttagaaacaaaaatcgctctctgtaaaataatattcatcagcatttttcttaatggtgagaaattagaaacaacctaaatttctgacatagaaaattgcctaatttatggcggtcatattggaaaatgttcaccatgtattgtcaagtgaacaaagtggtttccatgaccgcatgggtcaaatcacagcactttaagaatcaactcacagagagaacaaatctcgagaatgtatctgactgtgtgctagccatagttatctctagatagtgagattataggccatttttatttcattttaacttttctctgtttctcacattttttgcatgcaatgtggaatatttggtaattgtgtttaacaattttggaagatcagccaactcagcaagaggtgtattatctaactggaaagaaaaccagaggtataaatacgatggaatgaaacactccctgagcctgtgtgcattctgcataggcttcttgaaatagtccatggctgcagagatggaaaagttaacataagtgctttaagttaaaatgaagaaactgttgtacatcttcctatatttcctttggctatctaagtcctgcattagaatgttctgatattttctgaatggggttttatgaaaaacctagagttaaaatttgcattgcagttagtttcaaaatgctatttagaggaagcttttagctgcatgttacagaggtctaatatggaccctaactgaagttatgcagaaaggaaatgttttgctgtgtgtgtgggtgtctgcaccttttctccccatcacccacctcgttccctgaatgctattttatactctaagcaattaagagtggtttatgctgcagacttttccaataagcattgactcattataccagtccagtatcattatcctgagttgaacatgtcctgcagcaggtttcatttattctgctgcagtcttcatttctaccatatatttggagattcagatacagatttgccttgtaattgtcaaaagtaagaccgcaagagctggtatagggcatgctacgaaggaaccaaagaatgacattgagttggctgttaaaaatgcaaattttggagttggaaaggacatcaagaaaaaggtttaaggaacagaggatacagacagctaaggattggggaaagttctttgacaccatgaagactataattgcagcctgggtagcttgataaaccactcaaggaagggttggttcaagaacatcaggctagaggcaagtcaagaccttaaggcatttggaggtgatacggagtgatttctcgaaaaggaattctcaatggatagaatcctcataggaagacctacactgattcaggtaataaggagtgatttctagaaaggaatcctcagggctgggcacggtggctcatgcctgtaatcccagcactttgggaggccgacgtaggtagatcatgaggtcaggcgatcgagaccatcctggctaacacagtgaaaccccatctctactaaaaatacaaaaaaattagccgggcgtggtggcgggcgcctgaagtcacagctactcaggaggctgaggcaggagaatggtgtgaacccgggaggtggagcttgcagtgagctgagatcgcgccactgcactccagcctgggcgacagagcgagactccctctcaaaaaaaaaaaaaaaaaaaaaaaggaatcctcaatggatagaatcctcatagggagacccacactgattcaggtattctctccagtttagaatacattgcccccactccaaaacactatgtcccccaaaacacacacacacacacacacacacacacacacatacacacacaaaatagagcacataagccactctatgcagcataattatctgtatctcattttcccttcatttgtaaactagcctaccactgggaaaaaggtaccataggttataaattactgatggggtctaggtcagcagttcccgtggttcccacagacacctgcaggcaatcccttctataactttccctatgcatccagcaagtaagttttctttctttcctccagctttctggaagaatctgttcaccattgtacatcttgatcgcctttatgtctgcaataggcccaactcacatccataagaaaaacagatcattctcctaattgaaatagaagagcttgggcaagacatcaattagtgatgcaaatgtagagttcttcattgagcaatgacaaaatcccaagacttattagaagaccaataagaaatggaaaaccatgatttactggcagggctagcacagttaaatttaaaataaaaatcttggccgggcacagtggctcactcctgtaatcccagaactttgggaggccaaggcgggcagattgttctaggtcaggagttcgagaccagccttgccaacatggtgaaaccccgtctctactaaaaatacagaaattacccaggcatggtggcacacctgtaatcccagcgactcgggaggctgaggcaggagaatcacttgaacgcaggaggcggaggttgcagtgagctgagatcacaccaccgtactccagcctgggtgacagagactccgcctcaaacataaataaaataaaaataatataaaataaaaaataaaacttccctcattgtttttgttgtcagcctttacaagcattgatgcttccaactcttccacaaattcccaacaggtatttttacatatcatccaggcattttttttttctttcctgagtgatactctgatctctatctgatgagctggagagtgacctaagttagaagggaaagtagaggaggttgctaagagggtaggtgtagtactgaggtatagagggttggtagagtggtattgctactcagaaaccagtaccacatgaaatcagaaattcagctccccagaaatcagtgccattccatcaacaaacagatccactgtgttctcctggccttgcatggttctaggtttgtagagcaagtttttaattcgggtttatggcattgctcatattcgccatttcagtcatttttggtaacagttacgttgagcttatctgcatagacgcacatgatgaacaaggattgactattcttcagaggatgttaactgtttagagaatcatgaaggaagcatattttacaaagaccttttttttttcctggacttctccctaatcatctcaatcagaaccttgaaaaaggggcccaggaatgcgaagtgtatgcctgtctcccacccccacatagtgtctagatgatcaatcctattcggggaccccttggatgtgagtgtgatatcattagaacataatgaaactgtgattcctaacccagaggaaaatccatcttaattcttcaccatcatactttatagttagtgctctcttccaaaggaaacccctttcaacccctctcattttttaatatggaactttgtcttaataatggatttcttcagtctttaatatttgatgggagaagtaattccagtcatggcacatcagaaagttgctttttttcctctttctaataagacgtataatccgttgctgacaaaaaaagaaaaaaaaaaaaacagcacattgctacaatatttcctggatgctttacaatacactgtgacaaatggcgcctcatgttgtacaattgtcctcatggcttgtaacacatcatttaatgaattgatcacagtggaatgtaaagatgaagcagcatttattttgtatgttatattgcatataatttttagagttgacatttataaccatggaagctgttattttacatatcatcttcaaaccatatcagccttaaacacatttaaatttaataagcaagtagattagatttgcttttaagctaggcatatcattacagtgcgtgtttccgtcagaagggcatgctcacgattaaatactgtcttcagttgttttaaagaaacaaaaattttaaagaagggggttagagcgaaagctgaaataattgagtatgaagccctaagaattctctgtggtggacaactgtaagcatagccttctaaccattgaggcgaaagagtccgtttggttttattaaccatcaccaggcaactttgaggcagaatgtaagccttgggaatgaaatgcaaattctataataggaacatcattgtgataataatttattaaatttcctgagccgtctccctctaaggagggctgcacaaacggccctggtgattaatgttcaacatcgtttaacattttattagagggaaacagtttttaatctattgatgccctgtctgtagaattctacgagctgttttcaaaaccagagaaagggggataaaaaaagaagcaaaaaataattggtgggggaagggggtaggtagtagaaggaattcgcaatagcggttctagttctgatgccagatttctcagaatctcctgtgttttactggcattttattgttttagcctcttggtagcctgttgatgttttgtgcaaggagagagagtttccttgtgaatctgacgttagggaaaatgtcatattcagtggagaggttccatctaagagagttggggtgagaaattggctgaactgggtgcttctctgaatcctagtagtgtttgcttaggagctttagactcaaatgcctatagaggccagaagggtcccttcaatggagattataatacgtggaatgtagtaaagtacttagcaagcactcttcactttgaataaatattgaggtactgaagcatcaactgtgagaagaccaaagacaaataacagcaaaatactatgtgaaatcatagaggagatccagacacacgaaaagggggccaaatggaaaaactaatgcaatagacagtttagatcatagtattgtttcgacgtcaatttcctggtacccatcattgtattatgattaagtatgatgttaaacattaggagtgactgggtgagagacccaggagtgctctatattatttttgcaatctttctgtgagtctaaaagcatttcaaaataaatacaacatttttaaaaagtaaaattggaacatacaaaacacactaatacggaagatgaagtccgaggatcatgtgcttacaacattgttacttcgccagtctcacaccctcttctgagaacaatgtaaaaagcagagagaaagatctcttcccctcctctttgtgtcgacagacatctttgggttggacaaggtggtaggcaaaataatgcccttgccttacctatggccatgtcttaatctctggaacctgtgagcatgttgggttacactgcaaaggaaaattaagattacatgtagagttaggcttgctaatcggttggccttgagataggcgcattatcctggattatctggatggatccaataggattacatagggttgttataagtgaagagggaggcagaagagagagagtatcagagcagctcttcctgaaaagaactcaacacattattgctgtctgtaagatggaaggaagccatgagccaaaagcagcaggctgccgctagagtctagaaaaggcaagaactcagattcttccctagaacctccagaaaagaacatgccccacaaactccttaattgtagctggatgagacctgcatcagatttctgaactacagaactataagatgggttgtttgtgttgtttaaagccatcatgtttgaggtctttgttacagcagcagtatcaagctaatacaggcaagtaatcaatataactgcaaatgcttttatggtccttacacgtgccagatgctcttatgagcattttacatgcattaccgtccttgatccaatgaggcaggtactacattgtgtattctgctttataactgaggatactgcaacagtgtgatgttaacttgctcgctgtcacagagctggtatgtgacaaagcagatgcttagtcagaaatacagagcccatgctctgcaccagcaaccatggtagacagctcagaatattagtactagactctagcacaacaggtcctagaagatattatggtaatgtatttacgtaactcaaaatgatcagacatgtcacaagaatgaaagaatgacagactaaaatcttcttggagagttgactggaaggataagatattctagtagcagttgaaaatatagtagcatctatctctagctatcttttttttttttaaggattggctaaaaatagtctttcccaagtataagccgtatcatattattatggatttagacgggtatacatgatgctattaaataacattgaatcaattattgggagaaggagttattctctttccatttctctttccattaccctattcgtgtcaatgagaaagtctttatttggtactagagtgtcttaaacatctctctaatactttgtgatctctgtttttagtaataaaatggaagcctccggctcagtgtctacaggtaatggttgttagattttaataacttgtgattgcactgtatttattttatggctaccttttattcagaataagtgatattgttattttatcatttacattactgatatccagttgccttttaaaaataatgcatttcaatttaaacaaagcacatcaatgtaaaaagatactaagcagctgacaatttatgattatggtacaggatgaccgtctagtgactttggcagtggaacggctagagtttgggaaaatctagctctttggggctaaagatttcaaaatgtacatttaaattaccaaacagatactcattactaaaactcaatgcctgaaaccatctttgaatccattctgttttctacccctttcccagaaacacttcgttttattacatttagaaagtggtgaatttagcccaggcacagtggctcatgtctgtaatcccagcaattttagaggttgaggtgggtggattgcctgagccctggagtgcaagaccagcctggggaatatagtcaaacctcatctctacaaaaactacaaaaattagctggacgtggtggtgcatgcctgtggttctcgccactagggaggctgaggtgggaggattgcttaagcctgggaggcagaggttgctgtgagccgagattgtgccactgcactccagcttgggctacaaaatgagaccctgtttcacaaaaaaaaaaaaaaagtgaagaattcaaagacagctgaataacacctttcaatattttatcgaggttaataaaattgattggttcttaattagttgtttattgttcttctaattctagcaacaaaactttaaaaaattatactctctgaattttaataaagagctcttcagtctatcaacacccttaagtctgtcaacttcaccatgttttgtgcctcatattgcatttcttgttggaccagccatattaggagttggggtggactctgttcatggactgagtttcccagaatagccttatatttggtgataatgtctctggctgagcctcattctcttaaattaatttcatcacacaggcttgcaaaataaggcttcttgtgaaagtcttggttgcagtgtcttttctagccagtttcaccaatgacctggtgtgcaaatttgtccactgtaagagtatcaaagacatattgagaggaggtgatcattattacacgacctgggcaggtggctgtcctctaatattggcaaggcaaaacagaacaactgacccaacagcacagatttgaaagactgtttgaggacctacgatgcttgctcttgctctctttatttatgtatttatttatttgtttgtttatttattgagacagagtccaactctcttgcccaggctggagtgcagtggtgggatctcaactcactgcaacctccacctcccaggttcaagcgatagcctcagcctcccgagtagctggaactacaggcctgcaccaccacacttggctaatttttgtatttttagtagaaacgggatttcaccgtgttggccagactggtgttcaactcctgacctcaggtaatctgcctgcctctgcctcccaaagtgctggggttacaggcatgaaccactgtgcccagctcgatgctcataattttagaaaggtgcctggtttatatttcttataaatgtgtcactgaataaaggttagcccacgtgatatgattttttctttcattctctactgccacactgctatttgtggcaagatctaaggagtttcttccaggctgtcaccgtctgaaaaaaaaaatgtgagtatcatatttcccagcctcccatagggagttttaattattattattattgttattattattgtttgctcttttctcttcatcatcctactcctcctcatttttctaaaggaagtaaaggaacaggcttggcccaataattttgaagtataaataatcagtatgttccatagtcagaatggtaataatgattccgttaactcagtttatttagtgcttgtgtgcatggtgaatgtaatgttcttgttatcgactgtgttatcttcactctcccctttcatcctgaagatgtctcagggaatttctccttcaacttttcctacccaccctgcttcactccccctctccccagccccatttgccactgacttgcttagcagcacaaaatcaagaaacatctttcattcagaccattgccaacactgatagtgtaggtacccaaaggtccaatggcttcccaaacatttaagaggcgtctacaatgtgcaggttagtgcaaccggctctttaaatgcacaaacccacttcaccctgacaacaatcctgagccatgaatatttttattcgcattttttagaggaaaccagggtcaatgccttcaaagaacttgtagttaggcaaaggagacaggcatgtgtgtataactataagtaaaatgcaaaggcatctgtgtacagagggtcaggagtcatgctgcaaagtgagtttttggaaggtttgcggaaagaagggaagcctgggcaggcttttgaggatgggtgggaattttttcacacagatgatttatggaagggtgtttcaagcaaagaggacagcatgtgcaaagggaaaaggaaatggaattctgagccaaaggtaaatatgcacagctaaatataattagagtggtgtgcagaggggaagttgggttatctgaaatatataaatccagtggtctaatctttgcacgcaagtctgggtaattttaaggagagtttaaaagactccatttcgaaggtgcacaccatagccatctttcagccagttgctccttgtgtgctagacacctgaacacatgtattactcctgttccatctctcccagttattccttctctacccatctccaatctgtccttcattctagcgttctctggtttctccaggctgttgaaactaagtacagatgtggctcttccaagcctccttcatagccgttgtctttagggatgaagaaaatgaataaggaaaactgtggctctgagcagctattgcttcatgtcgtggttgaagcaggaagcgactgagcttgctatcgattttaactcctgatcttgggaatcccagagcttctttctgtttctggagtgatgtttttctttgaagctaagttaaaaggtagtcatggggagagagcctaaaaacctgtgagtggaaaaaaaaaaaaaaaaaaaaaacatcaagctgtgatactgcagaattatcacagatagtgtaaaactgtgtggccatgccttaaaaaaagttaaacataaaattaccacattaccaagcaattccacttggaagtttatttgcagtaacattgaaaacaagtactcaaacaaaaatgtgtacagaaatgttcatcacagcattatccacaatagctaaaaggtggaaacaactcaactgtccatcaccaggtgtgtggataaactaaatgtggtatatccctgtagtagaacgttattcaacagtaaaaataagtggagtactgatacatgctacaatgtagatgagagcattatgctaagggaaggaaccagacacaaaaggtcacatgttattccatttccgtgaaatatccagaataggaaaattcacagagacagaaaacagaatgggggttgccaagggagcaggaattgggagtgtaactgaaaaatgatcatgtgttttctcttttttcccccgttccactcagctcataccttgtggttttctttctttctttttttttttttttttttttttttgagacggagtcttgctctgtcgcccaggctggaatgccgtggagcgatctcggctcactgcaagctccacctcctgggttcacgccattctcctgcctcagcctcccaagtagctgggactacaggcacccgccaccacagctggctaatcttttgtatttttagtagagacggggtttcaccgtgttagccaggatgttttcaatctcctaacgtcgtgatctgcctgccttggactcccaaagtcctgggattacaggcgtaagccaccgcacatggccaatatacccggtggttttcttctggggtgatgaaaatgttttgaaactagacagagggtggtagttgtgcaacattgtgaatgtactaaatgctactcatttgtacacttaaaaatagttaattttatgttatatgaattccacctccattgcaaaagagataaaatcaaaaacaggaagacagagtgttttagtttgttttgtgtttttgtaacagaatatctaagactgggtaacttaaaagcaatcaaagtgtatttggctcatgggtttggaggctggaaagtccaagagcatgacactgcatatcacatgggctttcctgctcctccatcacatggtggaagggcaagagggaagaatagatgaactcacttttataacaatccactcacatgataactaactcactgcagcagtaatgactttattcgtgaaagtggagttctcgtaatctaatcacctcttactgggcctcacctcccaacactgttgcaatggatattaaatttctgacacatggactttgggggacacattgaaaccatagcacactatcagaggcaaaatatagtgttggttcccaggcaatgagttggctgccttgttcacagtttgctcagtatgaaccatgcttgcaggagaacccctgaaatcaacccttagagaaatggtgtccatctgggaaagtagaaaaggagacagctccaagcaccaggactgagtttcagttccaagggacaagggaagtaagaatatcatcaccacaggtccgtcctcctccccagaggaagaacacaggctgcagaggtgacagctcacaatgttagggactgttgatgagaaaattggaaatggatggatttttatggcaatgcatttttaactgcacttcagcatagagggggacattttaaggagctaagagcttaaaccagacaagatttccttcagtgtgataataaatacaccaaagtgcccttttatgtttaataattcaggatccactgagtgtttaaagggttttttttctgttttatcatttgaaaaatcgaatggtaatcatttaaaaagtagtaggtgagaaatgttttccaaataggccctgaatcatgcacttcaaaatgtctttggaaatgaatgactgagtgtttcaggcagcgtacgcctgaaggtttggaagttttaacacagccaaacacctgtcattgctgtgtatactcatgttcagaggaatggtatctacttccatacacagaatcagccaataatctgatcagggctgggatgaaattagacaaaaaggctgggcagtgcagtagctcacgcctgtaatcccagcactttggcaggctgaggcagaccaatcatttgaggtcaggagttcaagatctgcctttgccaacgtggtgaaaccccgtctttactaaaatacaaagattagctgggcatggtggcaggcacctttaatcccagtttgctcaggaggctgagacccaagaattgcttgaacccaggaggtggaggttgtagtgagctcagatctcataactatactccagcctgggcaacagagcaagactctatctcaaaaaaacaaaacaaaacaacaacaacaacaacaacaaagaaattagacaaaagaacaaacaacgtgttggggaacacttttgtaatctcattcttgaatgtgctcagaatgtggatagtcacaatcatagagccagatttctgggaaattctagagtgaaatctaaaagtcagatactagtcataatacataatagtgtcagggacatgaacacatagcaccaacaaaactggtttgaattgttctgggctacaaattgggcctccacctggaatataatgcaaaatcctaggaagtagtgacttttagaaaggaaactcgactgtccttgtagatggtaaggatgatactgtggttctgagatttaaagcaggtaggttttcccagggagtggagtggagaagtgaataacttaatggtgacactaagttggcctgtcttatggaagagcctgaatgtgacaggaagcacgcatgtgcatcgttaagtatcatcttagaaaatataacccacaactgtgctctctccatattcagcaaatgtttattgcacctctatttatggtgtgcctgtcagacactgcagtaggcactaaggatgatgttgcaatataccccacagacaacatcactgcttgcatggagctcatattttctgctcgaggaaaaacattcaagaaggagttgtgacagaaactgccagctgtctacccagtatccctttatgccttcttttaaaggaatagagtgcttggaaatagttcacttagtcagagtcagtatgccccaaattaaaggataataatgctgtgttcctcggcttagcagagagggatccccattaagatggcagtgaaaattattagacatgcatcctgggaaaagcctctaatagggactaactcatcgtgatgaaaacaccataggccctttcatgctttctccgcgctgttgtatgacattatgtgactttgaggcaacttcgttggtggaatctatgttctaaggataatggaataaaaaagtgaatgaggcaagaaggtttaagatggaatatgtagccctgaacttcttgtatgggagagaaaaattaatctatattttgtttaagccaccattatttggggactctctaaatagcaaccaaattgaattttatgagatcagtgtgggaatcacaaatataaatttatttctgaatgtaaaaattgctctgcaggcaacaaagctggaagatatgagagagaggaattggggcaagggttggagagaaagacctctctgaggttaaaacaaagtctggtatatgcacctctcagggagaaacatcccaaaccaaaggaatgccagataccaaagtgagcaacacagcatagcagagaaacaacggagagccaggtagtagaagaggtgaagtcaccagctgaggtgaaggaaacaggagagatcaagtcctgtgtctcctattgtgggctatgttaagaagtggggattctattctggctgaggcaggaggtccttagtttgatctaggcaagagaatgccacgatctgattcttttttttttttttcttttcttttttttgagacagttttgctcttgtcgcccaggctggagtgcaatggcacaatctgggctcactgcaacctctgccccactgggttcaaacgattttcctgcctcagcctcccaagtggctgggattacaggtgtccaacaccacgcctggctaatttttagtatttttagcagagatatggtttcaccttgttggctaggctggtcttgaatccagacctcaggtggtccacccacctcagcctcccaaagtactgggactacaggcaagagccaccatgcccggccgatctgattcttatttacaaagcttacccaggctggtagagaatgggcacggcaagcgtgaagttaggaagctcatttgggcagtgactgtagactgtagatcagagggagtattgatggtggggtagacttagatggcagaggagatgtacgagggatttatttcagaggtaacactggcagaacttgcagaagtttgggaagccaattaacacctaagtagcatgtgttaggaggatatgcataaatgtagaatttgcattgactttggaagatcctcccatggtctttctcctagagccgcttaactgtctccaaaaatcaatatgggttactcaacaacaacaacaaccacagcaatataaacaacttgattaaaatggttaaaggacttgaatagacatttcttcaaagaacataaacaaatggccaataagcacatgaaaaaagatgctcaacatcattaatcattagagaaaagacaaataaaaattacaatgagataccacctcacacacattaggatggctgcaaataaaaaaaaaaaaaaaagaagcacagaaaacacgtgttgataaggatgtggaaaaattggacccattacgccctgtgggtaggaaggtaaaatagtacaggtgctgtggaagacagcatggagattcccaaataattaaaaatagaactgccagatgatccaacaattcttattctggatatatatttaaaagaggtgaatgtagagcaggggtccccagtccctgggtcatgtagtggtaccggtgtatggcctgttaggaattgggctgcagtggatgagcaagcaaagcttcttctgtatttacagccactcctcattgcttgcatcagcacctgagctcgacctcctgtcagagcagccacggcattaggttctcacagcagcacaaactcttttgtgaactctgcatgtgagggatctaggttgtgcacttcttatgagaatctaatgcctgatgatctgaagtgggacagtttcatcctgaaaccatcccctgcaacagccccccaccctggccattagtttatcttccacaaaactggtccctggtgccaaaaaggttggggtctgctgaagtacagcctcaaagaaatgttctttttttttgagaccgagtctcactgtcaccctggctggagtgccaggctaattttgtttttatatttttagtagagatgggatttcaccgtgtgagccaggatggtctggatctcctgacctcgtgatccgcctgcctcggcctcccaaagtgctgggattacaggcgtgagccactgcacccagccaaagaaatgtttttacactcatattcataacagctaaaatatgggactaatacaagtgtttatcaatgatgaacagataagcaaaatgtgatactcacacacgcacaatggaatattattcaaccttagaagggaagaaaattctgacgcatgcttcacaaatgagccctgaggacattattctaagtaaaataagccagtcacaaaaacacacgcactgtataattccactcacatgaagtttgtagtgaaaagcagagagtcaaggagaatggtggtggctggtggagaggaaggtaggggaaaggacagttattgtttaatgggtacacagtttcagtattacaagacaaaaagagttctggaggttatggtggtgatggttgcataacaatataaatatacttaatgctactgaattgtatgcttaaaatggttaagatagtaacttttatgttgtatttgtgttaccactgtgaggaattggaaaattatagaggtgggccgtgcccaggattgcagtgagttttcagctggcacagctttgtccatgcttctcacagctcagatagggtccctctatgtgtgagccctagtccacattttggttaatacatggtctcttccatttctctgtttccctttgcaaatatctgcttggttagtgactctttctcgaaatctcctcataacccaccaagcaaaggcaatcttgtgccttcccagcaagtgattgtcttaccggccacggatttaaccagaaatctaagtttgtccagagagccagtcctcagaaggggctgaagtcagaactagtcaagaaggacaggtgcacatttacatatgatttgcatctgctttacatagggctgtacaagctgtgctgtgttctcaaacatcacttacgttatattttaagactgtcgcaatctttaactaacatttcgatctgcagccagggtgcccctgacttctccagatttccatatttaaactggctacaactctaatccatgggaggtgggaaatccacggcacccacagggtatctgcagatacctgccagaaggctttactttctcagagtaaccattcattccaatgatccattctcaatgaaccatctcatcctacctctcatctcttgcctctatctcaggcccaccctaaacttgcagcatcactcaaggccattgtgtgtatcccattttaatctgagggaggacaggattgcaaacactttaatattagcattcccatatttataagttcctggtcaggtgtaatggcatatacctgaaatcccagtactttgagaggctgaagtgggaggatcacttgagcccaggagtttgagaccagcctaagcaacatagtaagacattgtctctataaaaattataatagtaaattagccaggcatggtgatatgcacctgtagtcccagttacgcaggaagctgaggatggagaatcacttgagcctgggaggtcaaggctgtagtgagctatgatcgtgccattggacttcagcctgggcaacagaacaagactgtgtcttaagaaaataaaaatgaaaaagttcctcactgttctaagacatcagggattattcactggcatttttccttgtatttttagagcgaggcttccttcatctccttttctccccctctccccaatcctttctcttttccttcttttctcccttaatgcaaactgattggtaactcctcattttcccctccgcacagtttctggcattcgccattctactccttggttttctgttcttgactgttttggatatattcatctttctatgtctcttgcactgtctgggactatgcacttcaacttgaaattccttgtcttttttgtcccaaagaatattgtgactttctctttatcctacactctcttttccatgtgtaacaaggggaggtgggagtatgatgccactcctctatgagatagaggtagaagttacatgtggaatatttacttccccttttatctgattttctcctcccacctcccttcactgatagtaagatagaggctgagagaccaagaaaaatagtgagagagatgaggcttgctcgatgaatattttggaaaactccagttgagtgaaaatgtatggaaatgggcggggcgtggcggctcacacctgtaatcccagtgcttagggaggctgaggcaggcagatcacttgatgtcaggagttcaagaccagtctggccaacatggtgaaacctcatttctactaaaaatacaaaaattagctgggtgtggtggtgctctcctgtaatcccagctactcgggaggctaaggcaggagaatggcttgaacccaggaggtggaggttgaagtgagatcatgccattgcactccagcctgggtgatagagtgagactctgtctcaggaaaaaaaaaaaaagaaaaagaaaaaaaagaaaacttacggaaataaacatgaacctttcagtagaatgttcctatccaccctgttttcacttctacaatctgtgtttacaaaatacgatacattttagaaaccaaaattccatgccttcttggtcattaataacattgacgtaaacttggtccaccatctgcagtctttggtgatgggcagaaagaaaacgaagtccctgagtctttgaaaagggcaaaagtgagtgcagggactgcagtgattatctgtatgaggtgaattgaaaccttaccactgagagaactgtgtgtagtaattactgaggagccaattgtgctctgcttaacgcatccaaagcaaggcagctattagtggtgtccccacttcggtgtttatgctagaatacaggaggacagcctggttttctcatacgatttgatctacgacatgatgagcctatggccgatgttgtgttctgaacacaggtgtggcttgcccacccagaggcgagtaggatgtttagttttacttagactgacactaggaactcagtaaaatgttaagcaggtttagggaagtgcttacctgatagtctaatttagaaacataatcttgtacacacagtaatatttattattggagtaagtcagtagaaacagactcataacctttctagggagacccagtaggtaaagtggatttaccagacagtaacatcttagtcttttgtgtttgtatggcaagtatctaagttaataatgggaagtaggtgaaagttttcaggttgtgtaccatgcaattggtttgactttgccttgccaagtaagcctaacataccccttataaatacactacatgcatttttagcaattagaatatttacttactgaaatatatatatacatatatgtattatatttccttattaatatatataatatgcgtgtgtgcatatatatatgcacacacacacacatatattttagaaagacacttgcaagctctcaaaaatgagttgctgcaataccattccctctgccaatcatatgggttaaggctgattttattgccagtcatatcgtactcaagttgaagtgctaagaatgctgtcttatccctcagctagattagttttaaaaggtgatcctgaagtcctgacaagcacagagtgaggatttacgaagtgacaaacagatgccgacgacatttactgtgagatttctcatagctgaattcccagtcctggccaaggagaaatatgcaacaggggagagtgaaaggggcattttaagttgggatttataaacaatcaattctcttcttatcagaaaaaaaaaatggagaggctggagaaaccgtcttaacttgaaacagtagtttattgcttcttacagcatggtctgtttctgttctgtgtggtagtcccacttacagtgcacagagcttcatggccttttgcagccaatttagccccttgcagctcagtgcaatgccatgcttcatcctggcaacttcaagggctttatggaaataccctacagatgtgtaggtgcttttgtacagttggtaactgaggcttcaaatcaccccatccatcttcatggcatttcttagctgatcagcaagaggtgtacgctgtattttcttttatagcatcttcattacctttgtgtcttccgtagctgctcatttttatgtatatggcatcattggccgggcgttatgggggttcctctggtcacgttccggcccttcattctgctagcttcaggttggtgagtcatgcatgtttctgaccagatggaacatgatttttcttatttctccactgtcccttccaagaatctttatttctctctccgttaggttcacatgaatggtagagagaggaactcaacagcacaaaatagtcaaaacataacattttattaaaaccacatccagtgcaacccccggactggcccctagcacagtgcctgctacataatagatgatccagtgaatattgacagaatgaagacgtgattggattaacgactgatcttgccacaaaaaataatgacatggaaactatgacagcaaaacagtgctccttgctgagaacagtctctgcaacctaaagaaggatggagcggaagaaatgttttatctttgtttaaaagaatgcaacaactgtggagctacctagggttctctgtaaggcagttgcctccaacacagccagggttaatttgcctgttgcacccagttcatgtagcttctcctagaatgtgcagcaatagaacgagcaggccaccatctatcaccagagaatatcttacctttattcaggagagagagctaaggagaagataaatggtgacagtgagagttgaactccacagggtgcatcctctccttcctctcaatcttagtcctggggaagcttctcagttacctttattgtgagcctcctgtaagtggggtttcttttttccatcactcactgaaaccggcgcatggtatcttctctggaaaactaggactttaggcaacatcaatcctgcaacagggaagcaagagcaactttggtggttacaggaaaagctggagatggctgtttatgtatccctggagtttggtttttggaggcaggtatcttacttgggctgaggtatgaaactgtagccaattatgtcaccatctataatcggccagattgtccctccaccaattcatatgttgaaatcctggctccctttgcctcacaatgtgactgtatttggagacagtttgtcttagttcacttgtgtttcagtaagggagtagctaacgctggggaatttataaagaaaagaggggtgttttggcttatggttctgcaggctgtgtaagaagcaggcaccagcatctgcttccggtgaggacttcatgctgcttccactcgtggcagaaagagaaagggagctggtatgtgcagagatacatagtgggaggggaagcaagagatagtggggaggagccaggctctttttcacaacctgttctctgctgggtgcagtggctcatacctgtaaccccagcaatttgggaggctgtggtgggaagtttgcttcagggtaagagtttcagagcaacctgggcaacatagcaagaccgtatctcaacaaaaaattaaaaagattagctgggcatgatggcatatacctgtagtcccaactaatagagaggctgaagcaagaagattatttgagtccaggtatttgaggctacagtgagctgtgattgcagcacttgcaatccagcctgggtgaagagtgagattctgtgtctgtaagcaaacagataaacagacaaaaagcccaccagttctcctaaggactaagagagcaagaattcactcaccctctattcccttcctggcgggcattaatctattcatgagggacccatctactcttcacttcatcttccctctatgcatgtctgtgtccaaaatttccttttcagctgggcacagtggcttatgcccataatcccagcactttgggaggccgaggtggtcagatcacctgaggtcaggagttcaagagcagcctggccaacgtggtgaaactctgtctctaccaaaaatacaaaataataataataataataataataataataataataataataattgcagggtgtggcagtgcatgcatgtaatgccagctacttgggagactgaggcaggagaatcacttgaacccaagaggcagaggttgcagtgagctgatatcgtgccattgcattccagcgtaggcgacaagagcgaaactctgtttcaaataaataaataaataacaagatctccttttcttataaggacaccagttagattagattagagcccaccctagtgacctcattttaacttacttacctttttaaaagcccctgctatcatttggataataacctcaaggcctttgcacttgcagttggctcctgccagcttattacatggctggctcttgcccttccttctgctctcagtgcaaacattacctcctcaaagaggccaaccctcaccttctcatcaaaaatggctcctcttacccattgtaaccactctattaaatttttcctttttgagcacttaagtcgcatttaaaaaaatttttaatccgtatttggtttgctggttccctatatgcctcccttcactgagtgtaacctttgtgggggcaggagtcttgtctgagtcatcattgcccaggggcgttctgttgtgttcagccaaatgttgaatgaatggatgatgcaatagatgaatgagacaagagtctctccagggaagctgaagtggcacacacactctcaaggtcttgaaaatgcctgacccctagtgcaggggttccatgatgcaccatagagttgatggtaggcaggcaaaatgaaagcttttaagccccattgattcacctgtgcttattaaactgccttgcctctaaaaatgatcattctccagtgaaaaccagggatagcgacgctcagtgcagatttcccaaaggaagaaaatccaatgaagtgcatctttgcagtgtgtgcattgcttgtcaacctgccctgcaattgtgtgtattcaataagggtgataatgatgatgacaatgattttatcagtcaagatcccacacaagaaacacaaccaataggatacttctataggttaagagatttattgcaagggagtacttataggattgcgaggctgactaagcaattcagaaatccatgggccaggccatcaggaagagtatgttggcaactcttgggcaggagctgacagcgtggaccacactgtggtcctcaaggatcacatggaccacggtgtggtccttcctcacagttttgctcttaaggcctttttccaattgcactacactcaccaagatttcttaagacaatctactttacttaaagacaatcaatgttaggtgttattcatatctataaaatgccttcacagcaatacctaaattaacattttatggaataaacggatactgtattctaaccaggttgacacttaagactgaccgtcatactgatgctaatgttgatgatgatgacaactgctactctgtattttgctcttagtaggtgtcaggcatgctgttaaagttcttacatgtgttttctaatttacaacattgttgctccaattatcattctcatagtatcaataagggggttcagggaggttaaatgacatgtccaaggtcacacagggctgaaaagtacatctgtgtgtgagcaagtctagagatccaatgtacagtatgatgactctaagaaataataatgtattgaatactggtaatttgccaaaagggtagattctaggtactctcactataaaagaaaaaaaaatttcaagaatataaaaatagaaaggagggaagaaaggaaactaattttatgagatgatgagtgtgttaaattgcttgactacataatcacttcactctgtatgtggaagtcaagataagtatgtcaaagtattatgttgtataccttagatacatacacttaaaaaaaaaaaaaaaaggactctgggccgggtgctgtggctcacacctgtaatcccagcactttgggaggccgaggtggggggatcatgaggtcaggagatcaagactgtcctggctaacacagttaaaccccgtctctactaaaaacacaaagaaattagccaggtgtggtggtgggcccctgtagtcccagcttctcgggaggctgaggcaggagaatggtgtgaacctgggaggcggagcttgcagtgagccgagattgcaccactgcgccccagcctgggcgacagagtgagactgcctctcaaaaaaaaaaaaaaaaaaaaattggactctggtttctaaatttaaacgtttatccagtgggctggtagctgtcatagggatagaaattctaggctctaggactctatcactagtaaatacagggaattaaaaactccaaggagtatttttcatgtaaagcaaacaaacaaaaaaggccttgagtcttaaaagagagagaaagagttgttgaaatctagaggcacacctagtaagcaagggtaatgtattgcatttccaggagaaaatgaacaagaatgtaagttacactgattcctgccctggggtaatgggtgggtttccttttcagctctcgtgccaggtgggcattcgcctgaactaggaggactcggggggattcaagccccctgtctctaggttgctatgagctttcacatcttcctctggtttatcccccgcccttagcacgaggtggttgcagcgtttcctaatataaatgcaagcaaaataaaattagaaatgtgctggtcgggggaagccagctacccacaggcgccgtaaattgccttttcctctcacccctactccctcctacccaccccttctcactcccatcaagccaccccaaataacctgccttgcctggctgagtcacggtttctggaaaagtggggccaagaaggttcctaacaagtcactggagtgatgattagtggatgatcagcggtcaaaagagaatcatgcatggaaggaaggtggataggattcattggcatgagtggcagatccgggaggactgcttggggcagactgtttgagtgacataggtcttttagggtcaagggagagaaaccagagaatgagggaagcacaagctactaaattttgccatcacagcagctgcctttgtgtacagtccctttgcctctgctgttccaatattgggatggttccctaccctcaggaaagtattcgcttgcctgtagccgcgttgaccctagcgcttgatgactgaggaacacttgtgttattagcaacccctctttcccactattttaaatgaataggcatacttgtatccatgcagatgctgctttagagtttagggaattacaaaatcaggtacaccctagagtggggtttctcaacagcaccagaataatgggatcagtcctgggcacgaacatttttccaagcagagtagtctcacatcccttgaaggctgagaactctcatataaaggcattccacaagttgttttagaaaaaaaacgagaaaatagcctcaatatttgaggagtgtagttattaggaataacttacgctacatgaggacaaatacctaaagcatgtgggccttaaaacctagatgacaggttgataggtgcagcaaaccaccatggcacatgtatacctatgtaacaaacctgcatgttctgcacatgtatcccagaacttagagtaaaatcaaaaaataaaaagaataacttaggctacaatgatgatgtcggtgctggtgttgatgaaggcaatagtggttacatgtaacctagtatctagctcttaccgtgccactcatattttgagaataattctatggaacacttgacttgatccttccagtcatcttgtaaggcaaatatgattgtgcctacccttgcttttatagatgagcagaagtaaatgaaagccagagattggaataggttgccaagactttactgctaataggggttgagaatggagggacataggttatccagaccctgaagcccgaactccctaaccacctcaaaacactgtcaggatcaggagaaatgcagattacacggaacaatatctggggcagaaaaacaatgaggcatcagtttttccccctttatcagtggttccccattctggctgcaacacattcgctgaggttgccttaaaaaatcacgttgcatggatccaagcccaaaccaattaaagataattttaggaatacgggactcagtgatcagtatttctttaagttcccagtgtaataggcagccagagttgagaaccattgcctgacattaaagattcacaaaatgtggtccatgaatcagactttaatagatctgttccaagttttcatgaatgagtatttagtaaagatgtggtgcatggcttttcctaattctcaaagggatcctctaatgccaaaaaaaaaaacacaaacaaggtgggaaatcattcccttggagtatgatgggagcttaccgtgtgcctggaactgaagtggatcttgagatgagctatctcatttaataatcctaacagccctgatattgtcccattttatactcaagggaccgaggttccagaaggctagggaatatgcttgatatgtcatcatgaataacggatagagccataaaccaactcaaatctacttaatgtcaaagccagttattcttaatagacttctctgatggatgagggttgaaaaagtcctgcccagcaatagggggaacgactcaaagacagctagagggctttgccagccagagggcatgcaggaactctgaagtggtgggttgttaagaactaaaatattccatttgcaccgcagagctcagaattaatttccactgtcctgatggagcaggtgggaaggaatttgacctctcccctttgcctagaaactggtcctttctggaagcttctgagcttgctatggaaaaaaaaaaaatttttccacttctttcccctgctaccttattttcttgttctctgaccatttatctcaaacaaggaattattatctttctaatgaagccacagtagacccttcatttatcctaggatatgtcacccctacaattttctgtgaagtgtttttttctcaaaagacttctgaaattgaatttcttacgcatatgggaggagaatgatctttatgatgacacgatgatcttatccagcaaatatatttccctgtagatccctactttagcagatggcatgatcggggtgctcaagctaaacacttctttgtcctccttaattcctctctcatgggcagactgctcccttcctattctaaatcaccgtgtcttgccatgcctctccgatccatccactgcctccatctccatcatctctctggtccaaacctcatccgtctctcagacaggaaaccgctgtggtttctgcttggtcaccccactagctgtgctcctacctcatcgtctgcagccagagtaataacttttagtacaaatctgatcatgtctgagctacttaaaactcttctgtggctgctctgagccctgcacataaaatccagaacccttcacacaggctaccgtatactgcgcgatctttctttttgctctccagcctaatttttctccatggtttccttcactgtctcaatctcacccctgcaaaatgaagtagacacatgttcctcacatttaatgtctgcatatatgagattagaaatgggatagtctgggtgtctgtctcacagtgaaagagttttgtttattctttttattttattttactttaagttctcggacacatgtactgaatgtgcaggtttgttacataggtgtccacgtgccatggtggtttgctgcacctatcaacccatcatctaggttttaagccccacatgcattagctatttgtcctaatgctctccctctccttgtctccaccccccgcggacaggccctggtgtgtgatgttcgcctccctacgtccatgtgttctcattgttcaactcccacttatgagtgagaacatgtggtgtttggttttctgttcctgtgttagtttgctgaggatgatggttcagcttcatccgtgtctccaagtgtaaattagttcaaccactgtggaagaaagtgtggcaattcctgaaggatctagaaccagaaataccatttgacccagccatcccattactgggtatatactcaaagtattataaatcattcttctataaagacacctgcacatgtatgtttattgcagcagtaattacaatagcaaagacttggaaccaacccaaatgtccatcaatgatagactggataaggaaaatgtagcacatatacaccatggaattttgtttattctttaaagagctttatgagatacgatttacacagtgcaaaattcacccattttaagtgtacagttcaatgttttgtaagtacatttactgagttgtacagccatgaccacattctaaatttacaccatctttataaccctcaaaagatcctcgggcagattagcatttcttcccccagttccccaatgctaggccaccactaatctattttctatctctaagaattggcctattctggatttttttttttttttttgagacggagtcttgctctgttgtccaggcgggagtgcagtggcgtgatctcggctcactgcaagctctgcctctcgggttcacgccattctcctgcctcagcctcccgattagctgggactacaggcgtctgccacggcacccggctaatttttgtatttttagtagacatggggtttcaccgtgttagccaggatggtctcgatttcctgaccttgtgatccgcacgcctcggcctcccaaagtgctgagattacaggcgtgagccaccgcgcccagcctggatgttttatatcactggaatcatacagtatttgttcttttgtatttgccttctttcacttagcataatgcttacggggttcatccatgttatagatgcgttgccagacaacatactgttgtgtggatataccatgttgtatttacctctttactagttggtagataattgggttgtttccacttattggctattgtgaatcatgccactatctgcatattagttaagaacatcggaaagtccaggttctctcattgaccatgagcagaaatccagctagtcttttgacttgtctaagccactgtttttttcttccgtaaaatgggaataataatggcatctaccctagaccgggcgcagtggctcatgcctgtaatcccagcactttgggaggctgagggaggaggattgcttgagaccgaaagttctagaccagtctgggagtcagagtgagaccttgtcgctaaaaatttttaaatagcgtctacttcatgggttattgtaaaacttaaatataatgataggagtaaagggtgtagcacagaattgcttgaacctgggaggtagaggttgcagtgagcccagatcgtaccgctgtactccagcctgggcaacagagtgagactccgtcaaaataaaataaaaattaaaaaacccacaaacaaaccgagacaatgagtgtagcacagcacatagaatgtaattagcactccagaagcctgagctattgttataattcctcttttcattacagaaaaattcttagggtagcagttcctggtagttactgttttttcacaaatatgtatttactttttaccaagttctagtcatttattcattcttttcaatcatcctgtgttgtaatcattactttcccattttatacccaaggaaacaaagtcagagtattcaggaatgcacccagggcacattggtaaggaaaagtacagcaggattttccttccttcctccctccctcccttccctccctccctccctccctccctccctccctccctccctccctctctctccctctcctttccctctcctcccctgtttccctttccttcccttccctttcctttcctttctttttgacagtcttgctctgtcgctcagggtggagtgcagtggcacaatctcagctcactgcaacctccgccttccggattgaagagattctcctcccacagcaggagtagctgggactacaggtgcgttccaccacagctggctaattatctttttttttcttattcttcttttttttttttttttttagtagagatggagttttgccaagttggctaggctagtgttgaactcctgaccttaggtgatgtccaccttggcctcccaaagtgctgggattacaggcatgaaccaccacgtccagccaggaaaactacagcaggatttatgagcgaaagcaaccagtgaatatttggaagctttgttcctggtgttcgggagtctgctgtcctctgacctcttgacttccaacccctcgtccatcactctttatcttatccctcaaaaaaggcatgacaaagggtcatgagaggcctggttctgagaatataatcaattacttggcttgaaaaggaaaaaaaaatgtcagtgtttatttgtttttaatcatagggggaaggatttttttggtgaagagtcaccattcaatttcttctgagaaaaagctttatttacatcagtaaagattgcaaggagacatcagaaagaacatttttatagtgaaggttttgagatcctagggagttcatctgaaagacttacagcattgtcactactcactgcatgtgtgtgggcatgtgtgtacacgcgtgtgtgcatgtgtgtgcatgcgtatgtgtgtgcatgtgtgtgtgtgagtgtaggtgtgtgcgtgcatgtgtgtgtgtgtgcacatgtgtacctgtgtctgcgtgtgtgcatgtgcatgtgtgcacgtgcatgtgtgtttgtacgtgtgtggggtgtgtgcgcgcgtgtgcgtgcatttgcatgcgtgtgcgtgtgtgtgtgtgcgtctgtgtgtgtgtgtgtgtgcccctgagtagagctccctctgcagaagtcaggctgaatcatcccaccttgctgactctttctaaccctatgatcctttgcctgagtaggtggggagtgagtttaaaccttatgtcttattttccttcattaatttggccaaatcatctgaaaatcactattctctacctctcaaagatgtagatggtggtactaatttaaaaattgctataatactctaagccatcatcagtatattgttttctggttttcaccttcttcagtatgcttcctatgagacagagttagaagtggaaagaggtgaagatagagatggtgaaagagggtgagagatttaaagccatattcgatcccagtgagagagctcatacagaagaggcatagttgagagagaaaatagcaaaacagtaactaggtgtcactcttttaccagcattcacagtaattgagctgagaaagaggtaaaaagtttttttgagtgattttgttaaccagaagacgtgatttgacttagggtttgtgggggtttgctgtgtgtgtgtgtgtgtgtgtgtgtgtgtgtgtgtgtgtgtgtgtgtgtgtgtccttttgttcctaactggctgtgagactttggtaagtcatcttaaagtgttttttttttttaaagtagttttcagcagagattgccttttattttttctcttctactgcacgatgcaatcaggaacctgtctagaagtatcagaagttgctgctacattttggtggacttgcacctgactcacccctccagcctcgatgcatcgcatgcagttagcatgttcagcacaatcttctctcttgggtttgggcaggcatatggtctgtgcctagcagagctgatattgctggttccaaaaaactgcctgttacatgctggtggtcacaagagaagaagaggtgagaagggctcggagccagacaaagcacgcctttgtaaatgaatgtggagttggccaccagcagtcttcattatccccgtcattgcaggcagctgagctggctttgtgtcagccctgctcggagtagccttgttaattcacccccatgaaaatggaagtttcatacacattgacataattaatgaagaggcaggcagcatgctctaccaattaacaccacagggaaaagtaaaatgggctttcttttggcatattgtgccaaagttaaggactgtaagacacagcaaataaatagagatgcttttaatgagctgcaagatcgagctgaataagtcagaaaggagtgttgggtaaacactgccaactctttgcaccgttaagagtaattgatgagcatagttgaaagtttggggggaaagagaaccgtcggctgctccaaccgtgttcatttataaatgcatctttccctgaaagctactgttaggtgtgtttaagggtgtaatgtgcaagaggaaacaaatatgacagacttgctattttgtagtgcccagaaaatatgaggcatagctgttgtagaaagaacaagcgtggcggatttttcacacttgatgggattgtttttgtcaaactcggagtaaaactggctcctctgccgtatagatccctgctctgagtacaccctggaaacaggaagcagggaatctttaagagtggtattggaatgactccattccttttagaaaagccagacggataatttaatttttgttctctatgtttgtgatatgaaagcatgaccttccaccaaaggatttcccattgtttctgagagtgagtgtatttatataaagaagttttctaaccaaagagaaatctgttggatcaaaaaatagaatgatcagtagggtttagtagctatttaggaaattttctgaattcaaaccaattgaatctgagttcagttggtttttgttaatgtggtgtatcttgttcgattaagccttcattttaaaattaaaggtgtcttaaatggagttgcattgtttgaccttagagagatcaattgtgtgtatcagaccaaacaaaattcaccatattcaacaattgtcctagcacccatctcccctccccactcccgacaaccatcatgacaaaagtgcaggaggaaaattcttgacattagcagacagcatgctctgaagcaagtaagagaaggataattcaatatagtactcgtcagtgggcgtctggtcctgcccatttttcctggctctgacatttcatcatgctgagtgagattccatttctaaacttggtgtcattcatgcaacatggccccaagtataggacaactacttaatctgttgttgctcaaagaaggtgcaatgcattacaatgctagagagaaaagtgttcataggaacctaaagagacagtgtgttgacaccaacatgggacctccctaagcaagttgctgagatttgattatgtgtgatttctgccttatgtgcccactttggatgtaaccctgatgtcaggtgtggctcttggaaacgacactattttctgttgtgcaggtatcattgctgcatcttcctctggttgaggacttgttacctggacttttgaattatcttctttgtacatggggggatggcagtatttctctgattgtgatctgtgaacttgccacaggatcatcttggatcctggctgagtgtggaatttccaggcccacatctgacctatcagggctggccgtacaatcagcattttaaataggcatcttggtatttccatgggattctcttgatctctatccacccttaacatcccatcctactttctgcttgttaagactcaggatacttctgggactgctctatggaatgggttcttaggaattctaaatgcatttgcatttcaaagactgatgagaaagggacacctgtccaggtaagacaagtcatcggtttccaactccagcaataagaacttagtttatcagatgtactgtctaactagtagaggtgtgttcgctgtcttcattaaaatgaagccaggttgatgtgactaaattttgatttgatttgctgcgttttatgtggtggcttatacttgaatgtctctataatatctccctgtgtattttagagagtgtgaattaaaacagctgccttgtacattgtaagtgttcaaaaatagtttgtaaagtgttagaataagggcttcatagccacaaggagggtctcagaaggtgatttggctagattataaaacacaaatattaacttttgacttgtttattctttatttttatttgattatttatttatttatttatttttttatttatttatttatgagacagagttttgctctgtcgtccaggatagagtgcagtggcccaatcttggctcactgcaacctctccctcccaggttcaggcgattctcctgcctcagcttccagagtagctgggattacaggtgcgtgccatcacacctagctaatttttgtatttttagtagagaaggggtcgcaccatgttggccagggtagtcttgaactcctgacctcaggtgatccaccaaccttggcctcccaaagtactgggattacaggcgtgagccactgcacctgccgttgacttatttatttgtaaattatcctgttctccacatatatacttttaaaaagcacttcaaaatttcagtgtggttattcaatggccatcaaagtttgttattctaccagaatggtcttatcttttacaagcgagatctaagaaagcacatacagaggcctgaaaagttgatttccctccttggaggagttcctgatttaacttcataaatccacaagagctgacatctcttcatgtccaaccacaaaatgggtagaaaatgatgaaatgcagaagaggcttctaagtcttggtctgcttctgtgatagaacaggagagaggcagcattttatttttaccattattagccagcctgtcagtcacttaaaatttttccgtgaagacacaaagctaagttttgaatactctgtgtcactgcttccagctgatattataaaaggcagtggtgaggatttcagctaaaaaaagattcgttgtttcaaaagcccagcctgaagtaagacagtgccatagacacgaccacaccagagggcaggtggttcacaaagggccttgcattcttctttgctcttgtttactttacatgagggcaaggagtctcagaagcgtaagatataatactacactagacaggcaagcagacctaatgtgcaaagtctcatgttggctatataggtagtttatatgtcagttccaattatgaatacattcctcagcaactagagttttctcattcattcttactgaactgttagggcatgtggcagcccagagctctgtcaaaatgaattgtcccccttgaaaagttggcaatgcaaggaagtgacaacctaatgcatgttagcactcttgataacaggacccagaggagacggcgaagcaacaattggatatgtgtctgggcactggctgttgttcctgcctgggttcaaatctcctctctgccgcttatgatctgtgtgcatttacaagtttgttagcccccttacctctttgttccttataaggttgtcgtgcaaattacatgaaatgatgttacaggtgtaagccaatgcctgacacacatatgtattctacagtaatcattatcaaagtggtaagcaggaaccagtgccatttcacaactatcaggtactcttctgggtactcatcatgaaagactgcagtgttccatttacaggcattggttggtggtttactaaagagtgtgtttttgtccaagaagttcactcactacattttgctcaaccagtcctctcatttgcagcgatttttttttctttgagcgtcccttgttgtgcagcataaacatctgggctgcatggtcagacccatgaggcttctcttccatctggccacctgttatataattaagcctgattgcagatgcgattctcatttagctgtcagcagcagcctgggagactagcaactgaggtgaataaaggtagctcaccacatctacaagggtagaagggctgaagcgaagggttgaccagccaggacaacaaaggttattgcttatggcagtgtcagcctaagagctcaagttcaagatcagaagcatgagagggtaagacctctaggggagtctgcataggtccaggtgaaaccctgggtgtctcttgattgtcagagcatgtaaatgatttttccgtgaggatagaatttgacagtcagtgctagaaagggcttcagagtttggtaagtctctttggtggactgcatggatagatgtgaaaagataaaccaaatcaaaatgtatattccattgaatcatgacaaattcgcattggtaatgcgaatgatagaatattataggttatgcttaagtgctttacctgtggaagttacttatcagaactccaaattttcaggggcatttgcacagccagtaattgtgcaggagatccaactcacatccacctcagcttaactgcctcttgatgctttcaagcattatgctatttatttcagtgtcttatgtttcagaactaaagaaatgttgaattaaattccccactatatgccgtcagtgtttcagaaaaaaaaaaaaaaaaaaagaaaaagaaatgagcaaggcaggtggatttctggcaaagttttgttttcatttctgtctgatagaaatgggagcacttcctaaaccaaaagagcattttttttttggtagaaatagccatttattaaaaaccataaatctgttatggctggttggtgagcataccttacagtttaattgtaccaagttgaaagtggacacataccaggataggcacacctcattgttccacatgtggcttcagtgctttaatgtgaattataagtacataagtaaagtacatattatttatgcatatgttgtatttatgacctttgggatgcatcagaggttgcttaggctcgttgttctgggtctttcaggatctagattttctatcctgattcttcctttttctaaaaaaaaaaaaaaaaaaaaaaaaaaaaaggctcagttgaggaactcactcagctcactcagtgcaatactataatgggaagagttccatgatgctgccattccagttataaaatggcttcttttagtcatcgtacaagccagcagttatggacagtgtttctctaaatgttagtaataaagtgtagcaggtttcatatcagtatactaattctaccaaaagccattttcagtcccattgacatttgaattctgcccatgcaaattagtggaacttgccatcacccttggcctataatgccccataccaagcatcaccagcccagtgcttctcagtcttggctgcaaatgatcgagctataaaaatactgctacctgggacctgcccctcagtgcctctgatttaactagtaaaatcagagggaggtttgagcatcaggatttctaaactttcagattttcagttgggcgtgtagtggggtgggttagggggaggtaatgtctccaaatggaaatgtctttttggttaaaataaagtagaaagaccaaataagtgatatttggggagagcaatgaatattctaaaaccaatcaatgggaattgtcattttatggttctcctgaatgtgagtgtccaaagtcctcgttattcaaagtgtggtccaaagaccagcctcacttggtaactgttagaaatgcagactgttatgttccagacacacctactggatcagaatgtgcactttaccacgacttccaggtgatttcatgtactttgagttagagaagcactgtcctagtcacagtgatgaggagggtgataagagtggcagaattcactttattgagcctctgctatgtgtcaagcactatgctaagacatttttgtgacatacttctccttaagttgttgccggagttaaataaagtgatatgtttaaaacactaagtgtagtatccaatatcaggtgttccaaaaagggcttatcatcatcatcatcacggtcattgtcattatcttaaatccatggtcaccctaggacaggaagcatgaatctagtttgtaagtgcacgtgatctcctttccatgggtgatatgggttggctgtgtccccacccaaatctcatcttgaattgtagctcccataattcctacgtgttgtgggagggacttgatgggagatagccgaatcatgggggctgttttccccatactgtcctcatggtagtaagtttcatgagatctgatggttttgtaaggggtttccctctacggttggttctcattctctcttgtctgccaccacatcagatgcacctttcaccttccaccatgattgtgaggcctccccagccacgtataactgtaagtccattaaatctatttttctttataaattaccagtctcaagtatgtctttattgcatcatgaaagtagactaatacagtgggccatgtgagatgatgagattgtgaccttacattcaaagataactaagctgtggtggcaatggatgatttgttctcctgaaatctttaggtggcacgggacagaaatccaaatagaattggcgtttgtcaaaagtagaatatattgtactttaaaaatgtgaatgtcagacatttgggggtggggggaggggggagggatagcattaggagatatacctaatgtaaatgacgagttaatgggtgcagcacaccaacatggcatatgtatacatatgtaacaaacctgcatattgtgcacatgtaccctagaacttaaagtataataaatatatatatatataaatgtgaatgtcatgtttctgagatgggtgtcaggaatagctgaatcaaggtgaccaaatggcgatgctctaaggaatgggccttgctgaatctgtacactctgcttttcttggcgtccactttatttcatgtcatattctctccaaatagtggcaagatgctcaccctcaactcaggactgagatcctatcactttgtcttgaccaggagaaaaagagcacctcctttacaatcatgaaaggtaacatcccagggataactctcaggtaccctgtgcacatccctgagccagttactcaagtcagaagcatggatattctgatcaggcaggttggcttcaaggatgaatcaggcctctcatgaactacaagctacggagttctctgaaactggagaagaggttcttcttcaaagaagtgcagtgtgtaatgcccacctgaagagggaaggaatttccagcaggtgtaagggactaatgtccactacaggccctcagttaaaagagttgggtagaaagaggtggggtgtgtgtatgtgcagcctgcattgactctccacttgatgctgtgtacattctgagggcaaaaccctgaattttccttgggtctgccgtaacaaattctctcaatggtgcctccatagggagaaaggggccaacatctgggggttctttcctggaacagtgttaagtgctttcagagttaacaagttttatattcaaacaactccataagatgagtctttcagacttaatttctaaaaccgcaaaaagtactgtagaggagttcagagatacgtctaaagtcacagttaatcaagaggactggtaggattcccagctcacttcaaattcatactcctgtatattcctctttataaataagtcagtgagcaaattatctcattaaaatgtaagtcagagattgccaacttcaggctcacaggcaaatggactttataacttgcagatacagtgggggtattttcatctgtgtgtctatatgtatggatgtatttacaaaataacattttatgtaagaatatgaatttctggcttgtcttcatctctccaggataaaaaatggctaaagttgagttgtggttgtcctctccggcattgcacactttcttcatttcccccagcattcttacctggccagtttctgtcatttatagaacctgtttggtcctggagatatttgagtttgaaaatcctggagtaatagtaccccattatgtcactcatgtacatggtagcctatgcaatgtgtcattccattcttctttaactgttgcaaaacatgccatgtgctctatctgtatatctctctctgttctcactgtcacataccacacacaccccaccccacccccacacacacacacagcaagggaggaatttgcgtttgctttgctcttttctttccctgccccctctcacttagctcactgcataatcctcctctcgtaaccttcaactccacaatgcaggaattttgcatgctctgtccccaaccgtattaataaagcacttaaaagtatgcgattttattcagggttatttatctaactgtctctactgaagtggtacttctgcagctcttcagacgcagtggtttccctgggggcagctttcggagtccgaaagcattgactgaaatgcaaagcccggatgccagctgcacgcgcaagcattccaagcccagtcattgtagccactggagatgggggtgggggatttgagtggatgggtccttccagcgggcatttgggtcatttggcccgtcgccctgcctgcaggctggcctgcacgcagcacctggcctaggcaccctggaatctctcccttcctgtggcagacacaggaaactcctacctcatcacggcagctgcatgtgtgggtaagcccacggtgatgatgacttctgtactggctgtttttactccttgctttaatgatattagctcacgtggttatcctttcccttctagcaggatttttccacagccagacaattctttgcggtgaggaggccaccctgtgctctgtaggatgtttagcagtatctctggcctcaatccacaggataccagtagcacccacccaccaggttgtgatgacccgactttctcctgatactgcctgatatcctctgtgggtgaattttcctggttaagaatcactatcttacaggaaggtggcaaagatgagagtatcagactgtaagttccgcgagagcaggcattgtgtctggtttggtcgtggttgtgtgccaacagatagtagattttcaatacatatttgttgaatgaatgaatgaatgaatgaacttccgactgatcagagctgaggactatattcatcctcaaggtaatataatgattattattcacatattaggaggaaaatcaagggttcctttttatcttctcctactaccccccgctgtcattatcaagtgagttcaactaagatttgcttaatgaaaacctaaatcattatggctctcttaatcagagtacctactatgtggctattctaaataggtgttctcattgaacttggttttctcagtgattcataaagatggttaatagcaatgaaattttacagattgggaaactgaaaaccagagaagtgaaggaatttgtccatggccacacagccgtaagggagtagagacctgattcaaatcttgggctagaaggattctcagaatcttcttttctctttgcacctgattggctgtgcctctcgctttattcagtcaaagctcaattcaggacgacgtgaaagaacattaattccaaggtgaaatgtgcaagaggttaagtgaatttgaccaagtttcccattataatttattttgggggaaaatggattaaaaacataatctctcggttctaacttcacgttcacttgaaaatgaaaagtgagtgttttacagatccacagcttcacgttatctgttgcattttgagagagaagaagatggatgcattggggtagagagtataataatattacaaggctttatatggaaggtcaagtgaggggaagatgagctggaaggatggggaatagcaggctaagaaagaacaatgcataacagatgtatctaaactgtttttaaaaatggttaatagactcaaggagaaatataaagaagggagcactctgaaaggtcagaacaagtagtcaagtaagaagcaaagtaatttaaacataaaaaggaaaatccgcagatatttctttcatgcttcagaaagcgtcggccttaaacattgcagtgtcccagtgatgcattgcaatcttctgcaagacactgaagtattttatgaaggcatactttttcctcctaagttgaggagaccctgagatggcccaaatttcctttaaaaatgaaatgaaactgctcggctttccttacattaaccttaaagataatgaagttttggtccttgccctataaaggatagacagaaagggcctagtcacatcttcctgtcatctatgtagatgatgtccttattcagaagtcattatatgagaatatgagtgttatgggaaggcaggaaggaaggaagggaaaggaaaggagaggagagggaggaagggaaggagagagagaggaaggaagggagggaggggaaggagaaagggagagagaggaaggaaggaaggaaggagaagaaagatggagggagggaagggaaggaagggagagagagggaggaagggcaaaggaagtaagggagagagacgaaggaagaggggaaggaaggaagggagagagaggaagcaagggagggagggggaagaaggaagggagagagagggaggaagggagagagaggaaggaagggagagagagggaggaagggagagagaggaaggaagggagagagagggaggaagggagagagagggaggaagggagagagaggaaggaagggagagagagggaggaagggagagagagggaggaagggagagagagggaggaagggagagagagggaggaagggagagagagggaggaagggagagagagggaggaagggagagagagggaggaagggagagagagggaggaagaggggaaggaaggaagggagagagaggaaggaaaggagagagaggaaggaagggagggaggggaaggaaaggggagggaaagaaggaagggagagatggaaaggagggaaggaaggcctcctcatcctttttttctgcgttcgtttactcatttcacttttttttttaattggacatctgtatatgtcagtcactgtggaagacatttgggaaatgatgactagtaaaaacccaaacaaaataaacaaacagaaagtacctgccgtcgttgtctagtggacaaggcaaaacatcaataattcaataattactccgtgtgttggggcagggtctgttttcttgcagtcatgcctcagttttggcttaacatatcagcttccatagttaacttattcatctgcctgcctctaaatcccacagattttgagatgtagatcagctttgtcctctcaagggtttcacattcaggaaagggctgacccatcaggcatgatgaagcactgcttgacagattcagcctccccagtcaatgaaggaaaggaaaggaaagcaaggttcgtttcatttcccaatcacgtgatggcattgggcactaccactagcttctgatgcattcattctggaacttgtttgtgaaaatcagttgagatactaaatatagaaggggagagccacttggagttgaaagtgacctttaaggccacttctgtcaacttagcaccaaatgcatgaatttacacaactgaatttctgctcttcggacataaactttccccattcttttttggtcagtttgtttttaccctgcagagctgatactgcagagggcagctcattttattcctggactatagttcctcattttgtagaaatcaactttgtcttcccaaggttactggtgttaattttaccttctgatgttaggtaaccagtcactggtttccgaagctgggtctgagtcccagaattcacattgatcagccatggtacctgaacaagcacctctagccccctgagcatcagggatctttccattaagtggagagtatcctccagaatctacctctccagaattcagggtaagataagtatggttgtttggatcagataggttttgtctccatggtagacaagagaccactatagcttaaaactcccattctgccaacagaacaaccgaaagagctagaatacgcttgtttatgtgtttgttttctggtagctgggcaaagaaataagggagggcttggctggtttgtcttgtaccatgtgtttatccttaaaccaatcagaatgaatcaggaatcgactactatcgttcacgtgactaaactggagtattagagaatcagcagggttcatgatgagggagtatagctgtgttcactgcaacacagctcctaagagcaaacagtttaatcagctcatttatcatcctaaccaaacttttaaaaggcagttcctcgggaagttaagcatagaattaccatatgacccagcaaacccattcccagttagatgcctaaaggaaagaattgtaaacagattcacttgaatccacatacacaaatgcttataacatcaccattcattacagccaaaaagcaaagacaacccaaatgcctatcaataaatttatcaataaataaatggatgaacaaaatgtggtctatccatacaatgaaatatcattgagccataaaaaggaaggagctactgttacatgctacaacgtggatggacctcaaaaacactgtggtaagtaaaagaacccagaatcaaaagaccacagattatgtgatttccttcacctgaaatatctggagtaggtaaatccacaccaacagaaagcagattggtggttgctacaggctaggaggaaggggttggggaataaccattaaataggtacagattttgtttcggaatggaatgatgacgtattttggaactagataggggtggtggttgcataacatttgtgaatgaacaaaatgccactgaattgtttccttttttttttgagacagagtctcggtctgtcacccaggctagattgcagtggcacaatcggctcactgcaaattccacctcctaggttcaagcgattctcctgcttcagcctcctgagtagctgagactacaggtacataccaccaggcccaactaatttttgtatttttatgagagacggggtttcaccatgttggccaggctggtcatgaactcctgaaaactgtttactttaaatggttaacaaccaccacaacaaaaaccatggagaccaagggagaaaacttaagtgagatatataacttgcttgagctatgtgttcattttataaaatgggcaaaagatgcctatgtctttaggttataacaagcttcaaacaagtgaatatttataggggaccaggttcctggcaactattaggtgctcaataaatagcctgcatgcaaatacctccccacacacatatgcccacttgtacccacgtaattcttatttaatggtgttcttttaaagaatgagataacaggccaggcataagcggctcatgcctgtaatcccagcgctttgggaggccgaagcgggtggatcacctgaggttgggagttcgagaacagcctgaccaacatggagaaaccctgtctctactaaaaatgcaaaattagctgggtgtggtggtgcatgcctgtagtcccagctactgagaaggctgaggcaggagaattgcttgaacctgggagggggaggttgccgtgagctgagatcacgccattggtcattacactccagcctggacaacaagagtgaaacttcatctcttaattaaaaaaaaaaaaaaaaagaatgaggtaacagaaacaaagaacttacctagcacatgatgttagcaaaccctgtcaaatttgtattcccatatttctcaaaacttgttcttctttccctctccacaccggtgattgttgtcaccctgctttcctggactgctaaaataggctacatttcccttttcaatcccttttgcttgctcttgatgttcccaacagcggccaaagaacccatctcacaatgtacataggatgctttcccttcccagttaaaaaccccactgtacttagagttaatcccaaccaccttcatataaagccctggaagtctggctcctgccaaccttgctaaactcatcctttttttttttttttcctgattcttatcccattgactttgactgtttctaagctggctctatcccaagtgaaaagtcacctcttcaaagaccttttctatttaaaagaattatcccagctcttctatattcttttccatgacatgttattcacgtgcttccaagtcctgatcaccatttgtaattttaaacattgagttgcttttccttgctctttctcttattcatgaaggcagctctgctgttgaacacaatacatggtagacagcaggccgtcgatcagcacttgttaaatgagatcaatgtgtggaaattattattaaagtcctgaaaattttacaaagtctattttgctctaatgtgtacattggtggtatagtctggggaatacatgtatagtttgcattgtggacatccgattgtttccctggatgctgccctttcaacaagaaatgcgaccttagcaaaagatgggggccccatgaacttccaactcgtcttttatttatggtatatgtgtcagagaaacataacaacatttgggaatttattaaatggcagttttctcttcaaattcttgctctagtttattgtgcctaatggagtcttactaagggcaaagctaattgacaacaaggtttatttctgccgatcttagccaaaaagtcaatcaccactcaacgagagctactctgactctttggccaatggacaaatttccatcttgactggcttgactggtcctgggagaatagaagtgaatgagcttaattctattttgatacttttcattttcagcaaaactgagacaacatcaaggagttacattatcatgagaagagaggggttgcatggaaattatgtcacaagaatgcttggtcaattttcattgcattcagctctattcacaaaggcctgttttgctggcagacgcttttgtcagatatgtggctcacggcaggcaatcaagctgtggcatgttgcagagggacagtgagggctcacatgctggaggcagaggttactcaggccaggtaatgaataaccccactggaagagcaaaagagctcatttctcagtggtttatcttccagtgggttggtgttgtgtataatacagtgagttgagatgaggaatctatttggttttggttccacccctttgccagcaaaaccacaaagtgggaaaagctaacctttgggaggtaaaagctaacagtgcaagatgccatcaataaaataagctccctcatcagtgaagaagggggaaccaggctcaaagtttgtcttctaccaggaatataagcatcgtgtcctggatagtatgaagcatttaaccatgaagtcttctgttgcaaatgacatgtgtatacatatgtgtgtgtgtgtgtgtgtgtatatatatgtttgtatgtgcttgtgtatatgtgtgtgtttgtgtgtatgtatatatgtatacatattttatatatatatgtatatatatatgttatatatataagttgctttcaccaaatccttgtaaataccctgtgctgaacggagaagtcagaaatgggtaatagactacattcaaactcattttcaatttccaaaaatatgcaaggcaccccatttttggtacgtggatgttttttagcatttaatggataacaattttgtatgtcccataagaattattcacagacatctcccaattccattttcagagacttactgtagacttgcttttatgcctgtagcttggatccaagaaatttatttctacctctgcagtccaaaaaacggaatgtctaacgattttttgcaaggcaagtcgaagtgctatggtggaattcttcttagcaagacaagcttcagtggaaggaagaatgtaaaacagaaaaagttctttaagaggtatataaatctacacatcggtagtagtcacactaataataaacattcatttggcatcatatatttttaaagtgctttaaaatgttgacattccttagaaaggagagaatagctctgggatgaggatttttattttacatttcagggatgggttacacagaaagaaagccacttgttcattattgactaagtgtggcaaccagtgtgaccattccctagtggtatttttggctcttggcttagaacagggtatgtatccaggaggcaagagaatgagtaagtgacctactgtactgaaaagaacagacagagatgtagtcacaaaccagtttagatgagggacctttgtttgtaagatgtaaacatcgtaaacaaggagatgctggtagtttttgacattttatgggcccccgtagcttcatcgcttatgtacattgaatggatgtatgttgtgatggaaaggcagtggctgcgtttgccctttcaattgatgggcagccatatcttgggatgaattagccttttgtgggatgaatatgatgcctccctctgccatgacatcaagaatatcctctttgagggttggagagaagttgtctcttttttcctgccttgcaatttatatattaagggttgaccaaaaattgttaaaaatgtttaaagctaagtaatatcctgtgctagcctgaactaaaaaataatgccttattctgacaattccagtttttacagttgaaggctattaatcaatgaagcagtgtggatccatataaatattgatcactgtctccttgccctcctgtgaatgttctctcttaatgacagccaatttcaatattcattagaaagggtgcattttctggcttgcaccattgctgattagtaactagagagatttaactagaccatggtcattttgtataaatagttcctcagatcaaaaagatcctggttattgtctatctggacttagcttacctcttcaacatttcagaaattagagtgttttcttgtttgtgtcatatcctgctcacctaaacattgctactgttaagcattaatcttctcatatttaatatataaaaatcaaagtaaatattcaagagttatatttagatctgtaaagggaagcccaagtgctttgtatgaggtgcgaactagggttaataggatgtatttaacaccatattgtttcagctcaagttagggagagaaggagatcatgtatgcaaaaagtagaacatttctccccttcctattttgtctagaggggcgtaccctcttttaaggtattgtcacatgcacaacatctggccttcagttctcctctccgctgtcatgcaatctggcagaatctctttctgctccatggttcctaaatgcatccatcccattgccattaggattctacttttggcattttccccatctgttttggtaattactgtcagatgaactgatatctctaagttgaaaatggccaccttttaaggtagcacattgtagtcaacttcccaaatcatgaagtctatgtggcttttagtagttgtttgcagaagtaatttagtaactttactttttcttttttttttaatttctaagccactgcaagcacgcaccagccttcagtggcctgaattattcagcagtcattaaaaatgcagtcagtgataaggcagacagtccttgtgcctgggtttgtcaacatatcttgtcctcagcaaagactaggttcactggaagcacgcaggatttagttcaccttctctagaatggctgttgttgggaggatttctagcaacattactataaatgatctgcctgcctctgtgttgtggtttataaactctgtgtaactaggataagctggctttggaagaggcaagccgttctttcactagaagggagaggttattgcatcacccatcagcaagagaggaattcaggagaggtagagagctgtgtggggtttgggtggcagccagctactttccaaaacttcccaggggctgcaatacagccgccaacccaaatgtcattgggataggccagcgtgccagatgccatcacagaaaataacttcccttgcctggcatctgggttcttgccttgtaatccagaagaccacatgctggatcagctggtcccagcggggaccatgagctcttccgtcctctctccctccctgtctgctgagcatttgaatgagtcatcagagtgcagaatggattttggccatgcccttaattgagtgttctgtacatacaataataattaataataatttgaactgatccttctatagttttgtctctggaccaggcactgctctaaaggctgcacagattgtaactcatttacatatgtaacacatatctacatatctcattagcctgaagcacaatagaatgagaaaagtgaaaagcaaagtgcttagactctagatttggaccaactggcttcctatgtcaactctgcctctttcagtataggtgactttagaaagtaaattctgctttctcaagccaagcgtccatgcacagacaagggaataaacaaaacgtggtgtatactggaatattattcagccttagaaatgaaggagattctggccgactgtgtggtggctctagcctgcaatcccaacactttgggagggtgaggcggacagatcacttgaggtcaggggtttgagaccagcatggccaacgtggtgaaaactcaactactcaaaatagaaaaattagctggacatggtggcacacacctgtgaagccagctactcaggaggctgaagcatgagaattgcttgaaccctggagatggaggttacagtgagcccacgtcgcgtccctgcacgcaagcctaggcaagaaagcaagaccctgtctcaaaaaaagaaaagagatgctgatacatgctacaacatagatgaaccttgaggacattattctaagtgaaatgagcttgtcacaaaagaacaaatattgcatgattccacttatatgaggtgcccatagttgtcaaattcacaaagacaaaaagtggcatggtcgttaccaagggctgggagaaaagaggaatggtgagttagtgtttaattggtacagagtttcagttttgcaagatgaaaagagttctggagatgaatgttgggaatggctgtgcaacactgtgaatgtacttaacactactcaactgcagacttaaaatggtaaaaaaaaaataaataaataaaataaaaattaaaagaagaagtaaattctgctttctgcacatctgccagctgcccttgtctaagttcccaaaacagattctgctttttgcttccacagagcctttgcatggttgtttccccttcctgcaatatttacttagtactttttcctaggttactctcctcatctttccaaccttgggctacacacgcacctttaggaaagcctacttctgtgttcttcccatcttgtgtacgttccaaattctgaatctccaataaaatgaatatgcatttctttctctctttttttgtaacttttattttatcttcaggggtacaagtgcaggcttgttacataggtaaacttgtgtgtcatgggggtttgttgtgcagattatttcatcacccaggtgttaaacctagtacccattacttgtttctcccgatcctgtccctcccctgacctccacctgccaagagaccccagtgtgtgttgttcccctctatgtgtccacgtgtttttatcatttagctcccacttatacgtgagaacatgcagtgtttggttttatgttcctttgttagtttgctgagaatgagagcctccagtttcatccatgttcctgcaaaggacatgatcttgttcttttttatggctgcatagcaccccacagtatacatgtaccacactttctttatccagtctatcattgatgggcatttaggttgattccacatccttgctattgtgaatagtgctgcattgaatatacacatgcatgtctttttattatcattttctcctttgcctttcctaaaccatgcagtttgatatatgatgaggctacttctaccattgatgtaggtactgtgggtgccaggatgcccaggaaaaggtggaatcagccagtaatcccagcaatttaggaggccaaggagggtagatcatttgaggtcaggagtttgagaccagcctggacaacatggtgaaatcccatgtctactaaaagtacaaaaattagccaggcgtggtggtgcatgcctgtaatcccagttacttgggagtctaaggcaccagaattgcttaaacctgggagctggaggtttcagtgagcctagatcgtgccactgcactccagcctgggcaacagagcaagactgtctaaaaaataaataaataaataaaaattggaatcggctgggatgatacctcaacaagtgaaattgtcctgtcaagaccatttgcatgtgtgaaagaataaaagaaaaacagaaaacactgagcttctctgaggctttattgccccctgataagaccgtgagaactcatttgtcttatattagatgattattttactcttctgggtctttgatctaggcagttagctggttagaatttgctgatgttgtattcatgtttctttgaatcagcagtaactcacttagggatgaaaatggggcatttggcttataagaagaaaacaaatatcatttatattcatttttctacttgaaactactacttgaaaactgggcccatagagttcgttgtgctaaaaggaacatttctcattggtagttagtatttcaattgtaatcaaattccaaaacttcctacctgttgaaactataagatgatggtgacgattatttgagactgagcctagctctgtcgcccaggctggagtgcaatgctgcaatgtctgctcactagaacatttgtctcctgagttcaagcgattctcctgcctcagactcttgagtagctgggattacgggcacccgccaccacgcctggctaatttttgtattttcagtagcgaaagggtttcaccatgttggccaagctggtcttgaactcctgacctcaggtgatcctcccgcctcggcctcccaaactgctgggattacaggtatgagccgatgcatcctgccgaatctataagatttaaggataataataatgaatgtttacggagcagtgttcatcaggtagtgttctaagtactttacatatattaatgatcttcactatgttatacttgtatatcaccatctgtgatcatctgaagcccttacagtttaagggaaaatctgcatttgatacatatagtgtgtgttaaagaaacatgttaaagatgaaggaggagtatgttattttattgtattgatttctgtttctaaatactggggttttcgtggtgttttttgtttgtttgtttgtttttgtttgtttgttttgagacagggtctcactttgtcacccaggctggagtacagtggtatgatcacagctcactgcagccttgaccttctgggctcaagtgatcctcccatctcagtctcctgagtagctaggactagaggcattcaccaccacacctggctaatttttgtagttttgtttgtttgtttgtttgtggagatggggttttgccatgttgcccaggctggtctcaaactcctggactgaagcgatccacctgcctcagccttccaaagttctaggattacaggcgtgagccgctgcacctggcaaaatattgttttttgaaactcttcttgaagtactaatgttgctttagatcttaaacagcagcacaaaaagtttctaactttgttggaacattctacttttcccccacaccttcccaaacaattctcttaatatacaacaatatctgttctggctatcgtgaaaattaagccactggatttgggttggaaaagaaggtttatttagcgcagtttttagtatttatatcagattgccatttctggcttgagacccgaggcagaagtatcccctgcatttggaaaatgaaaaatccactggaggattgattattcataaccctgaaatgtattgccccacctctaccataaatcacacggagtttttattctcattagctgaattctggcatctcagtctcggcactactatttattctaattctctcagcttgagtaatgggtgtggcccaagcaggaagcaggtcacctcctggcccgttggactatcttggaaagagcatgtgattccctgtaggattaggggatttgcagttcaatgggcaaattatgcattccaacgtctaagtgtggttgtttaattaaaccctttggttcattcaagatgactaaaatgtttcttgaaacaggacatcttgaaagttattaaaatttcacagcaaacacttttatggcaggaacttttatgaattttgtttgggttggggcattgcaagagggttacttaaaatgttttatctggaatttataataaagaaaaaacatttcttctttatgttggtcatattttcagtaagagtgcattacaaaaaatctacatctggatgacaaatgtgatacaaatggacaaatatatatgcatatacacaaacacacacacatgcccattttctcatccccccttctttttctctttcaatctgtctataaatgtagatactcacatatacatatatgtttatacatatattaaatatgtaaatatgtatataagtatatatgcatataaatatacttatatgtgatttgtgtatacataattacatgagtgcatatatacctaaatatgtatatctgcatatgcgtgtgtatatatttaagggttttcaactttggccctcttgatactttggattggtaatccctttttttgtgcagtgtccctgaccactagatgctattaccataggcacctcagtgataacaataattgaaaagtcaccaggaatttccaaattttccttctgttgagaacccctgcttattgcttggcacacatgcgcacagagaaacccatatatgtgtaggtcatgcacttactgtaagagacatggaaactactgtctcctagtttatccccaaaggactgacaagagtgttcactgaaaattcagagacagggttgcatgtaaatgtctgaataaaacacatggaaaaataaataataggcatgacatatcatcattggaaaggaaggtaccttctgatgcagacaggttgtgccacatgacagctgtgtgagcttgggcaagaaactagatctctctgagctttagttcttttatgtttgaaatgggcaacatcatgattatttttcaccacttgttgaatttatagatacagtgtacctccccctgcatcctcattacacattgactaaggaaatggaatggtctggaacacgtggcaacttggacatggggaggtctcttcgccattggctgagagtaagctgaacaaactttccatggtgacagctgcaggatgctcagcatgcagtcaattcagtccaacatccgtgcttcgtgatttgcatccatgtgacttgaagcagccagttggaccaggtttctgattgagtggccacgtgcatgatgggttgggttggactaactagttgtctgcaagaactggctaaacggctcagccaaattttctgtttgttgattcagacccgactgactttgccaggtttggactgtgctggtgagagagatatggagtctgcggacagtttgcaagcagtgcctctcgacattttcatcctgcatatggggctgtgtcggccttacctgtctaccttctttatcttcttccttcatttgttctcttcctcctcctcctcttgtttttgttacttggattttcaggatgtcaagccctggcatttttaatataaattggtaatataataatatattccctttattctttgtcattagctgaacgttttaggaatatcaatatagaatacatttgaatgttttcattaaaattgtaacacacccagtattaaatcagaaagtgaatgttcagcaaacacatattgatctcttgctacgtgccaacaactactccaagcacttggcatgaatgtaccacatttattctccaaaccagcctataggcgtggtcagggtgtgccacgtgacagctgtgtgaccttaggccagcaactagacttctctgacctttagttcttttatgtatgagatgaagagacatcatggtcactttgtaaaatttattccaaaacaaaaagatgtggaagaaaggcatattacctttggttgacattatctttgtttgtaggtgaagaaactgaggcttaaaaaattcacatatgttgtggctaagcagaagggctccccaggaagttgaccccttactctttattagtagtagtattaatacattttgagagaggctgtcactctgtcacccaggctgtaatgcagtggcatgataatagctcactatagcctcaaattctggggctcaagtgatcctcccagctcagcctcccaagtagctgggttacaggcgtgcatcatcacatccagctaattttattattctttttggtggagacagggtttcgctgtgcttcccagactggtcttgaacttttaggctcaagtgatcctccttgcctagcctcccaaagtgctggtattagaggtatgagccactgcatcctaccccttattctttgttcttaatgattatgttataatctgggatttcacataatcaaaactcttaatttctaatggatttaagagattcattaaacctctgaagtcacatacaaaactcgataactaacatacatttcttttttcctggagagaatgttcatagcttttaaatcaatatctcaaaatgatctttgttttcacagcaagattaaagataatcattatgtaataaaacttttattttctgtttcttaggtcagtctacagctcaatcttaaacagcagtattgtcatcaaagggtaactccagagaaaaaaaatcagagtaaataaacatttataataatatatctttcatcccttcttcagagtctgttctaggaaaatgccaaagtattccaaaaaaaaaaaaaaaaaaaaaaaacacccttgggcttttcattaactacacttcagtccttgagattatcttgatcttgaaagttgctggcctttgagcaacttcttcaaaccctcaagatgcatccccatggaccatgctggtcctttttcctgagccagccatttcagcacacatctttgtcatttcttgtcatattgagatcaagtttggccatcctctttgcaaaatcatattcagttttcttaagtaagattgtatttttggcatgcttccattagagtcagagccagcggtggctctcagttgcaatgctcctagagaaagggaactttaattaggacacaatggggttggcctagggctcgagttagattcagtattcaaccaatgttgctgcttaagcctgtaaatgtatggtatgcaacttgtgggtactttccagttttcactgactttcttccaatattgtgtagtgtgtaaagatcggaggtattaaatccaggacctgggaggtcatcacactcgaaggaggcaggctgggtcatcagacatatggctgtcttggttttgtttccttgttcccacttctgctcatgatgggcctaaataagagatattcctctactgtaagaaaagctccgtatcccaagtgaagctaattggtaattggtgtttcatgtcagaggcacagtagggagcagtggggattgtggcaaagtgaggaactcatgcctgccttcacagtgcagctgctcctcagctgcataccattttcatgaattagaaatataccagactttctgattgtttacctaagagagtctgaaaagtcttatttctaggtgctgtatgtccatttaattgttgttacttagtctagattatttttattgataacatagaacagtggtcttacatgtctctctagatcctaactaaaataataaatatcttatatttcatttgaaaaatatttcatatagttatagaattctagattttgagtaattttctttgagagctttgaagatgttatttcattatcttttgtttcctgtactcttgagtttttttaaattttattttaggttccaagatacatgtacaggatgtgcaggttcattgcataggtaaacatgtgccatggttgtttgctgtacctatcaacccgtcacctagtattagttgaatgtttgaaactcaaggttaaaccatacctgggggtgttatctggtcttcaattcaccactgttgaccaacagaggctattatgatttgcaaaacgtattttcataatcaacaagacaaaaataaataaaattttaaatctgatttttataacttttctgagaggttaaacttttggagagctagagaaagagctatgctgataaacaagcttacttagccttatgtttttgtttgtttgtttgttgaaagatgtttgcctgctcacttaaggatacttagcattagagaaaagtagcttttttgaaaaaagaaaataacttcgggttgccctttttgtccatcagtcttgcatagtgctttagacagcacttcatacactcatgcaactcttcacaaattaccaattactttcccctttgcgtttatctaatttaatccctacagtcttgcaaatagatattcaattctcccagcccatagcagcttgaaacagttcaacaaacacaattagcccatccctgaaaaaaagtatagattgcagtgtaaatagaaatttgtttttccacttcaagtgtggcacaaattatcacccaccttagatgaatgattaattccacaactgttaagtatgtttttacttttatctaagcaaatattttgagagtttttttcataacttagtttgatacctaagctggtaaatgttttgttcaagtttgctgaagccaagactaatttagaattagggaagttaggactgctttcaaatttgagagaaaatttggaaggaatccttagcctctccacagccaccaccctaatccaatgcaatccaattgcctctcacctgggcagctccagcagcaccctccctggattccctgtctccgtccttgctccctggcatcccccacagcaaagcagccatggagattgttctgaagtgataacccgaatgttttcctcttgaatgtgtgatttttttagtggcctcctgttgaaagcagaattaaatcaaactcgttgttttgctttcaggctctgcattatctggcctctctccagtctctcccttataactgtaccaaaccatggtggcatccttccttttccacaaacgccaagcttattatgaacctagggctttttgttgttgcacatctatttattgtcagactgtatggtcacctcctttttttttttttttttttttttactgagtttgaatgcaattattccttccctttcctccttggtaaaacagaactcttggagttttgttgtgctgactgcggtggtatcagcaccaaggacagcgcctacgtagcacatccagaggcttattaaatatcaggttcaacgactggctgactgactgatcaaagagagctacagcataaaggcttcagagtcaaagttgaactccagttctgccatccacgagacaggaaagttatacaacctccctaaacctcaattttcccattttacgacagggatgagaacagtgtctcccacattaggataccctatgtattcttttcctattggtccccagcaatcacaaatctaattggcaggtaacagtgagcacttgtttagtgcatgtgtctgtagtacaatggggtccttgatttaggctgcactcagtcatgtgtctgcaggtcagctggccctcaagtgaggaggctcagctttggagggaactctggtccctgtgtctcaagtcctctgctggagaatagtagctagtcagaaatgttctcttggtgaaggagaagtgcaagagaaacttctattgtgcaaacgccttcaagcctttaaccgcatcacactcgctgccggttaacattccttaaccaaagcaagtctcacagacacacccgcagtggaggggacactcacagccaacgggtaggaaagtacactctgcccatggaggtggagaaggagcaaatactcctctatggtgatctaccacacactaagagttgtgcaagataatgagtgttaagttcctggtatgtgataggcactcagtaaatgttagctaaagttgagaattactaatttttctgtaagaccctgtgcctgccacaataatatgaaagtaatgaatagttttatgttaacaaaagctaaaagcccccaggtcatccttaaatgaatgtatatcctgattcaggaatgccgtgattttaagaatacattagtgactgcttgtcatttacacatctcttaatttagctgaaatggaatacgggaaacatagcctctttaaatccaggttaagtacatttccattgcagggagcaaggtcggtgctgttcatctaggtattttaaaatgtggttccaaacactgcatgttctcacttataagtgggggctaaatgatgaggactcatggacccatagaggggaacaacacacactggggcctatcagagggtggagggtgggagtagggagaggatcaggaaaaataactaatgagtactaggcttaatacctgggtgatgaaaaaatctgtaagacaaactcccatgacacaagtttacccaaataacaaacctgcacatgtacctctgaacctaaaataaaagttaaccttaaaaaaatagaatatggttctggaaggaagaataaccgctgattttaggaagaactgtgaatgaaggcaaagacttcagagggagatggctctcagttttgagccttggtttctttatcagttagggatattaccagctctctgatagggtccctgtgatgtttagaaaagggtctacaaaccattaacacagtgagtggcacatgaacggctttgcaaattcttgctgcctttcctacctactgctcactcccttccttgttcataaaggaccgtgctgttggccattttgtcgtcagctcttctagtaggatgccctatgtgggtatcagaatacatttgtgcagaatcttctagctgagtcccttcatatctttccagtcatttgggggaaaaggtaggatctgaatgaacagagactttcacgcttacacttgctggcttagctgaattaggggtagcattacttaatttcacccatcacagatggttttacctgtcatctcagccatgagccaccttccttccagaactaggcatttcttctttatggtgagtgaacttagtttttgaccttcctttttataaaacactaatagttgcttataggaaattcaagtactgcagataagcaccaagaaaattagagttgcatgttattcatcatccagagataatgtgaattagcattatcattaattgatttttctgtatgtctaggcagagatatatcagggaaaatgctatttataacagttgcctttttgagtaatcatttagctgtcatctatttgtaatctgtatgtatatcctacctatatacataacaaggcaaatgttgctatgtatagccaacagccatcgcccaagaaaggcgggtagcaccatcttgttctaggagaggtccctttgtctgtggaatcccagataggtttgattttgcaagactgagagtgggagccagggaatacagcactgctctgcataatagagggagggaaaagtagtgttccaggaataggactgataggagagggaggggaagagagaaatgggagagggaaaggaaggaatcaatgctgaaaggaacagaaagctgggggttaggtggtatcaccaccaaccttcagctaagttgactacatttttaaatgtttttgcaagggtgggtttgtttccattcccctcttttttcccttctcttcattgtctttttctttccttcttttctttctattggatgaaccctgaaagtggtgcaatagagaataaataagataggaggagcctggaggacaataagaacaaaatctacctgagaatttgcaggaacctggggacatcactagacttccaagggccatagaaattggagctttataccaattttacttacatcaccaaggagaaagcatttttccagctatctgaattctctgtctttctctctgacttcccacattgtatatcaactgtttatatgttttgtagttttttaatatagctatatattatgaaaatttccttcttcataggcttctttctttaaaaaaaaaaagagcctgtaagaataatgaaagggctgaagaataaaatcattgaatgggtaccagatttatttttatgtattttttatttttggcacagtcccaattgctgagctttttcttgtgctatctctgattttccaccataacaaaccgacagtgatgagcaacattgtgtctatatcttaagcacacccaggactttctggagtcagttcctacaagtggaaatacttgaataaaggttatacaaatgtttaagccttttgatacacattgttaaatgatctcttcagaaaggttaaaccaatttacactctcaacagtagtgtttaagagactctttctctaaatctcctttaataatgaagagaagcattataaaatcctttccaattgccatttttataaaaaatagaacctatttgttttgcacgtatttggtaactctaagaatccctccccctttttttcccatagggttttgaaccagttgtgtttcctctgggaaaatctgcttcttcatgtctttcaagccttttattgattttcgagagaagtatctttatgttttgtttttaaaattcaaatgtggtgtttctaaatggtatgtgaagcatgatttcacttagtagacatttgtggattagccattaggtgaaaaataacactgaagagtaaaacaaatgctttttttgctgttcctgggagcgtgggatgcttatattaattgtttactggtgaccatggatgctgacacaatgattaaatgctttaaagccagcttaatgatataaagccatttcttcatttgtgtcttctaagtgaaatccttcctaagtgaaccacaagagtttcctgcttcatcgcctcagctgcagcctcagctgctgtgattacacttaccttgtctctgctttagttagtttttatcccctccctccaagaaagtaaactacctgaaggcaaagactaagagtatataccccagggacggggatcataactatgtacacagcagacactgagcaagcatttagaggagtgcattttaccattagactcttgaaggacgtcatactgaattttcagaattttttatgtacccagggcattttatgtgaacgtatttaccagggagggtcatgctgtgtatgacctttatgtcattctaccaaagaatcaggcaccaagacagctgcagtttctctggctactctgtttccttcttttagggaacttaggacactgggtgattctttaaaaaaataataacgaattaactttttgaattgacaaagatggtatacatttatcatgtacaacatgacgttttgaaatatgtatatattgtggaatggcgaagtcaggctaattaatacgtgtattatctgatatacatttttgtagtgaaaacacttaaaatctactcttccagtgattttcaagaacatgatacatgtcattaactatagtcaccatgttaaacaaaagatttcttgaaactattcctcctatctaactgaaattttgtatccattcaccaacatctccccaaccctcaccaaccccaatcccaccccagcccctggtaagcaaacttctattccctacttctatgagttcaactatttcagattctacatgtaagtgaaatcacgcagtatttgttcttctgtgtgtggcttatttcactcaacatgacatcctccaggttcatccacagtgttgcagttgacaagaatttatctctttttagggctgaatgacattccattgtagatacagagcatacttctgtccgttttttttttttttttctgtgggggatggagttttgttcttgttgcccaggctggagtgcagtggcgcggtcttggctcactgcaacctctgcctcgtgggttcaagtgattttcctgcctcagactcccaagtagctgggattacacgtgtctcccctcgccgccatcaagcccagctaatttttgtatttttagtggagacgaagtttcaccatgttggcttgcctggtcttgaactcctgacctcaagtgatctgctcacctcagcctcgcaaagtcgtgggattacaggcatgagccacagtgcctggtcatgtccattcatctgtcagtgcacgcttaggttgattccatatcttagctatagtgaataatgctgcagtgaacctgggagtgcagatatcccttcaaaatactgatttcgtttcctttggatatatacacagtagtgggattgctggagcatatggtagttctatttttaattttttaaggaacctccataccatttttttcataatggctgtactaatttgcattcccaccaacagtggggcactgggtgattcttaaagagagtcttcaaggaaaatgcaaaagctctacagtatttgggtggtgagacagaaagtggagaaggatattgtgttctagcacactgcaaacatggttactgaatttgaaattcagaaggaagagaagggatttattttccagctcagaattgcaggtagagcctagctatgagaactcctatttcttacatcatcaaaaaggaggaaggagctggttctcctttgagagatttttgtttgtttcccccatatctccattcatttattcgttcattcaaaactttaaattttaagcttttcctccattgacttgaagtaagtggaaatataacttataaggaaagtggaaaacaaattacattcaccactctgtgcttgctcattacaagtaaaggttacacatctggctggggcagaggtcttcaactgacagttcctaggccttttgtactttgctgtctttttgctgtttcatgttggaattcatcgtcagcactgaagtatctggaaattttgcacagatctttatatttctggcttttcattaaaagttggaagatctgacaaagcttgtccatcatccaatataacagcaatctgttgagctttggtagttgttaaatgttttgggtgtagcctgagtgtttcagttaacctgctttactcattggtgtcagctacttgtcctagacgtaacctttttcatttacatcctttttttttttttttaaatttgagtcacccaacgctaaaggtatttaggttggctattattatttccacttttgatggcattaggtatctctgggctaatgttacatagtaacgtcagatctgggatgtgaacgtggtacctaaattcagaccaagtgatctttccctaactcatatgacctacccatatttggcagagccgttatcttagagcctccaaaaatgcatgtgtgtaatcacacacattttgtaaattttgtaaataagcatgcacatatgttaaaggaagttcagcatcttgagcctctgataataagcccttctgggtaaatgagtgttctgcatcttttccatctttttcatttacgctcttataattacctttaaacacagcatcactggacacagcaaacatatctaggtcaatctgtttgcattttgatggctccgctggataaaatctcttctccactttcttgtttctttggaagaagcagagaccaagacaaaagaacctgtggttcatagtggcttcaccattcacaggtattctcctgggggtcaaatcaacaaatcattctgtcagttctgtggagctattcagaaattcgtgttgatgtcagtggcaacaaggaagagcggagacatgtcaggctttggtttctggttcattttcactctaactgctttgcatggtgttctccggcttgacaacccctcaacctcttccttgtccttagggtaaagtctgagttcccaacgagacttcaggatcaatcctctgcctatctatacatcattgaccttgtcatcacttcctttctaaccatctgcaaaacattaaatgcactctcacctctgagtcatttctggatgtctcctctgtctgaatgctctcatttccagcctcttttcctttttctgttcagctcatttctacatgaccatcttgcctatgctttgacatcacttctccttaccctacttctcaggtggcctagaaacccctactccatcaccacatagtattctgtgtcgatctatggagcctctcgttacttaccttgctgcctccttgtgactgggagttcatgatgggaaggaatcttttccttgtgtctccaacactgagtccaaggtctgcacatgagagctcttgagaaatgcatattggaggatttaatattttgttcgttcattacctgaatctgaagagtctttatataggagctctcttgtatctagaaaggggactattacagtgtgagacagcaaaggaagaattgccttgaaaatacgttatggtgttagcagggatggaaagtgtaaatcctcctaacatgtttttgagagtttacttcactttgggcattgtgttgttgtgctaagaatgccctttacttccacctgttattttaattctcacatcaaccctgtgacccccttgtttgtcaatgagaagaccaatgagaaaagaaatgaaatagtttgcctgaaatcacacagttcattgttggagaaacaaggatcccagaaggagctgtttggcagcaaggactcatagtattaaccactccataaagaaattcttgactcatttgcctttagcccttttcttggattactaattcagcaggaagaccaaccctgggctccttaggttaatcgggtttattggattatctagcacatttcttagattatccaagctggaatctccattgccaagatatcactggcctgattaaacaagctgcggtctctaaagactccaaatgtcatgttcctgtctctctctctctctttttttttatcaatatatgcccattttaggtgttattttattatttctctaactgtaccaactcatcattgtgttccaaaggacctcccaggtatataatcctctctgttgctacttaaaagaggaaaaatttttcttttcaatcctgtcttctgattggaggtgaaagccattcaaatctaagttagaaagacattcacaagccatttttgcaattgttattatcctaaaactaaattataggcattacgtctctgaagcattattgctcatacctagaagggtgctttatgttgtatttcatacaatgatgaacaagaagaaaaagactggaagtttagaatgagtgattttggtctgaaataggtatgaatttttcaagaatgtggtcactgcattttgtaccatcatttctctagacatttcaaatttcaattcactcattaatggctcaaccgttaataagaaggtgttttccacagttttcttgagttttatttgctgttgtgtcctgagtgtgcataattttggaactttataacagtagtgtttttaatattttattcataatattaacgttagctgttatttagggagtatccccaatgtgccaaaaataaccccatctccgatctttgcaacactgttgaaaaatagaaagatagtttctattttagacaatgaggctgagggtagagatatgacttgcttagtgataaacagctggttaaagcctgagacttaataggaaccaaaaattgcctgaccttaaactctgtgctatttccattctatcacactgctgtggaaactttgagtacaaaaagatttcgttaaaaggatgttaattgcagagttgtaataatagtgactacttggtaacaatataagtatccactgataggggattggtttaataacattttgttatatccacataatgcaacattatttaatgtttaaacatgcactttaaaaataagtgaatatgtattgccatggcaagatgtccagcttatatttagtgtaaaagagattgaaaaagaatttgcaccacattatctatttttaaagcatgtttatatttgtgcatgcatgggcgtatccctaagcaaggtctggaccagcactgttcagtagaaatataatgcaagtcacatatgcaaagtaatttttttagtggttgaattaaaaaaataaatgcatgaaatgtttgttttaataaattttacttaatatatccaacatatttcaatatataatcaatatagaaatattaacaatatattttacatttttttgtgctaaatcttcaatgtacatttttatactgacagcacgtctcatttcagatcagtcacatttcatgtgttcaatagccacatatggctttccgttaccttattggatagcactagtctagaggaaatataataagatcataaagtgttcactttgggatggggtgattatgtgtgttggtgttagtttattgtctccttttgtcttatttgcatttcccaaatttccataatgaatacatactgcctttgtaatttggaattaaaatacactgttaaagtcatcattcatttttaatagggagtggtgagcttctaaaatgcactgttaaaaataaatacatagaatgtaaatccgtgacctattttcagtcgaggcgagaagctggagatggtatgaggttggctctcctctttactcccttgccttccagctctgtaacccctgctcccaaaagccaggcctctggggttctgatgaggggagaggttaagcctcacctccacagtcagcgagcagatctctgatgaagccaccattcctaccagaagttctgaggtttggcctcagattcattttcaatctctttgaaagacaaaggcggctgtcatgggagaagcctacactagtttgtctcaatcttttatggcattattgctgacctttcaccaaggagcctttttagaccttttttcccttcctaatcaccattccccttccctcattaaattttaataccacacatacactgtatgtctgtttataccatgtaaactgtgtgtgcgttgatgtatggtggccttctggatggccacaaaccaaagtcatatctaaaatttcttaccctcttgtaactaagaatccatttccacccctttagggtaaataatcgctccctgtctcattgagaaggacgcccagggccatgttcactggtgccaaatgtcagtaatacggttgtcctgtgagttgcatttaacttcgaatcttggaccagtcaccagctctctcaccgttctacgcacacatctttgcctttgtggatacctgtcacttccctatccccactagggcatctgaaagtccatcacacccgggaaacctacccaagtctctctccctgaccacatgggaaacagcctttctgtttctcctgtggcatgtgtcatggctggcattctctgttactcgttctgatcctgtctcctctccccctctgatccgaccctcctggagaatgggatgctgtataatttcatttcccgtgtgtgtctagagccgggctttgcatgccatcgtccttcagtgaacagttgtgaaactgaacgaaattgccttcggaaaaccctttccggtccaactgtttctctatcagaaaatctcattaagacttaatcgctaacatcttcccatccccggggtcatgctgtaatccccagctgagagtgcgatccctgactgggaggaagtgagagtatcatttctttcccagaacccacacgcttcctgtgtatttcccaccacccaaaggtcaccacctggggtaaaattacatgcaacctcatgagacttgctgcccctctatcttccctcttttatttctgaagtcactgtagggaaaatgtactgattgcaaactgaaatagcagccactgggagctggactggtatggctgtcagccataccccccgggtttcacctgcttaatgagccggtagcccatgctttatccagtagagacctcactgtctcccattccagcccaccgttgcccacccttgcttatccacacctaccaagagccccttcccgagaactgctcttccaaagtgagattgtactcccaaccctcctctgtagccatccttgggtccagtgtttatttctttgtggccaggaaatctctcccttgctctgttctgcatagatgttgcctgtgttagaatttcagtagaactctgcagatttgaatggaagatttgagggctgcaagagctatcatcgttgatagcaagcatttagctaaggaaattaaattggaagtccttgcattctggctggattctgttactctttgggcagggaatgatttggtttcaaggagattccatcttcgtatctcctgctttcaagggaggaaagggggaaagaaagctgaacagagcctaatgaaggaattctgtatcgacacaactctgacatttgagatgttcaatgtaatcagcacaactggtagctttaggcattgatcactgtgctgaaatataaaattcagttggccatattctgttcatgaaaatgccttttcataattcactgcttccagaggtaccagcgataatttcttgactattttattctggagagctttaggtatggttaacaatgtgccatgtacagagaggcatgtatgcacaccataaagatcttaaatgcattttcagttcagtgtccttcttattaattattctagtcactttaatttattcagcctccgtattttatacattaaaatgagtgaaaatgataagaaatattaatggttgtaattattgactgtatatttgagattcatgtctaaatacacttaacttgggaagatttgacattctgtttcactgtgtgcattatttgcctgtttcatcttctatattctcctaaaccctctctctctctctgtcaaggggggaggcgaattactgcaagtagattatgaaatattgttgtacatgcacgtaaaaatatatcagtactggcacatctgtaatttactcataagtatgagattcatattagagatctatatatcatataagcaaaataatatccatcctgtactatattattttactaacatgatggctgaatttcaaatgaactgcaaaggtcatggttgctgttctattagagccatttaatctcatttgtctccccattactaacctcaactttattagttgctgcaactactgctgattttgaaccgagaaagggttcctctaactgatgtcatttcatgctttgaatttacaagtaagagaccctgatttaaaattattagggctcctgggaaaggagaacattaaaagtttgcagtggtcctctggtttcccataaggtgaagtttttagatggaagaaagatgggtcctgtttcacctatgacatattgcatacctttccaagcccttgtattccctcacctcttgcccctcttcaaactagtgatcacgtctacctttgagaaaactagtagctaaaatgaaacaaagctactttatgaaaagtccatgagaagcaatttaacctggttgaccatctccatcaatctgtcacctggagagaagctgttgacaccacatgacctctcctccaccatcacgctatgaagttatcacttgagtaagggctttctctttgatgctatacaattaaactgaaggaaggaaggctttcgctagtaggaaagcaactgcaaagagaggcttaaaccctatggaaacaccttcccctctcaggcacacacatgcaaattatctttaaccaaaagcgaatgggttccagtcgttcagcacacatcacatataagatattcctagggcaggaactttttttttaatgagtgagacccctgtagagttcatgccattgcataaaatattgcagccatttgcatttaatggtgatacaaatactgctttgaacactgggaacatcatttactgagagaaacaggagatagtcagtataaatctccaatgtaaaaaaaaaaaggattaagataaaaagtagtttaaactccaacactttctctgtattttttattatttctaataaacaagcctatagcttttgaaattttatcactaacttgagaggtgactgttttctgatgtttatacatcactcacttagtcatgaacttgtagtaacaatgccacatgctttatcaatagctggtgagttaattgggagggagggaaatgttttcttaaaaaactaccttttctccagaaaggataattttatgtgtgtgtaataagaatctagtatacctggtgtattaggtgcttaatatattgtaggcccttggtaaataattctgggataaatgaatgcctgccaatttatactgtcattatccctcccctccctgatttagtaatttcaggctcaagtagttgatcccaatgcttttgtgcaatgtgtggcttgtcttttgtcattgtttataagctccataagaacagagactgtctattcactgttttgtttctgtaaatatataaccatatattgtgtatatggatccttaagcatgaaggcttagaggagataatgaataacacttttatacagaaatcaaaccaagactttcatatcattatggaatcacatgcttttagcgtaattaaagttgttgcatatagaacaaataagactgcattttctttagctgttaacttggacttgccagatatccagacatgcttcacttttggtttgaattaacaggtgaaataatacagtgtgtgttttgttaaaattttattaaacgccgctcttaaaaattaagcaagaaaatgaaagaaagaaacaaaaacaattaaccaaagatcacccacaaagctcccaaactgttttgttctgggtgctaaggcactgtttgattttttttttcgtgcatattgatgtactctttccccgttaactgcttctagtctccctggacctccaaggctgcatcttcagggaataactcatcgcatctccattatgtgtcatgtagagacgctatgtaggtaagataacagagtctggctaaagggcacgtttggtgttatattccattagtttattgatttttttttaagtttctctaatgttctaatgagaatattttccactcaatcctgaaggagtccaaagctttttacgaacttcaggatagaacacacagggactgattccctaggctgccgaacagcagggtccttggaaagaccaaatggaaaattgcttttctatgaaccccaggtgcaagagttagggaacccctatctaattaagagctgggggagttctgatgcagtcactggggttggacccatcattacggtgaatgctaggctctggccaaacacctacagccccttcaagggtcaagaaagttcatggcaaaagatttgagtcacttcaggggatggtggaagtttctcccaagcctaccttggcgtctatgactccacctgaaaaatggcccaaaatggacaataaaggaatttggagggacaatggcatcaagtcaggacttcctctgtaggacacatatccaaagagccaacccactagagctccagccgcagttcttgcttgttttggctgtgtgaatttgggtaagtcacttagcttctctgagccttagctttcaactttgtagaatagttctgagcattaaaggagacagtatatgatgtataaagtggaattgatgaatggcaggttctcaataaaagttggcttgtggttatatcattatcatcactactactgtcatgatgtccagacatcaaggcagcagaatgtgtcctccatgtgttaacctggggcccagcctctatttggtgcctaatagttaaaagttggatgcttgttgagtaagtgagtgtatgagtcccttgtcgtctccctgccaaagggaacacttgatcagcataggagataactaacggcagtaactttgctctgagctcttgcttcttcatcaaaccgtgctttaaagacttccctgtgcagaggcagtatagaatgaggctcaggaactcaggctctgtaggctctctccactcacctctttatgtgtctgacaggatgccagtccaagcatccttttccttattgataaaaataggcatcatgataataatagtatctacctgataggatggtgaggacaacaaagtgagatcacgagagcctgacactaagaatcccctggagagctttgaaagcattactgatatccagaccctctccccaaagtcttggattcatttgttcaggaggcaaggttcctttgggcatcaatagtgtgaaaagccctccaagtgattctaatttagagcctttgcaagtcactagttaaggggtggtagggtggctgttgttaaatcatcctaactttttgtcttttcctgattatccctttctctgttggttcctttttcacatttatgggaaaagcaattatgtacctttttggaggtttcactatgttttccttttgctgggggtaccatttctgggaaatatgacacagagaaactttgtagtaagtgaaaggtaaatatagttatatatctatagatatggatctgtatattgaaatttaggaaatgagttatttctactgcagtaagccacattttcatgcatgcatagcctgccattttatggttgctgttgttaaatcattctaatattctgtcttttcctgattgcccatttctctattttttttttcatattaatgggaaaaccaatcatgtacttttttgaaagtttcactttgttttccttttgctgggtgtaccatttctggaaaatacggcactgaaaaattgcaataagtgaaaggtaaataactggatatatgtctatagatgtggatctatgtattaaaatttaggagatcagagttattcctactgcaatgagccacatttgcaggcatgcatagcaccccactttgtggggcacccattgctcctcattctgggtccagctttgattccctgtggctgctgcagtctctggctcatctctgcagctttgatagctgtctcaaatacaatctgcaatctatcaaggagggcgtggaggtgtcctgaataatcagcaggtgtcttggttatcaccaaggagagggcatcatgcccggcatgcatggatggcagaagagttactgcaaaggcagttgtaagctcaggaatccaattctttttctaagttagtgctgaaatgtggctgactcagatgtggggtgtcaggatcatagataggacaagagagaaaacttgtgttcttatttgaaagccacagcctgtgtggagaggcctgcagttcattgccactggacaagagagtaaaatttctgggacctccacttactctaggaagtgttagagggtgataggaaaggagtttgtgcagacttctgcagcctctgcaggtggaatgactgttctctcctctagtctcttagagtctgtccacaacctctgaatagcccttattccttggtgagtcactcagcaaatgagaaattaaatgctattgtgcatgctttatattatgtgtatttcttctctgttacattctaagccacttgatggcagagccgtgagttactttgctcaggatattcagcaccaggaaggtactaggcacacatccttagtacccaggaagcacaggggagttgaagatgctttgaaagacctgtttggcccttcaggtagacatgcatgggccctgagaagccccagaatttcgatgttctcaggaatcatcaggagactagaagacattgattctcaaccctggctgggtagcagggctccttggagagttttaactagtcttgatgcctggatcccagaagagaccaatttaaaccagtgtctctggatttggagccagagtacctacagtattgtagttccttaggtgctttgggttcaggcagggctgaggaccacagctccataataaaaggatggctgagctaaaaggggtgataagaggtagaaagaggctgggaacggtggctcacacctgtaatcccagcacagagaggccgaggcaggtggattacatgaggtcaggagttcgagaccagcctggctaacatggtgaaaccccatctctactaaaaatacaaaaattagctgggtgtggtggcacgtgcctgtaatcccagctgctcaagaggtaggctgaggcgggagaatcgcttgaacccagaaggcggaggttgtggtgagctgagattgcaccattgcactccagcctgggcaacaagagcaaaactcagtctcaaaatatatatatataaattaaaaaaaaaaaaaaaacaagtagaaggaaggagtgatacaactgaaaggagaaacaaaacacagaaagatcttggcggttttgttacatcttcagccccatcaaaccaacacccttcaagctagacactttgcttttagcattttgtcattgttaccctgtttcttactcacagtgatcttaaacaaaatgactaccctctttgtagcaaaggaaaggaagcttataaactgatgtgctaggctcctggactccagacctcaagcacttagccagtaaactgtgttccttcaaaaagacaaggtaaatatgaaggaaaaagggagtgaactggacagaagaaaaaacaaaattggtaaactcaaggaaagctgataggcactaaagcaaaaacaaatgagcagaattcatagttgttgagggcctccaagatcttatgagaaactcagaaggtgcaaagcagacccagtcatctccagcttacaacagatctgggatggctcacagtagtccagtgtcttgctcaaactcacaaagctaagtctctgagctagtttttctgtaagggccaaaagctaagtatgttagtctttgctgaccacgtagtctctgccacaagtattgaaatctggtattgtggcagaaagtggccacagatagataacatgcaaagaaataaatgtagttgtattacaataaaatttgatttatggacactggaatttgcatttcatgtaattttcaggtgtcatgcaatcttatttttctttggatttttctcaacttttttttttaaaaaaatgtaatcaaccattcttagctcttggctatatcaaaatagatagtggggcacatttggcccttaggctgtcatttgccagccctggtccaaactttaaagtacccagagggtaaaaagttgatgagaaagcatagaaaaaaattgatacatgactatttgagacatttacccccagtccaccttcccacagaaagatccatcaggccaagagtccaacactttccatcttccatgactcaatgccaccaagcagttatttgtagaatccatttgcggttttcaaaccataggctctggacttcaaagcaggccagtcccattctttttgtcttgaaatgagtataataagctcccagaccctttgttctagcaatatttattgaattactaataaagactagactctgttctgcgcactaagggtgcagtggttatcttagtctatccagttgccatagcaaagtgccatagacagggtggcttagacaacagaaatcttttctcttgcagatctggatactggaagtgagatcagggtagtaggatggtctagttatcatgtggtctcggtggcttatggatggtggccttctccctgtatcttcccttggcagagagaaagagagagagggagaggaaagaagtgggtgtggagggaagatgtcttttctttctttttctttatgttttcttttcttttctttcctttattcatttatttatttgtttatttatttgtttattttagatgtagtcttgctctgtcacccaggctggagtgcagtggcacgatctcagctcactgtaacctccgcctcccgtgttgaagcgattctcctgcctcagcctcccgagtagctaggattacaggcacccaccaccacgcctggctaatttttgtatttttagtagagacgagtcttcgccatattggccaggccggtctgaaactcctgacctcaggtgatccgcctgccttagcctcccagtgtgctgggattataggcgtgagccaccatgcctggccaggtgtcttttctgataaggacactaatcccatcaggagggattacctttgatatagtttggatatttgtccccactcaaatctcatgttgaaatataactcccaatgctggaggtggggcctggtaagagctgtttagatcatgggaatgggttcttccttgcttggtgctgtcttcacgacagtgagtgagttatgagatctggtgggtttttgttttttttttttttttttttttttttctgagagggagtcttgctgtgttgcccaggctggagtgcagtggcgctatcttggctcactgcaagctccgcctcccaggttcacgccattctcctgcctcagcctcccaagtagctgggactacaggcgctcgccaatacacctggctaattttttatattttttagtacagacggggtttcactgtgttacccaagatagtgtggatctcctgacctcgtgacccggccgcctcggcctcccaaagtgctgggattacaggtgtgagccaccgtgcccggccggtagagatgtggtgattttaaagtgtgtggcaccttcccccacgctctcgccctcttgctcctgctttggtcacgtgatgcttctgctctttcctcactttccgccatgacgaaagtcccctgaggcttcgctggaagcccagcagatgcctgcgccatgtttgctataaagccagtggaactgtgagtcaattaaacctcttttgtttataaattactcagtctctggtatttctttacagcaatgcaagaacaacctattacacctcatgccctcatctaaatctaatcacctcaccaaagctctatctctgaataccatcgcgttggaggttagggcttccgcatatgaatttggagggcacacttcactccgtaacaatggtatacaaaataatgaggtttctgtgttcatgagcttacattctttatatttgacaataaaaaagtaagcaaaaagtaagaatttttagctaatgttaaatgctacaaagggaaaaaaaataagaaaacatgtaccgattacagagatgaactgggacaggaattacaagtttggaaactgttttcagggaaggcctgtttgagcaggtgacttaggactgggggtgagtggtgtggaagcactcctggaggttgctggggggagactggaagactgagcaatagggagagagaagatcatgttcaaaagggccactgagaccaaaaagctccccaaaacaaaaacaaggttcaaaagggtgagccagcggggtagacaggaggccagcatacctgaggagagtcgaagtgggggacagtagctcccactgtggagagtttgagtgttacctattaaatgcaatggggagctgggcacagtgtggcttatgcactttgggaggccgaggtaggcaggttgcttgaggtcaggtgtttgagaccagcctggccaacatggcaaaaccctgtctctactaaaaatacaaaaatttagctgggcacggtggctcatgcctgtaatgcgagcactttcggaggccaaagggggcggatcacttgaggtcggcagttggagaccagcctgggcaacatggcaaaaccccgtctctactaaaaatataaaaaattagtcagatgtggtggtgtgcacctgcaatcccagttacttgagaggctgaggcaagagaatcacttgaacctagtaggtggaggttgcagcgagccaaggttgcactactgcattccagcctgggcaacagagtgagactctatctcgacaaaaaatttaaaaaaataataaaataaaatgggaagccgagcacgatggctcatgtctgtaatcgtagtactttgggaggctgaggtgggcggatcacttgaggtcaggagttcgagaccagcctggccaacatggcaaaaccccatctttactaaaaatacaaaaaattaactggttgtgatagtgcgtgcctgtagtcccagctacttgggaggctgaggtgggagaatttctggaacctgggaggcggaggctgcagtgacctgagattgtgccactgcactccagccggggcaacagagtgagaccctgtctcaaaaattaattaattaaaccttcaatgaggaggttttgttgagtcagaagcacttcagtacagtcatgcagcacttaatggcaggggtaccgctctgagaaacaaatcgttaggcaatcttgtcattgtgcaaacatcagagtgtactcacacaaacccagatgctgtagcctacgacacatctaggctaggtgatctagcttattgcatctaggctacaaagctagcaggttagtgtgctgaatatggtaggcatgtgtaacatcatggccagtgtccctgcacctcaatatagctaaccatagaaaaggtactgtaaaaatactgcattaacgtcttatgggactgctgtcctgtaggcagcctgtagttactgaactgaaatgtggttaagctgtgtaggactgtgtttgcattttcaaaatattttgggtgctattcagggaacggacagtagggggcaaaagtggaagtggagaaaccaaggaacaggctgctgaagaagtccaggcagccttggaggactcgctctcactcttactggttttcgatgcctgagttacttgctctctgggagaaggaagcaggtcgttcctctgcccaaattgctgctactcaggagtgcctgacactcctttccaaagatgctctgcggtaatatgttctaatgaggagtttgaattgccaattgacttgctctttgcagctaataaagaacagattatgcgctggatggtttgcagttggtggccaagttgtcttgtgattattgtaagttcttttagttgagcttgtgtaactgtgagtcaatcctgcccatgttttatttggaaattagtactagagcctccttgggactagcctttttctcacccaaaggcaaaagaatccatctcggctgggcacagtggctcacgcctgtaatcacagcactttgggaggccgaggtgggtggggcggatcacgaggtcaggagttcgataccagtttcaccaacatggtgaaaccccatctctactaaaaatacaaaaattagccaagcgtggtggcaaatgcctgcaatcccagctactcaggagcctgaggcaggagaaccgcttgaaccctgaaggcagagtttgcagtgagccgagatcacgccagtgcactccagcttgggcgacagagtgagactccatcttccatctcaaaaaaaaaaaaaaaaaaaaaaaaaaagaatcagcctctggatcacattaaccctcacagcccatagtccttcgtcttcctctgaaaaaatatgaaatattaaagattcttaaaccaatgagcagtttccggttattccagaatatacagcacgttggtgacttgttccacattttctttttctcttctcagtgcttcctgctagacatagacacatacacacacctacaccccttttaacccattttaaataattctgtttagaaaagcaacatatgatcatttaaaaatattgagaaacacatacaaaagcaaaaatcatccattagctgctcatcacccccaaataatcactttttaaaaacattttgatatttctctttttggggtctctgtgtgtgtgtatgtgtgtttgtgggacagagagagagagaggcagacagaggaaaaaagcttacagtatttgactgatagtgaatttttagaatttatcgtataattttttacttggtattaaaatgtgaacattttaccatgccatgaatcattttgggaaattacatgtaatgattccataatgttctgttgtaccaaaagttattacctctgttgttattgaagaaattttttatctttctcccttactattattaagaataatgtcacagagaattttcttatactcaagtctttgtttacatttttgaatatttccttggactaaatgctaaaaagtattgtgtcagggtcggaagatatgagcatctttatactttgtgaatagattttatgttgctttttgaactggttgtgcccctgcacatcccataaccatagcgtattagcataccgtttaatctagtcattaccaacattatttggtattattacatactttattaatttgataggtaaaaattggtattgccctgtttaaaccttccccttttcatcttgtctgtttcgtaatgccaagagtaaacacatatcatgctcttaacacaatgtgaaatactgtggaaagtagatactactgtcctcattttacaaattgagaagctaatacttctcgttgagaggtggagctaagatgggaacccagtgtaggcaatgggaaccttgagtctgagccttagccagggctctgttccgcccccaggcaggagcaggaacctgagaggaccttctcagttaggtgtgaaataggaaagcagcctcattgaagtaattcacactaacatgtgaatgacctggaagcatctgtctggtttttatgaaaaaccaaacagaattacttgttatttcagataagcttctcctttgtggatggaaatgtaagaagtttaacgcaagtaaaaaaaacatctaacaatgataaaggaagataccatcgggcagattcagaccttatggaaatgtaagaagtttaacgcatgtaagaacacctaacaatgataagggaaggtaccattgggcagtttcagaccttcttgcaatgcagtggtggctcactgctggcccacagactagaatcatatttattcctatgagataaaagaaaataggtcttaaaattcagtgtttaaaatactaaatcagttgctattagacaaacctctactattctaccttctctttaaaaatggaagctctggaaacattcactactgtttctttcagtaattgactgcatctgattaatcccactgatgcttcaccttgcatctgttagctggctagctctcttcttccttccctatcaactttccccgctttctccctttctgagccaactctctaaaacttttctttttgataagaatattatattttaatgaaaatcctttctgtcatggagaatcccctttccatcatggttaggaatggagacttaggggttacggtggggctgggtgctgagtcatttggaagacacacatgtgcaagttggggcctgtgtctttattagccctgcttaaattgctgggtaatttaagcctctcttattttgctgcattgcctcacagttctaaaggagacctgaaatagagtgtatcacattgtgcacatttttgaaggatcatgagagcagcctaaatataaaattcacgtccatattcttagtgtccttttcccctaaatggagacgggatgcacttgagcattctgtcccatgcttgcctttgtctacacgtgtttcctaatgtttgatctctgtcctttttgtatgtgagaacattcacaggcatcttcctagctgcaaaaagacgggcctgggttgcaacaactggatctttgttatttcttggggggagctcgtatcaaactctccccaatccatgtagtgatttttttctacatctaaaaatgatcctttaaagtttcaatgatgccttggtgacccaggaccactgttgtaatttttgccagtttctttgtatcacttggttgatcttgtattaaatgtctaattgatttgtttttttaaagatacgtgcatgttagtataataactagaagctcgatgttatgagttgaagcataattatgcaagcaacttaatactaaacttagaagatacgtgactactaaccaagaccatctgatgtaccattgatggctcaaatgccagatgtcgggaaacagtgatttaaaaggaaatatttcatgggggtcagcataaagtcggtcctgcttctagaaagccacagtagttctctgtatccatagctaagggtctcttaggctcttattgtaaatgtctgggtttcactcaggaaaaaaaaaaaatctcaaagctatggccaaggcagaggcttcctcacagcccatcccctgtgcatatcgattagttgacatccatgagtgccccagtcctgctggaaatatcccctcaggcttgcttttctgtggtatcaccacctattcccctcttgttactcggacctctttgaagtcatcatagtgtttttgggaatagagaataccactttgcagagagagtgatagcggcttgtgatcatatcctcttcatatccccattgtcggcgtttgtaagaccccaaatgctcctgaaaacttgatttctaatggttatgcaatatttaaatgttaatagattactctttgcttgaccatttccctattttattttttttgagaaagagtctcgctctgtcatccagagctggagtgcattggtatcacctcggctcactgcaacctccacctccctggttcaagtgattgtcctgcctcggcctcccaagtagctgggattacaggcgcccaccactacacccagctagtttttgtatttttagtagagactgtgttccgccatgttggccaggttgggcttgaattcctgacctcagtgatccacctgcctcagtatcccaaaaggctggaattacaggcatcagccaccatgcctggcacccgtttccctagtttagacatatatgttgcttcttattctgcatcattcattcattcatcaaatatttataggcaactatcacttgccaggttgtagagaggacaggaaagcagtgctgagcagccaggcctctggatccttcttctccatcaatctgtgaatttttacttatatctgagaagggggagggatggaaggagggaaacaagggagaggagagaggaagggaggaaacagacgcagctgagagctcctgaagctcctgaaacctctgaggagcattctcttgctttgtattcttttcacagaaccagtgactcttgttttcttttaaaatcctctcctccctcccctccctcccttcccttcttcccttccgttcttcccttccttccctcctttcttccttccctcctttcttcctccctcccctccctccttcctccctcacttccttccctgctttcttccttttccttccttctttccttccgtccctccctctctcccttccttcctcccttcctttctgccttccttccttttctttccttcccctcccttccctccctccttccctccctccttccatccttccgctctccctccctccctttcctccttccctctctccctccctttcctccttccctgcttccttctttctccttccttctttcctctctccctcccttccttcctcccttccttcctccctcccttccttccttccttccttccttccttccttccttccttccttccttccttccttcctccctttctctttttctcatctatgagccagaatgttacgctaagttttggaaacagcactctctgctgtgtctttaggatgcttgtttcctgcatgctgaccagacctcctgttggactgatattctggataatggcttggtgcctttctagcttctaatctaaacaagaattatttcattttagattctctctgctgcatcaagggtccctggaatttgatgatgacttaagtggaaatcccagctttagcatatataagctcagtaccatagaccaagtgggttaacctctttgtgccttcattttttcaatggaaaagttgcaaacaagatacttacctcccaggattttcctgacaatgaatgagaaaatgtaagagaaactgcctttcgaattgggaagctctattctgatgaaagatggaccttatttttaaatacaggacgtttagtaattttatctaaattccccattcatcagaatacagtggagaagatatttgccatacccatttcattgtgttgttcataaacttgtttatttttccagggctggattggtttgcctttctctctttctgtctgctactgcataatttcattatctgccatacgtaaatgtattatgtaattctctcagttgtcattgattgcttctgtttttctgtagtattactggtctataatactttttattaaatccccaaggatagttcctgaactgtggttgaaggaccctcctttccactaagtaaaatacaacacttagatatttgaaatgacacaaagtactagagaaaacataagtgtggaattttcccactggctttatgaaatccaggaaaccaattgagatatttgtttatgatgcctttgtctatcctggaggtttctctctgcgttctttcaatggcagtcacagcatcaacaaattatataaaattagctaatgtttattgagtgcttactatgttccgagtaatgttaggaactgcttgcattgtcatttaatcgtcacaacagcctcataaaggaggtacgctttgttatccccattttattcttgagagaactgaaattcagaaagtttaactgctttgctcagagatacacaataaagaagagatgaaactgtaaagcacacccctctcacacacacaccacacacacatacacaactttatgcaagcttagcaaagtcagtttccttcttagcttggagaatacatacatatgttgaatgcctgagagtttgggacttctctgctctgtacttgcttctgacactaaccttaaactaatcacttctctctggaactaggtctacttatgggccacgtttgaagggttggatgaggtcattagtttttatttatttatttatttatttatttgagatagagcattaggttttttttactttttattttatttttttgaggcaaggtctcatcctgtcacccaagctgcagtgcagtaagacaatcttagctcacatcaatctctgccttccaggttccagtgattctcatggctcagcctcctgagtatctggaattacaggtgtgtgccaccacacctggctgatttttatatttttagtagagagtggattttgccatgttagccaggctgtctcgagctcttggcctgaagtgacctgcctgcctcggcctcccaaagtgctggaattagaggtgtgagtcactgcacctgcccaaaagcattagcttctaattgacctcatgatgttcaagaatctgagcaggtggtcgaagggtggtggagaggataggaaggcagtgctgagcgggcagggttctggatccttcttgtccatctgtctctgagcttttgcttatatctgagagggatagagggagggaaagagagaaagaagggatagagggagagaggaagggagaaaacagacaatcgacatcacatgctacactactaactcattcaaaaatagcattgtgccattgctatttcccatgtatgtcattagatattccatgaaaacttgatttctaatcgttatataatattcaaatgtgttaataggttaccctctgcttaaccatttccctgttttagacatgtgtgttgcttctgatacttcatcattcattcatttatcaaatatttatcagcaatgatgattctccagacattaacataagtaagtagggtgtggattttcttatatataaatttttgacatgcctgcatatatgtgcttccataactatatagaatttggtatttttgctcttgctgctaattgctggacttctttagtgaaagattacctgttctggaaagcctgctaatttagatggtaggttggattgaaatctgtgcaaatgatgagcttatctgtttcggggaacataattggagttctggacacactctctcccaggattataggtatgagattaataggcattgttttgatggcatatgccacaagcatcaaaatatccactttgtgaccttcaggcttaaagggatcatcttgaaggtatagctttacatgttgcctagtttagaggtagatgaggctgtagataatgtccactccaacctgtgcagaaggatctgagaggcagccccaggggttgctgtaagacttggtgttgctgactccccttagaagtaatctccaaacaccaccaccaccaccacgaagtgtgtcatcatataaactgaagatagctgagattacacactgcctaaatttcactcagaaaaacatgatagagatcatttctgattgaaaaggcaataaagaaactcctaaacatacctctttgtccataaatggaaaccagacaaatcaggcttgtagatttaaagagaccctgcaaggtggcgattctgaaataccccttggaaggaccatgccaagtctgaagtgaagctgcagagtgaagcagtatccagagactgagctatttctggctgcagactttgtgtcatgaaatggtgataatttccccacgccccataatgttcctctccttcctgatggctctataagtttgagtgatgtcagtctgtttggaggcagctaggtttgcttgtgtcttaggacagatgtccagaaaaaacaaggctagaccctgaagagcctggacatccattagaatgacaaaagactctgtggatacaaaataccattagtttttcttccttcctctatattctctctttttatctccttccctgatagcaagcaaagggtagggaaatctaagtaggaggcttctatccttgactgatttttttttaaatttttctgcctcctaggggatcacttaattcattttatgcctctggaagagaccagaatttcctcactcctccaaattcctgggcaggttacctctcccaacctcagttcatcattattctgcactgagttatgtaatgatttgatcgtgttgaggagtaattcacctttgttcccacctacgttaagactgattacaaatcctcataaaatactgattatgctaccaaaaatgttcttaaggatagtctgttaggaaggaggtaatgctgctgctcagaagtgtgggcttctgtctaattatgtgtaaattatctgagtggaatctcaaatgtttagtgataaacagtttgatgcgtcccagcaaagtatctagtttgtgaggcaatataatcaaaagcagcttatgtgcagcaaatcgtagatggtataactttgcgtctttttcaagttatttttacagaaagaaatgagaatttgtctgcagccctttaagaatagcaaacgttgtattttgcattttttaaagaaagataattgatcctttgactatactgctgttctgttctcagaagaaacattaaaaagttggatttcttaagaaatgcaattaaccgacttttatttaatgattttttttcacgttattcatcctggaggaatggtttctgttggttattatcaaagatgaggatggattttcagaagcaaaatatcatgatattctactgcaatgcatctgtggttactcagggaagatccaatgtggtttgtatgtagatatctccttctttagaaaacctttcctgaattgcctacctccatctcccacccatctccagctggaatgttgtacattctctgtgccaccagaagaaagctattctaataatcaaagcgaataggacaccatttaattgggatgaagccacaattgttagtgtagctagtggtaattgaacctagatgttcataatctaggatcctaaactagatgttctgataatctagatcttcataaaatacaggtatttaagtctgaaagctcattatttcttagtctcagtggtagggttccttaaaggcccaagaagcttgagagaagtctaccagggcggatacccatcgaaaaatcaaagccaaggacttctataggcacagaatggtcaagatatttattcagcatagcatgaggaagtttagtccagtatagaaaacaggaatatcagttaaaatgaaattagcatattagttaacataagaattcccacgtcagtgtttgagaacactttgcagctcttctagagacattcttattacagaagaagatgactaactcagaagaaaaagggtatgaaagtctagtaggagaaaatgattagcaaaaaaaaaaaaaaggtactaagacattaatattttattgaaaagaggcaagaattctgtcagttccttattggtggtcaatgcagaataatgctagcattgcctatcattcagttgattccgtaggcggctaaattggttgcttaatgaatccatagtggtatttggctccgcttggtttccaaaattgtaaggtaaattctgtgcacgtggttttaagttggaaatggttgatatggttatacttggtgtatgcattcaacaaattaaccagttgcaaatgtgtgcctattcacaaaccccttgattgaattgcaagtataccagctaattagacatgtgttccgtaatgcttaaagagagatcaaacctccttcagtgtctctagatggtgaagtcttaaatttacccaagatcaaaatatctacataaagattcctatgtatatctgacatgtgcaagccagagggtgttggacattttgaaggccaaccatttagatgattgactaaatatatttactttcatcatacagatctgtccaatattaccagcataccttttaagaaagtgtattcatccttttagagttcattaaaatttatcatgactgtctgtgggatgcatttatttcatattgacttctgtttgtatcctttcctatcctacattctctataaccagtctttttgcaagtctgcaattcatatcaaaaagtctgaaggaattttatttttatttccttttcagtgaaaacatattacaaattgccaactcatgatgtattcagtttgaacttaaaatatcatttgtttaaaaaatgcaataaaacctgatatgtacactgatattcattctgaagattaaagctgccaatgaattatggagctgggccaaggctgtcttgttctcagcctaaatttatcttgtcgaaagggaattattctgaccggggctagagagtgaagatagttaaaatttgattgttcgattgctttcttctggcttttttttccttcttaaaaaatatttgattatatttctcttaagagctggattttaaaatctaaaaactgatgacggatggataaaaagtcctattttatctaattctaaaagtgacgtaggtttctggagactcttttttttttttaatgtacattttctctttccttttctttctttcttttttttttaaacatggatctttggccatgggggaccccatgctgagtgcctaccctctctgacttacacagaggaagcttcagtgtaatagaaataaatgctgcattttctctgtttataacatgtcacttgggcaaagtggtacagtgtctctttggtaaagctgaaatgcggatttctcagaaatgtcttgttttcagttaatgatattttctgcttttcaccaggtggtctctttggggctttgctcttgaattcatttctctgtgcgtaagccaggctttctgttactcgtttattcagccggcatttactgagtcctcaccacactcaggcctgagcgcagcgtccaggttgcagtggccacggaaaccagccctgtcctattggtgcttgctggctttggggtaaagtgacaggctgatactatattatagccagggccacgttagacatcaaaataaaatgttctgggaatagagaggagggatggcctggcatggaggtgagctgggggaatcaggctatctatggtcacatcattctatgaactagcagaccaggcataatgggcgacgtaagctcgccctggtgttgcctgacctgaatgagtgcttctctggaaagagctcatagttcctctttctcttatgtgaaatcccacaaggaaaggcaacttccagaaatggccaagctttctatccctaaagagccagccctcaaggactcatgaaggctgaaagggaaattgatcattggctcattatggtcctgatcaggtatgacctttgagaaaccagtgggcctggtaacaatagggcagccaagttggccatatcagcagatgttgcatttgctgactccatggccagcgccacatcacctgctctgaaggtgtttggttcccgctgcgattggatctgtattcaaaacagattgtgcctgctatggaaagagagccagcttctgaatcctggctgagtttgacttcgttgaccacagagtcttggttctttgcaaacgcaaaggaaaacacgatgtacaccttgactaaattcagctgttttcctcatccattcagccttgccttcattgcaaaatgagcaagcttgtgtttcagagggcttaggtcacttccccagcttcacttagatctgggtgttctgccttccagaatagagtccttcttctccctccatagaccctaagactattaacagtaggtcatccccaacctgttggttaagaaagacatgcacagtatctgcacaatgtccaagggatccccaggatcacctcacctttgtccaaagagaataataaggtgttggtagataagagggaggcccatgtgcctctgccattaggtcctgtgacagggagtccacatggagatcatcatgtgataaagaccactagggctgtagtccagggacaagcttgagtgacatctcagtggggccgctaccttcggagagctccgcacataaggacagagtggctggggcagtcaactggcatcctagaacatatttctcaagaggggccctgctgacgttttggaccagattgatagttcattgatatgagttttatccattgtaggatgtttggcaaaatccctggcctttccccatgagacactagtaacaccctttcctctgggagtcaaaacattgtccagtatcccctggggtgcaaaatcacccactgcttgagaaccgctatcctatggccatatttgtactcactaaagaaagggtacataatggcagctactctgggcctcttgaatcaattgcatgtgattccctacctacctccctccctccctccctccctccctccctccctccttccttccttccttccttccttccttccgagacagagtgagtctccttcacccaggctgaagtgcagtggcacagtcttggctcactgcaacctctgcctcctgggttcaagcaactctcctgcctcagcctcctgaatagctgggattacaggtgtgtgccaccacacctggctaatttttatatttttagtagagatggggcttcactgtgttggccaagctggtctcagactcctgaacttaagtgatctgcctgtcccagcctcccacagtgttgggactacaggcgtgagccaccgtgcccagtgcaattgcatgtgtatttaatgagcttctgcttggggggtagtttagcatacatttggaggcagatgggctgcttcccttattgtatgagagccaggtgactttgtgcaaaacacttgcctgctttgtactttagtcctctcttctataaaacacagatagttctaacactgtatatctctcccaagtttgtagtgaaaaaggattgcacacatacacacacaaagagaccattatgtaagtgttaactactattcttattagcattgtctgggcacaatatctggtgttggaagtcagagaaaatacacagcatgttcttttcttcatggggttctagtctagatgagaagacagtgtccagccactgagagcaatatgcaaatcagtcatcataaactgagtgactgttaggagagagtctattgagggaaacgtgggttatttatagtttgcttgagtttgaatccaggagacaatcttgacttcctctctgcagaccaaaataatctttctttctctcttttcctccctgccttcctttcttttcttttccttttatttttgttttcttttcctagaaaaggtcttactctgtcacccaggatggacaggaggtcagtggcacaattatagctcactgcaacctctacctcctgggctccagcaatcctcccacctcagcgtccggagtagctgggaccacaggcgcgtgccatcacgcctggcaatttttttttgtattttttgtagagacagggtttctatttgttgcccaagctcaactcctgagctcaggtgatccacccacttcagcctcccagagtgctgggattacaggtgtgagccactgtacctggccgactaaagcgatgtctgaaaagggaggacagaatccaccactcaccgccccaaacccattttctttgcagcgtttgctcagactaacagtcagaggaacaagtaaatggcatttgcaaaggggatttcatttattcctggatgccacagttacttgttcacccccaactcattgcaaggcacagggtcttaggaattctttaattgtaaggaacagaaactcaccctgtatgaagatatctcattataagaatcaaaagatatttcacaaaactcagttgcatgaaatatggggaaatacatggatattagaagttatcaggtggattttctgctgccttttgctcttgcaccctctccctggagccttctgctctctgttctctggttgattaagcttttttttttcctgttatcgttcttttaaaaaatttttccataggttattgggggaacaggtggtgtttgatttcataagttcttcagtggtgatttgtgagatttgggtgcacccatcacctgagcagtatacactgcacccagtttgtaggcttttacccctcacctccttcccaccctttctccctgagtccccaaagtccactgtgtcattcttatgcctttgcattctcatagcttagctcccacttatgagtgagaacatatgatgtttggttttccattcctgagttacttcacttagaataatagtctccaatcgcatccaggttgctgcaactgcgattaattcattacttttttatggttgagtagtccatcatgtgtgtgtgtttgtgtatctgtgtgtgtgtatctcacagtttcttcaatgcactcattggtttatggatgggttggttccacatttttgcaattgtgaattgtgctgctataaatatgcatgtgcaggtatcttttttgtataacgactttttttcctctgggtagatacccagtagtgggattgttggatcaaatggtagttctacatttaggtctttaaggaatctccacatgattttccatagtggtgggttaagcattttgactttgtgtgcctctctctgcttgtctctctctgttcgttcatcccctagtgcttggtccagctttcagttttccatggccttcctccctggtcccccaatctgcctctgcagtctctatactccaatccagcattcctgacagggagaagatctcattgaaccagcatggatcagtgtccaccatgagttcccacagttggaaagatttaggggagctcactaggtagatgatggtgcctcttccgtggtggaaaggagtatgaatttgctaagaaaatcgtatgggtggaggaaattggttgacacttccataacacctcccctctgtgttggccagggaaacacccttgacattctgtatctccatcccctagatcgcctctccctaaacaccactcagcctcaccgtcctcagaagctgtatccttactcagttttctttaattggcatcttctaaaataagactctcatattgttgcttcttagggtcacccagagcttgccagaagtgagaaaggatctcttctggacttgatctagatcatgtcatcagatcattgcatcaaagtcaggtttactgaggcataatttacacacggtaaaatgtactcattttagcacacagttcttcaagtttcaataagtgcatacagtgatgtaataaccaccagcgtccgcatgatttggagcatattcgtcattccaaaaacttgcctagggcctagttatagttagtccccagctctagatcctgggaattggcagtctcttttctgtctctacagtgttggtgtctccagaatgtcctacaaatggaatcagaagtacgtagcctttaggcctgactatctctgtgtaatggatttgagattcatccaggtagttgcatctatcaacagttccttcttcccttttattgctgagtagcattctgtggtacagatgcactatagtttattcactagttgaagggcggttgtgttgtttccagtttttgctgattatgaaacagttgctgtaagcatttatgtacaggtaattctgtataacaattcttagttctcctgggtaaattcctaggagtggtgttgctggattgagaagtatgtttatgtttaactttattcattcatttaagatatagactcctgctctgtatcccaggctgtagtacggtggcactatcacagctcactgcagccttgaaatcttgggcacaagcagtcctcccacctcagcctcctgagtagctgggaccacaggcactcaccaccacgcctggttaattttttaacttcttgtagagatgaggtcctgctatattgtccagattgatctcgatctcctggcctcaagcagtcctcccaccttagcctcccacagtgctaggatgacaggcataagccaccactcctggccctttttaacttcataaagatgttttttaagagaggcagaggacagagtggtagtttcggtgtttaatcctggatctgatacttcctagctctgcgacctcacggtttatctgtgccttactggattgcagcagaattaatggcaaaataataactctgcacaagttcagggcagtcactggctgagtgttagagctttaagatggcccctcatcttttggccactgccttcttgtactggatgttccttctttattgcctgagcatgcacactctttcttacatccttgccacacactgtttccttttctggaacattttcccacccacctttctcctcgccaacgcctcatccctccgttgcccaatggaatgccgcctcttcagaaaagccttccctcaccctcagtctcaatccagccctttgctatctatagattccttacttttttttttttttttttttttttttttttagcaacctgttcttatcctttatagcatttaccacaatgggcctcagaaaattaactgtataatttgatttttaattggaatttttattgagataattgcagattcacatgcagctgtaaggaataatacagagagttccaatgtaccctttacacagttttccccaatggtaacatttggcaaaattaaagtacagtgatcacatctaggatattgatgttggtacaacccagtgattttattcaaatttccccaatgttacttgcattaattgtgtgtgtgtgtgtgtgtgtgtgtgtttgcagtggtggtagttttatctggttttgtagaattttaccgcacatgtaggtctgtgcatccaacaccacagtcaggataacaaacatttccatcaccactggatcccttctgtttttctttttacaaccacccccgcccccactcccaattcctaatttctggcaaacactaattttctctctatttataagcttggacatttcaagaaatggacccatatagtacctgacttttaggcattgacattttttgatcaacgtaattccctggagactcattgaaactgctgtgtgtataaataacttattccttttcattgctgtgtagtattccatggtatggatgtaccacagtttgtttaaccattcatctattgatggacatctggactaactcctggatttagctcttataaataaaactgttacaaatcttcaagtgcagggttttgtgtgaacacaagattccatttctctgagataagggctcaagaaagaacatgctgggacatgatttttaagagaaactgattgatttttaaactgagtctctgctgatagacttttagttccatccgggtaagtagactgagttttgtttgtttgtctgcttgtttgtatctttaatcagcatactgggaacactgtacaattcttagaacataatttaccactctataaatatttatagatgatttaaataaggaacgaatgagtgaatgcatgaataccactgctggcatagggattaaatgaaataatttatgtaaatcatgttcagaatgtctagcatggagtaagctctaataggtaaacacttgtagcacaatcgccattgtaagatatgattttggttgaaggtgacatgaggaaatttcatatccttccaccttcagcatcatacaaacatcatgtggctttgcaggatcccaagggtctaggttcttgccactttatttctttaaataaaagcctatcttgtgaaaatgctcaaaagtgtcagagtgggaatttgggtttcatactttgatactttcttatttttttttttttttttttgagatggagtcttgctctgtcacctaggctggagtacagtgatgccatctcagctcactgcagcctcccctgccaggttcaagcaactttccctgcctcagcctcctgaatagctggaatttcaggagcacaccaccaggactggctaatttttttttttttttttttttttttgagacagagtcttactctgtcacccaggatggagtgcagtggcgagatctcgggtcactgcaagctccgcctcctgggtacccaccattctcccgcctcagcctcccgagtagctgggactacaggtccctgccaccatgcctggctaattttgtttttgtatttttagtagagacagggtttagccatgttggccaggctggtctcaaactcctgacctcagatgatccacccgcctcagcctcccagagtgctgggattacaggcatgagtcaccatgcctggccctgggcttcaaactttaaagaagatactgcttaaataggtcagggtgaagctacataaccacttgcctcattgaacatgaacgcaggcaatgcgtgatagaagctgtaggagtgtgaggatgtgtggcacaaaagaggttaactttgttccaagatcattatggtcccagagtgtgacataaatattggtgaagccaatggagttagcacagtacttaatagagagagaagattagtgattctcatttgcctgaggaaagtgcaggtcttgataatgtcttgatctatgtacaaagagctagtaaagacaagcagtcctcataataaaaatagaaatgaggttttcccgacaaagatgccaccagaatgatgagctgtcacacaggacctggagagacaagaaagaaacttctttggtgactataattaggattccatggagagcagcagtgtgcaggaactatgccagggtgctctctttctctttctagaatcaccatcaaacttgctctaaaggaccaggacagcgagtaggtgcaagctgatccttggtggaccaagcctgtattccccacaggccatggtgaggctctgacctggggtataataggcaagaagtgttttcagtctgtgacttgggctacttaaatggaagaagataaaaccttttatttttccttataatgaaagtacttcacgctcattattaaaaacttggattgattgacaattttgaaaaatgataaaagtcgcctctcaacaccacatttgggtgtttcctcaaagctttgaaaatatctatgtagatctatatgtttagatttagaaagagataaatttagaagtggagaacacaaattagtttatgatagattttacatatatggggtattacccaataattatggatttgcatattaccttcccccacccatttcgtgtgcatttttctgcttcttaagctgtttttccctcggtgtattttcaaaatacacatagtttgtgaggatctagcccaaatgaaatgagtgatgtgtgactggctgttgaacgaaaaatccaaaccaatctcgtgtgtatttgctggctgagatctgttttcctcatgttctgtagaagggaaggagtaacatggtctcctttagatgctggatcaaggtctgagatttttctaccttcaccctggtttccatataacagggaaatcctagagtggtttaagatacccacaagcaccctggggaagcggcacctacctcaaccatagtttgtgatcctgtaattcaatttaatttctggagaaagaatccactctcagagaactctcacatcaattgttcaactttcagacattctacttggaaatccatttaaggaatgcatcatacaataaagtagaagattcaaggtgagaaaatcacactcatctgagttagggcctcagggtgtacatttaaataagttatttatcttccctcattctcagcttccttacctgtgaaatgggaggagtcacatcaccttgcttatcagatttctgggaagatgaaataagataatgaatgtaaaacccttggcatagtgtctacacacagtaaatgctaagtaattcttaactgtgctattactggccggagagcagtggctcacacctataaccccagtactttgggaggctgagctgggcagatcacttgaggtcaggagttcgagaccagcctggccaacatggtgaaatgccatctctactaaaaatactaaaattagccaggcatgatggcacatgccaataatcccggctacattggaggctgaggcaggagaatcacttgaacccaggggatggaggttacagtgagctgagagggcaccactgcactccagcctgcgcgataaagcaaggctccatctcaaaaactttgttgttactttttacagtatttcttggacttgtgtgtgcttcttgataggacattggctatgcaggggaacaacattggaatcgtttgtctggtgagaggcaggggttggagaaaagaaagtgacagcctgctgagaatctgagtgatattagaggaagtatgggcaccctggaggttagtgttttcactaaaaagatcataaattattaacatccaacagagttacccagaagaacactcatgccagatcctgcctgctgtatcagagagcctccttagagatgtctgtggctgagttacaaagaagaaaaagcagtcagggtgatgatgggtattacatttgcttccttagtcaaacactagagttgagagagaaagcaagattggaagtagcaatgggctctccttagaaagattaaagagatggctccctttgtttctagcctaagagaacagggctggctgtctttcccacaaaggtcaatgtacattgccttacttttgtgtttacaatcaacagtagccagattatcattaccgataccaacattaccaccaccattatcatcatcaccatcaccatcatcattaccatcatcatcagcaagagcatcactgtcaccaccattatgattatcatcatcgttattacagtcaccttcatcgtcatcatcaccattatcaccatcagcatcaatatgataatgatgatcatcatgattatcagtgccatcattactaccatcactttcatcatagtcatcaccatcatcatcaccatgatcatgatcatcatcagcatcaccacccccaccatcatcattatcacaattatccttgaagctgatatgtgttgtgcacttcctaggtgctaaggggttgcaccaagaaatttagtgtattagtccatgctatcaaatttagtcttgtgagataaaaatattagtgcttgtctcacttataaataaggatccaagactcaggaagttttaaataacttgccaaaagccactcagctagtatgctgtagttcaaagattcagaaccaggaggtctgcctccctagtccttatcatccatttcgttatcaagaaggcaggacaaggttaggataaactctgtggccccagaataagctcttttaattcttattatttttcttcataggagagtaaacctataatctgtgcttcccagggttacatggcacaccactgtttctcagatacctacgtacatttacaccggtagaaaccattttagaaataaatgttacagaaaattccatctataagagagataaaaggagcaggataaaagatgcattttatgacttcaaatgtgaagcatgtatcgtaaaggcaattagtgagaaaatgaggctattttgatgaacaccaatatttgaaattgggagtatggatagataatattgttttcaattaggcttataatccaattcatttcagtcttttaatttgttgcctgctattgagaagatgctggttcacacactgatactgagatgcagaaggtaattttttaaccaggtgaccttaaaatatctcattaatctggaatgtaagctccatgtcctttcgtagttgagcactgtatctccaaggccagcaccatgcttcgcacagacactattttcaaaaggtagctgacgattgaataaatgaattaaccaactagtaaattaaatgaatctcagaaacatgaaaatggaagaggactaatattttcattttcaaatttgctcattcactcaactaatatttaacaagcatccactacagtaagccaagtgctgttctaaggtggtgagcatgcaacattaagaggggaaaaataccgttctcatgggacatgtgcgtgtccgtgtgtacaggatgggggcgtggaagatagacagaaaatagacaaggaactcaccattaacactcgctgtaatgtttagaagcagacagcttatctaagccttctgagtctcagcatgcttgtgggtaatgtagtattatcggtatgtacccagcaatacccctgtgaagaataaacagaaacacacagaggtgctatcatccttgcctccatctcaatattgcaaaacatacaagaatgcacatttcattctgtgattatttatttaactaggcactgggcattctgggatttgtacattcatatcattaaagcagtttcagccaaagagcatatatttggagatgttttaacatgcactgggcataagtgattatagccctaggttcaaggtgaccagtatctggacagagggagatatgtagaagaagtaccagttacgttgcaaggtaagatgtgcagaaccagcttaaagcattcaatactgtgccctaaccagctgaaggggtcattgatgccctttgaacagaagacagacatccttagttttgggtatttaaaattcctctgtggcaccaatgtgaggtatgagttgggaagagctgagactgagagcaaaggaacttacctaagtatagctttttcccccttttctaaaaatctaggctaaataaaataatgtgatgtgctagtatagccacaatggaaaattaagacagccttaatagttgggagatggaagagttaaaaatgatacaatttgggaaccaattgactattcagagcagcaaaggaagatgtgaagggcaaatgttcagctttcaagattaagtaaatggaagggaggtgcttccattaacaaacaggtaagtcaatagaggaagagcagcatgtgcagatgcgtttgtttgggggaatgttaaaatagcagcaaggatgggaccttggcactgagacatgcaggaggctgtctgaagttcatgatgattcctgagatgcagcctgtgaggagaggtcatggctagggatgcgataaggatttgtctgtattctgcaaagagtctgatgcaatggctttcaatcattactgcaaatccttcacaagtgtgtaaagagtatcatagccattactatattactatatataaaatatataatgtactatataatgtattatatataatatataatgtattttatatattatatattatgtatataatatataatatattttatatataatatagaatatatgatgtattatatgtattatatattgtatatattatattatacaattatagtatatattacatattgtatatattatatatagaatatatgatgtataatatataatatatcatgtattatgtataatatataatatataatgtattacgtatgatatataatatagaacgtattatatatcatatatcatatatgatatagaacgtattatatatcatatatatgatatatgatatagaacgtattatatatcatatatatgatatatgatatagaacgtattatatatcatatatcatatatgatatatgatatatgacgtattatatatcatatatcatacatgatatatataatatataatgtattatgttatatatcatatatgatatacatgatatataatatgtaatgtattatattatatatataaggtattatatataatatataatatgtaatgtattatatataatatataatgtattatataatatgtattatgtattatatataaaatatatataatactatatgtatacacacacacacacacacacacaaatatataacagaagtgggttgtgcacggtgatgacgattagggtataggaggtaagagacctaacaaagcacgaagtgatgccaagcgagagttttttgtctatgaggcatgtaagaacgctacaatacatgtgcattaaaaagtccagccagggacatatatagtctttttcttacatgtcactctactgaaatagtcttgaattattttatctgatacgaggtgaaggaaatgctatgttttcatcagtaagcacaataggtcttgtaatggagcgtacaggtttggtttggaaagatggcttgatacaaagctggataagagatgatcccctcaaagacacagaaacaactgttgccgagcttttaaggagcaggaaacagaggatgaaggggtgaggatacgaatttgttctctggctctcaaaaagaaaagagggaagaggaaaaggaagtaaggcagagaaagtctggaaccaagacagtttaatcaaagtcgagggcactagaatagccaaatgtcattttcaaggatgtgatagataccgttgaccctccacgtccttgggttctgcatccatagattcagtcaactgcagatcaaaaatattcagaaagaaattgtgtctgtgctaaacatgtgcagacacttttttccttgtcattattccctaaacaatgcattgaaacaactatttacatggaatttgcattgtattagtaaacctagaagatgatttaaagtatacaggaggatatgtgtaggttataagcaaatactacacatctgtagattttggtgtccttggaaggtcctagaaccaatcacccatggatagtgaacgatgactctaccgatccttgtctgtgtttttaaaatgagaatcacatcttccattctctctgccaccatcttcatgtctgctcatacatgcatcatttagtgggtgtattgcagaatgggctaattaattttatgtgtgggtctttgtaatggaacccagagacagggaatataagaacctggactcgcaggccagatgaggttgtgagaacatgagctgcctgtaaccgtgaattgcaatttggggactaaaacttggaatcctagagattgtctgtttgccgaggtgagatttttgagagccaggaaggttttctacccaatacccgatacatccccagtgtcaccttgtaagttttgcagataaacctagtttcgtatgattccttacatcgttcctagctcacctccaacaatcatcagactttgaaggtatgcaatgatgccagggactaagaattcctggggtgtctttgacctgtgttccaggatgagaccctgggaaggtccaggtcaaggtggattaattcagagctggagatgttagaggtgaagtcacttctagtcagaaatgcttaatgacaactcatcttgtactttaaagataaaatttctgagcatttctggggtcaaagaaccttgcagccaagctcatgaaagaggaaaaagagaatcttctgcaggctttgtttgccttcaggtttgcttgagtttaatccagaagtcgaaacacagagagtgggtggggtggagggttcccaaagtagaccttcccacccacttgttcattaggagaaatcaccacttagctgtttttgtctctgccgcctacccttccttgtcccacgcacttacattcagtcctgtgcactggaaacagactcccaccctctcaactgccaaacgctgcaccttgtctttgcttcacctcctggagtccattgtttcaggaaggctgctataggaactgaagttacttgcttgctctgggtaccttttaatttggggttctacctggtgtgtctcgggtctcttttgacatatgtcagttggctgctctgatagaacattgtctccataaattgtcacttttgccagaaatgatgataggaaagtgttggcaagaaaaaaaaaaaaaaagactgaagcagaatattttcttttgaaaagcttagggcaagctgtggatagggtgggacttactcctgctctaattgagtaaggacaagaaagctaggaaaatttcatatgataaaattaggtggctggggtcagcgatatattcctggaaaaagaaagcttgaagataaaatggcatagagtagttcttcacaaaagtgcttacgaggtttagatattgtaaaaaatgatgaatatgatgatgatgatgatgatgatgatgacagtggtgattttgtaagcagcatctctactgctgtttgtattgcatggttaaaaaggatactttctcattttgttcaacagaccagaaaaccctgttttccatctcttattagaaggataagatagatacttcttgtgccctcagtttcttcttatgtaaattggaactataaaaataatctaccttgcaggattttgtgaagatcagaaaaaaattaattaccatctggccagaagtaattttctaacatgtattacgcttgtcagtcttcacaaaatagtgaaggacttgacctgatgttgtgtgagatacagttggtgaagattttagttgacaagggttaatgtgtaagctggcattcatttgattcattagcaaggttaaataaattgtgtactcagaagaccagggcagaaaggtgatgtgtatgatgtctatacatttttgtatagtgccatgtcatttaaaaaaactttacaaaaagaaaattgtatctgaagttagtccttccataaatgtattgactttgttggtctcgtttgtgtaatttttttgcaaagaaggaggaatgatggtttcatcaactggtcaggggctgaaaatagaaatacctcataataatagttgctatatattgagtggttgctagataatgggcaccatttttatgacttatatatattacatgattttatctttcaacaacttaggaaggaaaagtatcattattctccttagaatgaaactgaggttttaagaacttgtatgtcagtagacatataatagcagctgcaaaggtatgatccagagatagatcttcagaccaagcagcaagactccaaaaggtgtactgctcactacaggtgtactcaggggagtacaccttttgcagtctcgctgtttgtgtttgaggcatacccacatatgaaccagaaagagttcccaaataccccatcgcaactccatatttcaggtggccttgaacgagcagggctgagtcattgaggaacaagaataaactctggtgatccaacaaattcaattcatttgacctttattaagcctctcctaagtgaaaggcatgctgctctgtggttcaggaaactcagaaatgagaagggtgtttggtttggtttgctgcagtgaacctgtgggggtaaagagaatagttattcaagcctaaagagtgtaactattaattgttttttagtctcctcgtgatagctaacaagtattgttgatacttgttgtgccagtgcctatgctgagaagcactttacattcattatctcggtggttcccaaatgccgatccacagactcattggattctgtaatgacattttcgacagactgcagctaaatgagaaaattaagggcaatttagtgaaaattttaatagacttaaatttaatcaatttgaaggactgtcctttattttcagattatgtcctcctttttttttttttttttgcattttcgtgtaaaatgctgtttcttttattaaatgcttatgacagtagacagtgtatgtgagtttatgtgtgtatgtatgaatgtactaccttggcaagaaatttaaaagctgttaattttcatgcagtctctttaccatttttaaacttttcttggaactgtccatgtcattgagggctaggggataagaagtctgagaatcattatagttctgtaagggtgctaccattggccccattttacagatgaaaaaaactaaggctcggaatggttagctcacatgctcatgttcacgatagcttgcaagtagcagagcttgaatttaaaccagtttgtgtgtttctgtagatgcagaacacctgcatgatgggcatatggctgcttttgctgcaatgaataggctccctagcctgtccctggccatggatgtgggccatgcaaccgttttcagagtcccaggactctgggcctttctttcgggtgcagactgaaatccacaatagctttagacattcatggtgtttcctaggagctagtttgcagcagttctattcctctacttggaggaatacaggagttaagagcctagctttgtgtcccttccctctgcccctgagtcctgtgtttctgtttaccctcaaaaatgtgagcagtataggtatgtgtaaaggtaaatgcagacatcctgcttagtggcttacagcagaacctcatgtcaggggaagagctgggttgaaagatcccgttttccaagcttgcactccatgggagccatagtcagtagccagtgagacgacaggaggagagacaaggctcaagggtcaagggagaagacactgtctgtacctcctgagctttctcttcattgtgcctgcagggaggagggaaggcagtttgggccatggcttgtaggaacaaaaaaggacaaacttattttccacatcttcctgctttatatgtgaggcttgatgtaaagacaaactaccccaccctgtgagatgggtaattgagaatgagacataactgggtttggaaatcagttgcatcccttctcttctccagaaacatatgcaggtttccaacctggcagtctgtttctcagcagccttggcacctgaggaaggggtaagatgaggatctgggtatttttattttgatttctgacattgtccctaagaagttatgctgtaaacggataagagattctgggttactgaaatcctgtatggatgctaaggtgctatgtagcttagtccattcccttttttgttgtggatgttaattatctagaatattgcaactcagtagtggctttaagcaggttttcatgtactagccagggaaagttaccaccattaaaaaaaattattctttaggaacgtgtagcctggggtctttataataacaacagttgtagtagtagttgtagtagcaatgatgataatataactgtttcattttattgtaaaagtaatacacagacacattcttattgtgaaaatctaagcgacataaatctgtacagagtaaaaattgaaatcccccccaatagcccctcctctattaccctagatctaaaagcatttattggattgatttatttgtttccgggcccttttgtatgcacttcacatgactgcatgtatgcctattttacgcacatgcatatgcacatacttctgtggatgtctatatgcatccacacacatgtttttaaagaatcgtagagttttgctgtttgttttggtttgatttttcacatgtgaaattttgttatctatatcctgaaacttcttagagaattttcttagagatttttccaaggaaagacactcagatgccccgcattctttttaactggtgcattgcatgcatgtcctgtaccttgttttatttatcccctgtttcccctattgctgtttattatagttgacccttcagcaacatgggggttagaagcatcaacccaccacaatgtagaaaatttgtgtataggtttttttttgtttttttttttttttttttttgagatatactcactcttttgcccaggctctggagtgcagtagcatgatctcagcctaccgcagcctccgcctcctgggttcaagtgattctcatgcgtctgcctcccaagtagctgggactacagatgcgtgcgactatgcctgagggctaatttttgtatatttggttgagagagggtttcaccatcttggccagtctcatcttgaactcctgtccttaagtgatccactcgccttggcctcccaaagtgccgggattacaggcatgagccaacatgcccagcccaaaatttgtgtataagttttgattcccccaaaactatgattagcccactatcgactcaaagccaacagtggattaaaacgtattttgtatgttacatgcattatatatgtattcctacaataaactaagctagggtaaagaaaatattaagaaaatcataacgaagagaaaacatatttactattgatcaagtagaagtgaatcatcataaatgttttcatctttgtcattttacatgaggtaggctgaggaggaggaggaggacgaggaagacaaggggttggtcttgctatctctgggtctctcaggtggcagagaatttctgcatatgtggtcctgtatagttcaaatctgtgttgttcacgagtcaactgtatttgcttttacaagcaatggtggagtgaatatcctggtttatgtatcatgtatctacctcaaatatttcagcaggacagatatctagaattagaatagttactttgaaagatgtgcgtattttagattttgatagtgagcaccaaaatattaatatcatctccaggactgtaccagttttgactcccaccatctgtgtttcaggttacccatttctccacagtgatgtcaaatctatatattattgataggcattttattcgttatttgattttatttgttaactgatgtcagtcttttaggcaaaagatggccgtaaactgttctaaaccaccaatgtaactttgaaaagctcatttgtagtgggagcgagttgtgaactgggtattgcctgcgcttgtatttctgctcttggaagcgtggtttatttttagtcctggactcactgacaacccacacccaaactagaaagctagaggagtttgagggtcctttacacagaatcaggctctaatctcgatcctgtcattacatgcaaagcaattgctgctgaatggttggaattggttctgcctgggacgaagccctttactctgaaaaaggagcgctgtgctcatttgagcactgccaaaatcctggaccctctgactcagtgtggagtgatcgtgcttttgcctagagaaactgtgtctgagaaatggagcttctgcaaaatacagctcagagggaccatcaggggttgagacattctagaggccaacaggccagcttaatgtatacattagaagtgccaaacttctcacccctatccctagtagattgacccaagagaactacagaattcatgtagacatgctcctcagtttacaatggggttatgtcctaataaacccattgtaagttgaaaatatcataagtagaaattatgttttcgacataggatattttcaccttaccatggatttatccagatgtgaccccatcgcaagtcagggaccatctgtattaaacaaatgtgaggcttatgcaataagattggaaggagcgggatgcaagaggggctttcttgaagctgaaactgcattttttcagagcaagtgtagtttttaggtagatttcactgccgtctcccttaccctggtttccctaattccctgatcttgatcttgcctgctatgcttcccacagcactcaccaccatctattgtactgtacttatttcttctctgtattacttactttctgctgcccctcccccacccactagaatgtaaactgtctaatgtcagggacctttgtttgtccggccccactgatgccgacctgggggctagaacagtgcctggaatgagatcagcactaactaaatatgattcaggtgtttgaacaagccagtgactcaaagtgcttttgatacagataaataataaagttttctaaagatactttcatgctcactttaatgaagatggagactatattgtcgtccacattaaatttggaagtgaaagtaaaatatttctaagtcacatcttgacgttgccactgagctaaccccagtatagatgattacattgaagttcaagtccttctttctgtctaactggagtcttgcttgctctgaggtatggcaactcttatagaaagtattttttttagtggaatgtctgctatttcaacagccttgggaagttataataaatagttatgaaaatgagaaaagaaaaaaatggtttccattcttcttttaaattgctggcaaagttggaagaaaaaaagttacaatattattttatgagtcaaattaaaacttgggtagttgccttctgcctaaggaagtttcatttgaagatgacattattgattgccaattttcctgcactttttcagcttcctgtggggtatgtataaccattccattaagggtccttgtagctgaaatgcaggcagggtggcccttgaatgcatatgaacccatgtgatgttgaatgtctagaatttttttttgtggagagataagagtattttctttccccacttctcccatttattgatgttggagaatcatgccagagctagtggccttgatatggctctttctcagtctcttttgagatggaattcaaatttgctatccccagatgcggtttaaaaggctggcaaagtgttgtcatcaagtgagcgatgattgtggatatgatgctaccatttgatttggggtcattggatgccctattcctgattaaggagcactgatgttatcaatggaaaagtgttcctctgggctccttaatatagttgcagtgtttatgggaaggggacttgtccctgtgtgtgattgtgtttgcatgcactggtggagagatgttcaggtttagttatccagagagcagagcccgactccaaataattttgatgtggatttaggtctggttctcatgttgtactttgcagatcttcagtgtgtctgactgtgaaaacttaagtttaagggaatgtcagagccgttattgcaagatggatctgtggggatctaatcactactgaggggttccaactttggggagaaaacggactggaaaatctgtattgccttagtgcagccaagagcatttattgggtctttacataatgtatttgtttttcattaaaccgttcagataaagtcttattaaagtgccatgtattatgtatcatgtttcttatgaaaatgagctgaaggaaaaaattctctcctcttcttgggttatttacaggcttttctaatgccagcaagagaaaaaaaaataaaggaaagcagtgcgaacccgtccgtacagcagattgcttgacgcaacagtaaagaatgggaaagggagagtgaggattggaaaggtagaatggttggccttttattccattcgtgttctgtggagtgactttctctttagttttgtgaatgcaaaaataaataaataaaggcaggtaggaagtaagagaagaaaagagggaattcttatattatttgttaatcaaagcttgtcccatgaatgtgacctctgatgcaacgtacagcaaacgtttttcaaactaaccactgccagcaccccccaataaaagcagtacagaatagcagcctctactttcccactcccctggatgaacttctgcctagggctaaagggttaaacatgctactgtgtccctgataaattgatgggatgtgtgagccccagagaggttggaggcactggttttgcaagatgaaaagtggaaagaaacagcgggttggggcctagtgttaggcagagtgaagacttcatagttatttcaaacagaacgacaacaaaaaatagagccgtgggataattagttttcttttcttcagaaagcattttgattagcctgcaaagtgagttgtgccttgcgagctgatggctgggttcagagccttcatttggctgaggatgtcggggtgagccctgaggaggaggggatatttgggatgtccctggtggccagttccagggttctgccccaaatattcttttgtgagagagcccccatcccctctcaggtacggttccgtcctgcaggtcagtgagaagctgtcagcaaggtttctttcaggaagcccaacaatcaaaaaagctgctgtttagacagctgatctcttggtctgaaaacaaaaaaaaaaaaaaagaaaatccaatcactgggtcaaaatctatattaaaaaaatatggctactcttcctgatcacgattttattgctgccaagaatgcaagaatgtgcttttttttttttttcctgtcaggaccaaggacgagttagagtcttaatattttctttcgatttgcagatcacatcctattttattgcataaagactaatgaaatctactaatgaataattattacttcataaaataaaggggaggggagacccgtttgcaagagcagaatgttaatttggccaaggagggctggacaggcaagaataaaaaaaataaataaataaaccattgtaatttgctccctgcagccgacggagtaatctcttatcagacacggacttccctaccctgtgcatttataatttgagaggagcgggtgttctgggctgggagaagcccccttccagtcgccccgagctggcacgttagtccaacaggcttgatttccacgccagcctgggcggttgctctcattgaacagctcaggggctggttcgctggctcggggctgcctgcccaaccaaggcgaggcacagagcgaaagctgcgccccaaacgcccgggggtgcatcggcgcttcggtgctctgctggggggcgcagaaacctcctcccctccctcagcccaagctccctcctgcccccagcccctaacgtctcagcactccacctcctgaggaggggaaatcccttttctgtgtttatttggcaaggaatccggcaaacgcaccgccaccaacatctaccactgtgggtcccagctgggccatcgcgctaattgtccagctcgcctgatgccgggcgcgcggggcgctcgctcgcctgctcaccggcagagggttttagcagaccgaatttaaattttggtgagtgtttttttgaaacaaacaaaaaaaataaataatttttaaaaaaagcgaaggggagggaaggaaaaaaaggaaaaaaaatctttcccctggacccatttgacaaatgaggagacagacagcatcagaaccaacggagtgagcttcagtgtgagtcaaaacctctcttcctctctttcaatctctctctctctttaccctccctctcgctctctctctctctctctctctgtctctcccctccctctctcttcctctctccctctctacctccgtcccaccccttcctcctctccctccctccctccctctcgctatccttgcccccctcccattcagcctcttcgggagggcagcgcatcccctgccccttccagagaagttccctctgccggttctcgtgtcaccttcacaggggtatggggtggggggccccttccactttccgggggatcaaaaagcaggcccaacaacccagaaaagccagacgaccgcgcgaagggaaccaactagtttccaggtccccgcaagtgttttagttggaggcagaggaacgccgggatctagcacatccccaggcggggagagccagggaggagggaccggcggggtgcggtggggggagggaggaggaaagagggggagagagacagagagagagacagagagagagagagagagagagagagagagagacagcgcgagccaccggtcattgacttagataaccagcaaaattaaaaaagaaaaaaaaaaattgtagcgcccaggcagagagcaacgtgattgcattcaagcgtccccactcgggctcggcgggcgccagagagacatgatgcagcatcctctgacgggggccacctgcgtggcgctccccaacgtgggcatgtgtccccagctttcgtgtgccttgacttttatgtacttacagcaggtaaggcgcgcgtctgccctcggtggctgctttcctggggctgggccagatgggtccccgcgcgtactgggctgcgcttcggtgccttatgtaggttctgaggagggggctcccgcgttgcgatggaaagggtggatggaagcctcctgctctctgtggagcccgggcacctcgcgctgagatgtttctgcacctgtccgaatactttaaaaccgcctgatgcccagcctgggcaccggaagtttgaaatggaaaactgccttttccttgctaccatcttccttgtgtcagtgcctttcgtggtgatctgagtctaagacccctttgatgctaagagtttgaatctttgtggaggcattccggtgcctgtagtgttaattcagctgatttaatagagagtggaaaggagaagtgtgtggtgtgtggtgtggtgtgtgtgtgtgtgtgtgtgtgtgtgtgtgtgtgtgtgtgtgttttcctaagtttgtgtggtgctatattcggtccgcatgggatcgcagcatttgaatttctggagtgtgtcagccccagtctgccttcaaactcactggcaatgctgtgaagaaggtgagctgtttaggatgttgtctttgttggcatgtgttagggtgtttgtgtgtgtgtgcgtgtgtgggtttttttttccctttcacttctccttagtggtcttgctgagggagtctgtgtttgctttattttccattcattgtgcacatttcagtcttttgacaccttactctctgtctttctcagggtgtttccttgggaccctctctgctctgtcattctttctttattggaagggttgcttcctgagttggttcctgggcttgggaaatagctcagcactgcccttgtagggtgacaggccagctctctgtcattgggcaggggcagtggatgtgaactgaagggctagaaggggttttgtcatgcagatgaaaatcctttctccctcccaggatctccatcctattctatgaaggtttacagtgattatactcattttatctgtttttccacggactcacttcaagagtaccatttgttaacatgagtgtgtgaacagaacttcctatgcaagagttgagagtggccctcttccccaagaccctcaatttcaacctgtgttaaaggaatgtatatttttataaaatgtcaggattctgttttgaacatttgggtgattttctatcaagttggttgactccagaaaatatttcttaggtgtattttctgttgcatgtctttttgagaacagtcttaaaaaaatcttgggaaccaatttgttcttttaaatattattttattacgttcattattgagtaaatcgtgccagaagacatttcccaagagagtattgataacatattatatgcttcatcttccacaatttctgtgcctttgctgtgggtgtgtgtgtaaatgtgtatgtgcatgtgcgttttataccagttatttccaccggaagaaaattctaatgagcatttctatagatgctaagcctcagttggatttatcaaattattactgagttgatcttttgccttttacatttacttctttcatgttatttattaatcaatttgaatatcatttacctagcaagtagaatgctataggtactcaatgttctccgttcctttgtgtggtggtgtttgtgtttttttcaaaaatacatccatgtttctgccttctagatttttaaattggcttactcatttgggcacaacttaggagagaagatagtgactttgagtgagaggttattcttgccatgagaagaacaaacatataagataaacacaaaggttctcagcatcttccaggcagtctctcccacgaggaaaaacacccctgctctggaaaggggaggcttgaagaaaacattggcagccacaacaaatatttagaagtgactaaatcagcatcatggttccatatgaagatagatggagggtggattttgaaatgtgctttggaatgcatctccccctcccctgaaaggacttgcactgctatctgtgaaagtgtttataatgtgatactatgacataatgtgggaatggtgtgcgtgtgtgtgtgtgtgtgtgtgtgtattttctctgagcttcactgaatacctgaagtataataaaggcagtcatttatttttgcctgtttcattcagaattaggttttctagcccttcctggaagctcaccgctagggtgtaagtgatatacctggagtcatctgtcctggccattactgtcgtgatagttcgtttaaaagtctcaagtcacttattttatttagcattccagacaatcggctgattaagagtgtgaaatagtttaatctccacatacataaatcatatcgataagtaatatcttgtacccagacaccactactatattttttatctgcctttaatctgtagctattattggatctctagctaattttggtgaacagaagggtaatctttgatctcaaagtaaattgatcaagtggacgaatcaggcaacatttatgataagtaacaccttcactgaaaacaattttattttataattgtttagaaataaacataattcagaagtctttgtcattgagatcaccaattacataagaaagtaatcaacccacattgatcttattttggagcatttatcattttgttttataaatccacaaactctgaccaccggccatcgagtcttccctgaagtatatttttctggaatgcagtttcatatggttatttcttatccaataactaaggaaaatgacttcattaaatgctttctttgtctcagcatgaacatccaacctttcctcctaaattctcacagatttatccataagacaactcataaaaacaaaaatcaattggggtgcctcagcatcggagtctactctgaatggccaagtgtaagtggcaacatatcacttttgccacgaataatttatttacttaggccaatgaagaagcaactttgatgtttacattatttgacttatcctgtttcacttatttgtatgtcccaataacttttatctagataagtgtttacttacagctacgatttcttttcttttctccttctcctcttttttcctccacatccaagatgttactacagtttagagctgcaaggtgggataatgctaaatagtttttttggcgtctagatatcagacccagtgatgtactcacataggaacacacaaatttgtatacatacacacagacacatatacacacacacctagtatagagcatatattttgtggttgtcaaccactttcagatggaacggacaagtagtccttggagcaactggcttcaatcttgctgtccagggaaagtccctgcctcaatctcctttcctgagtggcttcatgctgtgtcttctttgatggtgaatcttcttgaagctgaacttagaactcacatatccccaatacttaatcttccacgttccaaagtaagtactcatggaaccattcttgctttgaggaataattctgaatacaattccacattagggggtttgcagcaagctaggtcaaaagagaacctattttgttttcctgatagagaagaaatagaaaacagccacacacacatgcatggacacacaggacacagaaatctagagatggtttatttctattgtaagtaatagagggcaaaccttatagcacccatctcatggtaaggtatggtgaggcaacagacaggatggatgatgagattcgttttctgatgcaaactgcgtgtcagattccacccagagctgtttttttttttttccactgagtttaatgtcctgaaagaggatcagtagcatattaacttaattttctctgttcttacaccaccagcgtctctcagtactattctaagaaagcttcttatctgtcaagccctatccactgagaacctttttatcagcctaaatttaaaaatacgtcaaatgcttaaaatccacattagagggggcagaaaagagcctctaaagtgggccatgccactgtcaatattcgaagattggtaatttttcccacttaatgatgatccatgtggtttgttttaagtagtgaagtggtttgtacaaagggtaattcccagtaaatgaagccattgctcactgtggacatcttcagatcgaaagcaattgaactgaaacctgcatatcaaccctttctgtctttaattagaaagcgattctcagttcagggaatcacctggggaagatgggctctcgcgcgaaggctgcaggcgttggggagggtggccccatgcaccagccacggttataaattttggaaacattaggtaggtcataacaattatgactgtgtagaaaagttcaattctcattgcagttacttaccttgtgttactccatctgatgatttatagggggccaaatggaatttatcacattctttctttttggcttaatcccgtgttgatttattagatagtgctatggattgggggtggtcgatagtgtcagtaacgcagaaaagaattaggatagattagcttcatgtctgaattgtttaaaggaatttaagtggctggaatgagcacatttccaggcccaggtggctgcctgatagaagaaaggtccctcagtctctttctagagggatgtcttacgtcgtaaattggttaaccaatctttcttgtttctctgatcttttccgattaagagaaggcatgaaatgttaggctgttatcagccaggtaaggcccacatttcaggtgagctgggggtcatctgtgcttcccccctttggggaacctatggagggccgcgtgttgtggacatggactgcagggccacctgggctgcctctgctttaaaattacttaatccaacaatcacttctgaaaattgtaagcatctgttcatccacagaccaaagccttgtgccattcgcctgctctgcctgccattttgaggcagtttctgtgttataacatgcaactggccgctcctgcctttgcccggctggagaaagtctgtgttattagtgctcacccgccatctgttttccttacagctgacccttgagtaattctccagtagctgatggactgagggtagacagtcttttttagggttttctgattcatttaaccaggttctctgccccaagaggaaacataatgcttgtttattcatattggccgggtgaaaacagtgtagtttgtcaggcaaataatagtcctgtggaagggaacgaaattgcagcattgtaaacaaaatcaggttgctgactctgtgcctaagggggttgggtgatgagcagcacatgtcatcccgtgaaggaagcagagctgacaggtgtgggtgtaattgtcccatctgcagacccctttttaatggacggggagaagtgtcccaatgttctgtttaattcagttaagaaaagcaaagaaagttccattcatcaataaagtttcctattgccgggtgctgcccaagagaactctgccgggctgagcgttggcccgtggctgttggcatgatgcagcttgcctcacccagccctattgagggcggctgtgtcagatagggtcagctctcaggcacaatggcccagaagagccctggccctggccctttaaccatgctgaatacaggtgagctagccaaatgagcaatggacccgcaggccgcctctgctgggagacagagctggccagggttctctctgaaggatcctgaaatgcagttcctgagcctggcatacgatgaggaaagagcttgtgtggttggaatgtcctggctcctgagagggtttggggaaagaggcttttcatggttgtttctgatcttcctgtcatgctatagccctgatggattgatcccggctaaaaaagtgacagaatttggaaccagggttggtggggaggaggtagagagaaggagaagatgttgatcaaaactgtaaaaactgacgttaactgtggagcacccagagtcctgttggtatgttttatcaaaacttcatcaaggggcatacttattaacatggaaataattgtcatggtccagtatttctcaaacttcagacattcaggcaccacttcctaagtcctgccaatctacccattaccagagttgatatctacttaatattttttaaaattaacttacatattaaacatagacttgcccaaaccaaataaaacacagtcactgaatcacacctgtgatcacactttcccagcatacgtggaactaaatgtgtattcattcacctgtccatccacccattccatgttgatggaactcctgataggtttatggaactccagctgcccttctagactctcccagggagcaaagcaaaggcccctgtcctcacagatagtctgttacgttgttcatctctttgccatcttgtgaaccatgcatgcagtacaacgctttggaaaacttccgcttggcctgctggattgcctgggaatcctctgccgtgtccggtctggaattactccttccgctaccttgacccaatttgcaaggggcaaggctagagttaagttctttgtgatgcttttttttccatctgccagatcagcagccactagtgcacaataaaggaaaatagccatacattcaacgtctacatcccaaggagggctttgagatgatggagctgggactgggaaactgctgtggtccttagcactcagccaagctctagctgaagagcagtcctaccctgttttgatccttttctttatgtgtcttgaaacagaatcaaaattaggaaggggaactggagtggaaagcattcagaaggttagtgtgtgttcccagggatgcaatgactattttttttctccccttttgtggccatagaacaaagtagaagcaactgtaggatttaagtgactccaatttcccaggcctgatgagtaaatgcataaaaggtttagtcttgatgagccttttcttttttttttttttttttggcattcgatgtttgctcaggattcgcctcaatgactagattccccttatcaaaaacagtaacaaacatccccggtttttcccttccatagatcagcttcctcttgctctgcctgaagccaggcacggggcaagccctgctcttatggaaaggttgagagcaatattggtacctaaacccagaaggaacagcgaggtttacacactgcagtagccagctgtccatctcaagtgtctcacaaaattcagatgaaaaacccagatctatttagagccagttggtatcatggtatcagccttcccaaaagtacaggtttttttgaaaaacgatagtgtttctgaagttatatgtaggacagaagtcatgagctgaaggcttaatcccaactctgttattcaattagctgatccagctgaattgagcaagatagtttttttttgtttatttggggacttaattgctccttcagaaaaacagggattagaacaaccatttcatactgttctttgtgatattaagtaagatgcaaatgggaacacttagctcagtgcctggggtgcagtgagcagcctatagatgtttgataaagaaatgaaggaagggccgggcgcagtggcccacgcctgtaatcccagcactttaggaggcagaggcaggtggatcacttgaggtcaggagtttgagaccagcctggcctacatggtgaaaccctgtctctactaaaaatacaaaaattatctgagcgtggtggagcacacttgtaatcccagctacttaggaggctgaggcaggagaatcacttgaacccaggagacagaggtagcagtgagccgagatcgcggcgttgcactccagcctgggcaacaagagtgaaactctttctcaacagcagcaacaacaacaatgaaacaaaggaaggcaatatgttaaagaaacgtaggatttgtttattgaagctggacataaacttctcgtttccatttctctcaaattaacatgattaatacacccatggcctgccaaggacacagacacaagggacttgggtgtcactccgggtcttcttggttccactaccctgtttgggagctcttctctttcttcctccagtgagctgtcattcctgcttgtgtcactggattgtaatatggctacacagctcaattaatgctcagtgtcaggaggagggaaaataaaaattgtcttgctcttgtcagtagcgaagttatttactttcaaaagctgacagaatcacactgcagggccttcatttatttccattcagaacgtcattattctgtgatgccagagacttgggcacacgttgaagtttattcccataagctttaatatggcggggccctgctaaagtgtagatcgtcacccaggagagtctgggagagtctggcggagctctctgggggccccagggtgcctgggtgcttggcactgatgtctgggagggtaccctagtttcaggatggaccggggaagctgacacgtgcattttcatgccctggatctgttgtaggagaggcagcgtgttccccactgctgctcttccttctgaagcaaaagaaaggggtgtgggactcgtacttccacatcactcttcatccgggccactcctggaatttctggaaacacaaaagcgcctcctgaaagtggctttgctttggatctatctattgtctctgcttaaactcgttgacaggttccctcaaccaaataatctgtataaaactatgcaattttttgtttgtttgtttgctctctttctttcttccttttccccctaagggtttgcaatgagcagttaacacaggaaggggttgagtggagaaattctcttttcttcatggtgcagtggcagaaccttccactgggggtctccatttagagtacgtgactcaggattcctgaagactttcttttttcctttctttcttcttttttatctttttttttcttttcttgtctttttttttttaaggctctttggttccgttcaaaaaatgaggctctttcggacagcagtaggagaggcagcttgtaagaccatttaggtaacgagataagccagccttcttccacaatgatgatcataataataaaataattaaaataatgaaataatcaataacttttatggagtgctttgtgacaagcacacgaataagcacttttacatggattatcacatttaatcccccacaaaaaaagcctccagggagttgaaattaatggcttcatttttagatgcagaatccaaggcttaggtgggagagctgatatttaaaaccagacacttttgccccagaaccgacacttagaaccacgattctgcaccatccctatgtcctcctcctcactgtgccggccagtggctggttctgtatgatttacggagagacctctgccaggttcctgcgttggaagaatagctccaattgatggagtgggcctcttttcctttaaaggcaggacttgccaaaagaggaaagagttcaggcgacctgtcaactttgatgctcttcccgattttgttttttttaagtcattacgattttgtttaatgaattgcaacaaaccatgaggcttttggacttggggaggaggaagggagaggggaaagaacgaggctgtgagaatcatcagcactgagaatgatggagtgtatttctccgcaaccaattccaatccccaaatctctgttgtactggggagctctccaactaacagaggaaacgcagtcactgcccggcaccgtattaatgatttatacaccccgcaccactgcttttgttcacttgcggggcctggtcgtgttcataacggaatttcagggagtggggtcctgccttgccatgctgttttgctcagtgcagtgaagactgcttcataaatcaaaagaatttagtgctttacaaccttcctgagctctgagatggtgtgcgcctgtgtgcggttgtgtatgtgtgtgtgtttaatcagattcacttagacacattttcattgcctttctgtaaagaatgaatgaagaacgggatgcgatctgtcttaggtgtttcagggctgattggtttgtttcacagtggcatcacggtcctatttgtttcccatttggtgtttatgctttatggtgttgtctgtgaaaatgggctgacactcttttattagcataaagagattcagatcacattagaatcctccgtccttctatatcatcaaaaacaacaggcaggggagagggcgagttgactgtaagccgaatcaccatttgttcacgataagtcaacaggagcttgatgtgatctttaaacaaaggggtttttgagccttttaaaaatgattctttttcaatttttcactgaaaaagaatgcagcttcgttttgaatgttatcgaggacatttattttccggattgggaattctggatgtaggaaagtttcttctcttgagtaagccacagaaagctctaattttaacctccgcttttatttttttcctaattggaagaaaacaaatcataacctcatatattttatttggagccctcaatcaatctttcaagataccagcagagaaaagctctttttttttttttaatgaattgcacttgtacttgtgttttcttaattatgtcatgcatttcattttgtgtgtggtgatatttctttccctatagaactgagaactgaaaaccaacagaagacagagtaggagtttgagggggtaaaacagaatatttagaaaattagaatgatactttaaatattccagtcaacagtaatatttttgtctatgataaaatcttgattttaggaaatgctcttgagttaaaaaagaaagatacgtaaggcttttaggaaataaacatgtcattttagtagaattctgaagtgaatacatgaaggaataaatgcaaagacaaatgattaaagccctactctaccctacccccccccccatactgggggcttgaatttcttttacaaatgtgaaagttttagctatctggttcttattaacatttatgcttataaatttttttaactgtccagtatgcttgtcagtaatgatgaaattgaagcaaatattcattgtggaagatagtcttttatagccttcctgaaaagtggagaacagaatatatatatatatatatatggaacattacacacacttttcatcatgggacatatgatacagcattttggactcggaaagcaggtgtccagcaaatgcactttacatttatattgtactgatttttgtatttttgtttgttctctattatttgaattcgtgagtgtctcattgtttttaattatgtctacatggcacaagacagcagtcaacatctgctctattgtttacttggtttacatatatctttgatgggttactaaacaatctatttttcaaaccccaaacagaagaaacaagctgaacccatattacagcattttgtaaagacccattatgcaattagcacttgggatttgtgcaaatctggtgattcacccaaacaaacatccctttattctgatagttcttcctggctttgtgagaaatatcagtttccaaaaaaataaaatcacatttcctctttaatcatgcagcgtgccaagaagattatgtgtttatatgagggatggatcctccactttgtgtatcagagaaagatcaacttttcaaaataatgatgtctttaattcaaggcagcagttactatattacataagacaactatctgcttacacatagcagacttttgagagttacatggtactattggagaagagaaatgctatgtttttacctgtttgtataatcttcctaacattgcatgatctgtttacagaaggcatagctggtcatctcttgcaaggcatgtgaggcccagaatgattaagtcacctcaaatctgattatttctctgaagtcaatggttaataattaatttactcactcattcatgcagcacatccttatttagcctctgtctcagagattgggttggtcattgaagggatacagacaaggaaagcaggtctgcttttcttcatggaggttacaagtctgtgggagagagacagcccatgagcaagtgatcatcacataactgtgccttgccaggtgtgataaatgctctgaaggaaaagagtgggagttggattcaggggtgagggaagcttttttgaagaagtgacatcaaagctgagatggagtgggaggtaggcaaggaggtggggtcagggtggaagagaggattcacactaaggcatagagtgtgtgtagtgcctgttgcttgcctaggtgtctttaagatgctggaaaaacaaagggaccagggagccagtgagagaggggtaaagagacacataagggccagagacgactggagtttggaaatcttgacctagagttggattttttgccaagacgaatgaagaagacagaacacacacacacacacacacacaaacacacacacacacaataagagggtttaggcaggagttaaatgaccatatttagcctttttacaaaggccagtttggcttttctgcagagaatagagggagacaagatagaaagctgaggacgggggtgtcaagtaggaagtcactgcgatactactggtgcaagctgatggtcgcttggactaggagtggacagaaaagaaacggccaggagtaaaacgttttgaaaatcaagcctgagattcatccccgaagctgatgttcagccagaagagaagaaatgcaactccctgaagtcagacttcggcaggctttggtgaagtcaggtggcactgacctgggtggtatgcagcttcatggaagtgagtgacaggccagtctcagcatatcttaggccaaagctcccagagctcagaatttttcatctgaactctaccatcaccaccactatcaccactgtcaccaatccagtgctattatcaccaccactatcaccatcgccattaggaccatcaccatcacgaagcaactggtctcatgtatgagttggtagcagtcaccaaagacaaaggcactcaccagcttggtaaggtgctctgtagcatcccacttctaatatggtgggtgagaagtggggagtcatttttatgaaatgtccactgagcagtacctccacccgctgcctccagccacaggagtacaggagtgaagtgcattcacgggaatgtgaaacagaactgactttgagtctgaaacaaattacaaatcttatgggcctccaactagctctatgggcatgtttctcgacttctctgcagtttcatttctacatttacgaagtagaggtaacagcaagaccacaaagacatagcattgttaggagtatggcacgagctagtttgtatactaccccagtacagtacccagcaaacagaaggagctcaatacatacttctacttttgatgctggaggtgatggtggtgatggtggtggtgatagtggtggtgactgtggtggtgacggtagcgatgatggtgatgatgtgaaaatggtggtggtggtgattgtgaatggtgacggtggtagtagtggtgatgaaggtgatggtggtagtgctggtggtagtgacggtgctgatggtgatgtagtggtgataatggtggtaatggtagtgacggtggtaatgatggtgatggtgatagtgatggtgttgatagtggtgttggtggtgatggccatggtaatggagttgggatagtggtgatggcagtgatggtggatggtagtgttggtgatagtaatggtggtagtgctggtggtgctggtggctctggtggtggtagtgacagtgctgatggtggtagttgcagtggtggtggtggtggtgatgatgtttggtgatgagagtgattctggttagatgcagcgtggtagaatagtttcacacataagtacctggcttcagatttggttcaagtctaccacttaccacctttgcaccgttgggcaaattatttaacctttctttgttttaattgtctcatctgtgagatggggatggtgatattcattgtcattatgaagactaaattatttaatgtttgttaaaatcagaatagcgttcctataaacaaactcttagacatagagaacgtttgttaaataaagtgtcagtgcagaatacagcttttaacaaaaaggtacctagtggcttctggacttctgctatattcttgattttgctttttatagcaggctgaaaaggctgtctttgccttctctcaaccgccagacccaccccccatctctccatgtgttctgcgtagaacaggtgtgtggtgagccgaagttctggcagagcgcaacatgaaaaagactcccagtaattataaaaataacaacgaaggctgcttagcgaggtaggcagatgagcacaccactagccagaatgataaatagcgcctgcaaatgttaggtcccagtgggagtatgggaacatatgggatgaaccacactaaaagttgggcatcattggtaagttttagatggttaaggcaggctaactccagtgccaatttttttcttctttctttgtttttttatcctaattttaaatccttcagttcccttttgtccctttgttctattttggtcctaaaagaagcattcatctttgaggccagccagggaatctccaaggaagtgaggtctgtgccgtaatcctaaaaacaaatggccaccctggagtctgtgaatttccacgttgagctctattcaatattgttgggggagatgtaaatgaatgtggtaaatatttaatggaatgctgacatgttgagtccagacctatgataggtgggcgtgtagaaaaattagtgcctaaccagctcaataagtttacaagcatttgtagaagaggcaaacaattcttgtctgccaaacattatttaaaaagaagacgtggagggtggtaggttgatttcaggtcagtgtttgtatgtctgggtctgaatatagtttggagactgtacaatctgtttggcatggctctgcagcagtgggatttctctggaaggatattttggaattcttgttcaccacccaccatgcttttcctgggcctcagaagagatttcagcatcgaggcgagatttagaatgtgggcacctgagtgttggtgccagctccttagtagatttccagggttccttacttagcaattacatcaacatccttggtcatgtgaagcaggcagaggaaaggaagtaggatttgggatcgggcaggtgtggctttgactgccggccctccctgctcaagttgccatgaatgatgtaaggcctctgagttctaatatcctcatttgtagaatggggctattatgagtaccaataccatggacttgttaaaagactggatgagtcaaagtgttggagtgcttagaattgtgtttggcacatagtgagacctaggaaagggtttgttaaaaaattaagcagaacatatcttctaggactgccttttatgcaagtgtacgtgtatgtatgcattaatctgtttttttgaaagttaccttttcttaaaaaaattaattttattgtaagttgcaggatacatgtgcaggatgtgcaggtttatcacataggtaaacgtgtgccatggtggttgtctgcacccatcaacccatcagctaggtattaagccccatgttcatcagctatttatcctgatgctctcccttcccccaccaccccctacaggccccagtgtgtgttgtttccctccctgtatccatgtgttctcattgttcagctcccacttgtgagtgagaacatggagtgtctggttttctgttcttgtgttagtttactcaggttaatggcttccagctccatccatgtccctgcaaaagacatgatctcatccttttttatggctgcatagtattccatggtgggtatgtaccacattttctttatccagtctatctttgatgggcatttgtgttgattccatgtctttgctattgtgattagtgctgtatgcactaatcttacaaccacttttgtactagtccagaatctattagttttaatggacagctacccaaatcaaacttgcttaagcaaaaatggggatttgttgattcatgaaactgggataattgaaggtcagtcggtagtaagtgaatcatcatttaaacgctcagcactctaattgagatataaacagatgtgattgtaagaaacaccatgaataaagctcaaacacttacaaatgggtgcaagcccaaagaatattttaagtatgtggttatattacttagagcaaccgcacaacaaccctgtaaggggagtgttattgccccaaatttataagggaattaattgaggttcagaaagtttaagtaacttgcccagggaaaaacagccagggattttcagagcccaaatttggacccaaacttcttatggcttcaatagctgagttcctgatcaatatgatacattgctattacgataaaaataagtactttttattagtaaactggagaccagagaaattatctatctatctgtctatctatacgtatacatatacatatacatatacatatacatatacatatacatatacatatacttatacttatattgtttgttttttgagacggcgagatggtgttttgctctgctgcccaggctggagtgcagtggtgcgatctcatctcactgcaacctctggctcctgggttaaagcgattgtcctgcatcagcctcctaagtagctgggattacaggtgtgtgccaccatacccggctaattttttgtgttttttatagagacaggctttcaccatgttggtcaggctgttcttgaactcctgacctcaagtgatacaccctcctcggcctcccaaagtgctgggattacaggtgtgagccaccatacctgtcccagagaaatatgttttcaaaaaacaaacaaacatgaaatacgtggaaaggcagcataacatgggattatgtatggggccagatttacccttcacaagctgtgtgattttgggcaagttacttgaccactctgtgtcttgttttcctcacagtaatatgaagatagtcataggatttaccttataggatagttgtgaagattaagtgagttaatatacaaaggagttagaagatgtttggcaaataataaatggcatatatagtttattttaaaatattttaaaatagattgtcatgtaagagccagaaaggaaatgaggtcactcagagtggttcctcttttgatgtccccagggtgtcccacaaggacactgctaatctggggagttgaaaatcccacctgtcagaggctctctgttgccaccagctgcctggccatgacatcgcagagagaccatcttgcagcagtcagccccttggctaatcctctccaatgagaggttcagctgcacagcttggcacagcttggttctgggtccctcacatctctgtcttgtctgcaaaactaggctgtatagtctctgaaaacacagttttatctgctacctccttttctcctccagtgctgtatttggtgggttcccagtgatggctaatacccattcattggtctgataacatattttttcccctggtctgaagctggagaaaaaagcttcagcagagagaagccatctcctgttctgagatgactgctagttatcggacaagggaatgaaagatgtgttttgcacttcttaagcacagacttgcttttacaatatggggtgccttagcacctgccccatgttgtttgaccttcttgccaccttgaaaacctgccccctgccaagctgtggtgaatgctgactggcaggttcatagcgtcaaagtcacagtgctagtaaacacgtcaacgtgatttcacgtgaaaacagccatccaagctgttaatatgagcccgccttaagggattttgactttgcgcatgcctgcccttagtagaaagtacagcacatcttgctacctacttggaaatctgatggacagtcagaagctcctctggagtcctttggtgaatttcacaagagccatcaactctctacaatgatggggaatatttggggagttacatgcgcagttttctgggatgagggcacaattcagagtggtccaatttcagagtggttcatgcctcaaaaataagattgaggaaccgcagtttcacccttagaagaggctcaatggtatgggaaaaagccaaggagaaatcagcccttgaggtggagatgatgcctcagcttcacaaaaaaagggcaacctaataatctctttatctgtcctcctcctgcgttccttccccttctgttttctcctccagtggttattctttcctggtgttccctggtgattagcccatttccatgtacctctgactttctcttgcttgggaggcatttccccacttcctgaagactcagtggtgggtggtgtaggtcagctcttctccagccatcaaagtcttctcctcctctctctgctctttggatttgtattcctttacctctaaggactgttgggatggttgagattgactaaggggtggagagtaaaggagatgaagaaaccactcagattgagttaaaatgtccaagctaagactgggcacatggctcatgcctgtaatgccaggactttgggaggctgagttgggaggatcacttgatcccaggagtaccagacccgcctggcaacacagcgagacccccatctctgaaaaaaagtttaaaaattgccagacgtgctggtatgcacctgtagtcccaggttttcaggagtctgaggcaggaggattgtttgagcccaggagtcggaggctgcagtgagctatgatcatgccactgccttccagcctgggtgacagagtgagaccctgtctcaataaataaataaaataattttctaaaaacccaggccaccatttctcagagtatattaatccatatcgcattcaaaaaaaagaaagccttcttatagtattgagcacaagggagttttgtagttttgtagcctctcagttcatggggatagctctgtgtttgactaactctacggccttggccaattcacttcccctctcatggtctcagtgttcttgttactaatgtactagatggaacagactctacttcataggaatgaagaggggataaactgagataacagatacaatgaaatgagtactgtgtctggcacatagtaagcattgaataagtggtagtgactctgttagtgatgatgaagaagatgaagatgtaggaggaaggaatgaagaagagaagaagccaaaagcctagcacaggtctgatacataattctcaaaaagcagataatccaatagatagcaaaatgaatgatgagtggatgggtgggtagacggatgggtggatgatgagtgggtggatggatggatggtgtgttggtcatcaaatcagttttggaaagtctggatcaaacaagatccagcagttttttgttttgttttgttttgttttgttttcttctttacaggacttctcaggtgcttttatatgctaatagtcatcatgaattcccaagaggaagacagggcaagctgaatttctccaactcatttgtccgtggtgtcctttttacaatgagccatctgatgagccttctatccatgcaaagtatgccttgcaagatgccagtccagcacacttagcttctaaagagaaaataataggcagaaagctcaggtggttcagccagttcagcaactgaatggaattagtacaaaaatcctcatttaccagtcctggagacctgtgctgttaggagtggcctctgtgtccagctcctgtagggtcctggagcacagaaggcagaagatgtagagagtgcacaaagaaaagtccagcggagtagctgcatcctccccccttctgagaggcctcagggggtatttgtttgcctcaagcaaggtcaacaaattctcaaacccagttgtcattcatccccagacaggtcagaggtcggttcctgaggcattgttgatctcagcagagatgatgtgcagggttgatattcttagatttgctcattcagccagtcagtctggctttcagaggagaatcaggtcaggaagcgcttaatgaaccaagaggagcatggtgctgcctgaaccactggggatttgagtttgtaatgactatcagcaggctcctcacttacaaaacctactggaattttctttgtgcatctccataaccatttttagagatgtggttagtactgctggttagagtaacccagggtcctggattctttaagttacttctgatttaaaggtaccatcttcatcatccctaaaaaccataaattgaacttgatatcctttttactgttttggtttcaaaaattgcattttccatttacagaagccatatacctatcctttgttaattcctgggtcttagttttttgtttgggacatagaagaaggaggtaagctcttcaacaagaaggcacttcacaagttgcatttgttagcacgctttcatttgagcaattagcggttgaagggaggaagagttttgatatccctggcttgatcctccaaccagctgctaattctgttgtcactatgacaactatcaacagccatttactgagtgtttgctatgagcctctgagctaaacactgcagtatactgtacttatttaaatctctggaccactccatgtgttatggctactcgtgatattcttatttcgcagataataaatctgaggcacagagaggttaagtgatgtgcacgggaacacacagctgataactggtaggaactgggcttttaatgtggtctatgtggtttaatgtgagctcttaactactatactatggtgcttgcaacaagggagccaggcatggtaagaagttgccaggaggtgagagaatgtaatgccacaagaataacatatgcttagtacatacttgtcattctcataagaacttcccatggaacggctcatttgcatacactaactgaaagcagtctctaagtggggagatgtgacttctcttctccgggtgtctttttttgctagattagtcctccactgagatttccaatgggggtggttgtaatctggagagaggttggttgatggtctggtgtatcctgtccacagtctatggaagcttttcctatattcccatcttgataatttgatgcggttgtgacttgggtgtcacattgacaacccttttgtagccatcctctccttcactgggaattcatttgttagtccttggtattctaaatattatgtagcatctcagggaatttttcttgcggtccatgctaggtaatgcttttccatgttctcttctcacctacgctggatggagtttgagtgcatgtctggcagtgagtgtcatttctcagttctggttcaagctgataccctagtgtcatcattcttgatgactcagcaggtattacaggcatgtagggaaacctgactcttggtaactgaccaggcacacattctgttgtttaaccttggacaagtcacttggactccctgcgcctctgtctcatcccacaggtaacagatcattctcaaatacttattgagcaactactctgtgcccagtcctgggtgaatggcaggcaaacacagggattgaggaggtggtggaggggatagaatggaagcacacctgtgtgataatgccagctaggcctttaccatcccagggcaaatcactgctgatgtttcagaatctcagccccatagatcacgagtgctgggattggagcaggaggtagtgctgggaagacctggcatatgactgcttgtggaaggatgggatgtatatataagcagttttactggggggataatagaatggaagctcgaacagcaacatctgtatggggtgttggtggggcactgaagacagacagagctgccatgatgagcagagagatgaaaaaacaattttgaatgggtgcattgaaaacattctgaagaatgaattaaaattaactagcactttctggatgccttccaagcaccaggaacacccaccttcagcatgtcatttcactgctgtaatgcatttatgagagggtacaggtgttttgtaccatcttagccctgatgggagtagggctcaaggatgagtatatcgtccttaatcagaaacataaaagggcgacagagcccagatcccccagatccaaacccagcctctccaactttgaaacgcaggcttttcctactgttgtgatgccctcaggtcacttgtgatgaccttggaaacataggtagctctcagtggtctgggggcccctggcagcccctccaccttcctcacactttttcagtcagtcatttctggaaggatttgggaaaacttcatttgctagtggacattttagtcattgggtgagcaagaagaaatggcatacttccttatttgagccaatctgccttctcaaaagtgtgatcactattaaaagagtcatgatatggtgtgggcagtctctgaaccaaacacaatgctgaaatgactttcggacaaaggtgatggtgcacttagttctgtcttgggtggcagggacaactttgcagaagctgtcatggaacatttgacttaggccaacaagattgatctaaaaggaagaaaggaagagaggaaggaagggtatttctgcatagcaggcaagtttaaatggaaaagtggattcacagaggtatttggcaaagataatttgccagtgtggtttgaagaaaagagtgatctgtagaaaaacggaaaatttgtatcggaggatgaatttggacagggtaaagtgaggaatattatgaagggcctcagatgctgtaggaaattttccattacccacttttgtctggaaacaaagtgagtgattgtgtgagtaattacataatctgcacaaatctgtattttgaaataaacattgtcaatatccaaaagataagaaatgtgatgataggatcagggaaacactctgttttatgcattttgttttgttctgttttgatagtcaacaaatggcaactgacagcttctttttagatagctttttagaaagcaaagaatggttgggttgatcctacagtgagctcctgacctgtgggagaggcagctttttcgcagatatgattattggtacaaagaaatgtggctcaacatgcctagatcttccagtgtttcaagagatagcataaatctagattttatatgagatgcccccattaaacaatattacctttttttttttacactgtgcagacaaatcattatcatgatcatcatcatccccttctgtggactggacttggtccccacggctgcaggttgcgatgttgaccgacagaatccatgaggcaggagttggtcttctctagataccccctgtctctcatcttccagacacagccaacacttctgtttcttccttctctttcattgacgtctaaactttgagaggctaccactcagaagggccagtcacttatgttggctctctttgttagtctggtgtcaaactcctgggctcaagtgatcctgctgcctcagcctccagagtggcggagactcaggtgtgcaccactgtgcccagcttatgttagctgttaagatctgggaaaggaggttctgggcgcggtggctcatgcctgtaatcccagcactttgggaggctgcggcaggtagatcatgaggtcaggagttcaagacaatcctggccaacgtggtgaaaccctgtctctactaaaaatacaaaaattaggcaggtgtggtggcggatccctgtaatcccagctactcggcaggctgaagcagaagactagcttgaattcgggtggcagaggttgcagtgagctgagatcatgccattgcactctagcctgggacagagcgagactctgtctcaaaaaaaaaaaaaaaaaaaaaaagaagacctgggaagggagatgcagtatctgacagccagagctaaaatgcctttatctagaacaggaaaagaggagttaatacctaagaaggaaatgtcatcatggaaggtggagatagatggaagaattttttttttttttttttaggtggagggatgagattgaactatcaaagcctggctaagaaaaagcaaaatccttgatggaaatctctggcacagggaaaatgagcagaactggcaccaaggaagcattaggagagagaagaagatagtggggaagcagaaaggaacagcaaaggagcgagtatttgccattgtcttgaagtctgacttcttggataaaatacataccctagattaagggttagcaaaccatgggctgtgagcccaacctggaccattgcctgtttttgtataatcttcgaggtaagaatggtgtttgcatttataactggctggaaactttttttaaaaaaagaataatattttgtgacctgtaaaaatgataggaatttagtaaatacagtattacaggaacatggccacaatccttctttggtgtattgtcaacggatgctttttcacgctacaacagcagaattttgagcagttgcagcagagattgtaagttctgcaacacctaaaatatttattatctgagtgtttacagaaaaacatttaccattccctgcccgtgatgggcagagcagatggcaatacacggctctttatttgacttccgtatgtttcagggatctgcctgtttcttagccactaccagaactgccccactctcctttcaccttgctgtttcttccactatttaaagttcctgcattacaccgtgagcgtaataccacataatagatgttgagtagcccgacatttgccatgaaccatgtgcactgccactggggaatggaaagacacacgacatagtgtcgaccttctagaggaggctccaagaaggaagaatcacagctcagcaatactaggtgcttcccatttgggagagcagaacctatgttaagaaaaagaggttttgtttagtagttgttatttatttacaggctttatgattagtggaaggttttgaacgaggacgaagtcaatacaacttcaaaaacataagtaccgcaatcatacaggacaataatatataaatacaaaatcagaatcagagaatgtatgagtaatggtgatcgcgactggaggtgggagggacagcccttattttcacacaagataaggaagatatttgtaactcaagaacagcaaaaggttattgtatcatggcgttcttaagaagaaaacagaaaatatccccggcacaaggtataactatatatctctatcctgtatgtaatatatctcttatttctatcctactaaaatcagcagattcttttatatataagcatatatacacacagtcacgtgtcccttaacatttggcactgggtatgttctgagaaactggtcaggcaatcttgtactgaatactgtaggtgattgtatctaaacatagaaaaggtacagtaaagtataacattataatataatctgatgtgaccagcatgatatatccaatttgtcatggcctgaaatgccattatatatacagtcatccctcaatatggtgggagattggttccaggacctcccctcagataccaaaatctgcagatgctcagtccctgatataaaatggcctaggatttgcatataacctatgcacatcttcccgtatacatattaaatcgtctttagattacttctgaagcctaatacaatgtaaatgctgtgtaaatcattgttatactctattgtttaggaaataatgacaagaacaaacagtctgtatatgttcagtgcaggtgcagaggttttttttttttttttttttctgttttagatgatctgaggttggttgaatctatggatgtggaaccccagaatatggagagctctgtgtgtgtgtgtgtgtgtgtgtgtgtgtgtgtgtgtttgtgtgtgtgtgtgtagagagagagagagagagagagaaagttacataaatacaatggatcactatcttctctgcagtttccagctacctcttcctcaagtttgcttattgaagcattcttgattaagagtaaggggatatagttacctctcttctatgctcaggaaactaagagtctaaagctgtaaatttgttgcctgaatgatggaattaagtctcctgccttctggtccagtggtctttctattttacaacactaaagagacaatttgatctgacacaggccttacctaagtaagtaagagctctcccctcctgttgattgctaaaggaaagcagacgggagagacacgtccgtctcacagtgatgcttctgtcctccccggtaacttctcagaaatgtggtgttgaaagtcatcgtcaaaagctaaagttagaaacagtatcgggctgttgagtaagaggggtcagtgcgcagctgttatgggagctttttgaattgtacaacgtggccactttgatgcatgagaatcaattacagagaaaccttgtcaagatggccaaaattcagccttaaataattgaattctctgccaaaccctgtccgccgtcgttatctagaaatgcaattatgcagctaaatcaagcaactaaaattagtgtagtgtaaaaacaccttggctatctgaaagtggaggaattgacatttggatttagaaaacgccaatagttggatatgtttggcggtgtttgaagctctctcccagtttcaacaaaatctatatcaagtgtcctgtttagagtgagcagtggaatgtggccagtgaatgtttcattttgaaggtgattttcagtgattcctgggacttgggcattatttgagtggattcacttcatcagaacttcatattattgctttcaaaattgtggaactacacacacccacatgtctttctaataagaagattagaagactgacaatttgattgttatctgagccttcagtctcaggtcaaagccttcaatctgaaaccaaagatgtgtctgtaccaatcatcaggaaaacagggaatacatgataaaagtggctaatagctgccggtactgcacacatcatgttatggttctaggacttcatttaatgataacacagccttttgaagtagggactattattatctcagttttccaaatgagtgaacagggttcagagaggctaagtaacttgttcaagatcacacagctagtgattatactgacacccaagtcagtataattccaattatattaattaatatattaattcaattggaattaattccaattcatgtcatcccctaggaatttatctgctcctatgtaacatatcccaaatgattgcttgggtattttcaaacaccagaaagatttcaaatctgtgcttgaatgtattttttatccatagttttggtgcttgttagctatgccttgaaactctgagaacaagaagacatctcttgttaatgtattgcatattaatatatcacagatgaaagctcaaaataaagaatgtcgttaaaaacacaaaataaaaggcatagaaaatgttattacagactgaaatacagcagtgaaaacagtgttgtggttaggaatcgggctctggaatgtgtttgtagcttcgcactgccttgtacgagctatgtgaccatgagcaaaccatttaactagtatcagccctgtttcccatttgttatatgggactgataatagtactgacttcagagacttgttgtgagaatgaaattacataacacgtgtaaataatttaactctgtctctctgcgtagcacacattgtgcaaatacaagctggctggtagttttatcttatttacaaattgccactttaaatttgaaatcagagagagagcgggaggaaaactagactgaatatcttcttattttttttctatcagtgccaaacgttgcccacattaacctgctggatttgaattttaactcggaggcgataatcacattaatttacatttctcagtttatttttccctaaaaatcccatgtagaccccatcccttgctcttttggccaaattcagtaggatgagcttatatctcatagcctggttccctctgtcacttggtctcttggtctctctctctgtctctctctctctctgagaactaaattaatgaagagtatttggttagtcatgttaggcaagctgttcccaaaatagcaccttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcaggtaattcaaggcctctgccagccagcaacttaactccagagtgctcagagtaataattggaatttttatggttgagaaagcaaacacttttaatacaggaaaaagccctcgcgtagtcagtgagaagacagtaggaaatcaaaaagatggatcaccctaatctagctatcgacatctctcatggctgaataaatggtgtagttgagctatatttgcttgtattgatctgactgctatttaacattcatgtcttagcttcaggaggttgaccacggggcaaaggatttgctctccttctcagctttctgagggactcagtctcccagagcagatcatgagacaaagtaacttatcatgaggtgactcagttaagagctttaacccaggaaatgaaaggagcatgaaatatgcattaattcataggacgcctccacacggattgtctattttcagagaaggctctccccacctgaatttgagtggtggcactgaggcaagaaggaacactctattgatgggtaatttatgaagctcagagattattctaggaatcccttgccagatgtgtacatcttaatgatggcaagaaagtggagggttgatatgtgtgctggttttactttgaagtcttttaattctgtgcagagaggattaatctaccaataaacaattggggacctttttttttccccctcatcataaggttttctttgcaagcaggtattgccttccgcgtttatgtctgaagttctccgttgaaagctaacatctactagcgatagaacccacagatcatagaaatccaaggtggctttttgttgttataattagttttttgagtataatcatccctttgcaataaattctgtatctcctttctacagaaaaggaaaacaaaatatatttaggtacgtcctttcacctttactcctgtgcctccctctgtcccctccagcccctcatagttaaaaactatatgataccctagctcattaattacaatttctgggaaccattctggtcacttttccccctacctcttctgaactttgctgttaccttttgttaagtgtacgaacctgggtgattagagtcatctgggggtgattccaagtcacaacaaaacattctctctttctggatttatggccgttcctctgtttggaagcttttctctgtattacctgttataaacaaatgggtcatctggagaacggtcctttgcagcgtggaacttgttgcgtcttccctggtatacacaggccggtatgataaggttgccatttctgaagtagggctcagtggcaacttagaaagttaacaggcctgttgctgctactggaaacgtggggtgaaggtcggctgttggagctttgtcagaccctctgccgacccatctgataaataattacaggcaaatcgtggccttcactctatgctgattgatgctgaaattgcttttgaaagttctcataagttcctgttatagattaagtgccggtgtaggaaaaataacggcacccactgaaatgggtgaatgtaatcaggtttaatggactccagagcttgttgggaattaaataactatcgatttgttggaatgttgctgtcattacgaaatgccactctggacgtattaccccagtgatagatgagaagatgcaagggccagctgagaaattggggaggccctatttcttcctcctttgcagagcatttgagaaacatagccagttatttttggaaagaacaagtggtcttacttgtaaatcttagcctgatcatactgtgtttttccaagcgacacctctggtaactagttacccataagttaggagagcagtttagtgaggagcctctagaccagctgctgtgatatgtgttatctcctttctttctcactgctgtggaatgcactggaaagctaacacacagagagaaactggctttacttatggtttgctgagacagcccatgttatttaccctttggcatcaagtagctaaaatcaccccagtgcagtaatatttgcaaggggagaaagggcagtgcaaagggagaaaaaactgtatcactcacagatgctcagctctgagccgatgtttctgctgccagctgtcctgcattgctgcagactccacttgctcactagtttcttgaccttatgggtttcttcctcactcaggaggcaaagtatttcctctagggaattaaggttctatcaccacctaaatatgtcattggcaagatgttaaaatgagccaaaataaaccatgtgtactccatcactgggagtaatttctctgtgactggagatgttgaaacagagttcatagtgtccacttggaaggattgttgtattatagttggagattacttttcaaggtctttccaacctcaagagattttgtggcagagtgctcccttttcatattttcaagagtcattttgaaaattcagaccagcatcgccctgttttagttgcctcagataaagaaaaaaaaaaaaaaaaaaaaaaaaaccaagtgatttaccagtcatttggtgtgccagactttaagacggcatccacctaatcctgcaaaggcagtggatggaggtatttactgatagcttcaggaaagttactcatacaggatcttttattccaagcaataattgatagttatcatctgccctacccttcctcctttaggaaaatcagaatctttatcatattggatctcctgaacccattattttatgtctacacttgttgtgtgtagccaaatagagagtttttccctccagccaggtagagaatgacagaatgactatggagaattcagctgaacctgtctggactgtctcatgtgcagaaaaagcagagaggaaaggataagagtagtattcccaagtgcattgtacaaatattggctgctttcccccttgatagagatcccgatgttgatatctttggataagaagaaccaatgtactacttaacactacttatttctgaatttctagtgatgccttgaatgatcagtgaattgtctgacctggtaacacaggagcctcagtcacttgcccaagtcagcctcgagtccagaagctactcagaggtcttagccaagccatggaccatggccaaatgacataaccaaaacaacagctttgtaactggttaggctatttggttagtgtttgggtctaatgtgttggctctgggctgcaagtgtggaccctcacccctcaatctaggtatctacctcatagatatgcccttgggccatacatggccaagtcactttcactattggacaaatcgttcccatttcatccaggtctgacagatgatgagtcagcagattattttcctggatggttgatggtgtaaatagagccatattcacctcatcatgcatttgttccttcagttatccattcactgtatactcaacctataacaaaagtgacagtcatagccactgaactgtgggttcacaatctagtggaagaactagtaggtaaaccccaactataagactataatgaagtcagagggaggaaatgataggtaatgattgttgaacacaatattgtcatgtgccaggctctgtgctaaacacttagatttaggatctcaatttatttttataataaacgtaatgcaattgggcagtatttgtccaccttcctatatctgtaattgtaaattccaaaaagctctgaaaatcaatttcttttggaagttgggcaccaaagctcatttaggaacagaaacttgacctgaaatgatgtgtagctatttatagactttctttatcccagctaatgtaaatattcatgtattttgctgtaggaatatttatgtgtttgattttcagggtgttgtcctagaccctgctgagggctttacataatcagcatttccactgaaataactttctgaaaaagcccccaaaatctgattttcaaaatgctggtgactccaacgggtcttaggtaagaaattgcagtcatgcctttaattcccctttgcctatggagaacctaaaacctacacttagacaaagctaggtagcccaaggtcacaaagaatgcgagtggtatagctgggatttggactggatttgttgaaccagggtcttttatccaccaagctaccctctaggttgaggtattcaggcagggtggcttatgaaaacacaggaaaggaagtaacccagtgcctcttagagtcgggaagagggtggtttcaaaggaagggaactggtatttgagttgggc[450 bp omitted]agtaactgggattacaggcacgtgccaccacacccagctaatttttatatttttagtagagacagggtttcaccatgttggttaggctcatcttgaactcttgacctcatgatctgcccgccttggcctcccagagtactgggattacaggcatgagccaccatgcccagcctagggctggtgaatgtttaattttctgggtttgtgcatcatttaccattcctttctcttttaaagtattattttatttttgtaagttccagggtacatgtgcagggtgtgcaggtttgttacataggtaaaggagtgccatggttgtttgctgcacctattaacccatcaccgatgtatttagcccagggtgcattaactgttttccctaatgctctccccacccccacctaagcatggcaattatcatttaccgtttctatgccttcttttctctctgagatggtaagctctcagagggctgagatttttccagcctaaactttctatagctagacagtggcagaaaaatgccaatgtatgcctctctgacgtggatagcaatggtttaaagaaaccctatactccatgtttttatttttatttcttttagagaaagggtctcactctgtcactcagactggagtgcagtggtgcaatcatagctcactgtagcctcgaactcctggtctcaagtaatcctcagcctcctgagtagctggaactacagacatgtaccactatgctcagcttttttaaaaaaaattcttttgtagagatgaggtctcattatgttggccagcctggtctcaaactcctggtctcagacacacacactgtattttgaagcagaaaccagcgtatgtattttatgagacatctacatacctatatgtagtaacaatgcaaattatagaaacatcggccttaacaatggacagagagtaaccatccttatagaaagataaagaaatctataaagaacttacaagtaatttgggtaagtttctggttgaacttgaaaaacaacagcttgtttggctctgtggctggcatttcaggtcttgatattgctgccctgcgattttatctccatgtttggaatgtctgttgattgggaaagacatcagcatgcacacctgatataaatgctggtggcgtcatttactctgaggctgctccatcttagtcactaagcggacttttctgtactgccaaagaggccatgtcaacagcggactaaattaaagagtcagggaggtggcagagagaatttggagtcaaacaggtccaggttgatatataggctctggcatttactaagcctgtggcctgaggcttgtcaattaacctcaccaagcctcagttttctaggctgcaaaacaaaagcaggaaggcctagcttgcaaagtcactgtgagttttcagtgtgattcatcatgtgtttattcagcaattatctattgagcacctactgtgtgccaggctgtgaactaggactaggtgatgtggtagaatagaacacactctagatctcttccaacaggaagttgatattctaacacatgggaaaagctagcatataaagtatgtttattctgtattattctggagagagaaggagagaggaaagatatttatgtattattattattttgtgacggaatcttgctctgtagcccaggctgtagtgcagtggcatgatctcagctcactgcacctccacctgccaagttcaagtgattctcctgcttcagcctcctgagtatctgggaccgtgggcatgcaccaccacaaccagcttatttttgtatttttagtaaagacagggtttcaccatgttggctgggctggtcttgaactcctgacctcaggtgatccgcccacttcagcctcccaaaatgctgggattacaggtgcaagccactgtgcctggccagaaagatatttgttaagaattcttttgtctgcgatgaagaaaattctaagtcctattggttaaagggggaaaaaaagcatctagctccagcttcaggcactattgaattcaggaattttgacaagccaagggctgtcactctccacctctccacagtggttatctctacttgatcctcactcacaagcacaccatgtccaagtggtggaaaagatggttcttggcaactccaagcttacatctcatctccttttagaaattctcttcccaactattccagcaagaattccagattgcagtctcattggtagatcttatagtccatgcacatctccaaatcaatcatctaatctctggttgcccactttagagccagagggcagggtcagccccaagaaagctgcatagactatgaacggaggccagatcagggacctcttaccaaaatgtgttggtggataagcaaaatctaggttcttgttatcaacaacaattatagttaaagctgtcacagacattcaaacctgtgctttctcccccataactttgcacacaccatcccctggggagcaagtggtgggtttcagatcttaattatcctgatcacttgttgccattgatcatatttactaggtagttttattgccttccacttcacttggcttctccattcatgatcagatttgccaaaggcagggatggctgttttacctggtatcttctccgttgcactaattacagtcatgtcttccactcgtgtatttgggatattccaactctttttacagactagtaagtcacaacctagggaagtcaagacagtccaaccaggacatccaacaacacaataatcagtgcaagattgtgtttctcagattcatgatccatgcagccacaccacttctcttcacatcagtgatgcataaataaatatattaaaaagagcaaacagagccttccagttattaactttgtcatgacgtagacctcccatcattccaaagcactcgaagatgctagtgacttgtcctattctgttttatataaattcacttttttaaattaagagattaaagggacactgtcaatctcttctgattaatatcagtcctataaaaagggtgtcttgctgcagcagccatctgtcattttgatcattttaaaggcatgctatatcagcaactatgctttttataatacgttggcacagggcagggagggttggaagacctacggatttcacactctctgctgctgctttggtgttcggcaatgtgagcttttgatggtggagcagagtcccctccctgtcttttaaaggttgttttgggtaagtgcttttcctgggtgatttatgatggagatactcacccctatttatgtttttcccccgtctaaagatagacctctcacacacacatcccaccagcttgcaaggagccagcatgttcacttgattcactgctgagccctaagagatgcccagaaacattgaactcaatactctgaaggtcttttcctctgagcaaccgagaccattatcttcagcaatggtcactgtctagattgagcttttcaggcttgtaaaactaggaggcaaaggctccatgaaactcattcatttattaagataatgatttatcaatcatagatttcgtgactgttgtcttgcaagctctggaggtattgggatgatcaagtcccagtctccgtcctcagaggttgcgtaggggggccatgccattcgcagtagagtcagaggttaagcacaactgtttgaagatagaactcttgagtctccaccccactgaccgactcagtatgacgtcttcattgctgtcagtggtctgacactcaagacaggtttatgcacagtccaaagaagatggcttcctacagagagatactccaaatgacagagttcctgctacatttcagagaacaatggtcctaccttccttccttccttccttccttccctccctccctccctccttccctccctccctccctccttccctccttccctccctccctccttccttccttccttccttccttccttccttccttccttccttccttcctttttgaggtgggaagatgacagcaggagctcctgcccccggcccccttcccaccttgcatccaacttagactaaagtaatagagttcaacacacccactgctgtgggagaaggtgttgcttggccattccttctcttctgctctttaatctgtattggctcctggaggaggggagaattgcagtgaggagggggatcacttgttcattccacattgttctcaggaactgctctctgaagacctatttcttcttatttcctgaggcagcacagttaaatttgaaaagaacaggatttacaacaaggaaacctgagtctggccattactctctctgtgttactcttggtaagttgcttgacctctctgaacctccacttcctcatctgtaaaatgggagtaataccaagtgtactctactcacaaggcctttgcagtgtagtcatggtgtcattagggcagcaagacaggatgcctagggctgggcttccaactcagatcttcccactcagacgcatctgagttggcatcctggctcctgtgtgatgcggggcttcagctctctgagcacccatggtttcaacctgtctgcggggatggtcacatcgactgcagaagggagcaatccgatttgacaatcagctcattgtaccaacgccacaactgattgccagcagtgttgtcttggtttgttcatgatttctggagttattgaatgttcattttgataaatcgagatgctctaggttgggaaaggagaatgtttacacttctctgctcccattcttggtggagattcctggtgagcaaggacacatgtgtttggcctgcgtggacagtgcagagatacaactggggaggtggcgaaggagagggagagatgccaccatggagtttgacatcttggctcatggctctgggtggtgtgaaaccaccatcctctttccacatggctggtataaaagccaccatcctcttcccactccctaagccaatagcctgcatagttggaatgactaagtcccagcctctgtcctcagaggttgcatcagggggccatgtcattctcagtagagtcggaagttaattacaagaaacacgtgaaggagagttgatcagtttcaataatgttgaatccttgcccaaatctttgtccagaacatgctgggactggaactggagctgggttgcaggacggggagggtggactttgtagggggaagagaggcctgtcccctccgttccatgtggccatagccttctggggacagactctttaggaccacccacacccctgttccatgcagctctggcacaccgtgggcgcttaataaatgttaaataataagaatagctcccatctgtcagtgcccggtggcaaggaggatgtgtgagtgccagccgtcactgggcagcttatgggaagcctttcggggggaaattgtagctctgagtcgcttcgaagtcccgctgcatccagatgttcccccaaagctgctatggatcagtgtccaggcaagggaggagcatgggactccagaacatctgcatcagagtgacagggggcgggaccagagagatgagaatctgaccagcagtgggatttgggagctggtattgaccaacagtacaagggctttgttgaggtttaaaagggctagaggagctgccctctgagcacacagcagcataaattcatacttccgtcatattcttggaagcaaatgccaactgggacttttcagattttgttataataacaacagcagctgctgtttttaggcatttactatatatgaggctgtgtgtgaggggtttcacttgtcgtacctaattgaagtaatatatcttagggaggaaaaaacaggcaaacaggaggtggtatggagtagggtgtgagctctagagcagactgcctggttcatctgctgcaaccattgaggcctccacctctgggaccttggatgccatttgctacctgtgtgaccttggcacagtttttcccttctgggcagtagtcaccctctttgagtggttgttaaaggaaccaaatcatgtaaagtccacaatatagcacctggcacatagaaagtcctcaataaatgtatttacaagtttatttccaagcgtaaagcaataccaccacaaccaacaccaatgcaattaaataatagcctcaatcttgagtgttttctatatagggaagccaataccttctactggctaagagtatgagcccttgagccagactgcctgggttagaatctcagctttactttttttttttttttttttttttttaactcctaagctactctgaactgcagttttctcttcggtaaaatggcccatattaaaagtgcctaaattcaagcttcgctgtactcttctgtaggacagggataataccaaagtcatttctgaggatcaaatcaattaatactccctaagtacttaaaatagtaaatccaatatagtcagggctaaaaaaaactgatagaaataataattgttacatgattattttatattttatattatttgtattatgcattattcataagatataatgcaatatatatttcaataatatatgcaataatatgtattttatgtaacacatagttataaatatataaatatataactacataatgccatatagttataggataattatatataatgattagatgacacatatcattgtgtaatactgtataatagttacatagtaatgattatatgtaatataaatgataataataattattatttctactcttgctactatgacaagttactccattggggattttttcctaaataatttctaccactttgaagcattctggccagacttattttaaaaggaaactgaggctcagcaaagtggaacaatttgccctcattcttaggactggggaagggcagaccagccaggtgtctggctgcagagcccgtcctcccgcagaccacacaattctgcaaagctttggtgtctgtcgtctccccatcctccatggggaaatggccatgtctcttgcccgtacaaccgactctgagcagaaggctaatgcgatattgtgccgctgtcatttctgatcagtttttcccccactgtctcacagcgggctgtcaggaggccttgttccccatggaagcctggctcctcgtggagaagatcaaacctggaggttgtgtggtgacaaaggctgaggaagggcactgctgggactgggtcttgtggctctattttcaagacctttatttttggttatcagtgttgaaacctggaaatacactttctgttttccgtttaaacacaaatcaagcaacgttaccaacacacattctctgtcaaacatgtcagttactcccggggctgtggacagcttgcaagcgatgtcttctattgttactgtggtggtgtgttatttctccctctacagctctgcatttgttttggcgagcagtgtaaacactgaggggcctgctctcggggaggttttgacagaacatgtgaaattgacatggaccgtccgatgaccatcttaataaggctgttcgggcagccctgtatttgcctgtagcattttccatgaattttggtgggggcttaaggattctaatgagctgggttttgtttcacacctggtgttttggcagacagttcccactgtgacttagcagagggacttggcacggcttgccagagggcctaagatttgtgtgggcgcccagcagatgttggatgtgttcacccatcatacagaacgccagtcatcagccgccgagtcccctctctgtctacattgtaagggaccagagctcccacttgctgccggtgatggagccgtctggggatggataaaaagcctttcattactgaggataatgcagagcatatgggattcttatctgtccaaacagttgtgggatttgggttagagacgccgtctgcatgtgtattttctttttctttttttaattttaattttttgtttttatttttattatactttaagttctagggtacatgtgcacaacgtgcaggtttgttacatacatatacatgtgccatgttggtgtgctgcacccattaactcgtcatttacattaggtatatctcctaatgctatccctcccagctcctccaaccccacaacaggccccggtgtgtgatgttccccttcctgtgtccaagtgttctcattgttcaattcccacctgtgagtgagaacatgcggtgtttggttttttgtccttgcgatagtttgctgagaatgatggtttctagcttcatccgtgtccctacaaaggacatgaactcatccttttttatggatgcatagtattccatggtgtatatgtgcgacattttcttaatccagtctgtcattgatggacatttggtttggttccaagcaatgcccctgggccacatgggacacacacaccatgatgtgtcagcaacgagacgtctatagagtaaaccacgatggcagaggagcattctacccaagagggcagtgtattttctttagtatttggttctagcaagtaggagcttcattaaggagcattttgtacagttccttcctgggaatggacacgacacgcgtttgataatgtctctgctttctggcttcacaccttcctcccatgttagcattggttctaaactcccaagcacagatgttaccaagccactgccctcctgtgtagaatgctcctctgccatcctggtttactctatagaagtctcgttgctgacacatcatggtgtgtgtcccatgtggcccacgggcattgcttcgttcaagcctttgtgttcagatctgccctgttatcagagacaagttgatgtcaacttacctcttatctctgatcaataactgttgggcttcctgtgggttgactgaagacccataagattcatgagacccatacgatcatgtgggttgatgatctccaccattctgaatctcaagaaaccaaagatgattcttgaatgtgtgtttttgttaagatccctttggctgaaggaacagaactcaatcctgtctagcttcaaaaaaaacgagaggggcagcatttatatgtttactgtgttttgaggtgtagtgcatgaacaattgaatgcacagaaactcttggactcaaaagagaaagaaaaaagtcaagccaaggaaagcacaagaggtaagacaggcctagtgatctcagcaggcagaatttatggacatattttgcaggcaagtggttctcaatcaggggtgatttttggcttgtaaggacatttagcaatatctggacacattttttggttgtcgtaagtggatgggggttgctgctatcatcctacaatgcataggtgcattagtctgttttcatgctgctgataaagacataccggagactgggcaatttgcaaatgagagaggcttattgggcttacagttccaggtggctggggagccctcacaatcatgttggaaggtaaaagacatgtttcacatggatgacagcaggcaaagagagctcgtgcagggaaactcttgtttttaaaatcatcaggtttcatgagacttgttcattatcaggagaacagcacaggaaagacccgccccccaaattcagtcatttcccaccaggttcctgtcatgacacgtgggaatcgtgggagatacaattcaagatgagacttgggtgaggacacagccaaacgatatcaagtggacacctggaattatcgagcattatccagaattatcagtcacgccgagattgaaaaaccccactctaggctgtcacactactgtgactcagctacagagactatcagtctctgcaagtcttcattcaacttttgctttctcagctaggatctgatggacccaacctatcgtatgtctcaatctttatatcagtgaactatgcccgagacccccatgtatttgcagcccgttcaaagtattgctgagtagtcctgggaaagcaggagtaggatgtagctggttgtgagctgttagccattccgagacaggcgtcttgcagggtgtattgatagccttcagtgcaccctatcctgtggctgacactcattcatgctagtgccttccatgcagagctgtctgtttgtagaaagcaaggcccaccttggtgccagtcttaacgagcagtcaattgatttggttttcgatttaagctcgttgcctcctttgacttctgtttaacagaaaattcactttgcaaaactgttttaaaacattgttgcttacttttcttaccataaaattaatgtgggctaaacctaagttttcagaaacaaaaagcacaaacaaacatacagagatatatgcatataccacatagatacataaaccacaatccgctacccaaaaatgcctactacaaaccactctttatgtatcctggatttctttgtggtacatatattttcttccctaaataattcttatctactctcatcgtattcacaaagatttgtaaaacttgcaagcagctgggtttttaataggaacaccttttgaaataaaattaatgaattttttttttttacctcatgaatattttctgttaggtttttaagactaaggtgatgtcttaaacaaacacatattccgtgtcctttccacatgcccctttgctcttatccctctccttcagcccatggcaaggtcgtatatgatatcctaagtaaatagatcaccaaagaaatgacattactttagtcagttgggaaaagaagatagggacaaagaagagaaagtagcaaaacaatcctatagattacagaattacacaaaaggccggttgccgtggctcacgcctagaatcccagcactttgggaggctgaggatggcagatcacctgaggtcaggagttcaagaccaccctggccaacatgatgaaacttcatctctactaaaaatgccaaaattagccaggggtggtggcacgtgcttgtaatcccagccccttgggaggctcaggcaggagaatcccttgaacccaggaggcggaggtttcagtgagccaagattacgccactgcactccagcctgggtgacacagcgagactccacctcaaagaaaaaaagaatgaagagagaggcagagattgatcggctccagtcaaccgggtgagtaggaggcttctgctttcagattttcttgtaaatttcttgaaatggggacattgaaaaatgtgctagttttggagaaaataaaaatttcatgaccacgatggaggtgtggttgctcctatggttctcagaacacaaaaccatctcctagagacccactgaagttcatgctcattttaggactaaaacttgggttaaaaatcaggcggctcaagagatcaagatatcttcctggcagccttctatcacaagtggagactgggagaccaaccagacttgccttgtcagctctcatcactccttctctcaaaccaaacgcatgtctaaggcgcaagatcggttttcaatttaagtgacttcgctttctctcttaaaaactaaatcctcctcctaattcccctaagtcctcaaagtataacatttttcctttgtagattggagaaagaagtcatggatcgggcttgccaatggcattaggatgaggtctgccagccagtccttgtcagaatgtgcacagaaaatttaaaagacttttttttttccaatcagtagcttaccagttaatactcctccctttccgttttgatagctgaccctcagaatcaaaatgaggatggcgacataccacatccgcttgagaggctgaggagggttgggttcagaaagacggatggctgtggcttgctttccatatgtgttcaccgatttagtaaatatttattcaacattcagtgtgtgctagacaatacagttccaggtgtgagtaagaccacttatatcctattaacaggaaaaaataaagcagaaaataaccaggagaatatcagatgctgttagctgctaggaaggaaataaaataggttatgggccaggcacggtggctcatgcttgtaatcccaacactttgggaggccgaggtgggtggatcacttgaggtcaggagttcgagaccagcctgggcaacatggtgaaacctcatttctactgaaacatacaaaaattagctggcatgatggcgcatgcctgtagtttcagttccttgggtggctgaggtgggagaatcacttgaacttgggaggcagaggttgcagtgagccgagatcaggccactgtactccagcttgggcgacagagccaaattccatctaaaaaatttaaaaaaaaaatggttacatggtagtgactgaaagggttattttagatagttgaaacaggaattagagctcagatctgattgacaagtaggtgccagctgtgtacagtcgtggggtatgggaaagaggtctaaggggaggaaaaaagcaaaagtcctgagatggaatgaaatgggtatgtttgagaaatgaccggatggtcagtatggctgtgacacagtgggtaaagagggaggatgaaaaacacaaagtcaggtgtgcaatcagcagccaggtcccattccaccttgtagggcattgcaggcagtttagattttgatctaggggaaatggcaaacccctgcagaatttcaagtaggagaacactatgatctgattgtatcatgttaaaagattcctctggaaagtgggaggaggatggacaaataatctttagtgggacaagatgcaaaacagacaggacagctagtatgcatggtactggtgaagacgaccagtaccatgttatccacgattggctagtgaatatccatatttcatgctgccatttctttgatcttcattgaccggagaattctgccctaaaaagagggcccgtttcagggatgtggggtaacagaaaaatcacagtgttaatggaatgagaggtagaggaccagggagtatagaaatgtatctgtgtctgtgcctgaaggtctggtattttgtgtggcttcaggggactgtagtatgtgtgtttaattgttaatgacccaagaatgcatccaaaggggttacatgcaaacctgcctgagcatggaagatcagtcttgagtgctttattaagtctggctctatcaaagctgtaagcaacatatggtgtgccatgtgcccatggactaggttttccatcacaggacagttctgtcttcgggatggctggttttccttttattttagcagaagtagagaaggccccttgggactggatctctcacttttgcaagttatgaccacaggggacaacttgggagtttggattcagatggaccgaggttccagagccagcctcactcactgttagctgtgatcttgaacaggttcttttacctctctgagcctcagttcattcgtacctaaaatagagggaaacttttctatgtcaaagggtagtagaaaggttattacgcattgactggttagttcattcctttgataattctttagacatgtattaatcaccactacgtgcaaggcacgatggcaaacattaggaacgcaatgaagtcagctttgattctttttttagtggaatttatgttcttgtaggggaaggagacaaaacaaagaataactaccataatgtatatataaactgattaattttagattgaagtgagtgctatgaagaaaataatgtaagagggaagaaacagttaatgatggtgcggtggatcatgatactctgctcttgagctcacatcctttattgtcttgaaatttttcacccattagctcacttgttctctttttttcgcttcctgggtttgccttagagacacctggtactttactctcccatgccctaaatacccatgtccacagggagcagctgacttactgtggtacaaggaatgtgcttttccagattttaggagccacctgtttctgggagtgccatggaaacacacattctgcctctcaatcttcaggcccaggcaggaaattttcagctgtcagcagctgtctttctgatctgctgccaaggagtttccaaccccaaccccaggaaaagcccacagtgaccctcaccagggactttgatgccattttttggagctgaaaaggaaggaggggctcctgcagagtgattcgtgggctcagttcttgacttggggtggctgagagtttccccttaaataatatgtcacgctgtaggcatatggtcttgcaattgcggggtgtatcatttccacttgattgtcaaagcaccccacggcagaaacatactaaaggatctctgctccagatacagccatggctttgcagcatggcagatttgcagctttgaggtggaaaacatttttcagcctttcccaagaggtgaactggatacagctgtgcagtgtaacctaaatctttgcacgtgtctttaaacagggcagaaacaactggccctgtccttccactctgggcctgatgatgaccaagtcggagagaactgaagctatatatcctgttctcagaagttgaatttccccatcttggacagagtagtgtgctgttgtgggaatgcgtagctattgccttactcaggtgaatgtcatctgaagacgtggggtgggtaagaatctgtcaccactaaacgcttactccgggctgcccatcactgctgtttggtcagtccttttgttctagggccctttgcagccattctccaggaagagtcatcctggccttgccttcagaaacaagctcgctatatttcccatgtagttctagaaagaatcctggtgcagggattctgaaggatgcactcttgtcctggatctgcccctcaatgtctgtgtattaatgagcaaattattattattattattttgagacagggtctcactctgtcaccaaagctggagtgcagtggtgcgatcatggctcactgcagcttcgacctcttgggttcaggtgatcctcccacctcaacctcccaagtagctgggactacaggagcatgccaccatgaccagctaatttttgtattttttgtagagatgaaatttcaccatgttgcctacgctggtatcgaactgctaggcttcagtgatctgcttggcttggcctcccaaagtgctgagactgcaagtatgagccactgcacccagcccataccacttttccatatggcttcaggttacaggtttgtgcatgagttacatagtggaaccctaaagccatacctttgaccagttgtctaaagtttttagcaccactactactgtatagctaatattttctttgaatggattcaatttttgtagcctaaattgattcacaaaaaccatacttttcgtctctaatttaactggacattcaccatcactagccataaataaatggtacctattacaaatgcattgatgaccctagctagaatggctataataaaaaagatagacagcaagaagtgtcagcaaagatgcggagaaattggaatgcacatacattgctggcaggaatgtaaaattccgcagctacttagaaaaatagttgagtatttttcttaaaaaaattactcagttattatgacccagcaattctgctcctaggtatatattcaagataattaaaaacatatgtgtacacaaaaacgtgtgtaccagtgtttataatagcattattcatagtaaccaaagcatggaaacaggctaaatgttcatcaactaagaaatggataaacacgagatgatatagcatacaatgggatatgttcaggtataaaatgaaatgatgtcttacatgctgtagtgtggatgaaccttgagaatgttgtactaagtgagtgaagtcagatacaaaggactacatattgtatgattcgatttatatgaaatgttcagcataagcaaacctatagtagcttaaagtagattaatgattgctaagggctgaggggagagagtatgggaagcgatccttttatggatatggattttctttttgaggtgatgaaaatgttctggaattatctggaatgttctagaattgtacaactatcaccactttcatacacagttgtacagttttgtgaatatgttaaataacacagaattgtatattttattttattttatttttttggagacagactcttgctctgtcactcaggctggagtgcagtggcatgatctgggctcgctgcaacctctacctcccaggttcaagcgattctcctgcctcagcctcctgagtatctgggattacaggatctgccaccacgcccagctaatttttgtagttttagtagagaaagggtttcatcacattggtcagactggtctcaaactcctgacgtcaggtgatctgcccacctcggcctcccacactgctgcgattacaggtgtgagccaccatgcttggcccgaattgtatattttaaagtgtgaactttgtggaatatgaattattatttcaaaaaatatgttgaaaacaaagcaatgtcatcaaattctttctattacctgtgtttgttgaaggtgtttgctgtattcaaggcctgttttccctcaggaaataaaacagaggttggaaagtattaaagaggtgttgttaaacacggcctagcaccagctgagactgtccttcaagcagccagaaaaactgaatgagcttggaaaaaaaactacttcctaaaaccttctaaactcagcttttcaaaggccaccaatgtgaaatgcttaggatttcattcaatttaagcactattaccgtgcccaatttttgttagctgtgtttatgaggaaagaattaggatattttagctggggaagatagcactctctggaaacatactgtgcgatatgacggccactagtcacgtgtctctatttaaatttaattaaaattcagtagccctcaaaactgtgccattgacattttcagtgcctaggagctacatgtggtttgtgttggttgtactagacagtatgatataggacattcattttattgctaaaagttctgctggacagctctatgctaaaagattaaattaattgtattgctatcttgtggtctctttgctctgctttccctcatttaagcaaattcgaatgctgaaacatgacaaataatgattataataataaaaattaatagttaacgtttgtacttgccctgtaccagacagtgtgctaagcatttaacgcatgaggtcttagttaatcctcccaaaactctaacaggtagctaccgctatcacccaagctttgaatgtgagaaaactgagcatcagagatgtcaattgctgaagtcccagggcattgggaggcctggatttgaatccccatcagttggctttgtgctcctcgtccttctaacctctactttttccacaaatcccatcccaggcctcagccagcaactcagagtccctctgtcaaggtctctgagaaattttacttgtcacgttttatcatgaccgtattttctcaggacagtttcaagaaataagtcagaaagcagagtaaagtttgtggctctgcctactgccccctttctcctgtcctacctcccacccagagacaatacctgctaacgatttggagtgtgagtccgaaaccctcccatacttttcctatgtaattacatgcataggtatgtgtacaaggacaccatgcacgtgtgttaagcaagtgggatctcatcacccacatgattttgctcattgcttttatttatctaacagcatgttttggccatctccccatgtcagtctgtacaggtccactctatcattctatattgtgacggcacacaattctataaacagtaataccatgatttatttgcccttcagcaaatggctttgccaattcttacacacaaaaaagggtatgatggaccagtttcttgcatctgtgctcaaactggacatcatcaatcttttaagtttttgccaatctgttgggtgataatttcttttcctttcaaccttcagggtcatttgcagctccctccacctgctctgcccaggcttctagctgctgacagccaaaggcaatctgccggaggcaaaatgaggtcaaggccaaaaaccatattttctttcagtgagagagggcatttacttgggtaaatacggcccatgcactgtgctttattggtttgaaaaatgaagaagcaagctccaacgagttctctctaatggggctgcatgtctccaatacctggtgctccaatgcattgattgacgcattgtcatcacttataaggtcagtatgttcatccaatcctttattcatcacgtaactatcaggcattgattccatgctaggcagagttctaggcactgagaatacagcactgaatagtgagtcaagacccctgttttacgggacttagattctaatgggcaggatggaggcccacacaggcatcatcgttatagatctaagcaacaaaagactgaaatgagaggtatgccccaagacacagagggcccatcacagagaggacagtcaggtaaggcctctctgagcatgcacactaaagaaaagaactgaaagcaagaaggagcatcccactgagaagaaagtgactggagagtgttcaaaagaagccaggatggccagggccttgtgatggaggaggagcctggcaggaaatgatgtcgggtggtaggtggggggccgattgaggcagggccctgcacagcatgataatgagtttggatttttatagaggtgcagtaagaagccactggaaagttttaagcagggcagcagcagaatttggtttattcggtaagctttacgttaagggcatttgaagttctgaagtgcatgaatactttgctttttaaataagacaaatacgttaaagaagtgttaacagttttcttaaaacagggacactctcacatggcttctgcagtgccttttccagtgatggaaggaagggtttggagccaggtttagtggacttactattatgcgtagtctttcgtcttcagtatctgggtcacagcttataaccaaagcatggcaagaacctccagcaaggttgatgcaggggaaagaagattgagatcaagtcttgttgcctctagtttctgttctttgtgtgaatgctgagggcccctctgtgcttggccatttcacaccagcagaaagcttttgggctcaggaatccagggatctatctgccttggaacattctgcatcaaggtaaaccagtttggtccagtagtgtcatgaccagagatgggagaagaaactgtgtgctcgaggtgctggggctagcatgtaggaacacaaggattttgaattctgcaagcatacacgcagttttgaaatcatcctgataagagtcggcaggagaaatggaaaaaaaaaaaaaaatctcttggatggaggatatcagtcctgtgggtaagaaggttcttggttatcatcattatactcccatttttcactacaaaaacatttttagagaaactgatgatgaaaacaaaagattccaatgaatcagaagcattgattaagcttaacagagagcagagtggtggtgaggtgcatgaattgcagtggaaccatccaggttttttccactttctttggcctcacctttttgccctacaactgtcctgcttactgctgtttgaagaaatgaaatccaaccacctccacctcttttcatacttacccatcttgttttgctgcatacattttgagccctatatgtgcatttcacccatcttcctggactctgaactgagccttgtttctgagccattttcagtctcttgcgcaggacttttattcagtctcggttgcaatgtcagttttcttgccctgcccatgctcagaggagaccaggctagtggaggtgcttcctgtgaccaagtggtgctttaactctttattttaaataattttggagcattcagcattgctccttctccccttccttactttgttactctcctctaaggcttcttttccattcatggaagatatttcttcagtctagttttggttcctctttaatttttttcctctctgagggaaggagttgctgttttttactttttactgtctctgtcttaatagggagggttactttcatctgcctgagaatcacgttatcttccatgtgggctaatgactagtgcagcctgagacctgagctcgaaccagccttgtagaagcagaacagtgaataggctgatcttcgataggtaatttacaagacttccacttcttactgattaactttcataactcactccagaaaataaattgtgtatctgttatcatcctattggatatgcagaagctgtcctgagagggttgataaacctttgaaagaatacataaccaagtcagcctctgctgcaaataaaccgtgacagagaaagagggtggccgtgccaccgaaagggacaggtgacagtggcatcagagcaaataatttgcaaattgtttaataaataatgataaatctctaagcagctcctgcattttattcaaggaaaattaagacttaagtatttttgtgttttttgttttttgttttttgtttttttttgaggtggagttttgttctgtcgcccaggctggagtgcagcggcgcgatctcagctcactgcaacctccacctcccgggttcaagcaattctcttgcctcagcctccctagcagctggaattacaggagtctgccatcatgctagctaatttttgtattttttgtagagacagggtttcaccatgttggccaagctggtctcaaactcctggcctcaggtgatccacccacctcggcctcccaaagtgctgggattacaagcgtgaaccactgcgcccagtctcttaagtactttttatatgaataaagtagtcacaggtggtaggtggtacagcaatgtttgtatgacaaagcccagaaagtagcagagagaaggaaggttatatgtgctcacgatgacttatctacataatacgagagaagtaactttctaaggacaagacatgagacagtaagaccattctgcccttgactctctaagacttggaatttcggatccataaagtaaaacatttctccttttaatagacaattagattaatgatgtttttggaatgaaaaaatctaagattagttgagttctttgctgcctccaccttccttcaaccttgactcacttggtaattgtcagctacagcatagccatctaaggaggtacagaaaactgtgggtgagttaaacatgttggctttgggtccaattcctagccatccgtgcaaatgctgtgtgacctttggcatgtctcagaacctctcttatctgagccttggtttctaatccttacctctcagagggacgattatgagaaggaaatgaactatcataggatatgtaaaatagtatatagctgtatgtagcatgtagctacatagcatatgtaaaatgtttatcacatagtaagcacctgttatatgccatctaattgtgtgtatatctgtgtatatgtgtgcctctgtgtgtttgtgtgcacatgtgaatgtgtgatactagggaaaataatttaccttcattaaataactaaatgctttttactactccctgtggagcttgatatataaggttgctcaggaagggagcagtaatttggtgggaaatagtcacttgtgtgtgaatcatctgaagtacccatccttgtgtccggatttggggctcttgagttaaaccactgtttgcttcccctgtccacaatggcttgctgtctacagcacgtctctccatcagcaatgtcaaggatgttttgttgaatctcaaatttaaccactctggacctggcatggtggcttacccctgtaatcccagcactttgggaggctgaggtgggtggatcacaagttcaggagatcgagaccatcctggctaacatggtgaaaccccgtctctactgaaaatatgaaaaattagctgggcatggaggcatgcacctgtagtcccagctgctggggaggctgaggcaggggaatggtgtgaacccaggaggcggagcttgcagtgagccgagatcgcgccactgcactccagcctgggtgacagagcgagactctgtctcaaaaaaaaacaaaaaacaaacaaacaaaaaaaccactctggaaaatcactttttttaattacactatatagtctttctatagttgaaacaacttaaatattccctccccctatgatgaaaatgggattcaaccaaaagacagatggatggaactttatctcatgtatatactatttaatacgctacatgcattctgcatgtcacatgctatatatagcatggtattatgttgtaattacatttaataaacctagaaatgccccattttttcccaatagcctagaattcttagaatagactcaaaatgtgtcacatgttagccaaactgtggtcaactgaaaacagtgactctgagaagatcagaaatggtggctctgctgcttcatatgtggctgaaataaatgaagtggtctacagtgtgcctgtatgtatgatgtgggtgtgcacgtgtgtgaatattagcgagaatgggagaagcctttactaattcttgaaaaactcacataacccatcctagctacaaccttcctggtatcagaaaacccaggaaggtaacgggtggcctgaggaccaagcctgtgcctagggaagtgaggtgtttgaaaggacgtttcctgtaggccacaacaaaggcaaaggaattatccctccctatgatacaaagttcctctcccttgcttggaatgcctgtgtccctgggatctgttgtaaatcttctctggataatgctgtcaacacacagccaatgtcccacacactgggatctcttttttcctatctgtgttggccaagtcttcttttcactttgcctttcttcacacagtgccattaattaggcttgtacattccagccctgcctcccagagatttcccaggtcaccttgacatcttcgagtatctatttagagtccctgaatgtatccttatccttggagagtctcatccactgcgtatgagtttttcttctttcattccaaaggcaacctgagtcctcagcctctgtgtgccatgatgagaaagaatgaatgggaatcaacccaaccaggaagctggctttgtggcgtggtagatgtttgtaaactctgcctgctgggggtttcttggccattgttgaagaccacaagcccagggacagaaagtggacaccttcctccacctgccagccctctttccaagcttctgctcctaacctgggtatgaacctgctcagtgaagccagtttcgttttatgcaggttctgggctctgaaggcctgtttgtgtcattgcacactttgtagccattccgtctcgctgggcctgcctgtaatagcagtgcagcttctaggtggcacttagaggatgcctaaattgacttagaaagctttgcattaagcagatgtttgctcttggggaagattaaaaccattttgcatcaaagaacgaggctgcggcacttccctaaagcttgaaagaacggtttccttttacttggctgagggttacctggtcccctgcttgacaccctcctagtccgtgaaatggagtaaatccaggttagaccaggtgagtccgaaggtggcaggtggctaaggaggatatttcctttgtagctgttcccggccttgtttctacttatagggataactaaagcaaccaaacacacaccaaacaggtgggagacagcagggaaggatgcttggatatggctgagccacgttcctgcctggtagtatgagaattcgaagatgcttgaggcatgctggtgaaagtaggcaaaagcagagagactcgaggctgcatcaaggggcaaaccgtgtgtatgtttgtgtgtatgccagtgtgtgtatgtgtgttagtgtgtgtatgattatgtatatatgttttgtgtgtctgtgtgttagtgcgtgtgttttgtgtatatgttagtatgtgtatttttttgtgttagtttgcatatgtgtgttagtgtgtatgtgtgtgcatgttttgtgtgtatgtttgtgtgtatgccagtgtgtgtatgtgtgttagtgtgtgtatgattatgtatatatgttttgtgtgtacatgtgttagtgtgtgtgttttgtgtatatgttagtacgtgttttttggtgttagtttgcatatgtgtgttagtgtgtgtatgtgtgtggatgttttgtgtgtgtgttagtgtatgtgtgttagtgtatgttttgtatgcttgctagtgtgtgtgtgtgtttgtgtatgattgtgtttgttttttatgtgtttgtgtgttttgtgtgtgttagtatattttttgttagtatgtgtgttttgtgtgtatgttagtatgtgtatgtttttcgtgtgtttgcgtgtgtgtgtgtatgttttgtgtgtatgttagtgtatgtgtgtttgtgtgtatgctagtgtgtgtgtatgtgttaatgtgtgtgtgattgtgtgtatatgttttgtgtgtatgcgttagtgtgtgttctgcgtgtacgtagtatatatatgtttttgtgtgtgtttgtgtgttttgtgtatatgttagtatgtgcatgttttttgtgtgtttacatgtgtgtcagtgtgtagatgttagtgtgtggatgttttgtttgcatgttagtgtgtgtattagtgtgtggatgttcttgtgtatatgttttgcgtgtagtatgtgttttgtgcgtatcttagtatgtgtatgttttttatgttagtttgcatatgtgtgttagtgtgtgtatatttgtgtatgcatgctagtgtgtgcatgttcttgtatatatgttttgggtgtatgttagtgtatgtttctgtgcgtatatgtgtgtgtgtgcatttcaagtgttcactgccagagaagtggcttatcagtgggtcagaagacagcatgtacgttttataatgtaccagttaagagtccagatgtgagagtcagatattgctggagtcatttcctaactcagctctgcactagtgtgtgaccttggacaagtcacttagcctctctgagcttttgtttcctaatttttgaaaaataggatgagacccacatggaatgtctcctgaggcttaagcaggatggcctgtaaatcacccagtgtggggcctggatcattgagagcaatgggatgcgctgatggtggtggatactgctgctcttacgctgtgactgctggggctgttgttgctattttcattatgagaggctttgggagagacagaactgcacaacggattgccgtcagcctccatcctgagttcctggggtctgggttctttgtctgttgtgttactgggcggggggaaaacctccagataaacctgtcaagctgttgagaaatcctgtctcccatctaactacttgtgtgttacttacaacgtgtgagacttaatgacttcttctgtccaagggggtaaaacaaagccaattgcattaccttgccatgagcagccaatgaaatggctagcacagagccgttagaacagtgtctgagccagattcaatccttcctccgaggtcacccctggagctaataaaggaaaaaaaaaataagtaaaggccgggatcttgtgggcctctcagcctggcaaagtgcctggcataaaatgggtcgcctggcttttaaggcagtgtgccgagcagctggggaaaggtcatcatgagttcacagaacctttaaacacactgggacttaaagccatcagatcccttttgctggctccatttaagttgttttgttggaggacaaaacctttttgcttacggctaagtacattttatggagcatttaatgattcttctatagacgtttgagtagctgtgttttggtttcaggggccgaaaataagtgcccagaatctcccgtcagtcttcttgatgtttattatctgggtggagggggagggacggggctgcttagcacatgttggcttctgggcttcattgttggcacttcagcagaagtgggaagaggcatatggccttcctggtgtcttatggtgaggaaaagaggacatttgaggggaaatatttttgaacaggaagacagcaagatcgtatttgtaggtgcgatggaaaagtagaacagccagtcagctttgggactcccaagtcctattaaagctcacatcttttcaaagcattttaaagattaggaatccatctctccctgtctgttggtaatcgtggggtgcaggagtctacaacagctcagcttacgtctgacgagctcttgtctgttacatcagtaccttgggatgtgccgggctagcggctttcccatcttctaagcacttggctgccaggaaagacggaaccctttgaagtatgagatctgtttatcttgcagttactatggagaaagggccctggaattaattgtaggttattgaatttgtcctttttaagaggaaaaaaaatgactacattatggtgctaattcatagatcttgagatgctagcatttttttgtgcgtgtttaacatttcatttgaccattattagcagtatcaggttgggttgctgagtttcaagtactagaaatctacttggactatctttggcaagggagagcatttattgggaggatattgagtagctcacatgatatcaagaagaccaaaaaaaaaaaaaacaaaaaaaaaaaacttggatcccagaagagaattattcagccattagaggctggctgtagaatgaatgccttttcttctatctgaatgatcctctagtcactttttctatcatcagatctctctggttaaaatttgaagtcccagggcagggaatacttgctagttgtgttctctctctaaggtaatctgttggaagaagtcagaagaaatctttagagctcccattgtgagggcaacatacttgtttttctgcttactaacaaggaagagacaatttctgtaaaaggatatcaagatgctgttaggaaggtgtaatggatactagtgaatgtgtcaattagatgccaagcactctgactgttgatacattcttgagacctacaatgatcagatgattcttttggggaatctatctgtctgtctgtctatccatccgtccgtccgtctgtccgtcgtctatcaatcatctatctatcattcgtctatctatctatctatccatccatctatccatcccaatacaaaccatatacaacctcatgatggatagggtttcaagactactgtcacgatcatgggagactttttctttcctctttttaaccataaacatctttgtgagatataaatgtcattagaaaccagagaaacagatgatacactcaatggggtaataaatatgtaaaggaccttgccacttattttgtagcagggaagaatgtagagtatatctgagactgagaacctaaatcaggacttacctttttttatagtctcagtccatccaccaaaccatagccatagccaggcaggacaaaagaaccttgttagttattaatgttgaattgctgtattaaaattctttcagtgagtgattctcaagaaggagtgatttttttcccccccacagggaacattcggaaatgtgttaagacatttttggttgtctcaattgtgtagagtgatgctgctgacatctacgggatagaggccacggatgttgctaaacatttgccaaggcacagaatcttgtgctgatttacagcatcatctttgcaaacattaagatggcagggcacagtaaaggtactttacttcccacagtacagaattatagcacccaaaatatcaagagtgcagagatagagaaaccctgttttagtaagagatgtaaacacaactcaagtcagtgtatgcaaagtgatgactcaacagggaagatacaggtatctcttacgtgactacatccagggtagctgggacccagggaaaatattaataccctaagactctccttctttgtctcctttctttgtgtcagtttcacttccacaaactagcttcctgcacatggtgggaagtatggctgctaatagaaggtgggtgagaagactcatcctgtgatatcagaacagaaagactctgtgtcagaaactcccagggaaggttttgattggcctggcggaggtccagggctcatcactgagccaatcagctatggcctaggtgtagagctgggtcatgtggcacagacatggcagctgaccctctaaacagtgtattgaggcctttcccagcaagaccaggatgattttaagccaggctgccaccccattggtgtctgctgccattgcatgttctcttattgccaggacatttgtaaatccgatgttgtttccagcagagctgtgtcagagaatgtcacttagccattgccagatcgttgagcaccctggctgaaaatcacaaaggcacggcacctagagaggaaacgaaggctgtgcatgtttccagggaagctgcgccctgacatttatggctgagccgagtttggccttgaaaaaaatcatccggtccagccttctgcctccaggcttgtgaattgataaaccctccaggacagacaggctgttgaggcacagcctgagatgatttctgtccttcctccctggtccaaccatggaggctgccttagtcggcttgtgtcctagttgatatatttgttggaatgtatttgaaactctggtcagtttctctgatgatattgatagttttcttttttttttttcccacttagatgaaatttgtcaagcctgcattgtgctaagccctattaaaatggtgccagagacccaattatggcagctacaaagccgttcaagagtaagcagagaaaaacacataaagggattaaagatcaaaaatgggattccagtgaaagtacattaggagacatcaggcagagacacatgaaagaattagaatatgaagaagaaagcgcatagagcttttgggatgtccttacttttcatccccccaaatcatttaattttgagcatgtttactcttttaaaaatgaattgaaatgatcgattgtacttttgtcaggtggacatgtttttaactctggtgtgaaatgaattgcagatgggttttctggcttgattccctcccccaaaccccccagttttttttttctttttgtcttagacaatatggtgtcagtgaatcatgaaatactgccggtgagcccatttagtgagttgggaaagatggtctcctgggctaggtggtgttggcaatgacactctggggaatggctgaggcccccacccccatcttactgtttgcaaagacgagactgtaaatcagcacaaagtgtgcatttgagagttgctgttttgagataaagagtgcagttcagtttgtagtcatcatcatgttggttctgaagaagtcctgtcacaagcagagctgcacagaatcaggtgtaaatctgtcattttggctagtcttcctctggtccctctctcttcgatggattccatgacaagtccttaggcacatgtttgatttgcactctgttgtttgctatagaaatgtgtacgtggcctctcaggaaagagaagtgaccctctgcctatatcatcgtgaaacatctcttccaggtttgcattctggagttaatggaagagatggaaatctaatcagctcacaatagtctctaactccagactctgatgctcacaacattctgtatatgtgcatcagtcagttcaatgggaatagtggagaaacagagaacaaatgtcccatcccatctgttctatctaaaggaggcagcttctccttagctgcagtcatttttttcaatgcaatagtgcaggctctgcgttgtcagattttctgatatttcaaaagaaggtaaaaatccagatttttgtggggatattcattatgatgatatatatatatgcatatatatgtgcatgagcacgtgcacacatgcgtgcatacacacacacacacacacacacacacacagacactacacatgatcaaacacatcattagcccaagggtcaccagtttataatctttactctaaagagagagccaggcatggtgtcttatgcctgtaatcccagcattttgggaagccgaggatggtgaatcagctgaggtcaggggtttgagaccagcctggccaacgtaatgaaaccccatctttactaaaaatactaaaattaggtggacatggtggcacacaccagtagtcccagctacttgggaggctgaggcaggaggatcgcttgaacccgggaggtggaggttgcaataagccaagatcctgccactgcactccatcctgggccacagagtgagactgtctcgaaaaaaaaaaaaaagagagagaagaaaggccgtaagtatttttcaaattagtgtttgatagtctatccattttggggtttctttccctgtttatcttcaaaagtgccatattttgaaagtttacgtattaccagaaaaccagcatcattcatggagtctttatatgcttaaaaagttttcttggaggtctcgaaacacccttagtcttaattcactttaaaaaaaaattggagccgggaacagtggctcacacctgtaatcccagcactttgggaggccgaggtgggcagatcatgaggtcaggagatcaagaccatcctggctaacacggtgaaaccccctgtctactaaaaatacaaaaaaaattagccaggcgtggtggcgggcacctgtagtcccagctactcaggaggctgaggcaggagcatggcgtgaacctgggagacagagcttgcagtgagctgagatcacgcccctgcactccagcctgggtgacagagcgagactctgtctcaaaaaaaaaaaaaaaaataaaaataattggagtgtatgtccttctacagtttagggaattaatggtgagaaaagcaagccagacagttatcttcagattaagtaacaaagaaagtgccctctaatggcctgggaggtttcattcattttttgtggaatgagaagggaggtgaatctttcttttttttaacacaatgatcctgcagctgagcaagaagtgctagatgatcctcctggctcgaacaggatgatggtgaagagatagcatggtggtggtagaagtcgtaatgaaggtgaaagaggaatacagaaaagaaggaagaaggaggtttttcacaactcagcgtggattggggtatcccactccggtgggacccacagtctgcttaatataggagattgactccaagtcttgccaccttcccccagcccaatagtaaaaagcaaacacacccaaacaaacagaaaccacgatgttcctgcagctctcgggggctgaccatgtcttccagaggaagctcaaagcctgttgttgcatgcttcatccagcttttctgcaaagtggaggccctagcaagaagcaaaggcagacagatggtgtcccgcagactctccctcaagccctttcatctctcctctcactattaattcatctgtttggatggatatgttcacgcatggaaccaagatgaataataatgaggtttttaataactccctgcatttgcattcctagttactctttacatggttctagctgattaaaatgaatcatttacataattaacatatggttatagtgttggctttaatatgctgattatctcaatacttttgtctggagtcaattggattctaactgtaacaattgtttgaagtgagactagtttattcctgggaggatggaggggctatttgccatggtgtctgattagcaatagcatacctttccaacaagtttgttgtgcttctgttttgtaatgtgattgaaaaataagtaaataataataataattgcagtgatcataatagctcccattaattctgggacaagtactatcaatttcattatctcactttcttgcagccagcctgcaaaacagcaaggcttatccccactttacagaggaagaaattgaagcttggaaatgttaacgggcttgcttgaagccaccatgctattatgtgtcagagccttgagctaggctttctgatcccagaattcatactttttaattactctaagtcagcttctgaaccttgagactattgacattttcaagcttggcactatgactatggccagaaaattctgttgttgaagggtttccctgtgtactgtaggacaattggcagcaactctggactcctccctgtggataccagtagcaccccttccctcattatgacaaccaaacattgccattgtcccctggggaggggaatggggtaaagtggccattgattgagaactactgctctaagttattttcttggtacccattaagacaaaatactaagaagcagacatgttatctaggttggtctttcagtgatgggtaactagggcctaactgcagtaatggtatttggaggtacattgtgatgtgtgtgactcctgtaactgattctgaattttccaattatatctgccaggaatcactgtatttgtcaatcaaagcgatctttgttttttatcaacgcgggtaagttctgtctccctcactttcccttcttcccccacgctccctccccactctttttaactcctctaaagggcatgcttgatattttcagatgtgctgccttgcagagttgatagcatgcatttcaggataccattctctcattagcacatcctaggcatgggtgccatccgctatgatctgattatcttgctagttcatattgaatttgaaagggacttgtgaactagtggccagttttcctgtttaggtacccgaggttttggaatgtgagtgctttctgaacattcatgcatatttgaaacgcatttttgctaattgcaggactgttgtccacaattagtctttggtaggcatgattaattgcaaagaacactgacatttatgcataaaatgcttgaggtcaaaaagaaatggagagaaatggtgactgcagccagggtgagtggaatactgatgcatggtgaccccagaagcaaagccccaatcaggaaattgtagcatcagcaggacaggtattttattgggatggatgtgtctgtatttttgacttgcctgtattttgttctcctctcctctaagcacctttagttttacgcaggttttcagaagcctgtctgatgttttcataaatgccaaggcctgccttttactctccttctgcccttctccctcccaaactggccccatcacttgaagctcataatttacttctttaacataacatttgtgtgttgtatgtgtcccaggaagaatcaagaagtaaacaaatgtgccacagtcctaccactgagattaaccagtaaacttttttttctgcttaaagtggtacgtgcctgtgattaataattcaaatgatgctagtaacggaagacgggaaatgaagcccatctccaaatcttggatcttactaaagctaatcagtatcagcggccattaggagaaagaaaaaagcaccattgtgtatagatatgcacatatatggccaggtgcggtggctcacgcctgtaatcccagaactctgggaggatgaggcaggcggataacctgaggtcaggagatcgagaccagcctggccaacatggtgaaaccctgtctctactaaaaatacaaaaattagctgggtgtggtggcaggcgcctataatcccagctactcaggatactgaggcaggagaatcgcttgaacccatggggcggaggttgcagtgagctgagatcacgccactgcactccagcctgggcgacaagagcaaaactctatctgcaaaaaagaaaaaaagatatgtagatatatgatacatacatgtgcatacagatatatgttgttttcacatactgacaaaaaaagccacatcagtctaaatgccctgtgtgactttatcttgcttaatttcacttgatgatatgccatggagcctccttcagtttttctacactaggtggctgtgacataccttatttaagtcattcccttaattcctttttttttccattataaacattactgctacacatgcatacactgagttatctgatagagatatttaaataaaacatatatatgggccctgattactttttactgccatgttaatttcctagcagtgtgattgttgggtccaaaagttggtgtctcataacttccatttaaagatgtgattcaaaacttacctcctactatatataatgctattcaattcacatcactttctcaccatcagtgcagacatcctatttgggcctcggagctggagttcacgtaaggatgagtaaccacttcatacttcagatcccatgagagcgggatcatgtcggtactagcaggctctaaaggacacagtgttcaccctgcttaggatcagacaactgcctagtctgtgccaggcatctgatacttgccttggtaataggattttgcttgaagttctccttatgcctctttatttcttttatttatttgtgctgacaagttagagtgtaagctcattgaagcctgtggccatgtacagaaagagaggtcacatcttctgccaaccctgattgattagtagtggctgttaggagctctgtctggagaaggattgcatctgacttaggaagaaggagtttcagaatcaattagtaatgtctgctaagtgcacagaatggtggaggggcagcctgtgtccccagtattctttttccattcttccataataaattaggattattattatggttattgagggcttacagaaaatttttgaatcaatataaaaagcagcaatgggaaaaggagaagagagggagaaagggagggaggaagagaaggaggaaaagagaagagcaggagacagagagagagaagttatactcaaatatacgaagaatatcttgcttctaggtggctttatatttgagcttttctatagttttgaaatttataggaatttaaaaacatagaaattgcatttttttttttttgagatggagtcttgctctgttgcccaggctggagtgcagtggtgcattcttggctcactgcaagctccgtctcccaggctgtagccattctcttgcctcagcctcccgagtagctgggactacaggtgcctgccaccatgcgtggctaatttttttgtattttttagtgagacggtgtttcaccgtgttagccaggatggttatcgctctcctgaccttgtgatctacctgccttggcctcccaaagtgctgggattacaggtgtgagccaccgcgtctggctgaaattgcattacttttaattctaaaacaacaattagttttgcaccaacctaaggaacatacgttacatttgaatttagaacataaagatcacaatacatgttatagtaaagacagtcttttgaagcaaagctacaggtactattaagaggcacagtgatcctgagatgggaaatggagggcagttctctgtcgttctgcagtttcttggttttgtgagaccactaagtgatgtccgttctctcctggcagaatagatggtgttaatctccagtcccttgtaataaatgctggactgtgaacaggagatggctaaaagagagtgcccgggcaagcctttatctttaataaggtccacagccagtctataattgtcagaaatgacagaggaaacagggcttctgctattttgctcagaataagaagtggtgtctgacctgtgttggcagcaataattgcaatggtcagttattgaagttgatcattgcaatagttgatacaggggcccagctctttgcgctgatattgaggaagccaccaggccccacactttggggtctggaaacattcacagagcaacttttttcaagaagatggacacattcacgttttaaagatgctcagcttctcgtgagagagagtttaggtacattctcattccactcaaatcttagcttataacttaggctcctcgtagcagccctttgcaatgaaactgtatcacttttgaagcttagcagatgggaattgtcataaatgatattttagtcacagatatgagccataaaacttgaaagataaagtatctttctgagacacacatggagaggcagatagacccagatacagcgtgagcttttctgcagctctgatggtgtggaacgaagggccaccaataggtactttattgcaggtgacagggtttgcagatgatgtggaatagtgggaatggcatggagcatgaattttggggattcaatatggggtcaaatatttaccatcccgtggaatcacatttcttatctttttctgaggctccgtgttttcgctgtgtaaggggaatagcggaatgtccttcttaaggtgtttggcacaatacagataaacactaaataaatattcctgtctgtcctccctacagcattcccctcaaatgaatgtgttgcttattgctagttatgctggattattctgctcagttgaataattcattagggcttgagttccaagatatggtgtaactgtatccagcagactctagccttaagccaatatgtatattaatgctttttactcaaggaatctacctggctcttagcaatcctaaccccacccccacatttttaacctgacaggaagattaatctgcatgagatgaagggtgattgtcatgtccaaactaaaaacaaaaaaattaaaaataaaaaatgacagaaatcttctagaaatacctaaacattccctcttttgtcttcaacacgtactcggtccccttcttgtgctcccaggagtcttttaatgcctttgttttcacagcatcaagatatcctggcaacctagagttaccgccatgaggtttggccaccttatctcaaacaactgcgtattttgaaataggtggtgatagcatgcttttcattccatccagaaagtgtctcttccatgacctgccagcactagtatttcaagacctctgcacttacaaatttaaacggagcctggagtaatttaaattaatgtgtacaacatctgtcttggtgagaggagatgtagagatattctccgtttatgcccatctggctttgttagagtagataggcgtatgtttcaggaggagaaagaacattttttatttctgctatgtttcagacattatgctagccattacgcattatcctgcttaatcttttcagtaacgttggtagattaatatcattatccctaccctatgataaagattctgaagatcagagaagtacatcgtttcagtgaccaagtcactgttaaatgacacagtctgtattcaaagacaggacagcctgattccaaaactacttctatgccatcttattagtctcaaggtaatacaagtctaatgtgtttttgcttctgataattatagcagtaactacttagggtaaattaaaatggaatatccaggaaccccattatggtggtaagagtataaagacaaattagcggctatggaatctcaatccaggaaagagagacctgcattgggctcccatgtgttacgagaggttttgtttttttgttttttttttttttaatcatcagatgttttgggtgttcccagctgtgcttgagtgcatttgagaaatgggtttatactcttctcgatcccctagttcttcccaaaaggtagataaggggactcacataaacagtaactgaaagtcattctgtgtgacaattctgtattccttgttgttttagtaaagtttgtcctgagagcaccttgcctataaataaatacagtgacaaataaaatgaatgatttttctgggttcctttcctactctctctccccccatgctttaatgaataattttaatctactttgtaattaagacactagcaataattttattatttggtactacttgggaaaagtaatctttgatatgagatactttgcaaagggaagaccttgtgcccacgtcctgccttaaatgcgaagtaaaggggaaacctggattcaagaactagagccattggtaggccaaacccctatcccacaagccagggaatgggatcttttaccagacactcagacatgaggtttggttttattttttattgttctgaaaagtacattgtaaaaaagggagtgtacatttctaaggcacttttctaaaacaacaagaaataatacaaatatttagtaagcaagggatgattgcatttttggaacatatatgtttatgagctatgtcaatatatatgttgatgtgataccatgaaagctgttttagatgaaattctgataaacagggcattatattgccacttacttgctcttaattcgattctattagcagctcagctttattaaaatttctcaaatgtattccatgtgaaatcattttatttcatatcgctaatgtatgactcaacgcagcatcgcctttgaggtgatccaggactttcatccccatttcacagatgagcactggagataagaacaggttaagtgatttttgcctgaggtcaaacatgctgggagaaagattagaagttggtgagtgtttaccacagctctgtgtctgtgataagtccctaaattcagattttccaacctccgagttttctgggttagacctccagctaactaccaggggatgtcatgttatgtaattaattacaactgtaattatcttggtttctgggtcatttgaagatcatcggtgctttttgttttcatggttcatgcagcagaggaattttttttccaaagtacaagtataattaatccaggttttagactcttaaataaccggaaagttaaaacgtcagtgcagaaactgagttcatcttggctgatgtcccttgcagtagagatggggagaattcagagctgttaaaagtcgtggtcatctctcttgaaacataaaacttccctaccagtgtctggatttcctaggaggtacccagtgcatagacccatgttgtatgaatgactggcctcatacaagaggtaaacatagtatccttgtatgtccctaagtgtcaggtggttgcttggaaaagcagtgatttccataggtccctgtaaagatttcttcaaaactgatggaaggtataaatgtttaaaattagctttcagtttccacttctttttcatgatatcttacatgaaggtaatctattgaggaaattaccttttatatcagtttaaatgaacttatttagataaaataccagtttaaggcattcttgactttgttctattccattcatggagatttgcttgacaggaagtgctctggcatatgtcagtgacctccaatgctcctggagcagatgatactgggacacaggtggtccgtatcacccacgtgaggtggtggcatgtatttatgtgctgaaccaatcggaagacatctcattcagaagaaccaggcctgtttaccttattcgtatgtcattataggtgacacacaggaagagtttctgaagaatcatttcatcattaagatatattcaatatgacagcttggctaacacatcaatcatttggaaaaaaaatactgtagtaacagcctaaggagaatttaaacccttgtgctctggaatctgtatttgcagggcaggaaaaaatgttttagatttgtctatggcattattctttatcagtataactttatagcgcttgaatgtctgaaagatgactcattcatttatttgtgtattcattaattcattccacatatatttgtagagaacctatctgggatctaagaacaatttcaggcaccagagacacaggggtaaacaagacgtctaggcccctgctgtctcagaacttaaatttagtgggacagataggtggtaaacaaataagaaggaattgagagtaacaagcacagtgaagtgaaatatgccaggtgatgaaatagcaaataggagattgatgctcccatagtttggagactcagagaagttttaaggaggtgatgttttagctgggacaggaaagaagacagccagggaggtatggagaggaagagcacggggaacagaatgtgcaaagtctctaaagttagaataagcttgacatgtctgaagaagagcaaagagactccggtggctagaggattctaatggagaagtaggaggcagaaaagaataattgagaagtagatcagtcagatggaggaggactttgatgggcggcagagtaaggcagtatgagctttatcgttgctgagccggaagttgttatgttatgcaggaagctgcgatgagtgtgtacacaaaccatctcctgatctcgagccttttcctcctgagggcaaggaggatcgggaggcaagggaaacgtagtggtgatgacgaagcttctatctttcagggtctacggtttagggattgagagtatgtgtttgctagcgagacctcacgaaaccaagccccctggagagtccctgacaaggacgaggtgcaacactgttagcggaatccatttcatcgcagaactgctgtcttccaagccttctgagccggctggtacttgtgtaacatttctgtcttgggtgatttccaactggatatgtcatttctaccaagccagtggcaactccagcctagggatgcatttaatctgggacatggtggtgggagaagcattaggcacattgtttttcttccttttttttgaagaatgcttggtacaaattcagttttgacctcccaatgtaggcttttatttcccaggcacttcctttttccctgcatccgccaaaccctggtgagctttctgctgcttttctcaatggctgatctaagtactgcagaacacggacactcttgggcacactgcaaagtcagcctggctccttggccattcctcttgcagggcacaaaaggaccttccaaagaggtggggtagtgtattattaagtggcaataacgaaggacttctttagattatcactgtttcaccagaagacacaacaggagagcacacagaccttgaaggaaatcccaccactgacatttagaatctggtggactgcaagcttagatatctactctctaaatgcagttactttatctatgacctggcaatattaacagtacttatctcatagaaatgtagtactgggtatgtttctggccagtcataaacatttaataatggtagccaatgtcatcacttgttgttaatagtggggatagcagtaaactctctttcctctcaaggttaaggggagtgtttggaagagaaaaaaaagctgagactgaatgacgtttagctttttgatttcaccataaactaaagagtttcattggtaactgtgccctgcctctttctgtccaaaagagtatcttatttttagactgttttaaaataataacagtattatctgatggaggagacaaaaatacttcagtaatagcctaattggagcgaataagaaaatagaacacttgtgtgcaatggaatactagaaagcagtgggaatgaatgaattggagctttatataagaagaatggcttctgccattatgactgtggataatttactaaaaaatttaaaatacactggagttttagtactttctgctgtccagaaatgcatacatatgtggtaaatatatatagacaataaagaaactcaaaattcaggatattgtctgttgtagaggtgaggcagagggctacatctcaggagggttttagacagggtatttagccacactgaaattatttcttaagctgggtagtaactacaggaattccttccttccttcctttctgcctgcctgcttgcctgcctgcctgcctgccttcctgccttccgtcctgcctgcctgcctccctgcctgcctgcctccctccctccctcctcttccttcccttccttcctcttttctcttccttttctttctttctagatagagtcttgcctttatcacccacctgaggtgcaatggcaccatcatatctcaccccacagccttggcctcctgggttcaagcacaatcctcctgcctccttctccaaagttaggactaaaggcacacaccaccaaaccttgcttattttttaaagaaaatttttagagaagagtgtcttgctatgtttcctgggctggtctggaactcttggcctcaagtagtcctctgacctcagcttcccaaaacactgagactacaggtgtgagctgtgcctggccagtatttatgttttgctgtataccttttggtatgtctgaactatatcacatcatgattttagagtcagaaatgctcagagtttagaaaataaccatcttcaccacatagaatcgtataaaataaaaaatgttttttctccttccctttcttcctcccccatcatttaataattgtttagtacatacctttgcagatattttgtgcatattaaaaatatacacatttagaacatatatgcttaatataaatgactttatgtctatgactctgttaccacttaaaaatagtgtacaggcttttcaatgttggcacatataaattatgtacttcagtcttaacatctgtctggtaatcatctttcagtgtactgtaatttaaacaaccagtttccctattgatagacatttgtatttaaaaaacaaaacaaaacaaaaaccagtttccaaactctggtctgctttcaattcagacgctggcagcagctcacaccgctgatcatccaaatgttttgtctttgctaggacgataacccagtcgtttcatacaactgttttcgtttgcacctgaatattccatggctatagccacagctagaaatccattctctaggggaaaataagaaatgtaataataaacttaaaatccctaatgagaaattcagatttcatagaagcaggggtcttctccctcttgctaaccttcttttccaagatgttagtgtttttcaagaatcgcaggctttttaaatgtcctccgtaaagtgtaaaggggaaaatggagagaaagaacagtattttgaatctccagagttctcagtgaaagtagacaggtctatcctagtgttctgtcttgcatgaaacactttcttggtattttgtctacatgagtgtttaatatttaggtcatagtttgtgaatacactggagatgttatgcgtcaaacaaacccagtgttctggcttcacagcagagtaaacagacacagatagttctagatgcttgaacttctcccacgttaaacttaaaacagcctctcatctcagggcttccatcaaagggattgaggccgtgtctctcaaacccaggtgcaagtggaaatttttatgggccctgacttttcttgttgtccttgttggctcataatattgccttattgtgcaagtaatgcatataacttgtgggaaaaggtatagtactataagtaattagaaagaaaaccatatttgaaatttaaaatccttaaacacatacctaattcctactcttcctttctgaaattcctgttttctcaatgatctgttagtaaaatatatagactacaaaaatgggttcatacatcgttcccccccgccttttttttttattttattaacagcttcacagtgttctgttgcatgaatataccctaaaaagaggatttgttttggcattggtgcctgttctttttcagtgttattcattattttgggatgttgcttttattatttttcatattttattttatttggtaggaaaaatgcaaatgtcccaccgtatggatttgggatttgcaagtcaggaacagtgggcacactttcccttaatggttggcgtaggcatttggatactgaatttactgtttatatcacggtttctccaccttggcagtgtggacgctgggctggatcattctctatgtggggactgctgagtgctttgttgggcatttggtggcatctctagcctctcctgactaaatgccaactgtagttctccccacactgtgatgcccaaagatgtctctagacttggctcactgtcccctgggggatgaaatgtttctccctttgagaatcctgcttttacgcgattggattcttaagttgtctgaaggatgatcttttcttgtagcatttataaatcagttggaagttggttctggattactgcctaaaataaaattcaacctattctgagaaaacaatatatttgagtagggactaattacctcttttttatttcaagtgacaaaagccaatatatcacacttagccactatgaagactccatttcagtaaactaattaaactaatcctatctggactcattattctcagttccactaaatattttaacagttgagatttatctcatttcataaattatatcatacttaaagctatccacagccctcaagagtttattttggacttttaaaaaatgtgactttaagctgctctggaatgtatatttttcatatcttttctagataatcattcaccttgattatgactaattattaaacatgatatatggctttaattaaatgaaagtacttggtttcttgttagcgcttattaaatactgacagtgttacaaagatagtgcagcagaggaaatggcataactcaccgaattgattccattttcttgctgtaagccagtgaagatacacattttaagagactgattaatgcgcaagatggcaagaacagtgtttttcatagttaaaaggaattaaaatctgtgtccatcctggattcattttctaacagaggatagtcacctaattaaaacgttaatacacatcccgctatttgtatgtacgttccaaagccagcatacattaaatagaaatttatcccaagtgcttcatggagaagccaagaggaataatgcctaagtaccacttcagagtaaattgctccctacttataatcgtgtaatgcaattaaattgaggagctgtaagctgcctacatcaagtatgtttagtttagatatttgcctttagacatctccctgtaaagggttccacattgaagagaaaagaaggaacatctagccaatgagctgttcattaaacttgacatatggtaagcaaggccagaaaatgcctaaagagtagagaattttctttggtatctaaagaaaaaaaaatgcaatatccagttgatcttagattctgattctagcaggtgttcatggtacagtcttgttctgtgcttcattcaagaatgggaaattcttgtttatcccgttgtccatgatgtgcttatttctcatggcatgcctgtatcaaaacatctcatgtatcccataaacatacacacctactacgtacccataaaaattaaaaaaaaaaaaaacgtaaaatgcaacaacactaggcacgcattttataatataacttctctgcttggacaaaattaggctccccagtggaggcaaaaacaaaaaaagcagatggcaaatatgttagtgacattgttttaagtgtttgaggtcatggagtcttcacattgaaataatctcttgaattatctgagttttaggctagccagggccaaggtgccagctgaattaatgaaacttggaattcatcttttgagttcccagtgaacatcaggaaatactttcctgacatattgacctccttattatccatttcccattctccatgttgaaaaccatttcatatttgagagctgagaatatgacaccttcatgataaatttaaaaataagatgcaatattattccagaattgccttaagttcccattctgtatattaaacgcctattcaaagggtattcagatccaagttacatcatacaaagtatgttaaagtatcccaagtatggcctggcgaggtggctcaagcctgtaatccccgtactttgggaggccgaggcgggcagatcacaaggtcagaagatcgagactatcctggctaacatggtgaaataccatctactaaaaatacaaaaaattagctgggcatggtggcatgtgcctgtagtcccagctacttgggaggctgaggcaggagaatcacttgaacccagtaggtggaggttgcagtgagcagagatcgtgccgttgcaccccagcctgggcaacagagtgagactccatctcaaaaaaaaaaaaaaagtatcccaagtatgagaaacatcagtataaatagtgagaaaacatatatacatatgttcttcttatatttacgggagagatatgtatgcttatctgtgcttttcatatatatatgaaacatatatgaaatatatatgaaacatatatgaaatatatatatgaatatgaaaagcaaggagtatgaaacttatatatgaaatatatatgtatgaatatgaaaagcagggaaaaggggacagtcatttagtgttgctgctgaaaatttcaatatgaaaaacgaggaatatatagctcaggtgcaacaggcacctttatatttataccattacaaaaacatggctctcctggtattttggttcttgaatttaggcttggagctgatattgaagagctgcttattgcagtgggttttcatgccaaacatagctgagtttgaatgacatttctgttactctggctacagaatcttgggcagtatcatttatctatccatctgggctttatttttcccatggggaaataggagggagaggggtcatggagtgaacagctttgcaggccatgccaactttggaattagtggagagaatataaggtaaataagaccatcctgtaatgacaacctagacttagacttgcacgaaatagagatgtaagtcaggatgagtctctcattcactcaacaaatatttattgaatgccaacccttctcagccgctgggtattcagtggtatagagtgtgaacaaaatgctgctggcatagagcttatattctagttgaaaggaggcaaacaataaataactgtgtaaattaatatatggttagtgacaggtgcaagtcagataattaaaacagagagtggtggggagctctagaaaggctcctatgaagaggtaagttgacatttaagctgagctcgcaatggcaaatcatgccaaggcagagagaaagaacattccaggaaaataccctaagaggagaggaccttggaatttttgaaagatgaacagatccctggaaaatagagagaggggcaccagagaggtctgagaattgggcaaaggccaggtcatacaggattttgttaaccacgataatgaatataagttttatatgaattacggatgcagagatttgcatttcacaaagatgactgcttgccacgtgaaacatagaccagtggggcccaggagaagaaggcaggagagcagttaggaagctgtctgggagtccaggcaaggggtcatagtggtttgaactggaaggtggttctgaaatggaaggtgaaggaaatggaagtaccgttgtagaaaattaacaggcagatctgggaaaacccagtggaggtgaagggagtgaattaaaatgattccaggatggagaggtcggggcttgggtgaatggtgccatggaaagtaatggaggtatctcaaatagaaagtagtgagtgggaagagcaggagtgagcttgcagaagttctagcagaaatgtgaaaggccatggttatttgccaagatggaagatagattaggtggtggtcatctcatttgggcgttgaaacttgttttcaaaacctgtacctggttttgatttctacacagggatgcaactggcagatgacatctcaagaggtgggtttgtcatggtggttattattgtacatgtgagacttttagcttttaaggtttttggtttttttcgagatagagtctcgctgtgtcacccaggctggagtgcagtggtgcgacctcggctcactgcaacctccgcctcctgggttcaagcagtttttctgcttcagcctctgagtaggtgggattacaggcacatgccaccatgcccagttacttatttatttatttatttatttatttatttatttatttattttttatttttagtagagacggagtttcaccatgttggccaggctggtctcgaactcctgacctcgtgaaccacacggctcagcctcccaaagtgctgggattgcaggtgtgagccaccatgcccagccagcttttaaggttttgccacacgctaaacaaggcatggtgaggactcttgggtttgagatcccaacagcctcagagatatcagatgtagggcaaagcgggtatctgcatcccccaagttctttccttctcactaaagtgcttgaagtactggtcctttatgatactttcagttctggagtacatgtgcagaatgtgcaggtttgttacatagctatacatgtgccatggtggttgctgcacccatcaccccgtcatctacattagatatttctcctaaagctataccccccagcccccaccccccaacaggccccagtgtgtgatgttcccctccctgtgtccatgtattctcattgttcacctcccacttatgagaacatgtggcgtttgattttctgttcttgtgttagtttgatgagaatgatggtttccaccttcatccatgtccctgcaaaggacatgatctcatgtttttttatggctgcatagtattccatggtgtatatgtgccacattttctttattcagtctttatcattgatgggcatttgggttggttccaagtcttttttattgtgaacagtgccacagtaatcatacgtgtgcatgtatctttatagtagcatgatttataatcctttgggtatatatccagtaatgggattgctgggtctaatggtatttctagttctatatccttgaggaatcgccacactgtcttccacaatggttgaactaatttacactcctaccaacagtgtaaaagtgttcctatttctccacatcctctccagcatctgttgttttctgactttttaatgatctccattctgactgccatgagatgttatctcattgtggttttgatttgcatttctctaatgaccagtgataaagagcatttattcatatgtttgttggctgcataaatgtcttctcttgagaagtgtctgttcatatcctttgcccactttttgatggggttgtttttttcttgtaaatttgtttaatgtatttgtagattctggatattagccctttgtcagatgaatagatggtaaaaattttgtcccattctgtaggttgctgaaacaggcagttttttgagtgcttgccacacaccaaccattgtgcaaagtacctaccatgcattatcttgctaaattagtataggattagtaataaattctatgagctatgttctatttttatcctcattttatagataagaaaactgagacccaggtatttgattaatttcacacagctgataaagagaggatgtggattctctaagtccagaattgaggccgtcagtcactggatcgtactgacatgatattcattcatatacccctgtcttccaaatgcatagatgtacaatagctgtcaggattgtatctccctgggtctcgtttcttatcaaaattgcacatttgctggcaagaagagagtggcacattgatctcaaactgtgaaataaatccatacgccttcagagaggttcttcgaatgtatggtcaagcattgcaaaagccgctgtgtgtttggaagaaaggtgaaactggaaggtctttggctcagggtgccattaggagtggtgtcggtggcagctgtgggccatcatggtacacatcctgcgtcaactccaggcctccccacaatcccatgaacagcaaagcccctcatcttttgaatgctggagaaagctccgtacgtgtagggcttcgccatcagtttaaaacgtctctggaattctttgattattttaatgtgctaatttcttgagctttgtttttgtgctgtctttgattttccactttcgcctttattttacgccattgttggaagggtcaaagcatcccagagcttaatggctctcttgttcagctattgtggggggaaaaagagcaaagcaaacaaaacaaaacaaaatatccttttttttgttttgctttttttttaatttaaaggcatccaaaaaattgtttcttttgcctttgatcaagatcatataaacataatcagtgtttattgtgtttgcataatcgaaaatagcaggaaactgatctcagattgcatggagctagaaaagattaagcctttccttcttggcagagttctacagacacacaaggttggtgtgatggatgcagcactcggtatccatgatgtgttcgggaaaatcctcagaagaaacttgcattgctttctggggaaattcctgaatacaagtggcaatgagatgcatgaaaattattttcagctgatgaatactgtctgaacataactattgctggggtgtataatttaaaatctgtagagtgaagtgtgcaatatatgggctttgggatacaacaaatatggatttaaattctactcctcctttttatcatctctctgcccgggataacttgtttcatccccttccctgagcttaagccccctcaactgtaaaagaaagataacaacccttacctcatatggttctagggaggacaacatgagataatacacatccaggcagtccccaacttaaaagtggtttcacttactttttttttttttttttttttttttgacattatgaatgacgtgaaacctttctgttttttcacatttggtatggtattcaatgaattccacgagatattcaatactattataaaattagctttgtgttagatgagtttgtccaaatgtaggctaatataagtgttttgagcttctttaaggtagagaagacaaagctatgatgttcagtaggttaggtgtatggaatgcaattttgatagaatattttcaactcacgatgagtttatagggacataaccatatcataagtcaaggaaagcatgtacgcagagcttaatagagtgcctaatacagagtaagtgcttaaaacatttttttaaagtgtgatacaagttctttggagagcctgaatgaattgggggtatggccatatgtaatatgttcagtgcagcaccattctttaataaattacaagttggtctatttctttgttcctttttatttttatttttatttttggaggcagagtctcactgtgtcacccaggctggaatgcagtggtgtgatcacagctcatggcagctttgatctctccaggcttagatgatcctgtacctcagcctcctgaatagctggcagcacaggtgtgtgtcaccacgcccagctaattttagtatttttggtagagacgaggtcttgccatgtagcccaggctggtcttaaacccctgggctcaggtagtcctcccacctcagcctcccaaagcacttggattacaggcatgagccacagtgcccagccagatgtaactatttaatgaaatgttgattggggtgtgcttgcttcccctgaagcctgattcttgatctttgttctggactccaggaccaaagatatcattgcttaatcttgcgaacaactctggaagatccttacagaatgacttgctttagccaaatcctatggtaaggcaaaacactacctaaaaacaataataagcataattgtcatccagatatgttgggaccctacagagaaattcagaagacaatctggctggagtttacagtatgtacaacagcagtcttggttaggccatggtattataattcagcaacaacaccaataataatattggtggttaaaatttcttgagtatatagaatgttccttctagtatgcttaaggcttgatatgcatacaatctttatggcaccctgcaaaatccatgagtccactgctgttttccaaataagaagatgggggttgtagtagtccattctcatactgttataaagagatacctgagtctgggtaatttataaaggaaagaggtttaattggctcacagttctgtgggttgtacaggctctgcttctggggaggcctcaggaaacttataatcatggcagaaggtgaaaacgaagcaagcacatcctcacatggccagcaggagagaggaagacagaaaaacagagcgagaagggagaggggctacatactttcaaacaaacagctcttgtgaaaactctatcaaaagaacagcaagggggatgtttgctcccattattctgtcatctcgcaccagacccctcctccaacactgagaactacagctggacatgagatttggggagggacacacagccaaaccatatcaggggtctagaaaggtaaaccaattttcccataacaatagagagaatacattataataagtaggacttgatccaaatctgagagacacccaaactcatgttcttaactatgagatttcgatacttggagtcagaagacttgggtttaagtttcagttgcagggaccttactcacatcttctaacctctcaaagccttgccatatcatctgttcaaaagaataccttcttcacaaaattgtaaagactgaatgagaaaatgcacctaaagcatctttgcacatcgcagagattatgcaagtataaggtgctatatttcgcattaacacctgagcatagatcattttcggattgtgtgagggatggtgaatttataaatttggtgatttttgatgaaaagaatcaatatgctgtctctttacagaggaattagtggttataagaactgacaatgcatttagagatttgtttttttcaataggacagaaagagactattttctttccatttataagaatatgaatgtgcttaagggaggacagattccaacaatcgagttgtttgctgtgatttgtacgccctggggatatggagagttgggaatgtagaaaaattacaattatggaataaaaaaagatccagggagaaggattttttttactgcctgttttgcttgtgtggcttggaacagggagtttcctggagggtgtggggtcttccttgctgaccctcgtgctttttggaggctcattggtaagccttgttgtgcctgttccttctgctcctagtccttaagaacatagctcttatccttaactgaccttttgcactgaatatgtgacagttaatccactggaaggttttagataggcagcatgtccagacactgccccctgcacgtgactggccccacctccgtcccaccttggtgttaatcccatggggtggattttctaggccagtctctttttagaatagcatttgctgatgtccctctaagagagtttttgggcatgtgccctggtttgtaaaagaagggccctcatggaggtagaggaaagaagtttcgcgtcccaagatctccaaggataccaattataggggtagctgggtacctgcctccctctgctcttcgtttctcaccgcaagagctctgctatgattttctccacatctggacttctttcctccctttcttgcatagctaacacccatgtgtgcttttggaccagtttccttgtcccgttcacaaaattaaaacttccttgacctcactgacttggttaagtacctttactgtatcactttataacttcagtaccttcatttgtagcttgcatcatcatttcagttttacaactttttatgtaatgatttggtttatgatactcttcccccaaaagactgtaaaggccatgcagatgaggaccaaatgtgttttttcttcctacgcatcctcagcatatgtgccttttatacagtaggcttttaacagtgactaaaaggaagagtgagtcggtggatggatggagaaatgaatgaatgaatgaatgggttacacaaccagcctgtccagacactgattcttttacgtaggctgagattcctgaggtaagggacaaggatatcaacttgcgttagtttaccttatgcactccatcgcagcctaaactgtcactgattacttgctgcccttagaatacaagctctctctgtcttccttcccctcctgccttttgcaatctcatttcatgctttgctcatttgccaccacaatacttaagccaggccagaattattttcagtgtttgaaagttgcacacccacttctcccttgcagattctgtacacgcttttcctccatcaaaaatgttttattctgcctcttcaaacattgcattttcataatcattttcagacctctgcctacatgtccctttttcatggaagccctccctccctgaatcctctaggttggacaactttcccctgtagtccccttgtatagcaccttgcatttccctccagatcacgtcccaaaattataatgaatatatgtttgcatttggacaatggcctgtttcctccactcaggagtaatagctacttgaggaaatgccttggtcatcaaaaagtgtctggctcctagtaggtactccacaagcagttatcaaataaaattgtaaaacccaggcactctttatggtcctaccaaaaccagtgacttgaatgggagatatttagggtcaaggaagaaagaaggcaggcatgttcatatttatttacctcctgtgggtttgtgatggcccctccttcttcttgggctagagtcagagccactttctcctaatcccctataggttaagctgagtaggtgataaagcccaagtcatagtagcataagcacaaggaattctgattatgttaagaaactgaaaacttcaggagtggttttggctattggtcattgctgaatctaagggtttgcataattactgtagggatgtcctcagtccgtggattgttttgactctctttggtgtcttggttttttgttgttttggtttggtttggtttgtttgtttgtttgtttgtttgtttgtttgttttgagacagagtcttgctgtgtcccccaagctggagtgcagtggcatgatctcggctcactgcaacctccgcctcccaggttccagtgattttcctgcttcagcctcccgtatagctgggactacaggcccatgccaccacacctggctaatttttgcatttctagtagagacagggtttcaccatgttggccaggctggtctggaactcctgacctcaggtgatctgcctgcctcagcctcctaaagtggtgggattacaggtgtgagccaccgcaccccacctggtgtcttgatttttattgctccttgcatatagtcaatggttctgagatctgacaggaaatgcctgatggaagagctatggcccatgcaggatctcacttcagaccttaatccttaagtttgtgtctgggaagatggggtacttgattggcaagatgctcgtcacttcttgctcacctctggatgtcaatccacaagttttctttggtatcttcactgtatgaaaaacccaactataatattacactcaagtacacacttataggagcacactttttatatagtttctatataattttcctaccccatctgtcttaggtcagatttcctagggataatgccatgcctgagatgggtgcaagtggtgaattgaaggaatgctctctggacaatgctatagggggtggtggtaatgaatcaggataaggcagaggaaggtatggtttcagggggaaacatagcctcagcctgatcttgtaagaagatctggattattcattgtgccaaggattatttcactgagtcttatccccaccccgtttcatccatctgtctttggccacaaggtgtcccccaggaaggggtggtagccgccttaccccttacctccacctttactccaggcatctctggctaaggtgaatcatgccagccaagtccaaacattcagagaagaattcaggttgtcagcagttagctgcaaacacccacgtcagcaggaagatggttcatcaagctagggaggatggctgaggcaccagctttaaggagtcatagaatggcctggtgtggtggctcacacctgtaatcctagccctttgggagtccaaggtgggcagatcacctgaggtcaggagttggagaccatcctggccacaatggtgaaaccccatctctacgaaaaataccaaaattagccgggtgtcctggtgcgtgcctgtaatcctagctactctggaggctgaggcaggagaattgcttgaacccaggaggcagaggttgtagtgagccaagatcgtgctactgcactctagcctgggcaacagagcaagactccgcatcaaaaaaaaaaaaaaaaaaaaaaaaaaaaagagagaaagaaataaaaaatagtcatagaatgagaaaaaaatctgaaattagagggattgctgtataaataatgacctctgcttgtattttctgagtagttccaattttacccagtcccttctgtctccttagtcttcagcctgaatctcttgcttacctcccctaatggccatatggggaacaggattttattaaggaaacctcgaaagggttgacacaagagtcaaacccccacacctttagatgcataggcagtgaaaccaacctgtacttcccatcttcttgcgtttccatttatccattcctcttggggtccagggtcatagcctctctactgtacctccaacgggtgccactacagtgtctggattctcgatcaccacctcccttttcagtttactgatcaggcagtttcggagaccacgccagggtttcatgtgccccggttgaggcatgaataacagcagtttgaattctcctttgtaattctcatccaggcaagtcactcttttttcctggtataaatgatcagatcgctgctgcagactcatccaggattcctctgccttattgtttttcaatccgtctacttccacgatcctctcttcccaccctccttgccgtcccctgcagccttcatgtctgtgcatacataaataaggctgttatgcacgcatgtgagaatatatacccatcatggtactgtgtgagcctgtgtacgtgctgaggaaatgtaatgggctgtggttgtgtgtttgtaggtgtataataagtttgccgcagactagggggataaatagagccatttgttgattcaaaccaatttttttttctcttgagttagtatccaatctgtagctaagaactgctgactacagcatatttccaagtgtggattttttttttttttccctgacagccaagacctaactcttgcctgatctatgtagatgcattgttcaaattacaaagcttaggtgacagaattgctctttttactgggagcccccaacacacctgtcatcagatagaagggagaatgcagaagtcatcactttacttagaaactcagcagatgattgaaattatttcttactactaattccccttttagtggagataagccgctttgttcagctgtaaatgaaacattagggtattaactgtggagccagaagtattggggaagctaagattttatctgcagtaagaacattttgggcaataaattgttttgttggacggaatactaaatctcttgagttacaaagaagcagagctcattaaggggaatgcttaaagcagaaaacaaggcgagacaaaagcttattacctttgttgtggggattgagggggtgtttgcaggttctcatgtatatgtagcatggaagacttatgcagtacagttattaaatagatgtgtctatagacttgcaaatgctctatgaatatgtccaagggacaaatacatttctgaaatatcaatagcaatctgcaataagttatgaattttggcgtacatatttaccctcaaagactagatttttgtttcctgcgggtgaaattttcccgtctctttgccacatccttcagattaattgactggcatggttacataaatgtttgtaatagagaagagtaagtgccagggttatccaaaatattgtcgcaaaatacacacctaaattaagataattatgtgttgggagcatctatcggcagggcttggcaaggaggggagctttctcttgatggagaggaggctctttctgggacactgaattcatgaatggtgggttctggattccccagggtgctctcagcttgtaagtgtcaggggaggggattgagggctgttcttttgccaataaccagggcggaaggaggacgagaggaagaagacagtgccttcttttccctggagttagcaaccctctgctgtgtctccaagagcaaggctgtggcagtacaactgtctacctgtctacaccggctgctccttcttgcctttggacagaagatgacactcacaaactgtggcccctgagcaacagtgtaaacgggcatacctcagttacaagcggattcaaatgtaatgagaacaatttcagagctatgcattttattcttctgtttttctccctggatgactcagggcatcttttcacagactcccaccctgaaggtttttattgccatttctgcgcttccctacacgtcctgattcataagtggatgctcaggacacagtcactcagagtagcttaatactctgcggacctcacgtgctgagttctcattctggacttaacgttactttaagctcagtttgtacctttccttggttctgtcaatggaaataaggacaacacttctcaaaacacagcaggtgggctgagagtggtgacttacacctgtaatcccagcactttgggaggctgaggtgggtggatcacttgaggtcagaagttcaagaacagccttgccaacactatgaaactgcatctctactaaaaatacaatcaattagccaggtttggtggtgtgctcctgtaatcccagctactctggaggctgaggcatgggaatcacttaaacccaggagacagaggttgcagtgagcctagaagatgccactgcactccggcctgggctatagggtgagactgtcaaaaagaaaaataaaagaaaaaaagaaacatagcaggaaggtagcagtggacaaatgaagtattggaaacacatagcctacacattcatgtgagctttaggagaacgtgaggtctaacttgcttaaagaaaacttagcacatgaaaaatgaaaactatttttttcagtgcatgagtgatcatgatctctttaattaaaagtgcactgaattgtaagatcttttaccaaaatgttaccatctttatcttctatctctggtgctgagtgtagtaacaggaagagatttcgaagtgaagactttagtaagatagaattgtgtgtattgtgtttaaatctggggtgtatttaaaatgtaattgaaatcacaagatatttaacatgctattcactttgcaagtgacttttcaggaccacttatctgcagactgtaggacaccagtctatgaacgttggcttataggagcaccaggtctccagttgagttaattcctcatacttgtcacatagggggcatactaagtcttcctgagatgagtagaaacatagatccacataaaaatgaaaagaacccactggtgacagagggtctcagagcctccagtttttttctgaactttgaaagtcagtaccaaagagtcagaactgaatggaaggacactaaaatcaatacttttcaatgtaacatcacaagcgttgggactctgaagaacttgatgacacatgattcagaagcaaagtgatatttacataggaagactgtcctcgccctctggaatgattttgacatgtgtattcactcttagttttggctcttagagtttaagtaatagatttacggtggtatgaacacaggtgttaaagagttctgggttcaagtcttgtccacgtcccaagctgtggaactctgaataaacctcttagtctattggaaccttagttttctcatctgtaaaacagatgaaactacctgattttttaggccctacttggctcttaaatttctcggctcagtgaacaatgcaagctttatgttataaaccaccaagacatctaagcttcttcccttacggccgttagtggattaagcgatatcctcagagcaactgtttggtgatttaacctcccccagttgctctatttcctgggttgttcatgagtaattgataaagaatttgcaacactaggattccacatggaagaaggaaatgcctcttttggacccatttcaaacaagcattggtaggagatgcctcagacgcttatgcttaaagcatcagtatcattgcctgacagcttatcacagtggcaggagcatagggttgaatcttatgtttttctttccctctgggtgacacttacaggatgcttaagtttgctggacctcactttcttcatctgtaagatggggacagagaactatctcagtgttacagaaaatttgaagatgaggctgaagatgtaagattttgttaatgtctacagtgttaaagaatctcaatatatggtggctatgattattgctattcttatattaacttggtgataggcatcagtggttgaattatctggagaacccagaaaacagaacagatcttgcaaattcagtcgcttacccagatgttagttgtttgatccccagtgtgacaaatgccaccttcaatctctctaacatttctaggcaagaaattattctctcaggagactgccagagaggcaattttgagcttgaaacttattgatgtgatgggctatgaccaggcaacttccgtagtcggggcatgtgctgagtctgactacagtctgactacaaatcccagctctagccccatgtggctgggggccagctattttcattgtggggttagactccctggagggaataattctgagatgacccttttaaaatgtaatccttgtactaaagtggggctagagggttccctattcattcatacggctactgtaacaaatgcccacaaacttggtagctttataacaatagaaatttactctcttccaattgggaggcaaaaagtttgatgtcaaggtgtcaacggaaatagtagacactaggaactacttggggcaagtgttgagtgactgttgggtactctgctcactttgtacctcaaacctcagcatcacgtaatatactcatgtaacaaagctgcacttgtacccccgaatccaacatgaaagttgaaattatatttttaaaaagcaatgtcgggccaggtgcggtagctcacgcctgttatcccaacattttgggaggccgaagcaggtggattacctgaggtcagtagtttgagaccagcttgaccaacacggagaaaccccatctctactaaaaatacaaaattagccaagtgcgatggcgcatgcctgtaatcgcagctacgtgggaggctgaagcaggagaattgctttaacctgggaggcagaggttgcagtgagccgggatcagactgttgcactccagcctgggtaacaagagcagaactctgtctcaaataaataaataaatgaataaataaataaaaataaaaatgcaatgtcagcagattggctccttatggagactttggatactttgagggaaaatccataccctggctctcttttagcctctggtggtgtctgtcaatacctgacatttctgggcttgtagatgcatctcgtccatttctgcctccatcttcatatggcattcccctctatgtcttctgttctgtgtgtcttctaagaatttgtcgatggatttagggctcacttaagtttaagatgaccccatatcaagatcttttaacttgattacatctgcaaagaccctcttcccaaataaggtcatagtcacaggcacgaggggttaagacttagacatacctgttgtggggacaaaattcaatctactgccattttattgtgaactatccttgcatggagaaacagttcattttaacttagaatattcaacaacacaaagctaacacttttctgtgggcgatgactatgtaccaggcattgtgctaattgataaagggcattatattttaaagttttatcttaacaattatatgaggtagggattatggccttctctgatttattgatgagaaaattgaccctcaggaggggaagaccatttttcttagtcacccaactaagaaagtggcacagttggtatcctaatccggaattttctgattctgccatttatgctttgaacaattatgctagaagttctcaaattttgtcatgcataagaatctcctggggttgttaaaattgcaccttccccaaagctcccatctctacagagattccgattctgtaggtagaggggaggggcaaggataggcattaaaaataactgcattatgcaattctgccccctctctcctcccactgaacccatctttaaggaaactgcaacctcagcacaggggctagcagacatattcagatcatctctgaagacagaaatcctcaaaagtgaaaaaacacaagaaagtccaggttgcttttttttaatttaaatttatagtgaaagctaccttggcccacagctttctccctcctggtcccttacaaatatattcctttccggattcttcaagaacacagtttgtattaccatctcccagcaagaagaaatttggaaataggtggtattgctcctaaccccttcctaaatttgagtctgctcattcttcagccatttggaggttttccacttggatgatgtccacagagctaggggaggaaaaattcttctgcaaagcacagtggatgaaccatcagtctgcagtaatccagtcaattaaaaatggatttcagttcccagcagcatggtggtgatgttaggaggagtcagtgtccacaatgctgttggtgcgcttgcccattaagtgatatttaggggatcttctgccatagcagaaaacagtgcggttgatgatctttgcaactaaagaagcaaaattgaagtctcacataccaccacggtattttatttctaatatgttaccctgccaaccttggaaccccgcatgaaactcaggaatgtgaagggacagaagtatgatatattgcccgatgcagctgattcgagagggggtatccaaaatacagtcccaagacatccaggagaatttgcctgaagagagggaacatgtaatggtattagaaaatccagaagatctaagctgcctgatgaagctattttttaaaaaatgtatcttcattgcatttatttttcatcacacagtagttggcgtaaaaccattctctctgtgaaagaagtcaaactacaaataactatgcaaaaatatatagagaaaaaggtgaagcttttcatattttaaatagcatctgaattacattgcttctttcaaggaggtaaactttgttgagtatttagcagttgttccagacttttctctgataaactttcaacttcaacataaaataatgataggtgttttgggaagccatagatgggatggctgtatggatcgatagctagatggctaaatatgttgatagaccctcaaacagattaggtaggtaaaaaatagaaaaataaaaagatagaaaaatagttaacaatgcaagcctctgggcagaagaaatttttccctatgttgtttatgctctgtgtgattctggcaataggtaaatgcattgattagcttctttgaacccacttttcattatctatcaagtagaggaaaacagtgtctttgttgcttgcctccagaattgaggatgacagtgaggtaatgaggaaatgtatttgaaaatattatggactcaacagacatattggcacaactcaggagatgtcataggcccagcttctataagatgatataacctagcacaggaggccaaaagagtttccaaattgcataaaggaaacttgattgtcctttaaaaatggctctggagaaattttatacccaggctcatgtcatctctcagtgaggttaaatctccaaaagaggaatgtcatctgttaataatacatcaagcatgcagcaggtagatgttcttttccttccctttaaaaagttatttttattttattttcatttttaatgtatattttaatgatgcagagtgtcatgttcctcagagtcagactgtatcctaaagtaatggtttggttaaaatatagaatggatttttgccaaattgaaaaatatatatattgtgttataaaactcgagctgtgatgagcaactctttgaaaatacatttaagtactcactgagtcttgtctgaagactcacctgtaagggagggtcaactaagttattcagtcccggacgttgttaactgccctgaaagtggtggctaataatttccttttgaagtgaaaagtagtaagtatgttcctgaactccattatcaatctttaataatttcagattaaggcattgtacttctatacaaaggaatatcatctttgaaaagtggtcttaaataaaatttcacaaataatagtatcccatcctcttgcatttgagaatttctgccgagagataggagaaaataaagactccttgctgctgtcaggaggtcatcgttgggaacagacttcaaagtatgtgaactttggtagtggaaagatgattattccttggtttccagatccttatgcataatttgaatatgagtggctttcaatgctaagtatatgagactcccctctgttaattatgctgtttcagatgagcctaattggacagccactggcacctaatatggtaaatatttcatataacgtgactttgagaagaagggtgcccccctccttaatcccatttgataggatggtgtaacctcaacagcagggatagcttaactctagaaagagttgttatttatctgagggcacctgtaagggggacatcacctaactcattcagtcctagacattgatgcctaaagtataaactgtggtctatagatgtaggaaggcttggaggcaattctagaaacactgcagaaaatttgcagtttctcctccaatctgatcttgaaggaggaggtgaacctggaactccccgttcacgatgcagttgtggaataaaatgaggcttgatttctcctggattatctgaccacttctttttattttcccccggctctatgggggtacaattaacaaatataaattatgtacatttaaggtataccatttgatattttgatatatgtatacattatgcagtgaccaccactctgaatccagtgaaggtatctatcagctcagagttccgttttttggtgagatcacttagaatctagtctctcagcaaacttcaagtatacaatacagtatcattaattgtagtcaccgtgctatacattagacgtctagaattcagtcatcttggataactgaaattttgtattctttgactaacatctccccattccctgctcccttcagcctctggcaaccactcttctcctgtctgtctattcctacgaatttgagtgttttagatcctgcatgtaagtgagatcttacagcgtttgtctttctgtgtctggtttattttctctagcataatgtcctccaggttcacccatattattgcaaatgagagaatccccccccccccactttttttttgcccagtctggagtgcaatggcacaatctcaggtcagggcaacctccgcctcccaagttcaagtgattctcctgcctcagcctcctgaatagctgggattacaggcacctgccactactccatgtgaattttgtatttttagtagagacagggtttcaccatgttggccaggttggtctcgaactcctgacctcaggtgaaccacacacctcagcctcccaaagtgctgggattataggcgtgagccaccatgccggggctccttgttttcttaatagatgaataatattctagtacgtacataaattttaattaaatattattcttttatatatatatataacctttttaattcattcatttgttaatgggtgcttaagttgtttttattattgtgaatatgccgcagtgaacatgggagtgcatatcctgatttcatttccttttattttattttattttattttattttattttattttattgagacggagtctcactctgtcacccaggctagagtgcagtgactcattctcggctcactgctacctccacctcccaggttcaagcgattctcctgcctcagcctcctgagtagctgtgattacacgtgtgagaccccatacttggctaagttttgtatttttagtacagacggggtttcaccatgttagtcaggctggtctctaactcctgacctcaggtgatctgcctgcctcagcctcccaaagtgctgggattccaggcataagccaccgtgcccagccgacataggaatttatttagtgtcaccttgtaggtcactgacctatcagggacaggcctccaagcttctgacatccagtgatagcttcttagaggtgaatgatgacggctcctgttaacattttctggcaggcactgcgtgaagcacttggcataaatgacctccatagataggtgctattatcatttctgcttcacagttcaaaaagtaaaggcttaaagaatgtaaataatttacacctgagtgaccagtacctacacctcagaagagaccctgtctctcagtcatgctgtgctgccagcgttggaaataggtagcaagtctgtggatattaaaagaatgctttttcagaaaaaacaaacaaacaaacaaacaaaaccgaatgcactttttaattatctgattccttgttgtcacgtctttatcaggtagaatgcacaataggttatcattcccttttcactgacgcagaaacagatgtgggctctcctggaatgtgttatgaattgggtgaggggtgccgttcaggatggcgttcctgggtcaatggattttatttccagtgagtagatatgtgggcgtaggtcctcgtttctcatgtctactccctctagtagagatgattttactccacagcaggaaagatgcctgctacaccacaaagggtattatttcggttacggtaataacgcataagggtgtgttttcaaagctgggcagtgcatgcttgccaggttgcagggtgattcttgagagctttctgggcccatcctagagaaaaatctccagtgaggctgcagttgcaatttatttcctcattctagcaagaaagctcttgacgatacagcagtgtttgttttctgcttggtaaagtagaaaggaaaacagcagaaattagcacggcgcagcgctgatgccagcccagaggcagggcctctcctggtagcccccccgctgcaaacctttgccgctggaaagccttcagctgcgatgagattagcagatgcagcagttcactccaaggcgctgtgcagttttttccctgttccaccaggtgttgccagagaacattgagcggagctgagctccgggcgaagtgtgttcccagctgctctggaacactcgggctgttctgaaggcagcaattaaatgagttatgctgaccggagcaaccctcttccttgcacgtttaaatatgcctcccgtgtgcgcctcatgcctcacatttcaaataaacacatttttgatgtgcctttggatctgctcacacattgttatattggaggaatcagagcaagcaaggctgtgcggatccaggctgcaactcaggtcccagctgcacctgtggtcagccttccctgttaccagaaagtggacagtaagcttggatgacacagagggggttctcagtgctagggtttttgcctggtaagtaaaggtagttccttctaacacctgtttcctttccactcttccatacctggagcattgagatcacagtcctaggtctgtgattctcaggcagttgtggctctgtgtccccagggtgcatttggccatgtccagagacatttttagttgtcacgactgggcagttgagggatgcaactgacatcgagtaggtagagcctgagatgctgcaattgatcctgcaacacacagagcatatcccccacaacaaagaattacctggtttgaaatattggcaatagtgaagggaaggggagaaaccccattctggaggtgaaggctttcttggcaagatacccgcattgcccaaaacacagagtacaatctttgaaactgtggtttttccagaaaacctcatctagatcatgacacctaaacatcatgcctcaccaaggtaacatccccaccaaggattaaagaagagttgccatatgccatgggcctactatgtgccaaataccttgttcatacggtttctaatccttacagaaataatgttgagtgggattactgcactgcgttatagaagagtaaaccgaggcccagagctcttgctttccttgttcagaatacctggctactacgtatgggagccttgttttcatccagtcccttccttttactgtgtcaccctgtggcccagagggtggatggatgtgggtttccaaaagaaaacctactttcgaatcttgcttttgagtggacagtaaattagagagtgatgcaaaaacatttagaaggaaaaacaattaaaaaatacaaactttccggaatccagtgttggcctgcctctaaaactctctgccttccaaagtgaccacgcacccacatggcagattgttacctgacaccttctgagtcccttttcagttactgctttggcaaattactacaaattccgtggcttacaacatcacagagtgactctcttagcgttccagaggcaaaaagactgaagtaggtcttactgtactaaacttgaggcttctgcagggctgtttcttctggaaatctaggggaaagtccatttccttgcattttctagtttctagaggccacctgctttccttggctcatggccccttcctccgtctccaatgctatcagtgtagcattttcaaatctctctctgtctctgcctctgcgtttgtatgtcctgtgatctcttaaggacccaagtgagtatgctgactaaccctaagataatcaaagataatctccccatctcgagaccctgatcttaatgttttttattttcataggtttttgggggaacgggtggtatttggttacatgagtcacctttagtggtgatttgtgcgattttggtgtgcccatcaccagagcagtatacactgaatctgatttgtagtctttgaatcacatccataaactccctcttgccaggtaaagtgaggattaggacatgagcatgtttgggagaaggatgttactctggctaccacaggtagtttagagctgccactgctagggataatgggaataaagtaaaggaaaagcatagaattttgacttcaagggatttgtatgggtgtgtgtgtgtgtgtgtgtgtgtgtgtgtgtatgtgtgtggtgcagagaagaatggcacacagcaaaaagaagccatgatactaattattctcagacaggtatgattatcatcaatcatatgcatctttgtatccccagaggctgctatgttgcctggtaagtggggtggtaggggcacagtttgtatttcctgtgttagtttttgtagggaaggtaagagcagtgttcaatagaaatacagaagaaagactgcttattatagcaaccaaaatatggcagcatacctattatcttaattgccgttaacattcaccttaatacaatgctggttgatatgcagaataataacctagagactgtgcaagtcttcacagtgccttctgtatcttcatagattcagtctattccattacactctggtgttgtacaggttttcatatttcactgggggtgggaaaactatggccctgggacctaatctggcctgcggactattttcctagacagaacattatgggaacacagccatgcccatttgtttaccaatcgtgggtggctgcttttgggccgcaatggcagaattgaataatcacaatgaatgtatggcccacagtgcctaaaatatttattccgtggctctttacagaaaaaaagaaactgataacccttgctttacacaactggatgctggcaagctcccttagggaggacagaaaggttgattaaccagaacacaacactctcacaacatgggggtcagaacatacacattctttgaattacagtatttgtgacaacctcctattgaacgtcttactgcaaataataaaagtctcaagttaagggagactgacactcaaatcatttagatttttttttctcagctatgtttagtgagataaattgtgcttcactgcagtgacttgtagatgacaatacagcagaagaacttttaatacggcgactgtattcattttgaaattttaaaaaatgttagactgtgtctgagcacagtaaaccattcaaaactgtcactgcacagagatgaatgggagaaacagtgcatctctgaaaatattccgtaaatatccttaaattataacgtctgtttgatctgctgagaagtagctaattcccgacacttttcatctctctagactgcccatcgattgtcctgagtattgcgattgctgttcctgataactgacttgataatttaatttaataagaccttatcttggtctagaggagcaatcaaggctgctatctcctacagcacgtttctccaccattgacattttaggccgaacatgtacttttttgttataggtagacatcccatgcattgtaggatattgaacagcatccctggcctcctatccactttatgccagtagcatcccctccctccttgttgtgttgttactaccgaaaatgtctccagatactgccattgtccctaaggcatgggggcaggggggtggttaacatattccccagataagaaccattgttctagaggtatggtgttggaagcgcttggcacctttcatgtaaatcattgcatgttgtcatcccaggtgaacttttcttcttttctttttgcatccccgcccgtcaattcttcccctactttctcctgggctgggcttttcttcatgtctaaatgcactgcaaagacgagattgccttgaactcctccagcttttcccgataaccctgagctgcgctgtcgctctaagccagatcagcagaatccggcctgtgatcaggttccgggagctggaggacctctccgtctcaggctgctgtgatcagagagtctggagaatgagaatctctctgatgtggtcttatcaggctgagcctaatgtcaaccctgttagaggagctttgtccgatctgcctgtagctttgttctgaaccgttcagtaacagttcactggagcagaaagagccctgtgaattgatattataaacccacatgcctgttttattcattgtggaggcaacagaatataacacaagtatttatttttagtggttggagaatggcatttctttccccgtccccattgtcacagaatgcagaaaacagcacagggctcctgaacacaattctattagaaagctgttgccagttgttcctggtttcgattattttgcactatcctaagcagtgtatgtctgtgcattgaatatgtatgtgtgcgtaatacatattacgttcgtttggatggtcttaataaggagccacataccatcagatgtaatccaatcactataggccagaccttctatccttggctattcccttaaccccatcaccaccttgatttcgttggaagttagattttctagaaaaattcatgaaacttcaacatgcttcattcattccttgctctgggcattccttgctgaaggtcaggagctgtgaaatttctctttagtcccattgctttgatatggcagaggctgggcaatgaagaaattgaagtgtggaaaaatggagttccggcaatgtcttaaatgaggggaggggtcttatcgaggaggctgtgcctgtggtctgagctgacatttctctaacagtgagaccaggaagaggaccaggggacacagctggatggctgcaataccagggtcccttcagctgcaattaaagctgcatcttacattggagtcttcagtgatgatgatgatgatgatagtagtagattgaacataggaaattgctgtcatttgacaattgttaacctacataaatgtcactttcctacagcgcaacttaataattgtacacataatagctcatctgcgctgggtgaccgctatggtccaggcacagtgctgtaggcactgcatatgtgttggctccttagaccaacacagccactgtctattacagatactgttattgctctcacttgacaaataaggatgctgagctgtgggaataatttgcccaatgacactaaatggcaaaactgggattaaaacccaggaccttaagactgcagcctcggctgagcgtgatggctcacgcctgtaatcccagcactttgggaggccaaggtgggtggattacatgaggttgggagttcgagaccagcctgaccaacatggagaaacccggtctctactaaaaatacaaaattagctgggagtggtggtgcgtgcctgtaatcccagtaaggaggctgaggcagcagaatcacttgaacccagaaggcagaggttgcagtgagccaagattgtgccattgcactccagcctggacaacaagagcaaaactctatcccaaaaacaaaacaaaacaacaaaaaaacaaactgaggtctcttctgttaacccctatcctcctctcttggttggataacagttttagactgatgctcctaattcccacagaggggcctgcattttcatcaggcttgaggatcatgagttttcacgtgtgtgtgtgtgtgtgtgtgtgtgtgtgtgtgtgtgtaaatcaccctaattgtggggagtactaataagttccatcgatctactcttcacctagtaatcaacttgaattatttatttatttatttatttttcgagacagagtctcactctgtcacccaggttggagtacagtggtgtgatcttggctcactgcaccctctgcctcttgagtttaagcaattcttgtgcctcagcgtaccgagtagctgggactacaggcgtgagccaccatgcctgaccaatttttgtatttttagtagagacggggttttgtcatgttggccaggttggtcttgaactcttgacctcaggtgatctgcccttctcagcctcccaaagtgctgggattacagccaccacacctggccaatcaactttgaattctaagaatgggtgacaaagaactttgtcttgagggttgtgtgttaagcaagagccatcaggtctcatcctcctcagtttagccacaattccacattagtttccccgacagtgtatggaatttcagttctacactcttccttctctaaatttcacccggtctttcagagaggagacagggccctaacagacttagcaaagatgttgaacacatgaaaatgggaagtactgtttaaaaatggaataactcttttcttcccccaaatctataaccccagtctaattgtaagaaaaacatcagtcaacttccagttgagggacatcgtgcaaaatatctgactgtcaaggtgatcaaagacggggaatgtcaggccaggcgtggtggctcacacctgtaatcccagcactttgggtggccaaggtgggtggatcacctgaggttgggagtttgagaccagcctgaccaacatggagaaaccccgtctctattaaaatgcaaaaattagctgggcgtggtggcgcatgcctgtaattccagctacgtgggaggctgaggcaggagaatcacttgaacccaggaagcagtggttgtggtgagccaagatcatgccattgcattccagcctggacaacaagagcaaaactcctttcaaaaaaaaaaaaaaaaaaaaaagatagggaaaatctgagaaactatcacagacaagaagaaacttcagagtcacggccgcccagatgccatgtggtgtctcagatgggatcctggagccgaaaaaggacattagatgaaaactaaagcaatcgaagtataggctgtagttaatcgtgatgtattcatagtggttccttagttgtgaacatgtaccatgctactgtaagatgttaataatagtgaaaattggctggacaccgtcgctcacggctgtaatcccagtactttggaggactacctgaggagttccagactagcctggccaacatggtgaaaccccatctctactaaaaatacaaaaattagccaggcgtggtggcgtgtgcctgtaatctcagctcctcatgaggctgaggcaggagaatcacttgaacctaggagctagaggttgcagggagccgagatcgcaccagtgcactccaggctgggcaacagagtgacattctgccaaaaaaaaaaaaaaaagttaataataggggaaattgtggagtacatggaaattctctgtacaaacttcacaacatttctgtaaatcgaaaagtatgctgcaattaaaattttatttttaaaaagggaaaataaacataagcccacacaaaaaatatggactaatcaaatactttctagatttcgtgtttatagcgtttctcacttagtaatacaaagcattctatcttagatttctcccatgtctgttagactcccaaaggcttttaccccatggtaaacagcataaacaaatttgtatggcttttttaaattcagattttcccaggctgatttaatcatggaattacgactgggcatggtggctcacgcctgtgatcccagagctctgggaggccgaggcaggcggactgcgaggtcaggagatcgagaccatcctggctaacacggtgaaaccccgtctctactacaaatataaaaaattggccaggcgccatggtgggcgcctgcagtcccagctactcgggaggctgaggcaggagaatggcgtgaacccgggaggcggagcttgcagtgagccaagatcacgccactgcactccagcccgggcgaaagagcgagactccgtctcaaaacaaaataaaaataaataaaaataaaaataaaataaaaaataaaaaaataaattatggaattattttacttgagaagcagtgatggggaaaaaaaatgtaggtcacaagcctccctgatgacaattcctttcataacaccagcttttcccaggacacaccattgagacaccttgacatcactacccagaagcattggtaacctctttgtgcctcaacactgattctcgcctgtaaaccattcctctcccctggccaccctcctgcatctgaccccctgcctcccttccccagtcttcctctgtagcaatgggtcccacacatccctgaatcacttgttaaaacctagatgtccagccttgacccccagagttcctgattcactgggtctgggatggggcccagaaactttgcatttctcacaagatccaaggtgaggtcaacactaccagcctggggaccacactttgcaagccactgagatgccctctgtctccttgtaaggctgccatccattccgccatagattccacgctttgctgccacccccctgccccctgcctgcccctttgcttgtcctcttgctattcccaggcactggttgcctgttttctaacataaatgtcaaaaaagtattcctcagcgggtgtggcattcagaaatggataggattcaaacaagcaaagggggttacttggtttaagagctcagtttaatgacaagagtattttccttgtagctttgtagagctggatcccaggtacctctcatgaagcccatgaacttggtttctaccctataaattgaggttgatgagactcatcactttggcttttgcgaggattaattggatttgcattcgttaagtgcagagcctggcacattgtaacagctcattagtaattactttccaaactccaaggagatggttctcagatgttggtgactatcatcacctcctgcagagatgtggaggtgcagagtcctgaccctgcctccaaagactcttactcatcaaatttgggagtgagataagaatctgtacatgttacaaagaaaccagaaaatcccaattcaaggggtctacagacaatccattcattcgttcttcacttagttatccaacaagtgtttcacatacacttccatgcaccaagatgggattgcaggtggtagggatacagaaatggacaaaaccgagtgctcaccttggtggagatgattggcagcctgccttacacaaggaactctatgttcactggccaggttatgggaagtggtacaaagttggagtaaaagtaaggtaagaagatagattggtggtcaaaagtctttctgagaagattacatgagaggaaagatggaataaaggaagaaaaatattgaaaaatcttcaattaaaatgtgattctttctaatgtgagccacagaatttaacacagatctgtagtagtcatcttgagtgtttttcttttgatagaaaagtgtgactttccaaccaatatagtaggaacttgttgaaggtctaccatatcccaaacacaatgtttttcaaatattgtttttattttattttatttatttatttattttgagatcaaagctcactctgtcacccaggctggagtgtggtgatgcgatctcagttcactgcaacctccgcctcccgggttcaagcgattcttgtgcctcagcctccagagtagctgggattacaggcgtgtgccaccatgactggccaatttttgtatgtttagtagagatggggttttgccatgttagccaggctggtcttgaactcctgacctcaggtgatccgtttccttcagccttctaaaatgctgggattacaggtggtgagccacggcgcccagcccttatttctaatccctgtaacagattatgcaagggaaggtgtttcatcccaacattacagatgaggggagttgtgaggagcttatatgatcacatagtgaatggccaaagatggctctttctatactctacagcctctgacatacaaagattcagacttcatttccaaagtcattagcagtaccaactgtaatcctcttaaggaactaattattttgttaccattttctgtatttattatattgccatgccccatggcttacaatcctggctgtgccttcaaatgtcccagaggcaggaactgagtgtctggggtattaaggttttctcagatgatgcatctgatatgcatccaatgacaggtaccactggctagcattataatccaagataaatccatatcttctgcctgtggaaccagatggagttctggtatcaaaatacagatctagagggtagctctgagccagtgcacttgaagtttgtggtcatgatgaacttcaagctcatgtaagagattactgaatttcccagcaatgagtaacggaccaacctatggagaaggcagacagaatggcaatgtggaataagcacaggccctggcatccaaactgggtttgaaacccacctgtccacttttctggctttgtgatttggggtgacacacaaaatttataatatacgtaatattattaagaacacagtaggttcccagcattgtattctctgttctctctcttaaaagtgccaccctctaccaagaagcactagttgaattccaagaaggcaagaaaagggctaccatttcttctctacccagcaatggttacgttaattttccagtgcaggaaagtggaagaaaataagagtatatatatatctttccaggcccttctttccaaagttatttgactctaaacttagcatcctctcccgggaagatggaactgtcctttttgtgcatttgctgtgataactttgggcccagttacgcttgctacgaagcttgggctggtagtggtttaggagaaaaaaaaatcaagtgaaacttaggactgtcttctctcttctttcccgaacttcatctttgcagagatgatctcctctttgacatgcagagtactcaggcctctttttctcttcttgtcctttctttcttattaaacctccagccccccaatctgaaacgattgctcccattttgtattccatggagctgtaatatttgcccaatgatgagctccattcagcagtttgttaactgaaatgggaagtgacagattcaataaaaggaaatctctgtgccaaggaaacagatattatttctcccctcgctctccctttctgtgtctctcagactactctgtgcccggaatccagagactctgagcttacggacaagtcaaagctttctgttgatccatgcccaactaatttgatcagaatagaggtttttattccctgtagttcttctctctcatgcttactgatatgattgagtgcctgggagtcacccccaacctctgctgattgttagagggaggaagtgatgtacaggaaagtgggtacatggtgtgctgggaggggggccttgtagacaagatggggacaattgtaaacagaagatcggggctaatgtaaaagtgcaagatcctcttctggggacagccttcttgtcttcatggatagtgcatatagaaaagcacccacgattcccagtcattgaaaaccagaggaccccagtggcaatggatacccatttaatctctgagaaaatattaatgagtaaaaggcaagcgactttagggatgtttttttttctttccacatatatgtggacactagttgtgaataataatgacaatgacgatagtgagtagatatcatgtatcaactccctactaaatgccaaggtttggtctatgcacgtaacacatattatctcattcaatccccgacaacaaccctctgaaggaggtgtccttattatccacattttatagcagaaaactggggcttagagaagtaatgtgtccaagaactcatagctggcaggtaggagccctgagattccagtgtggggctcgtaaacttacactttgcctaaattttttttaaatgattgagttcattgttcatttatatttaattttaagaaatagcacaaagagtccgggcatggtggctcacacctgtaatcccagcactttgggaggcggaggcgggtggatcatctgaggtcaggagtttgagaccatcctggccaacatggtgaaaccccatctctactaaaaatacaaaaaatactggctgggcgtggtggtgtgtgcctgtaaccacagctacttaggaaactgagacaggggaatcacttgaacctgggaggtggaggttgcagtgaggtgagattgttccactgcattccagcctgggcaacagagcgagactctgtgtcaaagaaaaaaaaaaaaaagagatgaccccatatcctgttcccccagtttccccagtggtaacatcttatataaccaaagtacaccaccaccaccaggaaactgaccttgatccaatgcatccgccttattcggatttcaccagcttcacatggtattgtgtgtgtgtgtgtgtgtgtgtgtgtgtgtgttcacttctctgcaatgtctcacccatgtagcctcctgtgatagccaccatagccaacatacatcatagctccatcacaaagatcctaggctctactctttcgtccctgcagtgacctccctccctgctccatatctcaggaaaccttaatgtgttctccatctttataattttgtcatttcaagaatgctatataaaaagtatgtgaaaggcttcatgttggtcaccctctgtgcatgtgtgtggttgcagaattagtcctcacacagagcttgattgtctacttcacttcttgacgcactttcgttcctctgtcatctcccatctcccttttcctgcagatgtattgggttgagacttctggattaggtaccctgttggccctagtatgcagcctatcacccaatcaccacaaccaccctcatcccacagatgggctccagatgtcactgtgtggaggtcctctatagattttcagatcacattcagtcactggaggccaagacactccctgtcactctctgcccaaccctccattcctaacctcacctctcccccacggccaacctaggtccattagccatgctgagcttgaggataagaggactagtttccattgctggtccatagtttccaccccagaagcctccatgccccatactggttaaaaagttattgcagaagaggtttgccagaggtaaaccaggtcttccagagtataccagaaaggactgcatgttgtctgtttgagtgggggacttcatgcccaattttcacagggcaaagcatctcctggtgtcttgtgtggcaaacagctttgatacttgcccatgtcccatggtgtccaggagacttttcattaaatgaggtgaccactgcccctttagggcgtgagccaggcatctgagatggagattacgcattctgtgtctctgcctgacacaacatttctgttttcctgatggcttatctgatgccattaaagtctctacctgtaaatagtcagtagacattgggtatgaaagacccaaacaatatttggctgaactgttcgttgccacagagtattattagattagattggatcttagatattgaagaatttttactcccttacttttgcaaacctggaaaaaaaattgatgctatctgctctctagaactaatactttatggtcttatcctcttttctcctctctctcactgtgtctgtgtctctatctctgtctttctctgtcttcctctgtctctctcacctcttttttctcttctctcctctaaaggaaggcattgactcttccagagccactaagagtcgaggtttttttttgttgttgtttctgtttgttttgttttgtttttgagaaagggtctcagtctgtcacccaggttggagtgcagtggcacaatcagagctcactgcacccttgacctcccgggctcatgctttcctcacacttcagcccctggagtagctgggactacaggtgttcgtcaccacgcccagatagttttttttgtatttttactagagacagggtttcgccatgtttcccaggctggtctggaactcctgggctcaagcagttcacccaccgtggcctcccaaagtgctgggattacaagcgtgagcaccaccaccgtcccccacccccagccaagagttgtttttatcatgtccttagtcttgttggttgctgccttgtccctttacctgttgttcctcttcaatcattgcaacagtgacactccccttagctgggcatcaaacacagacagaagcatattcaattccaggagtctccactgtctctcatctgaatttaagctggacacctcgcttgtgaatgcagaggggccagcatcccactcccgccttggcgcaatgcaaccggcacctttgagggggcagattgtattgtgccttgtcaggcccaccacggcttttgttttcctgcgcatttgaataatacatctgattaccatggcaaatgttgcggcatatgcaagcttggacctcctgcctaattagctgttgataacagggccccctgccctttcccctctccgcagccctcagggacatgacagttcttttatctttcttcaaaattgacttgctctcccgaccctccagtagttcctgttttgtctgtttacctctcctgcattttgcaagactgttaattttccgtggcacctcctatctggttgtaattaacacatcgcacactgaagaaatagttctgctttttccagatgcctaatggaggcatgtccttttttttcttttctccactaattataccactgtattttagcaacctgcattgacctaaaaggatctgttttctttctttcttcctttttttttttttttttttaattgttttggttggaagaataagtatggttttagaacccagtttgggcagaaactgggaagagaatgaaatcattagtgatatatgttgtcactgtttcttttcatagcctttaaagtaacaaatgagggtacatttgttgtcagccttcctgttcagcgtttgacaactctttgttagatgtgggtaacgtttgctttggatatatgctctctctccagtctaaatattctgccgtggtaattatacagatggggcacatgacctattccgtagagtgtggaaattctcagcagattgtaaatagcctctcgtcctattagattttaaggaagctaagcccttgcctcccaaacatgagacatggaatctgtttatcatcttatgcttaggcttaagatttaagctgtaatgaatactggttcaaagagattgaggtataagaaggaggttggtagttacagcaataaaaacaggagcaaaaagagcagcttttgtgaaggactccggctggaataatgatgatagaattgtctaaatcgatacatctcttgtcagactcatgtctgatgtttgaatcaaccaggccttttctgcaagagctttcctcaagaatattgaattatttattatttgtatctttttttttctttccctttctgatgattttttttccttctgacttagtgaaatttgtttttcatgctgccaggttgaatgttgtctactctttgataaatagcagtaattgggcatatagcaggggtcatgtacaaatgtatgacttcaattacatctagagcatttttttctttatattgatcttttttttttcttataagatctgttctctatagcctgtggtactgagtactttaaagaattattctttgtccatgtatgtcagcatgcactttcaaatctatatatcttttaaaatatatatatatatacacacatatatatacatatatatatatacacatatatatatacacacacacacacacacacacatatatatatatatgtagtcctgcgctttcctgaggctgtacagacgtgggaggcgaaattgtgacgcctccacttgatgaaccatacctgactcttttgctcatcttgcagtcttgtggcggtgtcatttctacggttggcttttcttgctacaggttgggccaaggtggagaaggcactggtattgaccaggaaagttgtatgtaatagaaattgtagagcacagtaggagaagaaaagtgaaatgaagtagacatgggaggcagaaagacaaagagagagagaacaacctatgttgtaattgaagcttaagaaaataccatccttggacactttcttgtttctgattttatctaagtatcttctggttgattcttaaactgcatgtatttatggcacatgtatttgccagtttaatggacacttttccatctaggactgtttatattcaggcacccatacgtacacatatttccaagggtaaataaacaccagcctgaatgtttggtgagattagctttggcaatagtgacatttcccaggcacagccaggttttctaaggcaggaatctgaggtctgatgatattactgctctgagcgtacctaacctacagtttgaggaaataaaaggtaggttggaagactgccgaggcccccagttggctgctgcttccagagactgcaggcttactcagtgcttactgtcccatttccactggcctggagatggcctttgccaaagggcagtcatagaaataacaactccacatcattccttgtttggttctgcgtttctgtaccatggcatcgtgctgtcgtcagcagttttctgacatgcaaaataatgatggggcactgaattatattttgtaagggcatgcaaatagagagtgttcatttcttcagcctttttgaaggagaagtgagcccttaaaagtcattttcgggtaggaagtgtacacacattattttatgtcatgcccagtccctaaagccatatctgttccatatttttcagagggagaaaatagaataaaaaccctcagaggctctgagtgataaaggaaacacagtctcagttattatgctgtaggagatgaagctgggacttaaatagacaaagagaaatggagttggctttggtcgagcctgtgattctgggccacatcgtatttctgtgtgtatgtttgtgtacgtgtgcgtgtgtgtgcgtgtgcttgtgcgagtgagaaacacttggatagaactgcctctcccaccagtaggctgttaggcacggcactcagaaacagccctattgttttagatttcctttcatatcatgtaggcgtctataccatgccacccacacaggagagcaagtgagctgtgaaatatattcattgttagagtactggggaaatggcggcaagcaatcggaggtaataatgtccgacaggcaagggaggctgccaacattacctgcattatttcggttgcctttttcattataggttcgggaaataggcagcaattcgattatggcatgatttggggtggaattgcttgcactccgtgaccccgtcactgggggatcaaatgagaagtcaaatcaaataaagttcatagtgcattaaccggatggagcagtgccttacccactcagcacgatttttcatcttccaggggtttgtgactgcagcctagatatctctgcaccttaaggcatggggaggattggctgagatgtataggagtgaggagaggcggccaatagtgtgcaaacccctcccctcccatgtgtagcgccgagtttctctgcagcttgagcaaagcagtgtgattaataacaaggaggaaacctgcttgttggattattaatttcccatcccctttgccttattttttttctttgccatattcctgatgctttttcttctgcctcttttctttttgccatttgctaaagcctctccacccctccttttccctcctgtggcccacacttttgcccatggagatatccactagtcctttacactgacacctggccacccaacctcgtgccggctggcttcacacctggggtgagtttatctcttcccttcggggattctgtctctgaaactaggagagagagaatgagggagaaagagagagagagagagagagagagagagagagagagaatatgaatatgggtccagtggtgttggagccctgctgtattttaatcatagacttggccttcttttaggagtgacccaaaaagcaagaccagttcgtggggtacctgtatccaaccccatttcagctgctgtgtggaaaagtaggatttctcatagttaactgattaggtattttctcaccagttctaaacacaaagagtgcatcttgcaaaaatataaaaagttgtggggggtgggggtgcaggcaggggagataatgactggtaattgcaagctgtcatactaaaagatatttggggtgcaagagttacttctgccagcagaatggtagaatggaggaagggggagatttggaaggctttggggtagcttgtgaggggaggtactttgcattaaaacttctgtcaccatctgtactttcgatttcacagtcctaccctcacactactggaaaggagagtttcatactgactgtgggcacaggggagtggtttgcaattgcagcttgtgctgtttatatggtgcatgtgatttggggaccttctgggttctgattcgctgacctgcccagaggaggaggctgggccactttcttttccacattatgtattgcacacctctgttctgtgtctctcctcacctgctttgaaggatttctttccctctctgcaaatctctcccctcccgtaaatcagcatgattaaatagcagaagggtggaggtggcgccatgcattatgcacatgagctgtctttaccagcctgtccatatgtctgaaggaaaccttgtgttttaatcccaagaagtcaccttttttgaagattaccttgaagcatccaaaagctaataggatggagaactaaaggcatttgacattaattgttctgtctatttatataacttaagcacaaggcagcgaaaatcttccaagctgattatttctttggtttattctgagtctcttttttaagcattcagagcttcttaagtaatgaatttttaggaaaaagagccatgcaatgataaagtgactccagtagcagatttttgtcattttttttaaaagaagtgctcaaatagggcagccatgaattttatttgtgtaatttacacttgaatatgaatatatatatatacatatatatgggggtgggggtctagctctgtcacccaggctggagtgcagtgatgcaatcttttctgactgcaacctctgcatcccaggttcaagcgatgctcctgcctcagcctcccgagtagctgggaatacagaagggcatcatcacacccagctactttttgtatttttagtagagacagggttgcgccacgttggccaggcaggtcttgaactcctggcctcatgtgatccacccacctcggcttccaaaagtgccgggattacaggtgtgaaccacctcacctggccatacgcttgaatatgttttattaaatatgagattactggtaaggacttgatgtttacatcatagctgttcacaaggtacataatgcatttattttgtttcttatgtagtgcccaggataagaaggaaatgaaagaacctatggaaggggatacaatttcagctttgacagtttgggatcatagtattatcctaaaagcaagcaaacaaacaaacaaacagtgccagctgaaacaatcacataatcacctttctagttattttttcttcaggttctgggtctccctctggaaataacaggtgttattttgactgaatgaccccctactgaggtaaaatttggagcagaatataatacaaattatattccaaaggtgataagatacttgggagtttgagcaccaagaagaatgttatcttagagatggtatgagtataatacaagttggcattattattattttgacataaaagggggaaattattgtaaatctcagtgtgttgtctgtatcaagtactcattttttaaaatatgttttttttccagggaaaggcttatactgttgggaaataatttcttttagacatttagagaaaaaaatgtgaaaattatgttttgaagtgcatttttgctgtagaatgctagaagtccattgttgtttaatgcttcatttacagcatgcggatttacaacacactgaatgagagaagtggggtttaattttttcactatgacttcttataaacccgcaaggggtctatttgatgagtaatagttgagttgacttttacctacgagttaccttctccacgtcttcattgcttcatttttccctcaaccggatcatgtaatagaaaacttcctcaaaacctgttcctacttgagaaatttcaaaggatggaaacccttctttgaaggacttaaaattacatttatatcaggatgaatcatgtttcgactttaaatatcaccttatttctggcggtctcttttgtttccaagtggcaaatgttccttctgaaattacatagtttcctcttgctcattctgtttctaaacttctctggataaatgtgtgaaaataaatgaaattgttaagccctgagaataagcttggaaaatagaagttatcctacctgggcaaaagctccaaacattctaggggggatagagacccctcctccctcttttaacaaatcctcccttgaactggggagagaaaggatcgccttccaggattttttttccctgacgtgtaacagttcttaaaatactgccttgttaatttgtttctattttacatgagcattatacaaacagtgataaacgaaatgtatcattttttccccataaagcctcctcccagattctcctcagtgtttacagaaatgtgctgtatccatgagctcagatcaattgtttatacacattggtgttcatttgttcaaggcggcatctgggcctcggatgtcgggagagacccactgaggcaaagcactattaatagaaaggcttatctcgtttaagggagtaatcattttaatatactcaggaaaaagccagcgtgcaggctcttggcccacccttgcctaggcagggtctacaccttccagaagcaaacacagccgaaaagagctcttaaagaagtgattacagagtcatgattgctctacaaattgagtcttttttctgcttgacagtgatcctggcatcgtctccccgcttaatccttactagcaatttgcctatagttgcagctaacaagaggtgattagaggggagttgccagtcaccacttaacacccagctctgggggcaccatgggcacaggctgccgaattgggcctgttttcttattaactccccacctctgaatgcattagcccagctcttagctaatgatagttttcaagcaacagcgtgagttcctgagcagcatggtgatctgactctccagcatgcagctaggaaaattaggaaggagagggagaaagcatgttgttcttcaaaccaaatagatgcgccaagggagaggatctcccccaataaaattaggcgcacgctgtgctgcgtggctgtcttggtcttggaggttgtgggttgacacaagaaggggacatgatgcgttgcatattttatctgtcctgtggaaggtcctgagaataccaacagcagtggatcttgggttagaagctagagtgaagtggtctgcagacaggagactacacctacaggggtgtaagcagagaggcaaggcaggctgtctgggggacaggtccttggttatcatacatgagggtgcatcagcattcctgcacggcttgttaaaacctctgagtctgtggcagatacacaccatggaatactatgcagccataaaaaaggatgagttcatgtcctttgtagggacatggatgaagctggaaaccatcattctcagcaaactattgaaaggacagaaaaccaaacactgcgtgttctcactcataggtgggaactgaacaatgagaacacttggacacaaggtggggaacatcgtgtgaccggggcctgtcatgcagtggggggagcggagagggatagcattaggagaaatacctaatgtaaatgacgagttaatgggtgcagcacaccaacatggcacatgtatacatatgtaacaaacctgcatgttgtgcacatgtaccctagaacttaaagtataataaaaattaataaaataaaataaaacctcgagtttctgattctgtaggatgtaggacggggccaagtaatttgcattctaacaaatttccaagagatgctgatgctgctggtctgagaacccccaagtttgagagcccctgctgaagttggacaggcttggttttgcaaaaatgcgaaacgtaccaaatgtaccctccggtgacttgcttaacaactgtgtgtagctctcccagtgcagaagaaaatccccagtctctaaccaacttctgagacattaggccatcctttcccctccaattttaccttcccttgcccaagctaatttaactctttctttcttttcttttctttttcttcttctttttatttttttttatttttatttatttattttttttgagatggagtctctctctgtttcccaggctagagtgcatggagtgcaatggctggatctcacctcactgcaaactccacctcccgggttctagtgattcttgtgcctcagcctcccgagtagctgggattacaggcatgtgctaccacgcccagttagttttcatatttttagtagagatggggtttgaacatgtttcccagcttggtctcaaacccctgacctcagatgatctgcctgccttggcctcctaaagtgctcagccaccatgcacagtcttaatttagctgtttcttgaacatactccgtgcccccatatcagatatctttttacattccaagaatgtttctccctcctatttgctcatcctaaaagttcttacctgtcttttaagttgtggctcaagtattgcctcctccaggaggccccagctgcatttgtcatttcctccaaatctgaactccttatatgctgttatgtgatggatgtatcacgttgcatgatagtgcttacgtatcttttcccctgaagtcaggaatcccttttattcatttagtttctccaacacctagcattgctattggcatatcgtcactgcagtcaactttttttgttgaataagttttgtatgagatatatttgacctatgagaattaatatctttttttttttttttttttttgagacggagttttgctctgttgctcaggctggagtgcaatggcatgatctcggttcactgcaacttttgcctcctgggttctagtgattctcctgcctcagccccctgagtagctgggattacaggcatccactaccactcctggctattttattattattattattattattattattattattattattattatttgtagttttagtagagacagggttttgccatgttggccaggctggtatcaaactcctgacctcaggtgatccacctgccttggcctcccatagtgctgggattacaggtgtgagtcactgcacctgaccagagaattaatatctaataagcgaagaccaaacattggagtcagacagcttacatttgagtgttcacacaatgatatatgtggatttttctttctttctcttttattttggctttgagggcaattcacttcccctctctgagactcagtcttactcatctttataatgggaataatgataatgataacagtagtagaagtagcagcagcagcaacagtagtagtgagtgacactactcacatctgcacatgtaggtcgtaaagtacaacacagtacaatgcctggcgctctgcaaagaaaaaaagtgtatcaacagacaggaggatttctattgttgtccttgattctactgtgagacgtccacactggtggaaaggtgacctgtcttgtggaaatgaatgtgtggaagtggagaggacccgactccagagctggtgggaaatcgagcggcataaggcttttctgacatctcctgatgtgaacactgtgaatataatcttgtgaaccagagcaagtggaggggacatctactggacagaggcacagcaacatcctctctctggtcaccccttccctgctcacccatccccggccatgctggcttcttcctcctgctgaagcactcagggatctcaaggacttggcacaagccatcctgcctctccttccctcacccccttttcattcatcagctgttgattttggtgtcaccgtcctctgagaagccttccctggctagcccatcaaaagtgatcctgcccagccaacttttattctctctgccagcacactgtacttttccttcatcacattcatagctgtctgcaatgatattaccttgaattttagtttacagtaagcttcaagagaacaggaagccacctattttgtcctctcatacacccagagcctagaatctagaggaggtgagcagaaaatagtcgtcaggtggatgaatacaggatgggaggaactgataaaaactgccatataaccatcatgggacatggcaaaggtagataatatatcttttcccttgggaatttacaatttttattgggaaaagtgcatgggtagagtatcactcagatatttctttctgtgcttccatagaccctattatttccctaacagcaaactctgcctttccattcttcattactccaactaataattattgagatatactatgtattgcacactcttctagaagctgcagaatgtatcagtaaacaaaatacacaaaaatctctgcctttgtgggacttgtgacagtgttgcattgacctacttactttctccctgcaatcattgagtttctcttggtctagggccatttgtcatcatagtttttccccagctcctaacatgattcttcacagagagtacatgctcaaaacaaattggcggaatgaattgatttttaaaaacttgttctactttcttgccactaagtctataatccaaccaaatgagcttatcattaatctagcacatttaaatatttttggataaataatgttccattggcccacagtaactattccagcctcatgtcttcactcatagccattccctatttcgaaaattatttattgttttgttgtggtggtggtttatgcaattcccaaaagcaaagctgcagcatcttactgctgataatattttgaaacaacttccttctttgaattaaaaatggtacccacctaggctgggcgcagtggctcatgcctgtaatcccagcacttcgggaggctgaggcaggcagatcacaaggtgaggaaatcaagaccatcctggctaacaaggtgaaaccccgtctttactaaaaatacaaaaaaattagccagccgtggtggcacgtgcctgtagtcccagctactcgagaggctgaggcagaagaattg[136 bp omitted]atggcatggaatagtacattggacttcaagttcagtggccagggtccacacaggaagcctggtcgtcttgctacctggatggccaagtgcaagtcacttaactttttataatctaagcatccttattcataggaagggggcttggttatcatgaatattaaataacgtgtatgatgtgactggaaaagaaccagacgtagggatatgccaaagaatgtttgtttgctagtttcttagactcagaaaaatagaagcacgtgtacttgaatctatgttgtatggtagttttgctttcacaatcatcaaacaggagtctaagcccaccctggtcctctggctttctactaaggcacaggcagcaccagcttttccataacaacaacctcaaacccaaactgactaattatctactgtgtgccatgcactgtgctagtgttttgcgtgattatctcgtttgattccttaccttaactctaacaagggatcctattttttacatgtcttttattattattgttgttgttattttgagtaggactctcactgtgttggccaggctggagggcagtggtgcaatcatagagctcactgcagcctcaagcttgtgggctcaaggaattctcctgcctcagcctcctaagtagctggggctacaggtctgcaccaacatgcgcagttaattttttaattttgtgtgtgtgtgtgtgtgtgtagatgggttcttactgtgttgcccagactggtctcaagctcctgaactcaagtgatccttccactttggcctcccaaagtgtgggattatgggcgtgagccaccgcgccactgtgcccggcttaatatgtcttttatttttaaaaaatgctggtaaaatacacgtaacataaaatgtgtcatcggtgatatttaatgcaaccgccatcactgtccagtttcagaacatttttattacttcaaaaggaaccccatatccattaagctgtccctctccattctgtcctctccttagcctctggcaattgctacagaacaaagacatggagaggttaagtggcctgctttagacccacattactgagtggcaaaactagtatttgaggctgggaagtctgctaccctagtgcagaacacttaactgttaaggtaattagctccccattagaaagacctttcccccaccatccagttcacaggaggcaggggcttgtttctagctaacacaaaagatgattttctctgaggcctcattacgggatgccaagcattcccaccagtgggcagcctgtggcacctagaaggtccgctccttccacttgctttccttacacccagcccagtgggaaggagggtgtcacttcagcagtgggggcagatgggtcttcagatcccacaggatgcccccacactgtgctggtcatccaactcattgtcaggtcagcaggggtgcctgctggcacccagagcttttgcctggggcggaaatgtggctgtctgacttttcttagttttcatccttgtcttaaaggtaggatgagtctcccaaggtgggatagaatgctgggagagaagtgaactttgggattttggtaaaattctctgcacaaataactcccagagagaagggtaatctgctaccccactcatctttactctttgaaaaatttaggatcccaatcccagaagagaagctttttgtgaattctcctaatgcaatcgttgtgcttactgaggctgcttggagagactgtcactcaggttgcattgcaccttaaagacataggatttcttgtcttaacaacaggtatgcacaaacattttttttataaaggaccagagagtaacacttttaagctttgtgggccatctggtctctgtcacaactactcagctctgccattttagtgtgaaagcagtcacagacaatacataaacacatgggggtaactgtgttctaataaaactttatttaccaaaacagatggttggctgaatctggcctatgggccatagtttgagagccctgtcctagactccagctgatggccttttctgtgatgtgtggaatctcccccaagcattctgttgattcctggaactatggctcctttgctctctctgctgcttcccagcttgtgaatttgcattcatggtcatctctgttttcaggccatcataacacagaatcaacagccttatggtgttgccccagaggattcaatgtgtcaagtggcattttcgaactgtgtagaagacttctctgcagcttctgtggagggaaacagggaaggaggtttatatcttgtagcccccagcaaatgccacgcaaaattcccgcataatcttgttttcccaggattctttctcagcagccttggaagtgggatagttggggttggtgtgcccattgaattcccccaaccaagtactcaaacttgctgatcctcccttctttccttctgggacttcttaggaggaagtctataaaatctcttgtctttaatatgcaaaaaggttttcttgcctcttctagtaaaaacacatagtgggcagagacggtgagtaagggtccagttctaattcaaaccctaagctcttagtttgcattctccacaataaaggcagtagtctctctaaaggaaattctcactgatactttttctcctccccacgtcatcatagagacatggcatggcctttgttctaaggaacttcaagtctaataggggataatgaatgttccatgtagagcagatacaaaacagtggactgagtccataatgctgtgttggagtacagacaaatgcgcggtgaaatcttgctgaaagactgcatggaggaggaggcatctgaattgagtcttaaggggttcatgtcacacaggtgaagcacactgacttcacgtgtttgaagagttgtctgggagataggttaccaatttagtttctacagtatcagagatagaaaaattcatccatcccttctaccatccttctgtccatccatctgttcatccacccatccacccaaccacccatccatctaattatccagtcatctaactatccatccagccagccagccagacagctagccagccagcctttctaaaaatacttatttaacacctgtgtgtgccatggagtaagccaaatgacagggagagaaaggtaaatgaggccatctccaaaggagttcagagaaaggtggtagataggtatgttagacaattcatttataagctgaatagttaagtgcaattttgagtatttgtgagaacgatgagagggaacagttaatactattggaaactgctcttggaggagtcaagcctgaatgatcagaaagacactaaaagatgtaaagcaggtaaaaaggaagaaagatcagggctgattttggagagcacggagtaaagtttcataaaccaggtaagagcttaggagatgacagacatgtggtggtataagagatgaaggaggggcggggcgcggtggctcacggctataatccccgcattttgggacgccaaggcaggcagatcacgacttcagaagatcgagaccatcctggctaacacggtgaaaccccgtctctactaaaaatacaaaaaaattagctgggcacagtggcgggcgccagtagtcccagctactctgaaggctgaggcaggagaatggcatcaacccgggaggcggagcttgcagtgagccgagatagcaccactgcactccagcccgggcgacagagcaagactctgtctcgttaaaataaataaataaataaaaataaaaataaaaaaaatcatcaggagatgaggagatggactgggaaataagacagaggcccaaacactaagaccaccatgacctactggactgcatcctttagaagccctaaggggatcctaaagtttagaattctaaataaacattttattttagaatacttttacatttacagaaaagttgtaaagacagtccagagagttcccatctacccagcgtctagtttgccctcttgttaacattttttttttttttctttcctgagattgagcctcgctggatcagccaggctggagtgcagtggtgtgatctctgctcactgcaacctctgcctcccagactcaagtgattctctagcctcagcctcctgggtagatgggattacagacatgcaccaccacactgggctaatttttgtatttttagtagagatggggtttcaccgtgttggtgaggccggtcttgaactgttgaccttcagtgatccgcctgccttggcctcccaaagtgctgtcttgttcacattttgcatttatcatattttacatatggtacgtttatcacaactaatgaaccaatattgatacattattgttaactaatgtctacattttattcagatttccttagtttttacctcgttcttttctgttccaggatgtcacattacaattaattgccatgtcttcttctccccttctggtctgtgactgtttcttagactctgcttgtatttaacgaccttgtcttttttggagtactaagcaggtgttttgtagtgtgtccctccactgaggagtttgtctgatggtgagactggagttatgggttacggagaggaagaccacagagacagcgtgccatttgtatcacaccatgtcagtggtacatattatgaaaatgacttatcgctgttgatgttcaccttggtcatctggctgaggcagtgcctgtctcatttttcctctctttgcatactgtgctctttggaaggaaatcactatgagcagttgacacttacgggtgaggtgtttgttaggcttcacctccttgaagcagcagcatctacatccatgaggcttttcagcaggacctgggtaaaggaccatcaggtggaaaatgcaagatgaactattgcaagccacattgaaggagaatttggctcactaccaggaacattgcctgcccccgaagctatttagctgtaggttttggccttcaggtgggcttagttgcagggctaaataattttctttaaagagcttcatcatccaggcaaacatcacagccacagtgccagatcctgtgtcaaagaaattaaaggctcattcctccatgcactaagttgtgtcataactgtaggagttggcctgctggggtatgtgtgtgtgtgttttcccatggaaatgaccaaagcaggcagcacttgttgaagtacgtcaacattactgcagcacgtcattccttttatgacatagcgacctcttttcttttctctgcgctgtgatcttcagttaatttttagggagggtggggcatgaaagctccctgaacatcgtgagaatttctttccacagatgcaaacaactctgttatggagagtgtaactcaagatagcctttttggaggacagattggaagtacatttccagttctcacattcctctcttttgaccgaggaatttatattttttcagtagaagtcattctattcttattgtttttgtttttatttttctatttgacaatgaatcgtgagcatctttcctatgggtggatgtttatgttatttccggttggttttcccatcctctttcattgtatgccaaattactgtggtaggcaaacttggacaaacgtgtttgaacacatatagtgcgtgtcatatattttgtaataactggaatttcctgttcaaaggttggggatgtgtgaaatttggacagtgtccatcagatcactgtcaaacacaggtggagacatgtgtcttcacaacccagtgcaacagcatggcgttatgcctcatccatccaacaactctagggggcaggcataagtagtcccattttaaagatgcataaactgaggctccatgaggttaaaggattggcgctgggttaactctttctttgctatcaggcatttgcggaggatcactcaggaacctttgaggatgagatgtcctgagctccagctcctggtgtctgacctcccatctcagtgaaatagctagaaaattatttggtctccttgctgagattttcttaacatattttaaaatctcagcctggtgcagtggctcatacctgcaatcccagcactttgggagaccaaggcaggcggatcatcctaagttaggagtttgagaccagcctggcaaatatggcgaagccccatcactactaaaaatacaaaaaaataaataaataaataaaaatagctggtcatggtgatacgcgcctgtaatccgagctactcaggaagctgaggtaggagaatctcttaaacccaggaggtggagattgcagtaagccaagatcacaccactgcactccagcctgggtgacagagcgagactctgtctcaaaaaatctcctgacaccagaaagccacagagcagaagcatcacagggctctctgatttgccataggatcgtttaatctgttttatgatactgtgctagtagaattttccaagttcacaatcacaaacaaacatactatcctcaactgtgctagaattaaattatctttgccccccccccctttctgttatattaaattagtatccttcttctccaaacaggcagctcccactttgagggtgggggaggagtacttgtccatcaaacatggggaaaatgactcctacttccatcgcacagtgaatcataggctctcccatgtcagattctgtggaaaggatgttaatagagacaaaaggacactgttggcgcgttattaatgttaaaaattgttgacgttccatgcagtgtgtttttctaattagagccaagctgcagagtaccatttccataatcaacatgggaacggaaactcagcaaaatttcatgtatttgcaatgaaactgctccccggcaacataaaaatggcttttataacataaaggctgtaattagaataagtcaaatcagttggaaacgattaaggccggagtaggcaaagctgccttctaaatatttgtctggagattagcctactcctgcagctctgagaagcatctttgatttacttatactgctcgacgtggcaaagataatcttgtggaaggcaaacgaatacagatttagatgtgctggtcggccccttctgcaacttgacaggaggcagtccattggaagcaaagtcagaaaaaaaaaatgaatatagggtcatattagacaaattgcttaaaaaaaaaaaaagcacaccgcgatcatcaatttaaattcttttaaaatgtgctaggtctttgaagcttttaggatgcactttagaagtccacgtggaataatccctgcatgtcagtgcgacagttgatgtgcgtctcattgtatttaaaattatagttctgagatgggacttgctccgcgatgcttgtctgacatcagctattaaaatacaagtaaatcttggcaggtgggaatttaaaaaagaaaagattatataagaaaaatcagaatggttaatgttaatttactaaccagggtacagtggctacagagagttcttcatgtcctctctctattaagatgctgatgcgagaaacaccttatgtttgccagggatggggatggagattgtaaagtggatgtgagggggtaaagagtgctactttggatgtcagtccatggtttgggtcctctggggccacggtgagcatgatggtgagacaggttcattttattaaattcagattagccgttttgccctgtcctgggagggcagaagaaggtaatcaaggagagatggcgggacaataactgctctggggatcagactggaacatccacggactccagccttcctttagaagggcgtaattcgtcctcacagactcctcactcatttgtaaacctctctgaatcccaaacttgtgtgcgtgtctgcatttagccattgaaaatataatcaggctaatgcattctcttactgaattttaaaccagcccattaaaactcctttaacgtgctaaagtcggcttcagagagggtttccatttcatctttattgagctgaggctatggttcattctccctttgcaccacagtgagcgcctgtcaataattcaatagcgtagccttgatgggcccaggcccaacctagactttcaaccacgccaagcagcttgtcaaagcctgatgctctgtcaatggctgagtgatctatactgcatgaatcccccccttcagctcttgatgtgtccctgggaataaaaagaaagccatttcagaagtcagcccagtgagaagcacctgtatgtagagaatctttaatgagggcaggtcgcgctgtggtggagcagagttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttcaccattgcaggaggccttgaactcagaaaatccagtgcaaggagcaaaacatctgaatcatatgatcatgccccagtggctcttcttcaggtgccagtgacggtgatttgaaccttcatgtccctcttttcatggaacgtcatgagtctgtactggctaaagagtgctgtgaaaggcagattaaaaaaaaaaaaaaatccagcctcacctttctttctgggtggaggaaaaggcatccattcactttaagaagaaaacaaatcatttgtattcttcttgtctggacacaatttttaacccagaattatccacctagttcctcccatctccaggccttgtaagtcgataggagatttgcaaatatctcccttaaagaaaggcaacgaggagagcatttaatccatgctttaaatgcaaaatgtcttgagtcccaacgctgctcagtttttcctgaagataaattttagctggattaaataactgttttaaaggcactattcatgcaagtgctgtctcatttgtgactgtatctgcattgctaatggatgtgtcttttcctcatgcatattctttcctgagcatctaccgccaaatttacagattgcttgcttgtcaaattgggatggggtttgaggaagaggtgacaatgatctaggtggaaaagagaagtgccagtgtgttcaaagctaatagaaaattgttgctttgtattagcagtcaaggctccaggtttcctgaaccacaaaacaaccaaatcttttctttcttttttttttttttttttttgagacagggtctcattctgtcactcaggctgcagtgcagtggtgagatcacagctcacagcagcctccatctcccgggttcaggtgatcctcccacctcagcccctcaagttgctggggttttgccgtgtcgcctaggctggtctcgaactcctgggctcaagagacctgcctgcctcagcctcccaaactgctaggattacagatgtgagacactgtgtctggccccaaatgttttatggtaacataaattcatgccactgtggcctgctggtcttcccaattaaacagcagagagtttgttatcccagccacagcatattagggtggagccaggtaggtatgtgaactaacactgtgaaaaaacaagattgtttttaaggtaagctttcgaggagggggaaaggaggtagaaaatgaatatggtgatttcagagaagaaaatctctcccaagcctatgtccctttgtatgtccacaaccccagttaatgatgggtatggcttatgaaggcactgagagcccaaggaatgtggccagcattaggcggcatttgagctgggtcagtgaatcctcaggcgtataggcaattaggacttagagatcctgttgtgattttcatacttttaatctggagagttgcttaatgaatttattaattcatttatttttagcctcacaggttttgctccaagactcaggtgaatgagtaacacagtactgataaagttgagcttttctgtttagggctggggaggagggaagaaggaaaggaaatgaaacccagggctttgcatcttcctcttcaacttcatcccttcctctctattcctcacatttagcagccctcaagggggctacaaggaatttttcagggtccagcgtggcctaatatgccaacttctgatatagtacagctcaattagcctggcatggttgtgcacaaatgtagtcctagctgctttggaggcagaggtgagaggatcagttaagcccgcccagagtttgacgttgcgctgagctaggatcatgccactgtgcttcagcatgggtgacagaggacccatttcttaaaaaccaaagaaaaaaaaaagacagctgttattttcctaagatatcctctttaaagagaaatggaacaagtgacctgccttcctctatatgaggtggggctcacaccagggttctcctgctcaccattggcccaggaaactcaggaaattaatgctgcatgcgcatgacttggcgattcgacctctgaaagctctgcaaggctaggaatttatgctttaagaacaatcagcatcaaaggccttggcagtggtggagctgttagcatattagttccatttgagatggtgaaatgccttggaaactaaaaaccctacctaataaagtttattttcaaaggattagaggtagagttttgctctgagagatgatgttgcctaagcctcccattacagaagagcagagatgggactctagggattcatggatgtgccagcgtcactgggtagtggtaaaaactaaaactggtatctgtttctctcctactataatatctttttcacgtcagggcttgtaaacctgaaatctacactttagtttcacccatatgatttgtttttgcttttttcccccctgttattagctgccaacatttagatatgtaaagattacatttaaaatcgaaatttttggcttcttgcaaaaaaatcagacgatctggcatattgagcaacatccgcacacttcacccaccagctggagctctgtagcacctgcacacctcagtgtggagatgagctttccactcccaggtcaacacagaccctcttactcaggactcaccttcgcccagcctgcttcacgatccactggctgtcacaggcatttgcctccgtagtgctctcctcccacccttccacaaataaacgtgcccagagatgctggcagcctggaagctttgcatctgcattggggctgcccgttctttgctgccatgcctgaagatttcagtagctctttgtcagcacaaatgagcttttcccctagttcatggggagaatgggatcctggcacatagcagaaaacatctggtaatgaatccattaggcaggctgttgctcagcctccaggtgcccaggggtctgagtgctgggctgaacatgatgcatgaacgggaccccagagattttaccttttggccttcgttctgccagagctccggcttggtcctaaggggtctcctgactactccaatgccaggtgttctccccagccatccccaagcgagaagctggccagccttctggattccctcctctgccttctccagcagcagtccgtctcccagcacagccttccttaggcacacaaaggagaagacagagatcatttttggcagacgtaaggagcagcatttgtcgaactctgggccctgcaactctgtgaacagacctgcatgctgtacaaaattattagaagccctgtgtctcagggctcaaggaggttgggcagggaggtgagagtgaataaaaatgaggaggccgcaaactgcttttgcccaagggctggttttaatgagcttgtccctaatgagttgtccctgcaactagcttcaggcctaaacagatgaggcagggattctgctaaatttttgataggatttgcactggttttatgagaaagcaagcagtagagagtgcaaagttgggtcatgaatcttttacgagggtggatggttgtccgtcttgtcaaccggaacgagaaagacctggttgctaatagaaaccatggcctcagacgtcgatcgtcacccaccagatcagctaatttggtcagggtggctgggtgatttgttttttttctgattcaggacctggcctatggcccctgagaaggatttatctgaaaactccatcaaggagatgatttgagccattgcctgttcctgactaatgatcttttgtggaactcaagccatattggggatttatacctttctcccatagtgcactgggaaggaaacaccatcaaacactttaattaacatcctttttactttgggcagccccattcgtatcaaaaccacaaaccttacccttcagttgcacgagaacactcttaccaaggataaaatgtgattttcgattcctatggagatgtttctaatgtttctaacacccgtcaattctaggatcgcgtggtacaggagatttcatgtactaccaccttttttttaaatattaaaagctgccaacaaatgcatttctccagtttgattcatataccaaaaggcaattttcttggtggcttagaaggttacagaaaatgcttgatcagcagcctttactgtgctgagtgaattcctaccccatccccctcctgtctcacacactctctttcacattaatcatgtaattgatttaataagctctggcttcaagagctccccctcccctctttctttgccccctccccctctcttataagatttcagttcagcgtttgactggtaggctaagaaccttgaatcctgccagatatgaacccaacaaccttgttggtgtaataagtatcctcatcttatatttctgtggctccttgaaacataatttttaagccatttcattaatagagttcaatgtaataatgtaaaaaagtgcagcgtatttctatatatgtctgtagatgtagacttctgtatatatctacttttcacaaacttgaaatcatttcacatgtgttgtcttattcaaacctctctaaaccgaaaactttgagagttgcccagaagagatccgttgctcctattttatacattacaaaaccgaagtacagacagatgaactattttaagaccttgaggctaattagggatgcacgtggcgtgaaaattttgggcgtctgaacttcctacaatagggcactactgattctgtattcctttgttgcctgaggcattcctttctctgggagaaaccaaagctgtacatatttatcttcaagagaaacttccactttgcctatgaagaaatagttagaattgttttctgtggttgcctcaagttagaggtgctaatatacatggaagttaaacaagaccacacatgtgcaaaactcttgatgaatcacgttattatactaaaccaacgttatactaaaccaacattagctagggttattagttcagattatagttatgcaggtcttccgtgttaagtctcatgtaaatatcttctggagcttacatgtgtagttatctatgttctaacctgtttcctaatgggtcatccagaaaacgtgggtgtggtctggctggaacagagtccctaggattgtgtcagagtcattgtcgtaagatatacctattcagaagttagttatctagatgttagagtctagagatggggcttcaatgagggatgtcaatggcagtatggggaaaagagaacagagttgaagactgaacagcctagggggagagcagaaagcaaaggcagctttataaataataaagatgttctgcaaaaattcctctgactgggttctgattggcttgggtagcctttttttttgagacagggttttgctgtgtctcccaagctagactgcagtggcatgatcctagctcactgcagcctcaacctcccaggctcaagtgatccttctacctttgtctcccaagtagctgtaccataggtgcacaccaccacacctggctaatttttacattatttgtagaggtgagggctccctacgttgcccaggctggtcctgaacccctgggctcaagtgatcctcccacctcagccttccaaagtgttggggttacaggcataagccaccgtgccccactgacattttactcttaatcctggcctgtatttaaagggtctgggtgaatgcagatagatagacagttactacgcgtaacagcttaccatgaattctaagtctcaacaaatccgtaatcatggtgtgtcatatgaagaacatgttctaactcttattgctgagcctgactttgaagtgtttgtttttttttttcttctttttttcttttgggaataagaaaaagcaacgttcttgactgcccggaaaaatactgtcttgtcagctggggatgcttggtgctgatgaggaatgtggtacagggtggggatagtcccttttaaagggctcagcatgtgcctgggcagttagcaaggattaaacaaaggaaagttggtaatattactgctagtatgagtatgagtaaaatgaacagtggaaagaaattaataataggaaattagtgatactatgtgtttaatatgcatagagcctctgtaatcttagcttctgaacaatagcactccccgctactcctctcttaatctggaggcccatgggtctccagtacccttatgcaccagctccatttgaggaaatgaaagtaggaatcacaatatttgccctggatctgcataactaggacaagcttttgaaagtggaagaggcccataaatgaacttctcaaaatgcacttgatacagcatcaaataggagtgacaggtccataaatcaagggattggggtcatttgattcaaatgtaaattgtcccctgcccagaaaactcattgccatgaaaccctgcacagaatccagagaacattttcttctggtctcttagaaattcaaaatacaagatctacatggtaccacagtttttgttgctgttactgttgttgttgtgtggtttttgttgttgttgtttttgttttgtcttttcacgcgggtgacgtttggagatgcccaaagactgatatcccaaaagtacctaatctacaacaacaaatatttatagaacctttatctcaatatttgctcattgaagtgggttaataaatgtctgttgaatgctctcaattggatggtgagtattttccattttagtttagctgtgaagcttcgctttccctcctatgccttttgttttcttgcctaaagaagcccatttcaagagtcggggatcttctctttctaatctcagcctgcccaacaatttgtagcatggtcttgctacagccgctttgctcccctgctactccatcttgtctgagatctgggttaactgggacttaactccttgtcaaagatgctgtgtgaaatgactaattaacaccagagaaggaaagagcattgtcattgacaaatagggcttttaataaccagcagttctcctggttattaaagttggctcttgagtctccccagacccatgcgaattgacaggaaggaggatattttagttccttctatgattgagttgcttgtcacttgagtttgtaatctcaggagtcactttatccatgttgtcccaggaatgaaaatggtgtgaatctaatttcagaagttgaggagaagtagaacaaggaggccatgattttctagtataactagacaattattttcagcaagttctccctcactgttgtggggtgagtgctcacatttgcctgccgctgagctatgttttaatgaggttggaagaagcaagaaggttgggaagattgatgttaattgcatttctaccatacactaagcagtgagcagatttaggatgactagtgtcctatagttctctttcaagatcagatcaagcttcctgaaccacatgagcctgtcttctctttacaccagcagcctcagtaactccctgttgggcaaccccatagagcaaacaccagaaaccccagaatttttctcttactaaagaagaccctccactgtcaacttaagctcacgttttcctatttctcaagccaaggtaggtctaggtattttttttttttttttttttttttttttttttgagacagtgtctcactctgtcacccaggctgcagtgcaggagtgtgatctcggctcactgcaaactccacctcctgggttcacagcattctcctgtctcagcctcccaagtagctgggactacaggtgcccgccaccacacctggctaatattttgtatttttagtagagaatgggtttcaccatgttagccaggatggtcttgatctcatgaccttgtgatctacccgccttagcctcccaaagtgctgggattacaggcgtgagccactgtcctcggcctcaaggtaggtctgggttttatgagatgtgacacttacagaatttgggagccctccgtaagaaaaacattcacactttgggaggccaaggctggcagattaattgaggtcaggagttcgagaccagcctggccaacatggggaaacccccatctctactaaaaatacaaaaattagccagctgtggtggcacacacctgttatcctagctacttgggaggctgaggcagaagaattgcttgagcctgggagacggaggttgcagtgagctgagatcatgccactgcactccaggctggccaaccgagtgagtctatctcaaaaaaaaaaaaaaaaaaaagagagattccaatgagattcaaaattactagtgcagagttgcagagttaggggtagcataaaaacacattgcctgaagtgatggtctctgaagcctaagcccagtcaccttctcattatccatttctgttcccagttgaaactttgcagtaataaagctgattttataaagtggtcaagagctgtatcccaaacttttccttgcatcttcagctcttcctgtctatgaacctctgcctctgttggcctagtctctcactatcctcttcttttattaagcaattaagtattgattaaaagccaagtctagtgagagctaaatgcatttgttgaaggttataggtcttgttatgggaaagcaggagtggaatgtagttgaattaacctagcctagaacagatttttctgtgtgttctatgaattagctgtatcagcatcaaccccctggaggggaggggccaacaggcatctgcgttaaatatgtacattcctaggtcccttccaaagtactgaatcaggatctctggggttgggatgtagggatttccactctttagaaacacccaccctcctttcttctgaagcatgtgaaagttgtaaaacaactgactaatctaagggccactgaaagctactcttaagatgcagcatttacttgagactcaaaggatgaatggcagctgccaagtgtattaatttcctaccccttccatagcaaattactgcaaacagagcggcttaaaataacagaaacttattctcttagttctggaagttggaagtcgtaaatcaaggtgtaggcaaggtggattccttctgagaactctaaggaaggatgtattagttgattctgatgctgctaataaagacatacctgaaactggaaaatttacaaagaaaaagaggttcagtggcctcacagttccacattgctggggagacctcacaatcatggtggaaggcaaaggaggtgcaaagacacgttttacatggcggcaggcaagagagtgtatgcagggcagcttcccttaataaaaccatcagctctcataagactaactgactatggtgagaacagcatggggaagacccacctctatgattcagttacctccaaccgggtccctcccatgacacatgggaattatgggagctacaatttaagacgagatttggctgggggcacagcataactgtagcaaaggatttgttctttgtttctctcctggctcctggtggctccccagcaatcctgggtgatccttagcttgtggctgcattactccaatctctgcctgcattgtcacacatacattttccttctatgtttgtctgtcttcacctaatcttcttgtaagggcaccagccattggatttagggcccactttaatccggtataatctcatcttaactaaatacatctgcaacaaataaggtcatattccagtgttcttggtagacatttttctttcccctgtttttttttttttttttttgagatggagttttgctcttgttgcccaggctggagtgcaatggcgcgatatcggctcaccacaacctccacctcccgggttcaaacgatttttctgcgtcagtctccggagtagctgggattacaggcatgcaccagcatgcccggctaactttgtatttttagtagagacggggtttctccatgttggtcaggctggtctcgaactcccgacttcaggtgatccacctgccctagcctcccaaagtgctgggattacaggcgtgagccaccatgcccagcctgacatttttcaaataaggtcatattctaaagttctaggtggacatttttaaaataatgtctcattacaaagtcctaggtggacatcttttttggcagggggacactcttcaacccaccatgccaagtgaaagtagtcagtgggggagaatggcagtgaaaatagatggatgaattcagaatgaatagaaaacttgaagaggtttggcaggagtgagccctgcttagttatcatccaggtttcactaacgcgccccttgccaacatgcagtagctctgagtcatgatctatcatattgccctgttttgtaattttgcattgtttgtttacttgtttaggaccatctctttaacctcgttagacttgaaatctctactcaattcaagcctgcacatccccagtgcctgaaaccatggctgttacatagtaggtcttggtgataatttgtcagttggataattttagctggagaaaaagaaacatgtatgtgtgtgtgtgtgtggggggggggggttgttttgttttgtttttgtttttgtttttttcacccatcctgcagaaaacactgcttctgtgacataaagagaacaccttcacagggtaaagtgttcttcccatgaggtctaagaggagtctcaaatgcgaggggcttgaagacatttgtgaagggacactatgaaacatatgagagcagtgagaagtggagagttgtctctctgactgcagtagaaggatggcgaaacatcagggagggagaagggcactccgggccagtattcaggaggagagccttgtggcagcttttctgggtgtggatttcagagcctgtcatcatagaaagaaaagaaggaactcaatctaaagtataaataaaaggagagacttggccgaatgcggtggctcatgcctgtaattccagcacttcgggagatggaggtgggtggatcacaaggtcaggggatcgagatcatcctggccaatgtggtgaaaccccatctgtaataaaaatacaaaaattagctgggcatggtgacatacgcctgtaatcccagctacttgggaggctgaggcaggagaattgcctgaaccagggagtcggaggttgcagtgagccgcaatcgcgccattgcactccagcctggcgacagagcaagactctgtctcaaaaaaaaaaaaaaaaaaaaaaggagaaacttacagaaagcaagttcaaaaaggagggactgtggatgataaattctataccactgtgaatgttaactcgtaaggatttgaagataacggcccccgactcccacttaggttacagatgaagatactatggcccagggatgctgcgtgagtgtcttaaggaggaaaagagcgttaatgtgacatctgggattccaggctcctttccagacctctcccctttttcacttttccgcctgatttaaagtgaaaagaagggtgttggcatctattaatcacctactgggcgccaggcatggatgctaatggttaggtcttcaggttgctgagtgggtgttgaggaggaggaaccagtgaccccagtagacattgaagaggctcaatgacagcaggaggattcaggggtctggtggggtggatggcatgcgacgggcccagcatcagcagtgagagggtaggagaatggtgagtttcagggcatgcatccacagcgtaggttggtaactaaaaggccagcccaggaagaggcctctgcacatgaaacatagaagtggctgcctccttcaatcactgttctgattagataagacctgggcttcgcttctgagtggtaaactcagaggcagctgggagtccctgagtgacaaggaggagactggcatgccaggtagggcaggctgagggttaaggctctggagggagaagaatcgtactcagaaaacatccagctttctgggggatgaggttgtgcagtctgggtgagggacatcggatttctatggaggctttttggatgggacctgatataatcatataatattgaattcagttctatgagcttttgctatgtacttattctgtgcaaattctgcaagggatgtcttgaacggatggttctttcttgcattgaatgcaaatagtaatttattttgattgagatagttttggaaatttcggagcagtgaaatccaagtatttcaacctggcaggttgaggcaataggtaagttaacttgggcgggctcacttttctatacattttgtgctcgggaccgtaatgcaagcccactgcaaatggcaacttcatgtatcaacttataagcagtggtggaggagatctcaaccctacactcattgctccctctggctcttagagactggcttctaaattcctggtgagttgcaaatattcttagattggactatgctaacattttgaaattaaacctacctgtctttaaatgagttgttggctgcccctccccccgccccgtattctctttgtgaagtagaggcttccagcacttttctgaaggagaaaacatttatttctcattttgtagaggcaagaccaaatttgtgtcagcttcagctgagaccactggccagccctccttctcacctcccagttccctaatctaatttatctcagtggggtttgtgggggttcatttaagcagcagaagctctgctataattgttgcatgtgccagcaacgatttgtaccatctgggtatggaatgaggtggggtaaggtggtttggaaagagaaaggaacagagagagacaaagagactagtacgaccaaagagaaagattcttattccatgaccaaagcaatatcattcaaaaatggctacaaagcaattggatactaaggaatgagaagcaatgtagttagagtaaaatgtcaaagtataatgaaacagaggaacatcactactttatgatccagccaagttacaggcaggtggcagctgtaaatacgcatataaataacaatatggatgaaatgtcagacctttcagctggcttggttaaagcactttagtaatagtctatttagggtaacaatgtagcttgacaatttccatgaaaaatacatcattggagaatgagtcagcccgcgttagcgtgtaggtgatgtgcattgtgctaagagcttagaacaacacacggtgcctggtgcatcccccacctgcctagaatggccagttgcttcatattccatgaggttacgttggttttctggcattgggttgcaaatgcttgtctttcccattacagaaagtaccttttctctcttatcagtaacacaggaaaataaataaatgatcaatgcctcagatccggggtcttacctgtggaaaggtgtggattgatatctttatttattcatgcatgaaatgtatcaggcacttgctgtggtgccaaggatctaaaaaagtgaacaaaaagatgtataggctcagacttcatgaattttaggctacactgcttaaaacctttaatgattccctattcttaggataaagtcataactcctgatcatggctgccaagaccatgtagattacttagagtctggtgaaagaagaaataactgaataaaatggtcacaaaaggtaaatgtaaaattgcagtagtgaggccaggcacagtggctcatgcccagaatcccagcattttgggaggtcgtggtgggtggatcacttgaggccaggagttagagaacagcctggccaacatggtgaaaaaccatctccactaaaaatacaaaaattagcagggcatggtggtgcatgcctgtaattgcagctactaggggggctgaggcaggagaatctcttgaacccgggaggtggaggttgcagtgagctgagatcgcaccactgcactccaggctggatgacagagagaggctttgtctcaaaaaaaaaaaaaaaaaaaattgcaatcatgatacatgctacattgtttggtagccaggatggcttcctgaaggaacaggtgctagacttgtgatcgaaggggtaggaggttaaacagagaggtatgagagtagcattccaggctgtgggattggcatgtatgaagatcctgtggtaggaaggacattagtgagtatgaggaatggaagagatcattgtcctcatagttgagctagggaggtggagagtggcccaagtcaggtggggataagtaggcaggagcctacatggtcttgccggccatgatcgggagttatgactttatcctaagaatagggattcattaaaggttttaagcattgtagccttaaaaggacgagcaggggctggtcctttagaaggcattgtgttcatagtgtatgacagtaagccaggagctctgagaaaacaaatggcactttgatgagcaggcactgtatatagtttcatacacatgttaaagcgtgtatagaggatgtgtaaaacatccacttcatgccaagcactggtcaaggtactgagggtgcctgagtgtaagacagcatccttgcctctgagcaatgcacagactaaggagatggaagtcatagaaaccactgactgaagtgttgggcaccctgatgagattatgaagcacggaggagcaccttcagccttaagatggcattcctagagttcatgtcctctaaacagagtcttcaccaaaggctagaagttgtcctcgcaaagaaggagtggaggaagtgttggtcttctggtagggggattaagaaagccatagccagctgggcacaatggctcatgcctgaaatctcagcagtttgggaggccaagacgggtggattgcctgaggtcaggagttccagaccagcctcaccaacatggtgaaaccccgtctctactaaaaatacaaaaattagctgagtgtggtggcccatgcctgtaatcccagctactcaggaggctaaggcaggagaatcgcttgaactcaggaggctgaggtcccagtgagccgaaatcatgccacggcactccagcctgggcaggagggcgagactccgtcccccaccaacccccccaaaaaaagtcatagccaatgtcttcccaggaagtcaaggaagcaaggaagatgcccaggatcggtagacagaatgctggtgaagtagatgggggtgggccctcttgaccagtgtcttgccagattttcttaaaactgtaccatatcaaaggcagattgtctcccaagttatcaagtcaaactcgtgttctagccctgcagctcaccctgttttccatcatatgtgtgttataggctattatagatatgatcaagttgagtttataaggtccagaattcccatgcatgtgagaaagtgtaaactgaagccacctgttgggttatgtcccctaccttggtgcatgaaggaaaactacacaaagatgtgtggtatcaactcatggagacaagactctatctacaggatagcaaacatttggatagaacttgagaaggaatatggtggaggaatgagtttttatctaagccaagatccaaccatctctcgatgtatacattttctaccatgaacatgtgcaattgcccatctgtgttttctttcccttttgagattcctcttgaccttctgggtcctggggaagtcctcaggacaaggatggacctaggcgagttacatcaggtaccacagtgttaaagagtgattatcacagtttgctcctcacactttatatttggccagccctgggccaaccccttttcccagccctgggccatacccttttccaataataaagcccattttttatgattttgctcatgggttcatttattgatttgttcaaacacaatagggcactacctatgtgtcaggtaccatgctaggcacaacggattcgatagcaaaccagaccattgtattttctgccatcttgaagcctcagattgcatctggaatgaatattattagaagcagctagattttgattggaaattctctcttctgaatcctttagcctaccaaatgctttggttctagctaaataagtggtggttttatttcctttgtaatacctgaatatgtattccttggatacatcaccctccctatattgagaagtttcacgtttcagcagcctcattctttctcatccttgtggaatgcatgtgcatgtatgtctctgtgcacatgcatgataggtttctatccagccttactctccatgcaagaatataacagctcccagagttgtttgcaagaaaatattaaatatttacatagatatggacattttgtggggataatataagaaatcttattcacacttggccgggcaccgtggctcatgcctgtaatcctagcacattgagaggccgaggagggcagatttctttagttcaagagttcgagaccagcctaggcaacgtggtgaaatcccatctctactgaaatacaaaaaaaaaaattagccaggcgtggttgtagtcccagctactcaggaggctgaggtgggagaattgcttgacctcaggaggtagaggttgcaatgagccgagattgtgccattgcactccagcctgggaacagaatgagactccatctcaaaaaaaaaaaaaaaagaaaaaaaagaaaaaaaaaactgattcacatttcaatcaatgatagtcactgacattgaaacttactatgagccactgtgatgtctaagattcattctctgtttttattcttacagcacccctattaggtaaatattattaatgtcccctgtttggaaatgtcaagttcaatcccttttattaagggcagggccagctttaagggcacattccctgcatggtcatgcagggccccaggctttgaagagccccgcatgtggtcttatgctatagctggaattcttaatgatttttgaacaagcgttcctacattgcccttttgcactgcccccagaaattatgtggccaatcctgattaaggggcagggcagggctctgtggagggttgatgtacccacagcatccatccctttaacagttcctccacgttaggaccctcctctcaacattgcctatcctagagggacccccccttatacaaatacagaaggtacctggttcattcttcaagctgtgtgtggattctcattgtgaagtgaatcaccttttaatgtatagtcacccaagtacatctgctatgttgatatatcacttgttttatgggccgggattaattccaaagtaaacactaagtactcagctgaaaagctgtaaacacaagacaggacgtgcctctccaactcccagcattgtttgccaaggttgcaagtccctctatgctttatcctgtttggcgtaacaaaatcttcgtgtaatttggtctcagcagtcatttcaaattgattttaagagttgcaggcaagggggtattgtggttgggagaacacaccttcacgtgcattttgcctccctttcttgcctcagcatcacccaacggtcttcctgggatgttcaccttcctgagcttgatgggtgcccgtagaatcgccacctatggctgtgctctgtgcaagcaggcctgcagtggtagcaattgcaggaggcagtctactccaagccttctattcaagccctgagccctggagcagggctgtatcagcttggaggaaagggcatattttgggtattcttccactcggaaggtgtactttttttctttttttttttgaaacggagtttcgctcttgttgcccaggctgagtgcaatggcgcgatcccggctcactgcaacctctgcctcctggatccaagcaattctgcctcagcctcccaagtagctgggattgcaggcacgcaccaccacgcccggctaattttgtatttttagtagagacggggtttctccgtgttggtcaggctggtctcgaactcctgacctcaggagatccgcctgcctcagcctcccaaagtgctaggattacaggtgtgagccaccgcgcctggccttgggtatgcatttttatcactcatacagcgggtccatgaatgcaagcagtggctccagatatccaggaggtcacacagttgactgttgtgtcatggaatagcaaacactatcttccgatctgtgtcctgggtgctgggcctcctgacattggtgacccagttctgaattccagaatgacagttttaacattagattttgttagtttgtccatcttatttttatggcattagtgttgcgtggattgaaaatcacacgtacacggacacatctatttacgtataaatatgccttgccttgcattcttctatcttctttacttaagtggtgagatgtttgggtttcttcatgcagtgactttggggaagtccctggagctctttgatgctctgttccttcttcttcaagctgtatttgattgtgaatgttccttgtgaagtgttttaaatcacaggtatcaaatcccctttgcttggtttgagggatttgcctctgttgccctcatattttcagcctaagagggccctccccattcctcccagggacatctaaaaacgtttatcttcttgtgtgcagtctggaaggttcttcttacgagcatctagcctcacaccaagcagccaaagttgtcttaaaaaaaaaatagcatctttgatatgatccacttggccacagcagcttcatcaccccctccccaatactctaatgtccagttaacgtatattctcagtccctccaacaagcatgatctttgtgccccaggacatttgcacatgctgtttcctgaaaggctacattccacagttcctaccctggtgcctgcttggttggtatattcagccttgctcagcttggacatctcctctttaaggacatacttcctgattcaccttccaaatcagaacaaagcttcctgttctttgccgtattccagtaagttgccaactcactggacattttctcatggtgtgcaccacacgtctatactgccagagccatatgcattacaaagacagggaccttgtctctctggagccctaagtgtgtccttaaggtttgcaaaggaccagcgtctaatgaccatgtgaatgcaggaattatgtgattgtgtgtctctctgccttcccctaagtctgccgtgtccctgggccagtccactttgtgcccagatgctcactttcccatgctgtcctggagcatgtgctcctcaaatctctccttgttcatgttctgagaaagaaaatagctcatgctaagctttccaagtagacagaaaatgagccatgcctctctagctgctgttttttaaaattttattttactgttgcttattttttgtcattgttaaaggaaaaaaacattgacttctctgacctacttccctagcattctttccctttcctcttggcccctttgcaagcccttgaatatcataggaatatattccccttaaggtctttttgaccactatgtcttttgtctagaatgcaatttttttcaagttcttacctagttcactccctctcctccttctcagcttagctcattaccttttcagataagacctccttgactcctccattaaaatcagaccccctcttcactcccacacaccctgtgttcctttcctagctgacttttgccatattgcttatcaccatttgacatactatgtattttatgtttcatttgtgtctgtctttctgcactagcatgtaagctccaaccgggtagatattttagcatgttttgtttgttgctatatccttgcagtgcctttcacaaagtaggtactcattgaatatttgttgaatgattaaacctatgaatggatgggtgaatggatggatgaatgatggatggatggatgaatgcaatagatggatgggtgagtggatggatggatgatgggcagatgaatggatgtaacagttgggtgggtgagtggatggatgaatgacgggtagatgtatggactgaataggtgggtgggtggatggatgggcaaaagaaagaatttggccttgggttttaacatcagtagtaatctctactttctagacattgagttttaggatggataccaacaattattatgttttgagacacactttctggagaaagtccagagatccttttaactcacttggcatgggcaattgttaccttgcacttgccattttgtacaaaagtatgtttggttccgtgccttccttccttctctggcaaattgaaaattatgatggaaataagaatttccaaaaacctgtggaggtgaaagaagacataaaaacaaagccacagattattgtacatttcctgttgccagattaaagccttgcatccactgtgtggaacaatttaaaatttcatctgttaattggaaaagttacagatattgcagccattcaccttatattgcggggggacagttctagtttaaaatattctactatgctgtgtctgtaaatcacagaaattacctagaaattgcaccattttggcatttcaaaatattgcttgcacctggaaatagcaccagaaaatctttcccagatgcagtttgatttggaaaatataataaatgtagttttgggatttaacttttattctggtccatcttcttttagatgcttacgggccaccatacatacacatttattactacttttaccctacccacttggtaaaagttttgtattttatttttttaactgacaacttgttaaagacagaaattatgttttaatagtttattggttggatacttttagcaacaagtaattgaaaatggaaataaaattagtttaaacaagagaaacaggtatgatttcacaagaatgttagcaagaattcaagggatgaggcagacttagggttagataattcagttaattcatcaattcgaaaatatcattaaggtttcaggtttttgcaatatttctcctatgctagtctgattgtatttgcttatcctcttaggctgtcattcctcctgtttctattatagctgccattgctccagacatcatgtggaaactgcaacacccagaagaagaacaaaaaatatccctgtttaattttcctttttaggaaaatctccctagccagcccacgtatctcttccacagacttctggtatttcattggccagattatatgatttgccttaatcatttagcaaaatatatatatatatatatatgtgtgtgtgtgtgtgtgtgtgtgtgtgtatatacatatgtgtgtgtatatatgtatgtgtgtatatacatatctaatatatatctaattatgtatgccttatatataatatatacatatatatatctaatatacatatatattagaggggaacaacacacagtggggtctaccagagggtggaaggtaggaggatggaaaggatcaagaaaaaataactatgggtactaggcttaatatctgagtgatgaaataatctgcacaacaaaccaccatgacacacgtttacctgtgtaacaatcctgcacatgtacccttgaacttaaaaaattttaaacaatgagatatctaaatgaatgaatgaatagataaataaataaaagctattgtgttgaagaaaaagaaattattaggttcccaaaactgcatttccagcctccctcccaaaatttctgatttgatatgtcttgggcagagtctgatattctgcaagttttacaagttccctagtgatatgaaaatggctggttcttggaccacattttgagacccatcaacatggaataatcaagattgatctccttgacattgtggagaagctcgactcccttgaaggacaaggaagccatgtagtgagtgaggtctttaggtttctgttagccagataattatcttttgtttagttagctaagaataactgatacagctgacaacttatggcaataacattatatttcacgtggttgataagaattgactgaggatgaaaaaacaaaggcaaaacaatttttttttttttgagacagtctcaccctgtccccaggctggagtgcagtggcactatctcggctcactgcaacctccacctcccaggttcaagcgattctcctgcctcagcctcccaagtagctgggattacagatatgtgccaccacacccggctaatttttgtatttttagtgaagatggggtttcaccatgttggccaggatggtgtccatctgttgacctcgtgatccgctcaccttagcctcccaaagtgctgggattacaggcatgagtcactgtgcccggccaaagtaatttttaaataaaattttatagaataattgaggatgaatgtagaatttaagtctgagttgtggttaagtgtatttcagataccctccaagaacttagaattgacattcagctctacgcagtattccaggtcatttgtgtgtctgtttttgcatttccaaaagccgtacgttttcttggaattcataacaaccccattcactgggttgagcaaatattactggaagatgatatgataatccacatccagcaggagaaagctggggctcacagaggttaagagtttcccagccctcggaggtagtgagtgttggcattagagcttacagcagcatcctctcatatctcttagcgacttctgggatgtgagggggcacaggcattttgcagtgactgtgagagccctcagtatcagaccatccttggtacccactccagagagacttctaccctcccatttgttcttgtcttttaatttttcagcctcctgtgaggtgaacggatgtcaaggaggattaaagaatgaaacatgcttattttctctccttacgtgcctgaggacaggccagtgagctgtggggacaatagaactgtgaaaatcttctcctggggttcttttcttggtatttggcctgacataccagggaagctactacctctgtgaagttgtggagggctcctgcccagccttcggagggaaacagcgggtcacaaagagagttttccatatttacatgattgcatttgttgctgttttaatggctgctgtaacaaatcaccacaaatttaacagagtaaaagaaacacccggggtcaggagttcaaaactagcctggccaatatggtgaaacctcatctctactaaaaacacaaaaatttgcctggtatgatggtgggctcctttaatcccagctactcagggggctgaggagaatcacttaaacccaggaggcagagattgcagtgagccaagatcgtgccattgcacgccagcctgggcaacacagcaaaactctgtttcaaaacaaaaacaaaacaaacaaaaaaacccgccatgtattatctcacagctctgtgggttagaagtgtaacttcggcatgactcaactgggtcctctgtttagagattcacaagacggaaaggcagaagttagcagggctttgtttcttactaggggttgtgagaatgaatccacttccaagctcactcagctttgcctggttcagtccctggcagtggtgagactgaggccctcaaagctttgctggctgtcagcagggagatagccctggccttcagaagctgcccgtattccttctcctgctgtccagcgacagctactcgagtctctttttgctttgaatctctccatgtttctcttttgccacatcactctgactctagttggagaaagttgtccaccttgaaaggctcattccatgagactgggcccacccaggtagttcagctcttctcctgatctcaagatctgtaacttgaattacatctgcaaagtccttgtcttagcctgcttgggctgccataactaaatgccaaaaactggttggcttatcaacaacagaaattcattgctcacagttctagatgctggcaagtccaagatcagggtagagtgaatgtcaggtaagggcccactttttggcttatagaagattccctcttgctatgccctcagatggtagaagggacttgcaggctctctggagtgtcttttaaaagggcatgaatctagccaggcatgctggctcacccctgtaatcccagcactttgggaggccatggtgtgtggatcacttgaagtcaggagttcaagaccagcatgggcaacatggtgtaaccacatttctactaaaaatacaaaaattagctgggtgtgattgtgggtgcctgtaatctccgatactcgggaggctgacacaggataatcacttgaacccgggacgtaggggttgcagtgagccaagattgcgtcactgcgttgcagcctgggcgacagagtgagacttggtctcaaaaaaacaaaaaaaggtacaaatccccatcaacagagtcctacccttatgatgtaatcacctccttaaggccccgtcttctaataccatcaccttggtgttaagatttcaccatatgaattaggggtgagaggacttaaacattcaaaccatagcagtcacctttgccatgtaaggtaacatatttatagattccagagattagggcatgggaatatttggggggccgttctgcctactacaatgatctcatcacaatgataaatgttagcagacattgctctgataacgacaacagctgctattttttaaatgtcactctataccagccactgagatagatacttcaaattgattggatcatttaatccccatcacagaagagcaaagtagagactattattcatctcattttacatgtatattttttaaaaagccaagacattgaatgctttggtgtcttgccctgggtgactcagaaggaaagtgtgaagctgagaccctagccaggaggtctgactccaaagccttggctgctaatctttttgcataacccatgtcttccttgtatctatgccatctttatgatctgcttacttgtacattgccactcccttctggtgctcaatggctctgatttccttaagatagggttacattattcacccattacagaccactccaagacatgtgttttgctcaatgattgtgtgtgcacctgtgcacctatgcacatgtatataatggtggacagtttagccattggagctccccagtaggagccagtgacattagtcacatccagaaacacagtaaaatgatcaccatcgcaggtgaacgctgactcttttccaaaggaatatcgcagaagctggtaaaacagtcgcatccaagatcaaacaagacatcggccactggaggatggtggtcacttctgcaaaatggatcaggaggatttagaaagtcattatggcagaatgggatttggggttgccaaggcctattggacctcttttctagtaatttcacccctttcagggacatctacaagctattgttaaaaatccctgagtgtttggctctccatttcgtcttctgttaaatgaggcaatatctacaatgtcctctctaggcttttaattggatcccccctccccgcccgaaatacttcttgtattgtctgtcttttttttttttttttttttttttttgagacagagtcttgctctgtcgcccaggctggagtgcagtcgcgtgatctcggctcacttcaagctccgcctcccaggttcacgccattctcctgcctcagcctcccgagtagctgggactgcaggcgcccgccaccacgcctggctaatttttttgtatttttagtagagacggggtttcaccgtgttagccaggatggtctccatttcttgacctcgtgatcagtccacctcggcctcccaaagtgctgcgattacagggatgagccaccgagcccagctattgtctctcttctatcccttggaattgccttaagctagcatgttacctcttccagggcatggcacgcctcctgctgtctcttacccggtgtctgctaagctcatccttagaaccccaagttattttctacgtcaggggctttgcatattttactttttccacctagaatcctccttttgacattctttacaaacctagctcaatcttgtcagcaaactctcagctcacatgtcacttccttagaggatcctctgataagcccaattgaagtacacactcattacaacttgtaattaattgattttctggcctgccttctcgtgttgggtgggatcctctacaaatctgtaggcgccataagggcggagaccttggctgcttcatttgttcttgtgtctcagtgcctcagctgtacatgtaagtgaaataggtgtttgtggaatgacttgggagcagcaccgtcatctctactttcctataaggagtcttgtgcatggcctagcacatattctgtccccaagtccatggaaagcactgcctgccaggctatttgtgtcatttcaggaaaataagacaaagttaatagtggtggtaatacttcactagcttccaagatttgtcaggaatatgctgtctgcttttctaaagcccactctttactggagtcttagagtataccctggggatcctttgcttctgggtcaataggagcactcattaaatgcagatttgtgggtccctcttcaagccgatgaatcagaatcactaatgctgaaccccaggaatatgcatttataacaggcaacccaggtaattcttgtctacaccgaagtgctggaataactgatgtcgagtgtttgatattaactgttatctgttcatacatacatttttttgccccaaagcatctcatggtgcttctctaagcaattttgttgcttaaaagaatgacagactggataactggaagcagacatctctctaacagatctcatcgttccagttttaagtagaaagtgcatcatctgtgttttctgatcctgagcttaggttggagtaaacctgctcagagactttctccaggattagctagccctggggcacaggggaaaagatgcctggttttaggcaacagtgaacaccatctgggtcagcaataggattcaactgccaaaaagctagcacagttgtaatttgcatctaataaaaggagatttatagaacaacaatccttacagctctactctgaagtattgtacgtacagttaatgtcattgctgtttatggttttaccagacctatactatttaatagagataataaaggttaagttaagtgaatgcttatttcatgccaagctagcgcttctaactgcattatctcattaaattcataccacttcccagtgaggcaggtactcatgtttccattttaaggataagaaaagaggggcttagtagctcggttttaaaaagtcaccccaggtcctagggtggttaatggagcccagatgtgaagtttgcttcaactccacgatgtcctgccttcatctgagcctccccaggaagacagggctcggaatattcaggaaatgtcattgatctggatcccagctctgcactcactagctgtgtgtccttagcaaggcatgttactttctgaatctcagtgtccacatctgtaaaatggcaacagtgacgcttacctgcatgaattattcagtgatgatgcccaggtatccacatcattcctaggtgtgtgcaatcaagggagttatttgattaaacaagctgctctgattatatacacaatgctaggttggggacaccatacttccaaaggaataaggacaaattagagcaggaagagaccaaaatggtagaatgaccaggaatggtctctatgaatttgaggattttcagccacaggagagactgatttaatcaacacatatttacagagcacccactctgctccagggccctgtgttaggcacctggaaaacagaggcgaaccaaacagatatgtctcttatctctatgtagcttcagaatatttagcaaacactgcatataaatatgtacatattttaaattgcgatatgaaggataagtaacacaagcatctaacagaggtaactgatagagtatcttctagagaggaaatcagacttctttgcatccctatgtgctaatataagaattctgagttaagcataatgacacggagaactttccaatgagtctcctaggcgacctctcaatagggaacaagtgctaaagacagacagctgctgggtatggctgttgcagggggtctcatacataccaagtcttatagacttggcagtctttaaggtcaaccagattttatctgtctgccttctagggttttcttgaagacgtgcactttgaacaaagaggacattgggatgtaacaaccacagtggttgaaaaaccccaaatgcccagagagaacattcaacccttagaatgttagagagggcagtataatataatgggtgagaacatggattttggaatgaaataaacgtgggttcaaatcccagctctgtcatttagtagctgtgggactttgggcagataattcaactgtaaaattgtggtatgataataagagtgaccttgctagggtgtctgaggattaaataagattgtatacctacagaaaagtggggatataaactcggatctgtctactgggacaccccttatcttcccatggtgcacatgcaacgtcttccccacttccacttcatctctttggaaattacttttgccctgcctgacttcagtctttacagagtccttctttgtttcctgagagctcaatctatagccaaagtaatgagcctgatctgattcagcccaagaactctggtcattgaacttgacttggtatgtccatcatttgtacattttggataacaggttattgctaagagggaaaacctttagctgaatccaatacattcactgcaagtgaagcagaaggaaaatgcctaattccgacttgttagccgctgaacttctgagaacagaatcagcttagctgcttgcaaataagcgagcatcacagaacttggttgagctggcaagaaggtaacaagctgtgtgtgaaaaccctggcattaaatctccacagtaaagttgcttggtacacaggatcaaaagagctgaaaagggtaaggagacaatgagcaagctcctttctgcatacccgcccgacctttaccattgggaacaccccaaagagtgtatgctctggcaccttatcaaaaaataagactgtgctttagattataattaaaacaataaattcttctcccctgcgtgtatcccgattagattgttgacactgtgtcaagctgttagggagataaactcacgctgctacttgcactcaacatgccgcttatttttgagtcactcggagggtgtttttttttttttttttcctggtgacaacttggaaataacccattggagtttccttccttctatttctctatgaagttattaacactgatacacatggaacttcggaaatgggacagcttccatcttggtgttgatgtaggtcccagaatgagccttttaggaatctggggaacttatgtgttggtgaaaatgccagaggacacatgcatgcataggatgctttaaagtcttctgaagataggttgtttaaactgtggcaggaggtctggggtcagcctctgagcagggatttaggagattgtctggctcctcacccttgtttctccaagcatcaagagcaaactctttcttttgggtggatgccactgatggctgaccaagagtcaagggtggggaggttgcgaggatcacagggtcccgtccaaatgacctgattcaggaatttcgggtcttgagccatggtcccagcaaggctgagtaattttttttttttgaggcagagtctcattctgtcacccaggctggagtgcagtgttgccatctcggctcgctgcaagctccaccgcccaggttcacaccattttcctgcctcagcctcctgagtagctggggctacaggtgcccagcaccatgcccggctaatttttttgaatttttagtagagacggggtttgaccgtgttagccaggatggtctcaatctcctgacctcatgatctacccgacttggcctcccaaaatgctgggattacaagcgtgagccacctaattttttttttaattcttagtagagacagggtttcaccatgtcggtcaggctggtctcgaacccctgacctcatgatctgcccgcctcggcctcccaaagtgctgggattataggcgtgagccaccgcacctggccccagcctgagtgatttttaattcctaaacctatgaggctatgtttgtctcatcttcagacctttgcctatgaggttttgtcacttgcaatgaccttacaatggcacgcttttcttgggccacctcagctcatccttcatatctcagcttgcatgtggcatcctccataaagctttttaaaataatgcatattttattttgaaatagttttagatttattgaaaagttgtgatatagccctgagttcccatgcacccacactccgtttcctctcttcttaatgtctcacatcattatggtacatttgtcacaatgaataaaccacattgaacatggaaatttccccttttaaatatttttagtgtacaattcagtagcattaagtatatttatattgttgtgcaattactaccattgatctccagaactttttcatcttgtgaaactgaaattctgtccccattaaacactaatttcatccgtcctgctcgcagcccctggctactttctactttctgtctctctgagtttgactacgctaagtacctcatataaatggaatcatacattatttgtctttttgtgactggcttatttctcttagcataacgtcttcaaggtacattgatgtgttcaaggtgctacagcatgggtcagttttttttttttttcacttttaacattgcataatattccattgtgtgtatataacacatgttatctgttcatatgtcaatggacatttaggttgtttacactttttgattagtgcaaataatgttgctcagaaagcctttcttaatctgactgtataccccaggtgcacccttgggtcatctctatcatagaacttatctcacagagtataagagctgatttctgtgtctgcctctcacactagacttccacatccttagtgcaggtgccctgccagtaagttgttcaccattgtttccctatgatgtagaagagttcctggttcatgtgacatgctcagcaaatatttgaaatgagtgattgtaggaggaatgaatggatagttggttggttggatggatggatagagggatggttggatgaatgagtgggtgggtggatgagtggatggatggatggatggatagttgaatggatggaagaatggttggatggatggagggatggttgggtagatgagtgggtggatgggtgagtggtaggcagatgaggtgatggatggatggatggatgggcggatggatggatggatggttggatggttaggtgggtgaatgagtgagtggatagacggatgagtgtacgtatgtatgtatggttagatggaagagtggatgaatatatagatggggggaaagatgaatatatccagaggatgagcccaagcagattcctcaaggagtagaatttgatttatgccattgatctcactggggtggtcatgtgatgataaacaagagttcagggcaaagaaaacacaccaggttaaagtagcattgagcatagaaagagtagatctcagggcgggatgggggagtataatttgctttactttttttttttaacctaaaaatatttttatttagtgtttcagtaaattaaatcaatgacagtcttttccatgatcctactgccaagatagattttattgaacttttaagtataaaaatagtgcacagacagataataataggagaaaataaggaataaaatgaaaatgttcttcccaaccagtctctctataaagataaccacagtaactacgtcttgtttatttgccattattcttggggggattttctatgatttgtgaatatgtgtctgccatgctcttttttaacgagtgcctgtttgttcattgcataaagttaacaccacttaactgttcctcactgagggggacatttagctttaggctatttccaacagaactgcaatctctttaaaataccttgtgagtatatccataaggtaaattatttgaaggaaaactgctgggctaattttttttaatgtacatacacttatacattttggtagatgttcccagatgcccttccccaaagtttgcaccacctgatgttaccatgactcatttttattgctgtcagtcatttagtgtgggtgaggcacccttgttaaaagacataaggttggagcacatagtccagtttacttctgaacatcagtaggacatttcaaaaaaaatgagtcctgctattccctaatttataataaattctgagacgggggtggagatggcttctttacccatgagctatgcacattagatcaaaaaatgggggagaatccagagatgttgaactcaagcgtgatttgaaattctgtccattttcttgccctcagtggatgtttttaaagtagaagagacaggaaaggttaagactttcagtctctttcccttaagagtgatgtgtgattctctactgtctgggagctccagggcctgacccacagattggctgtcactaatgctgggaagaggtgtcactagtttagcaacccttcattctatgccatttcctgcttccatgggtcaaatgtcagcaccgttcaacacgggctgaagaagctgacaaaaaaggtgcttgggactggatctttcacagagtacaaatgaggtagtagtggaacaattggtgaacacactttagtatatatttgacacaatttagctgctatgcctggcatctctccttcagcatatcctgcctggtagttatcattaaaaaatcgaagaatatataacatgtttataatttcttctttttatccatagttcaaagggagaagcatagcttctcttttaagagatagaaagatatagacatagacttagatgtatgtcattattctcctttaggataaaaggtggctagggctttataaaatttcagtgtaaatacatggagtaccatgtatttaccaaattaccaaatagtaatttggaggaggggatcttcgtcaacaacataaactttccattaacagtaataccctcttgcagtgtcacacacgagtctttataacttaactcatttggaagtcaattctttccagtgtggctgaactataagtctgaaaccagtgttatgaaacttgcaaagaaaagattaagttattctgatatgaaaatctttattttagaatgcgatatttatgcagtacacagtgcaaatatacaacatagcgtttactgtgaaacgactccttccacttctgtccccagcaattcagttcttctcctccgagactgcactgtagctatttttgagcattaatccagaggcagtcaattaataaacaagcatattcacacaaatagtagcatgtgatcatatgacaggaaaaccaagttcccagactgtggcaaaattgtttcactaaggataaaagttacagaaagtatacttgtttggcagagtttattagataatattattagataaaagtgttagcaggataggatgaattcatggaaatgtgggatttctcttatgtatgtattgctttattaagagcaaacgcaatattaatatcacaggtttagacgtctgaaaaacatacagggatttggctatgcctttcataggctgtgtgatgtcagcaagctctccattcctctcaacctcacagtccttatattcaaaaagcagaagaatgtctctgtccaagggttgatacaaacgatgaatagcattagattaaaaggatctccgctaggtgcagtggctcatgcctgtaatctcagccctttgggaggctgaggtgggtgaattgctttaagcccaggagtttgagaccagcctgggagcatggcaaaacgccatttctactaaaaacacaaaaactagctgggcatggtggcgggtgcctgtaatcccagctactcaggaggctgaggcatgagaattgcttgaactcaggaggcggaggttgtagtgagccaagatcacaccactgcactagaacctgggtgacagagagagacttggtctctcatatatacatatatatatatttatatataatgttatatatacatagtatataatatatattttatacattatgtattcaaggtcctttatacataatatatatgtatatatgtttatatatgtacatatgtattatatatataatatatataaaggaccttgactatagtagtatttagcgaaagcagtttgcttgttttcctctttacctgctacccatattatgagttacaggagcagctcctcaaacagtaatatcttgttgtgctttatatggctaaatttaatggttaaaaaagaaagagagagaatgtggtggaatcaaagagtagtttcttctgatttactagtatgctccctccccaacctccacttcttggctgtgttcatacatgaatggagtgtgtagacattcattctcatctactaattgctttcttcatagacaattctagtgattacagggacattgattctaggggatgtgccaaattacctaagtgccatccagctctcaaactttttgtaacctccctcaagcaccttttgaactctacctattaactggcaagcaatcgagacgttatttaaaaatcaatattatcttttcattaaaaacagccccccggccgggcatggtggctcacgcctgtggtcccagcactttgggaggctgaggagggcggatcacgaggtcaggagtttgagaccagtctggccaatacggtgaaactctgtctctactaaaaatacaaaaattagccaggcatggtggcgcatgcctgtagttccagctactcagggggctgaggcagcagagtcgcttgaacatgggaggcggaagttgcagtgagccgagatcgcgccattgcactccagcctgggtgacagggcgagactccatctcatgaaaaacagaaaacaaacaaacaaaaagcagccccccatctctctcagctgttatgctgctgagtaaatggcctcttctcacctttttgtgttccccagtgcacttcaccttcactgtgaaggtcatgtattcatgcttctaatgttttacaattaaggataacatctccactttggtgaatttaatgagacttggcagtgaccccagtgacctggtgaacagccaactatttaggttggtgcaaaagcaattacggtttttgcctttttatttttaaaatggcaaaattaaagtggcaggaccgcaattacttttgcaccaagctaatattaaggagcctggctctaaagtcggactggctttcatcccttattacttgtgtaactctgggtaagttacgaatatgctttccctttccagttcttaatttttcttctgtaaaatgggcataatcgtagaactggacttctagaatgtctggtgaggattagatgagtataaagcgttcaccatgagggttctaatcatttagccacagtaagcattctttgtgtgttggctgttactgtgaatgccatttagttacctgaatccattcatccacttcgtctcatatattttccaatatttatggagtgcctgtgttggtcaaagcaccaatgcagagccgccatctttccctttgatttttgaatgtcccaggatggtactctagatggttccacacaatccagctgttgataacaaagacaggttgttcaccaaatcagagagtctttgagagttcagaagagtttaaaagagacagatgggtgcctctttcatggccccgagcttttctgtagaggttgtctttcacgtggagacatctctgttccttttattttctgttgactcatagcaactcgggagggagattattgaagaacaaaagggaggagtgtgtagttctgttttcaacactccttcaaagggaggagtgtgcagctaccgattaatagatttgaaggatgggcattcttttttttttttttttttctttctagatggagtctcgctctgtcacccaggctggagtgcagtggcgcgatctcggctcactgcaacttctgcctcccgggttcaagcaattctcctgcgtcagcctcctgagtagctgggactgcaggcgcatgccaccacacctggctaactttttgtatttttagtagagacggcgtttcaccgtgttaggcatgatagtcttgatctcctgacctcgtgatcacccaccttggcctcccaaagtgctgggattacaggtgtgagccacacacccagctaggatgggcattcttgtagagagagatagctaagatcatgtttctggcatccaagctcttggttataactctgggtttgctgcttgccacatgaatggcctcggacaagttattgaacctatctgggcctcagattccccatatgagaatttgattgtgttaaagtattagggtagctaacagagcacctgaaagttattaatttgaatatatgttggtaacagattataaagttgtgaggtagcatttatttggtgcttactatgtcccaggaagtggggtaagaagttcacatcatgtctggcagtgtagtaacctgcagaagagcca[131 bp omitted]ctcccacctcagcatcctgagtagctgggaccactagcacacatcaccacacccagcaaatttttgtagtttttgtagatactagagatgctgttttgccatgttgcccaggctggtcttgaactgctgggctcaaatgatcctcccacctaggcctcccaaagtgctgaaattacaggcatgagccataacttctggcctagtcagaatatttgtttgaattcttaccctcacaattacaagctgtggccttaatccctttccttaatgctttcttgtcttcagatcctccatctggaatacgtgaagatttaatgagatgatatctatataacacgctttgaaaaatgcctgacacgtaaagatcacttaataaatgttggttattcttactgtattaaacatcccaattattagatggtataacttgcccaggttcacacaactcagaagatacaagaggaaaacttgagttggttttgtcagctcttctgcagacgtagggggctaaatgagtaacattctgaaatgaagtcttcggcatctccaagggataaggatgcctggaaatttcacctttggggcacattctataaactgtacaaaattaaatccctcacttcatttccccagaaagacccctctgaagcattgctctgtatccttgcaaatctgtaccacgagacaaggggatgtcagtaggatttggtctccccacaaaatccctgcaaagatgtatgaggctgcatataaattgcattgaatgggctaacattgcttttatgctgaatatcggcaaaaagtatgaaatggagattacattttcaattctggctttttcccccaaagctttaccaagctgccctcatcctcacccctccatcatagtgcaattgcattggtgtggagtcctagctctcctttccttgctgggaagtgtacctaacacttgctgtcaggctggaaccgtgggtaacatgttccttaacagcaagtttctttattttccttcccccacatctctgtcctttttttctcactactttttgttgttaagacctgtcacacatgagaatcacaaaaccaactacaaataaatggcattcttgtggatgctaaaatcggtatatctgtctcttgggttgttcagggtagaaataagacatcgatgcaaatatggttcatccaccggcaatgagacacaggcttattatttcttcctgaaatacatatattcatatcatctatttcagtttgtatctccaaacagccctaaatcattgtgaggacctgggctccagtttgggtctatgaaaagagggtttacccgtggggggtcggggggtggttgtgcatctggttttacatcagcattaattccgatatttcaacagccccttcctgcccacattccttgcctctcccttctgccccctgaatattattgcctggctgactccccaaagagaaaatgtactaagcgaacttgacagattccggctggctccatatggcatggcctgagtttcgtgttcctgggacccccaagctgctctcaccttattacgatggtagtaactacatgcaagtcaagtccactgcattggttttaattccttgggccctggggactagcctcagacttcaaggtggcattggatgcaacatcatccactgcaaatatgacctttcccttctcttcccataaccacacagctggggggaaggtaggtggaaaatagaccctgagtctaggaaaatcttcgaaaaatgcagagataatatcagagggctttgctagggctggcagcagagtctaacaaagacatcttaaagcatcttgttgtttattgcttgatctgaacctttgcactcccacacataattgagactttgactttgattcataagtatataatttgaattcctccttctctctacactgttttaaagccatggagaaaattaactccaaatcgaataagtgcatttcaaatggataagcacttgcaacccgatgattaaggagtgcagttgaatcccatatgtttttaaataatcagaatttgttagaatgcatctgtaaaagaaagttttttgacagcttttcacttcacccagagtatatagaaaatgttgctaccttcatgtaatgtagtcttccatattctgacagaactatcattgcgtagaatgaagagaacacaaagagggcagagagtcaccttgttcaaatagctaaaagggatagcaagaggaagatagactttactccaggtggcccaagggaaaaaaatacatctaaagggaaagattttttaagggagtgaggagtgggaggagagttagagaaatagtgtagcaatctgagctgctgaagagaaagtgctttagtgttcacagtaggggctgcagtttgcagaggctagagagggggagtccctggtaccatgtctgaagttccttctaaccctgaggtccttgatgctgggcattggcacacctcacagtgagatgatttctgacacaaactggattggtcaccattataaatgattcaacttatttcagaagccacttttgccagctttccgctatatgcaacaaaaacctcaacctctgaatatgaaaaattcaatccatttgctttccttttagctaaaaggaacccaaaactgactccgcttattgctggatttgtatgctacttgctaaataaatggatctagtctagatgccaacaataccctgaggatgtagaaaacctcctttgcttgagtcgagcgccttgaaatagctctgttgcatcttgaacggggctagtttgttaattcgatgagtaaaggggagagtaccatcatttcgtttgttcccgtgcggaccgaacacggtattagcctctctgcagatacaatctcacttagacgtaccagccactgtgagagtgtagaagagtttatcccgaatccacaaacaggaaagtggagtcataggcaggaatgcactcaggttgtggtgggaagtggatcaaaacccagttttgtttttttttttttaattttaattttagggacagggtctcggtctgttgcctaggctggagcgcagtggtgtgatctcggctcagtgcaacttctgcctcccgagttgaggcaactctcctgcctcagcctcccgagtcgctgggattacaggcatgcaccaccacactggctaatttattgtattgtatagttttgtagagatgggggtctcactttgttgcccaggctagtcttgaactcctgggctcagtgtatcctctggcttggcctcccaaagtgctgggattacaggtatgagccggggtgcctggcccaaacccaggtattttactctacaatgcttgcccttttctcagcccttccttgcttgcaggacacctgaagtcccttgagctgctgtctatgggaaaggactcaagagcctgccttttcccgggtgaaggtagctggttgggcctggggtgtgaagcatgaaacaggtactgtgcatctcaccacagctcagagatggaaggatgcagcttcttctgcttttgttccacttcaagtctagcccctcttggggctgcttctctccgaggggaagtggggcacctggagggggggcaggtgtaggtgattggagctggaatttctctagtgtgatagtggcatcagctccacattctccccagcatgtcgaatttgtaacaaagctagatgtgaagagtcttccccagaacatccctcaataatttgttttaataatagacattttcagcttaaatgtgagtttttatcggagatttcccccttcccaatttgtgtcagcaaccgttattaaattcctaggaaaaggcaaatgttggggcttggtcagaagtgaggccgacgtataggtgccagttccagcctgatgttccccaccgatgtccatgtgctgactcagtaaacaactgcctttcttctgaatggtctatgtgagctgttgattatcatgttcttaaagaaggctgaatatcttgtgcctttcttgttaagcctgtgtgtcttgggacagctacacacactctctaagttacagttttctgagctttgggtgaggggatgttcgtctttttctgcctgcagcactgggcctcgggaagcaacttagggttttggctagagcaaggacagatctgacatctagtccttcttctgtgttttctgtcaatcccagtttccctctctttcaacctgagctggtagcactatccttttactgtttagagggttaagagagataacacctagtatatagtagctgctcagaaaatttctcgtttccacaaatgagaaagtgaatgcaatagacatttgagaacagtaaatgtgtaatagaattattagttctttgttctaattgtcaccggctccgtttaaaaaaatacatatatggtatttactttgggaaagctgcaagccctgtctccatcacctccttttttcaagcgtggactcattttcatctgcggattccctcttgcctgaaggccttggtgccgcatgagcaagtgcagtgctgagagctgtgtatggagctggaagcacaggccactttctgctgccgagaaatcttctgccctccgagggcacaggcttgactgcaaggggatgtgggaagccatttgtgagaagtcgtaattaatgatctgctgggccttggcacttatggaggaagcagaaagcagctgggaattgaaacagcctcttggataaaagttgtcctcctggggctgcttccctctgaggggatgcgagggacctgggagggaggggcaggggtaggggtctctgtagtgcgaattactcaatgctactgtcttttccacagcttatagggctgctacctgccatgcatgatatccaagtgatatggccaaagaaccctagctcttgagacaaaacatcctgggcttgaattctagctcttcctattgctccttacatctggacagttgccctccatctctgagcctatttttttcatttgttcaatgaggatggtgctacatactccgcaaggctgtctggattagaaactgagtaacataaatggaacagagtaaggactcagaagtacttgggataaaatatacagcaagaaacatagagcccccgtcttcagggtgcttacggttttgtggataatagaaatcgcattatctatataatgtgtaaacttgtggatatttctgtagatattgctgtagaatgtatgcacatatgtcaggtgatattagatataaattgctgctaaattattcagatacttctcataatataaattgttcttctttggtggaatattgggatgcctctgtagtgcaaattactctcttttggtgagttagcaagaatctatcataccttaatttgatcttacttgctgctaggctgatttgaaagttaacttacccttcagatgactaagggctattaaatccctgaaggaatcttgcagataactacagcaaataacaatatcttctattgaaaacatatttggtattccttgtaccaaccttataagaatgctttgagtatgacatgaactacagatactccttgacttaggatgggatcatactgcaataaacccatcataagtagaaaacataataagtcaaaaatgcacttaacacccctcacctactcaacatcacagcttagcctagcctgccttaaaagttctcagaacacttatattagtctgtagtttggcaaaccatctaacacagaggctatcttacaataaagtgttgaatatctcatgtaataattgaatgcattactgaaagtgaaaaacagtatggttattatgagaacgcgagatacggtttctcctgaatgatttcactttcacaccattgtaaagtcgaaaagtcttgagtcggggcgatctgtattgcctacaaatcaagccgtgcagcgtccacacctagcaagggctagtgatggttatcatagcaacaagtcctcctgctctatagtcataacaataatattttgtagcatctattccattgtgttgcatgaagggttacagaatctaatatatgcagaacgctgggcacagtgcctggtgcattgcattgtaagagctcaaacagtgtcagctgcaatcatcctcattaattctatcttcgcagtaactctgtgaagtgctttagggaggcgttacagtcccactttaccggtgagaaaaatgaggctcaaagaggcttgttcagtccgcacagctgacagtgattgctgcgtcagggccagctgtagccttattcctgaatttctccttatacctcttcagcccctccttccatttcatcccagttgttgttgttgttgttgttgttgtttcttaaatcaagagtttgcatgcatcttccctttgattgcctgggattttttttttttttttttttttttttggaaagcagtcatgaagatattgcctagcctcgggtacacaaattctggatctgctttccaagagaacccaggaggaagaagatgctgtgacaggcatttcttatcagggagaggctcccctgcttgcacttcgaatccacaatgatgaaggaattttccttcctgggcgtatttgcttatgttcttggatgtgctggtaagcccctgcctacccacctctatgtaaatgagtcctcccacaagctcgggatgttctgtccccaaatcctgaacaccatgtacaggagatgggcttagatgttgcagaagcaaagactgagaggggggcagcttttggctgcaattaactccctttttgactttatcctgggttggaaaagaccttcacctggctaggagatctgaaaatgtgcctatgattgtcagctgattttcccaggtcatgaacctgggcccctcagcctggaacaccgtgggaggagagggaagccaccctcgtcactaaaaggtgctacccttttattcaccttcctcaagttagaagaactgtttctccagctgtaccaaggctgtgctggaattgggatcgcagagcagtgcagaatatttattaaccacctactatgtgactgcggaaatagactcatcaaactattttgggtccctcctggatgctgtgagagacctaaagtaaatcgttgcaatacttgggttcttgacgaagagcgttggcttcacaatctggcagacctgttgtcctatcccagatcagacttactgaacctgtgaattggggcaagttatttatctcttctagattcatttcccttacttgtgaaagatggtaataatgtgtgtcatgtaaaaatatgaggatattagataagcactttgtggtgtcttggacctaaaaagcagttagtgtgtggtggacattgtatatctttaatatccagacctttcctgggatgccaaccttgttatctacagacatactgcctgagggtggaggtttgaattgaggatacagataggacagtgttcttattggggtggctgataatagaataattgcttatttatcttataggttgggaaatattggtattttaaaggtgggttttccagagttgggtataagttcagctacccaagacaacaggttactggggctgtatggctttgcatccagagttaaaagccaggcctgggaataattaaaatacttttcatcctgggaaattctgctttaactggtttatagcagaggctgcgcatcagatgttttcaaaattaagtgatggtttatgtacaatctaattcatccgcttaagtgtacagtttgaattttgatgattatatacaatctcacagtctccactacagttccttgaccttaagtttccttacgctttattttcagtctattctgcccccccattccctaacccctggcaagtattaatcagctttctgtccctgttgttttgaatttcataataaatggaatcatactgtgcagagtcttttttgtttgagtcctttccctgagcataaagtttttgagattcagccataattgttgcacatattaacattttgttccttttcattgctgagtggtacgtcacggtaggaatataccaagatgtgtttatccattcaccagaccaattaatggacatttgtttctagtttttggctattaagaatgctgtggaatttgagtacatgtctttatgtggacacatgtcttcattttggggagataaatccttcaaagtagaaatgctgggagacatggtaagttcagatttaacattctaggataccattattgttgttatccaaagtggctgtgccattttgcttttccactggcattgtagcattgggtatttatttattttttagacagagtctcactctgtcacccaggctgtagtgcactggcacgatctcagctcactgcaacttttgcctcctgagttcaagcaattctcctacctcagcctcttgagtagctgcgactacaggcgcccactaccagagctggctaattttttgtatttttagtagagacaaggtttcaccatgttggtcaggctggtcttgaactcctggcctcaggtgatccgctcgcttcagcctcccaaagttctgggatgacaggcataagccacagtgcctggctggcattgggtatttttcgcacagctcccagatgtttatattgttatgtatctaactagcatggatatcctctgggctctgttttttctgatttaatggccacctttgggctatcagatgaataaggatattgtcagtatcaggaaagtaaagaagacatttgtcccaacccatatgccccaagttgttcaaaactattgaggaaagagatactgtctgggttttcataactcagttgcatttttatgtcttgcatatcaaaatttgtatgcagggttacgttccccaacattaatccacttttttttttttttaataacagaggacttgacttagataaagagaagtcttattccctcaggtaggaagttgtttccacctgctatagacacattagttaataatcaagggacaggtgtgttcactgacctacctgttattttgttttacaactataatgactagttctgtttatgcatgcacacacagctgcaccctcgcgtgttgcttttccctcatgtttccaggcagaccacgcagtgactatttaatgctttgccttgctatgcgctgttgcttatacatttctggaagacattttcccatcctctgcagtttaccttgtacttttattttctccttgttgaattacaaatagattaacacgctcaataggttttccttgaatccagctgaatgcttcaacctcccacatgtgctttttttagttttgtaacatgacagggaatgaggtgaatgagctgaggatgtggcctttgtcttgggctgaagcagttctcaacccccagatggcttgtccctactcccccaggcaagagcccatacctcaagattataaagagaggttttaaatagaagattgttctatctaaacatgtgcctaactgacatctattttgttattatgtgaaacacatccatatataatgtatatgtatccataatgtatgtacatatatgtatttcccaactctctcatgtctgaatattacatcccttgactatcttctgtggctctccgagtccacttggcatttggttatcagcttatacttaacagcaagtgtcggtctgcaggcccatcacctatttttgtaaataaagttttattggcacatagccacacccatttatttacatattgttcatggttgctgttttgctacaactgtgaagttgagttgtgtcaacagaaatgtatgccccatagagctgaaagtgtttcctgtctggctctttacaggaaaacacaatttctgatccttcttctgtgctaccacttggtgtgtttgcaacttcactgtgctgtctgtgggtatttgtgtgtttgtgtctttttttttttttttttttttttgagatggagtcttgctttgttggccaggctggagtgcagtggcgtgatctcagctcgctgcaacctctgactcccgggttcaagtgattctcctgcctcagcctcctgagtagctggcattacagtcctcctgagaacctgccaccacgcctggttcatttttgttttttttggtagagatgcggtttcaccatgttggccaggctggtctcgaacacctgacctcgagtgatccaccctgtcccccggcttcccaaaagtgctgggattataggtgtgagccatggtacccggccttgtgtcttttctacgtggacagttagatttgtccagttaatcttaccttgggccagtcacttaacttctctcggttttatgtctacatccataacttgggcataataacagcatctcccctgtagagtggcttgaggattcaggggaaggcgagcaaagcacctggcattcacagtgtccagttcacatgacgagctcatttaatggcacccaggcttgatagaaggtatgtgttatgatctgggtggtatctcctgccattttggagcagatgctaagaagcaagtcattcagctgaggtctaggggaatagacagagatccaggccgttactaggagacaagctatgcaatagtcagggttccaacattgcctgcctcttccagcatccgtcacctcctgtttttgttcagcctccttgccactctgcagttagttcaaacacaattctcacttcaaggcatttgtttttgtctttttgaaatggagtcttgctctgtcacccagtctggagtacagtggcacaatctcggctcactgcaacctctgcctcccgggttcaagcagttctcctgtctcagcctcccgagtagctgagcttacaggtacctgccatcatgcccagctaatttttgtaattttagtagagatgaggtttctccatgttgggcaagctgatctcgaacacctgacctcaggtgatttacccgcctcggcctccaaaagtgctgggattacacgtgtgagccactgcgccttaaccactttcaggcatttgaacttgcagttcccactgcctcaccttgtttcctccaagacatccacatggtatactccttcctcaactactttatctcaaatagcggccccatcactgtcttgctccacgccctcatactcatcacatgtatgggtcattgtacttcatatcaatgtgtttatgtgtcagtgtcctgtctcctgtactgaaaggcactccccatgcagttgagaaattcatcttgttatatgcccagcacagtgaatttcacctgcgtgaaataggggagcactaaatattagttgagtaaatgcatgaatggatgaacattccttaaagtgggaatgtctttccatgtttcagaattctcatctgccatctctcttcccatgcatgaagataagcagtagactatccactcctgcacctgttcatatacatatagaaacacgcactgagaccgagcaccacacgcacagacactcacacacacacatgcattcaaacctctccatgcagacacattctctggagcagtctggatgcagcttgtaaaagtgcctcctcattcagcacttggacaacctaagagcctcttcagtaagatcctgatagctttattggagaggtcttgggtagaaaaaaagctgcagcttaatgaaggccttttaacagtcaatctcaattccaaggaaaagcaaatctattaccagcgtccgataatttctgctcagggattcccactcttggaatggatttttttttccagggcctcttttctaattaactctggagcgtagattacaagaggccggccttgtgaatgaagggggcacctcggcggaagtaatcactggaggtgatgtttaattaaagagatgctgttagagggaaaagacctgagcaggctggagtgctaatcctcttgccgtgctagtgtgtccctgcgtgattgtgattgatgagctggtcctgctcacatcttcatctgcagcgtgctcatccctgcaggaggggcttcagctccctccacatacatgcttagcctggtgttgttctggcatggtgaaagggatggctgtgcagtttccctttctcactctgcatttttctccttttctttttctcctttattatagctagatagttggatagatacacatttagatatacaactatgtacagatatatatggacctctatatctatctactgtctgcctgtctatctgctatcattctttcgttgtttgtctatcattctatcactctgtacattcatacattcattatccatatatacattcatccattgtctacctatctactatctacctgtcattctgtctatacatacatcaatccatcatatgtttatccattctgacatcgtctatctatacgttcatccgttacacacctatctactatttacctatcactctatttgtctgtacgtacatcaatctgtccatcatctatccatctatctatacattctcacatcccttatctagctatacattcatctattatccacctatctactatctacctatcactttatttgtatatgtatacatctatctatacatatccatacattaatctatccatccatctatccatctatacattctcacatccattatctatctatacattcatcccctacttatctactgtcattttatcattatgtttgtctatacgttcatcaatccatcagtctgtatacttcacatgtccactatctatgtatacattcatccattatctatgcctctaatctctctattgctctgtcattatatctacctacctatgcatctatctctatctttataaaatcttgctgtgaatctcagcgtgtctgtctccccatgtctgtgtctggctttgtcttcatttttctcattctgtccaaatctctctgtttctctgcctctgtctgtctctgtttcactgtttgtccttttgtttctcctaggtctgccctattaggtaattttagggaacgtgtaactgatacctttttttaaattcaagagtattaatggttgagtaatgtaaaagcaagtttttggttaagcatttactaaatgacaggaactgcctgaggtaccttttggcaagtatttcataattgttcttaaaatagcaaatattaatctcttaatatgtgccaggtcctaatgccaagtactttatgtattaatcccatttaatcttcaaaatagtcttatgttgtagcttcttttgctgttcctattttggagattaaaaaactgaggcttggagagagaattattattattattttttttttgagatagagtcttgctctgtcactctgctgcccaggctggaatgcggtggtaccatcatagctcactgcagcctcgaactcccggactcaagaaatcctccaacgtcagtctcccgagtagctgggattacaggcacacaccactatgcccagaaaattgttttttattttttgtagagaccgttttttttttttatgttgttccggctgatcttcaactcctggcctcaagtgatcctcccaactcagccttccagagcactgggattacaggtgtgagccaccacgcccagctaagttatgcatattatctttaatccacactttcgcacaccaagataacattttatttccaccttttaatgatgcatgtacaatggttttaaaagttaaggtgaattttccttggtcagagtttttaaagaatgtcattctagggatcttacttcagatgtgtctctctccaaaatgctccttttgaatggacagaaaggtagacctgtgtctccccatgtttctctgtgattgctccccctttaaatctgtgtcccagctacatttagtgaacatctttgccatgtggcttctgaatggaggaggctgcagaacttccttcagtcttctgagccataataaattggcagaaatgtctgatttgacgttttcccccccttgttcaaggcagatgcttttctcattactgagaaaagaatgacactttgtctctccaagagctcaggcgttcataatagataagtgtgcagtttctgatcttggagctgctagctctgctagactaggggaggctcagctctatcagggctctatccctggcgagattaggtttgcagaatctctactggagcttgtagctactcactagagtggattggtctatgattctagtttcactgtttatagttcaaaattttccagccagccaggctgtcttcttaattagaggggttgagtctgacatggaaggagtggataatgtacctttactccccattttcatctatcaatggaaaagaattaaaataaattcaactgtgacttgtttaactcccacattaacttgggttagcaaattctactttgtggaaggaaccatgaggaagaaaacagattgtaactatggtctgtgctagttcataagtccaagttcaactctggttgaggtgggggtgttgatagctttcactaaacctcaaattgttcattatcttctagtcttggtgaaacaagctttcccatgtctcaaaaagacccacctaataaatataatcaagtcccatcttacccagaaacagcacctgctgttactctctgattctcattgttttgctctgacattagggtgtctttatcagcctaaggatacatagattcttagacagtttcaatctcttatcttctttaggtggcctaaaatctaacactggagatctcttcatcatagcacccttggaaaactctgaaagctgtcataggtctagaaatccatcaactccagattctaaagagacaaccaaatggctcacacttcttaccgtacctgcacccacaaatctggctcttaaataaagtcatcagccctctaattatactaagatattcaaatcatgagattcgctctgaagccaattcttcaaccacccacttacccatctttgctttccgggcattgccacatccctttttcttggggtttcctccgcaggaacactccttatctgcgactttggttgactgtaaatcttgtactgttgctttgctatttaatgcaacttgtcatcttgtttttggccttgatttgatatcctagtaagggactcttcttgggttttgctttaagattcagtctgctgaagggctgtgactccattgtgagcagaagcagcctgggaaggcaggactagacacaccaaacatcagccagacaggtgatgtgatccctctgattttcagaattcctttgagagatcacttggcccttccctgctgatctttgggctggagtcaaggcaatcttttgaattagttctgtctctctctaaattatttgctttatgtaataggaacatgcctcatttgggctctttattttatctattttatttgaaacagggtcttgctctgtcacccaggctggagtgcaagtacatgattgtggctcacagcagcctcaaactcctgggctcaagcaatcctcctgcttcagccccctgagtagctaggaccgcaggcacatgccaccatgcccagctaattaatatatatatatttaaaaacatgtccttgtatttaacagaattttaaggaagaatttgatttttagtaatttacaacttctctggccaatcttccaaatctggctaattttcattgtaccactccgtgtgttccttttttgtcattctgaatattgatgattatagtctatgttcctaacgcctaggctgataacactctactcagcctactttgttcacatttccagcatcagaatcctgtgttccatgcttgtatgttgtggaacgagctcaattttcagcattaaatttaccatgccaaaaggtggaaaaagactctgcaataaacagactacttagcatgattttgtctgccttctgcatttggaattcccaacataacctaagcaggcataaaattcagttctttaagattcgtttaccaataagaatgttgtaaaaattcaaataaaaggaatgcagattagcagagagaatgctaagcaagttttttgtttctgtccttggtgctgaaaaaaatgggggtcaacttttctaccttagtgaatttaatgatgtggtgattgtatttaaatgactatgtgacaagggatcagatacttccctataatcattctttagtttcctagaactgtagaagcttggtggcataatgagagctgcctgtcacctaccctagaactgtcctgtctcatatgacagccactagccacatgtagctacttaaaacgacactaaataaaattaaaattcagtttcttagtgatatcatttagatattgtcccatctaaatctcatgtcaaattgtaatccccagtgttggacttagggcctggtgggaggtgattggaccatgaaggcagatttttttatgagtggtttagtgccatacccttggtggtagtggcatgatagtgaattgttgtgaaagctgactgtttaaaagcggttggcatcttccccttcactctctcttgccccgactctcaccatgtgacatgcctgcttctgcttcaccttccaccgtgagtaaaagctccctgagacctccccagaagccaaactgatgctggcaccaaccatgagctaattaagcctctcttttttgagacgtcccccaggctggagtgcagtggtgcgatctcagctcactgcaacctccgcctcccaggttcaagcgattctcctgcctcagcctgccgagtagctgggattacaggtgcctgccaccacacccggctaatctttgtagttttagtagagatggggtttcactatgttggtcaggctggtctcaaactcctgaccttaggggattcgcccgcctctgcctcccaaagtgctgggattacaggcgtgaagccactgtgcgcagccttaagccccttttctttgtaaaatacccattctcagggatttcaagaacagactaacacactcagtcagactgtctacctttcaggcgctcaacagccacacgtggctagagtttcctgtgttagacagtacagatatggaatatttctgtcatctcagcaagttttattggacagtcttcccctagaatcattgcaatagactcagtaacgcccacaaatctgtccacatcataatcactggaacctgcgagtgttactgtatatggaaaaaggacctatgcagacagatttaagtaaggagaattatttcttttgaattggagagattattctatagtatccagatgagtccagtgtaatcacaacagtacttacaagggggaacacagaggtgtagagtcagagtcagagaggaagaaaatgtaataacagaatcagaaactggagtaatgcattttgaagttggagaaagagaccacaaggtaaggaattaaggtggtcattagaagctcaaaaatggcaaagaaaccgatgatcctctcagagcctccagagccctggtgacaccttgactttacgtcagttgagaaatcagaactaaaagagaatatgtttgcattgtgtgaagccacaatgtttctggtaatttgttataacaacaatagaacgctgataaaatcatcattatcattgtcatcatcattatcgtcatctcagtaggtgcttggttttagtttgggttcttataattttgcattctcaaatagaaagtcaaaacaatttcttagttatttgaagaaccacactgataagcaatggcaccttttattttttgagattttcttattggcttgtgaatgatttcttctccgagagtggttatggaggcttaaacagtatgtcatgagttagcaatgtctagtgggggagctataatagataaaggtgagaagagataattcacatggccccactttctgatttttttggactgggatgtttgtcaattgcaattctcgttttgagcatggtggtcagatgagattggccttgctgaagcacaggcaagcatcccattaaatgcttttaggtgattcagaaccaaagctcaattcagtattttaaaggcgccctttggggagaccatctctggccttcctaccattggcggctagtgtgttattttccaagcccgctgtgtgatgatgggtgtgatgtgtcacactccttctctgctccctcaacatgctcctttcctcccaggctgggtttgatggattattttttctggaaaattttcctaaccccctgcacactgccatccaagtcacttcgcttaaataacaataacagcaataatagcacagagatgttcagcatagtgataagaaatttactttcatgacctaatttattgtagaaataatcctatgaagggtatgcagtttttatctctcttatgacagagaggagccaacactcaaaaaggtcatgatacttactcaaagccatatacctggtaagaggcaaagccagcatttgaacaacaggccttctgagtctggaagtggctttcattccgaaactcagcagaagtttctccttcccaaatgcttgagctccttaatatcaggaactgtgttacctactttttttttttttttttttgcactataaaatcttcattctttattttagatacaggaggtacatgtgtaggattgttacatgggtatattggaccaaggtaatgagcatagaagccaacaggtagttttttactccattccttcctgccattttagtagtcccccgtgtctgttgttcccttatttatgaccgtgtgtgcttgatgtttagctcccacttataaatgaaaacatgtgatactcgttttctgttcctgcattaattcagttaagataattgcctccagctgcatccatgttgctgcaaagacatgatttcattctgttttatggctgcatagtattccatggtgtagatataccacattttctttatccagtccaccgctgatacacacctaggctaattccatgtctctgctgttgtgaatattacagtgattaacatacttgtgcaggtgtctttctgagataacaatttcttttcctttgggtatttccccagtcatgggattgctggattgaagagtagctctgttttaagttctttgagaaatactcaaacagctttccacagtggctgaactaattttacacacccaccaaaagtgtatcagccatcctttttctctgcagcctcaccagcatctattgttttttgactttttactaataggcattttgactggtgcgagatggtatctcactgtggtttagatgggcacatatttccctgatgatgattataagcattttttcgtatgtttgttgactgtgtttatatcttcttttgagaaatgtctgtttgtgacctttgtccatttttttgcatgtgcagaatttattcaagttttaatataattccatctttaagtctcagaaacctttttacatttattttaagactacacattgggtacagtacacactgcttgggtaacgggtgcaccaaaatctcagaaatccgcactagagaacttattcatgtaagcaaacatcacctgttccccaaaaaccaattgaaataaaaaataaattactttttttcttctccattcaaagatactagactattttttttgaaaatcagcagaatttcattgaagttcctcatttaaatttatgtttgaatcctgtagattcttaataagtacttccatacagagaagaagctaataagaacgttccagagagatcctacagaacgtggtgtggtgggaagatactaggctgggtccacattctgtctctatcagcagtgagtcagtgcacacatcctaccttctgggcatcagtttcctcacctttttattttattttgttttacttttgaagtagggtcttgctctgtctcccaggttggagtacagtggcatgatctcagctcactgcaacctccatctcccagttcaagtgattctcttgcctcagcctcccaagtagctggaattacaggcatgtgccaccacatctgtctaatttttgtatttttagtagggatggggtttcatcatgttgaccaggctggtcttgaactcttgacctcaagtgatccacctgccttggcctcccaaagtgttgggattagaggggtgagccactgtgcctggccaagtttccttatctttcaaatggggatagtgatatctaactcagagcccttatggggatgtaatgaggtaatagatgtcagtcacttagggtgtatacatgagtttaatcatcatcatcatcatcattaataccatttctgtacccccaaagtgtgtgttcaagtacttgtccacattcagtggtcatagcaaggcctcagtttacttgaatgtatttacattccaacaatgtaaaccttaacaaagactttttttttttaaatttgaccactgcagtgttctcatagaaaagactacagaacagaaaaaaaaaaaacagtttgcattgtgtaattgctccaaattgtattttcttttagaaaataaaaaataaatcactagaatcctatttaaatacaagtttaaaaattaattattttgcactagacacagaatggactgaaaaaattaggattagagtcattggtacccatacagatgtgaagaagttgtcctgagagtgagcctctggtttcatctgtgcttctctgtctccacttggctttgtcacgtctcccataaatgaccacagtcattttattgcctctctccatgtccccaccttttcctgtctccagcctaccagccatttagtggccagcgtggtctttctaagacaaacctgaccatgtgaatcccatgcctggaactcttcaatggcctcccgttacttaaaggatcaaatacaaactactttatgtgtcattttctgattctcttcctatgcccacaaccttattttctagccccagttcctgctaaatcttcaccacacctatactccagccatattatcctgttttctgtgttcttttatgccctgatgctgagtgtgtgcttttcctcttccttgaatttgcacctaactcactccatcatctcctcaagattcctctcaactgctacatcctttaagaagcatttgatacctcctgtctctgaattgagagctttcttctttgccccctataataatttatacttataaaatccatgacacttgctttgatcatcgattttttggtatctctctttatccagatcttaatctgcatgagagcaggactattttcttatctctgaatgtattttatattaatgcaaaaacaaatgcttattgtgaacctactggggaccagacacagtggataaaggtacctctagtgcatttctaaacatagtcaaaaactacatttcgaatgaattaatgaatgcaagatatccttccatgtgtcactgagacttttaaaaagaactagtttctttctgatcaaattcaatggataaccttgcagagcaagatctaactcagaatgtctacggatgccttaagcattctgcatactggagcgttttcaagagcccttctctgacctcacacacagcgaatgtctgagctctgtaggctatttgtagagagtttatttcatctttgcagaaagctgcccagtataaatattagtcagttgatttcacacagagtaaaaacaagcttttaaaagcttttacctctcctgtccccaaataggtgctttagacagattctctgagccttgggagctttgttggatttggtaaagtgaaagttatgttctgttccgaagcagccttctgtgaaggctgtcttggggttgatgctgtaattgtgcagaaaggtaaaatgaagaataacaaaggtggcgtgtggggtgggatggagatcaagcttccctgttctggatatatctccataagtccatttcaaaaaatgttcacgtttggtgccaaggtggtcacttggtattgtaaaggagtggtggcttcaaatttaaatagtctaagttcaatcttagctctattaatgaactagctaatggtgtacatgggtctcactcagcctctatgacacctgaaccaatgagtatagctagcattgtccaacagaaatataaccatggtcacaaatatgaatcacatatgtagtgggtttttttttatactttctggtagccatattaaggcaaaacaaaatgcgtgattttaatttcaatattttattcaagcagatatatcccaatatataaccaagcataattttatttacccagtatatccaaagtgttaccattcaacatgtaatcaaactgacactactaaagagatatgttgcattctttctcttgtatgacgtctctgaaatctggcgtgcagttgccatgtacagtacgcgtcatttcagaccagccacatttcaacacccaatgaccacacatggctagtggctaccatgttaggacagcaaggtgaaactacaatgcttaagctgatctagcaagctcttaaagctctctgactaggattacaatatctgcttcacagagagcaaatgagatcgcatgaaaattgtcatgcgccccaactttctcctctgaagtgttagtgtataagcaacagattaagaggataaggtgtcacaacatccttagctgtttacctaattgttgcatttctatcactggacctcaaactccatgaagtagacagtgacatcactcaatactaggtcttccgtgactagcacgtaatagatgtattaatttcccagggctacgaaaacaaagaaccacaaactgggtgacttgaaatagaaatttactggctcacagttctggaggcctgaagtctgagacaaaggtgtggataggactggttccttctgagtgctgggaggacaatctgccccatgctgctctcctatcttctggaagtttactgacaatctttggcatcccttgagttgtagaagcatcacccattcatcttcagatggtatgcatatctgtgtccacactttcccattttataagacacagtcatatggattcagaagcccaccctgctcgctactcaggcatgacctcatcttaactaattacatctgcagtgaccccattcccagattaggttacattctgagatactgggagctgggactttagtattggaatttgaaaataagacaattcaaccaataacagtatgtgttcaataaattcaagtcagatatatgaaaaaataaaaattgagtataaagataatttttggctacattgactggattccaagaatcttccattctgtctaaagaagatagacacgttaaaaatcaaacgagaaaaaacagtaagtgaagaggatgaatgcagccagtgggtagttagactatgcaaaaacaagtgcgccagaatcacaactcaacatatattaaggctttcatttggtggtgttttgaattagaaatatttaatgtcgatcagcctcagtttccttagcattatctacttcgcagttgttgagacaattaactacaatatcctaagttgcacacaattattgggccagacttctacactgtgagtatctgcaaaaaaaagaaaaaaaaaaaacattgttcactgctgtgcttcttccctctgatttaccaataagggaaacatcttccatatttccaaaaacccctggttttccttgagtacaccttgacatcatgcaaaacctcttcttcctcaagtcagccaggccctgctgtactctaagctgcaacccactgggctcagcattcaatcaggcagacgtccttaaaagatcacacattcttagctacggaagaataatatttatgcactgcttaatcatgtgaagaagcacagactctccagtctcaagtggagacattgggtgatgtataggcttagagatcctcatattgggaaagagtcagttactgatcttggctcttcacttgccaagatggaactgtttggtttcaattctgtgaacatacttacaaagtagtaggaacttcaatactgtgtgcttctgcttagttgggttgtactgaatttgtaagtccagtgaggttgtattttccctttgttctgatgagaggtctagccactttgtgtttcaactgttataatgtccatattcagttttcttattcccccataaaagttcatgagatagaaatggaggaaacgtagatatgcatcatgcatctaagcctattgttgtagctagacttgtcgggtcatatggatgaaaatatcttagggaacagtttgatgcattggaaatacctctagggttcatatcactagatatgatttgggcatttcactgagttacctggctctcagcttcttccactaaatagatgtgaatgatacccattctgactttctttcaatattgtatgtaaggcttaaaacgattatgtttaaatgctcccaataacctttacaacctatcccatgatatggtttgtcagtgtccccactcaaatctcatcttgaactctagttcccataatccccatgtctcgtgagagggacccggtgggaggtaattgaatgatggggacagttacctccatgctgttcttgtaatagtgagtgacttctcatgagatctgatgggtttatatgaggctttccccctgctttgctcggcccttgtccttcctgctgccatgtgaagaaggacatatttgcttccccttccaccatgattgtaagtttcctgaggcctctccagccaggctgaactgtgagtcaacctctttcctttataaattacccagcctcagatatgtctttacttgcagtgtgagaacagactaatataacccagctgagatattttgatgatggtgatggagaagagaatgatcatttgtcctatttacctaaagtgactacttgtttcctctgcttatttcttctatttcaagcactagagttacttccattgagaaggtaatgtcaaaatgtagcttaaattatcagctctctctctgttcttacccttcctctttccttccattcataagacaaaggaatgcataagacagctttatcttggcatgtatcattgttgcatttactctttgatttaatcaaatcgtgtttgatcattcactctgtgcttgccattccaatagtgctggggatatgctgtcctataagacagacataggtctctgcttttgagagctttacaatccagtagcctccaggtcttcagcccagctctatattttataggtcctatgtctctgtgaaaatgtcctcattgctttgttctactttgttttctttgattctgccactcagactatcagatattctgtcctaacatttagcattacaattggcctttctacatattgttttgtcagtctgtatcctaccacctggctgcttcctgctcttcaagaacatcaggttagacatcagttcttctggaaaaccttacctgataaatcattttgtttcttaaatttatcttctctgggcacataccctattgcactgtaaatctctaggctattctatgactcctgccagcctgtagctatagaggtacctgggctatgtctaccttattcaccactgtagcccccaaacatagcacagtccctgacatccaacagatactcaatacctaactcctgaaacaattgcgtgagtatcatgctcttgcccatttggacagttcattgcccttgctttctggcaatctctcctaatttcatttcttccaagtccgactatcattcattttatgacagccttttttttttcagctggcaaactatgagaggctaaaacttatgcaacacacaatgaaagacaaggtcatattttatcgtctttgcctgttgcagtaaccagattagacatctttctacaagtgaggcgaatgcaagccaaccgatatctatcatgtcaaacacctgattactatgtgcggaagaaaaagagggaaccattaaagatacatggacaagcacctgcccttaaggagcttacaacattgtgggaggtctctggtttcatgtaagaaaatcgaataattaaaaatacaggcagatgcttggctttgtgcattctttataaacaatgtaggggtggcaggtggttgctaagttttcaccatatcatgcctccacaaagccattgggttgtttagactatgtttacgtacccagctttgaaaaggggctgaagaagaaatagaagatatgttgattcatggtagtgaggcataaacttttttgtttgtttgtttgttttgtttttttaattatactttaagttttagggtacatgtgcacattgtgcaggttagttacatacgtatacatgtggtgaggcataaacttttatgatgggtagaaaactttataatgtgttataagaagaaatgattctgaattggctgggagtactggctcatgcctgtaatcccagaactttgaaaggccaagatgggcagatcatctgaggtcagggtttgagaccagcctggccaacatggtgaaactccctgtctactaaaaatacaaaaattagccaagtgtggtggcaggtgcctgtaatcctagctactcgggagcctgaggcaggagagtcgcttgaatctgggacactgaggttgcagtgagctgaggtcacaccactgcactccagcctgggtgacagagcaagactctgtctcaaaaaaaataaataaattattctaaatttatccatgtccaagattatggcgtccactccttgcactactttttatctagaatgtttatttttctcttcactagaacattctgtcatctgtaacctaatcccattggggagagtatttgattatcctttcgttagtgtgacttaatgctgccaattttccaaatctagcaagagatccttggtgacattcttagtgggataccgtagtcagcaacgttcacggcagagttgctgtctctctaagcgatttggttttctttgtatgtataaggacttcctctcttacaaagaaagttgtgtcacattcgatcgatcaatttcctcctttagaagcaggcagagaatactctggacagctatgatggaataagtcacacagcgatattatctcaaattatatctgtagggtaactgcaagtcaggtatttaaggggacagaatccatccttctccccttgtggatttggttaaatgtagtagtattagcaatggcacaagtcatctaaatttatcttgaatgtgaatttgacactgatgttactctggtggtagtagcaagaacttttccccctttagaaaaagtgggctggtgaaaggagatggattatgaaagtctgttcaggattgaggcttcccgcatacccaggaggtggagaatccctattgaattaaaattcaaaatgcatctgtctgttctttcccttacaaaaattcacttttgccaatgtttatttgcatggtttgattttctgcttgtccatatgcccttctgtccatacaagtatatctgtgacagtgatgggcagccccatctgtcactcaggaatggatggcagtggtgatggttggttggtattgatagccaagtacttactacagctgagctttctggtcttgactgtgtattatagttatgcaagaggttatcacggggaaaaatggatgaacggtgcccaagatcaccttctacattttttgaaactttctgtataattatatctctatgattatttgaaaataaaaaattaacaataatggcagtcataggctaggctctgggttcagaattgggttggtacaaatttcttcatggaaccatcatgacctgagataattttcttagcgtctcagagcctattatttatgaaatgaagataaagtcggtgcccgtatcatcgggctgtgggttgcattgatggaagttctatttatagaacatttagggcagtggcaagcatgtggtttaagcccttctaattgtattattgttattatcaagaatgttataagtaacactatcatcattaacgtgattaatctacctgggttctggatcttagggtggcaggaacatggtcttgtgcctttttgacaacctctaattttgcctaggatactaaaagactttgtcagaatgtctcaaaaatattttatggtgaattgttccaccataactctcacaaatatcacctcttatctcagcccacaaaaaaaggtcaattatagataaaggaaaggacctcattgttgccgaaagacttagatatgaggtctggatttgcacttattcacttcaagactttatgtttccttatctgtgaagtgggtgtgctgaaaatgagtttattactctagctcctgtggagatgaagtgagattatatatatatatatatatatatatatatatatatatatatatatttatatatatatatatttatatatatatatatttatatatatatatatttatatatatatatatagtgactaacattgtctgatacttagaaggtgctggaagaataccagctgttctggctgttagtttgtattaataacaggcaataatacggcatttgaagcaatttcgcaaacagacaggtgaagccctacgcagcatgcctttccagcgcgaaatgcttcagtgcaatgttaggatattctaatggggaaacttttttcagtaatgcagggcaacggtggatggttttgaccttgctctcagtgccccgaggtgctgagtgagtcagaacatgtctcagtactactaaaaatgaagagactagcttgggattcattttttattcaacaaaacattttgaatgcttttgtacatgtgtgtgtgtgctcgcatgtgtgtgcacctcagacactctttgagatgattgaggcaacagtgatggaccaaaaaaaaaaaaaaaaggaaaccagacaaggttcctatactcatagagttcacagtccagttggagatggacaccaaaatgtgtatataatgtcatactttgacagaggttttcagtggcaagacagggtcctctgagaccctggaaaagtgagaaactccatcttcctaagtgcttgatgccgttggttgggaacttcacttgttctggatgtcgctcattttttaagggctaagcacatatttccctttggaattatcacctcagaagtggccatatccaggtctctgacttgtacagagtaccataaatattttattgtcagtgacttttaaagagttgagaaaaacagcctctccattgccttctgtaactccaaatggaaaatcaggatggaacattttgcaaacatgacacctcctcactgcaagtcgaccgcccactcggttggcttgtgtttctgaggctggtgtttgtcagccatggcaagatggcttccatcctctctctgtgcttccctactgagccggagaagtgaaatgagacaagtagctttgctggaatctgtaacatggattctgtcatctttgttgtttgttggattttatgaattatggcttcagcacaactttagagttctttgttcaagagataattttctggccaggtgcagtggctcatgcctgtaatccgagcactttgggaggctgaggtgagtggatcacaaggtcaggaggttgagaccatcctgtctaacatggtgaaacaccatctctgctaaaaatacaaaaagatagccgggcatggtgacgggtacctgtagtcccagctacttgggaggctgaggcaggagaactgcttgaacccaggaggcggagtttgcagtgagcagagatcgccccactgcactccagcctgggtgacagagcaagactctgtctcaaaaaaaaaaaaaaaaaaaaaaaaaaaaaaaaatttctgtaagctggcatagttaccagaacaaaagtttatatgtttatctaaatgaggtcagatctgaattcatctccaagtatttaagaatatacaatgtaggattctgacagatttgggtacctggcactaacaagttgtgtgagcatgagcaagtaatcccacctagcttgaaaaagaagataaaaatatgcggtgtgttggattcttgttaaatgaggtaatgtaggcaaagctactttattgaattttgtatgcttggtgcttagaacaataatcagttcataattggtgtgcaagaaaagatttcttttcctcgttaccagacatcgtcatcaccatcaccattattaccatcaccttcatcatcatcatcatcatcatcatcaccaccaccaccatctttgcttttatcttcttatggattcagtaacaagaattcttcaataagactcataataagattgtgttaaaattcgggttctttcccttactaatgtacgagatccatgtgttggaaagtgttttccatttgtttagcacctcagttttcttatctgccaaaggtaccataatgaggtatgtgatctgccaaaggtaccataatgagtttagtattcactgaagtaggttagagtccaacacacatcccttcttcctgggttctccagaggaagaacttcactggactggaaggaggatcagttttatccccacagtgggacatatgtgcatacaggactttctagattataaaatacattccagtagatttttccctctaaagcatcgtaagagtctcactgtgaagaataatatatattactatttatattttatgaataaggaaactgggtcacataaaggttgaatgacttgccaatagtttcaccattatgctcttgatgcctcaatatttgactttgatttcatagtcacagcattaaaaggttagatagtaacactagaaattacctggcctatcatagtgtttttccatttatttatttttaccccaattcataaaagattttacactctgaacccattcctccacataaagttttcatgaaacaatataaactcttaactattttattcttctctcatgtgtgtagattatttcatttaaagaatgttggtatgatgatcccctacatgggtcttacagcctaagagatcagactgacagaataaaaaacacagaacatttttctccaggattgtgtatcagaactatctggggcaacttttgacagtgcccatccctggatcccaccctcagagattctgaggcagtaggtctggtgtgaaggccttggaacgtgattttttttttctttctttcttttttttttttttttgagacggagtcttgctgtgtcacccaggctggagtgcagtggcgcgatcttggctcgctgcaagctccgcctcccgggttcacgccattcttctgcctcaacctcccaagtagctgggactacaggcgcccaccaccacgcctggctaattgttggtaattttagtagagacgcggtttcaccgtgttagccaggacggtctcgatgtcctgacgtcgtgatccgcccgcctcggtcttccaaagtgctgggattacaggcatgagccacggcgcccggccggaatctgttatttttaaaagaatacataaggagctcatgctccactgactaaggacccatgttctgttgcatctatctgattgtttccagctgaaactctttaactctttgtctatttaagtttttttttcttttctttttgagatggagtctcaccctatcacccaggctggagtgcagtgatgcaatcttggatcactgcacactccacctcccgggttcaagcgattctcgtgcctcagcctccaaagtagctgggattacaggcacctgccacaatgcctggataatttttgtatttttcgtagagatggagttttagcaggttggcctcaaagtcctgacctcaagcgatccgcacgcctcggccttcctaagtgctgggattacaagcgtgagccaccgcgcccggccagttgttttgttgttgtttgtttttgagtattttctgcgttattccctaggacattaatgctttcaccagggaattgtccgtcttggtcttgtctctctttccaaggttgaaggacagaagttggcctctcagttgaggacaagagcttatggtttgtgcgaatggctgctgtcctcgcatactgagctggagtcttgtgagacagggcctcttgtcctctgtgtttatgtggttagagaggggagctgacacatccttttaaagaaactgaaagggctgcttgttttaactctcactctgtgatgcattgcagagatccccaaggtatgattggaaatggaaacgtaaggacgggcacaaatactatgtatccagattttctttccaaccttgtagagctgggaattaaaaagaaaaacctcgcccaggggccacctgaactagaacctgcaaaacagacaagcagaaaggttgaattcttccaggcggtctcttccaccctcacctcctcctctgttatacaatttaattacaactttattcacttcagaaaccccatccattccttccagtaggggaagatctctctttccatagcaaggagccttggtgataagcagctatctgtaggaacggtgcatgggactctcaaaacctctcccttgacaagcaagaaagacatgagcaaataataactgaaattattttgacatttcactctggttgttgtagttttcataataaaggaagaacaaagtacttgcagctttaaataaagaggctgcctttggcattgatgtgggatttcactggggaattttttgtatgagttcttgtttttgctcactgggagagaaaagaaaacgataagccatgaaaagacaaaagtccaaggaaaggagaaagcaagacccctgtactttttcttgatagcatttgtcacccctggaatattgcggtcatcttagtatttattttttgtttcttgaagtctgctgctgcacttgactgtaaggtctatagggacaaagatggttttggattttgcttaccgttgcattaaatgtgaatgaatgaattcgtttacataatgtgtactaggagccaagccctgtgtgtgtgtgtgtgtgtgtgtgtgtgtgtgtgtgtgtgtctgtgtctgtgtctgtgtgtggtttttggtgatgtgatttttaattagatccttacaataatatggtgaagctactcatcattggtcccattaaacagaagcaaaaactagtgcttggagtatcacaataacttgtctaagattacacagccagtctgcaaaagagctggatttcaaaatcttccaagtcatcatcagttatggtatttttaagatcgatttgcagttaaccacacagctttattacaaattcatgctctcttgatgtactcacagtatttttcaaaatttacctattgctatctctctatctctttaaacttttttcatccatcctctgtctcttcccttttatccctgaatgtttgccctcccctcttaagaaaaaataagatagtagcaagctccctgctggattttataactttgcataccatatatttagtttagtaatgaaaaattccagctccaggcgatgcatagaatcgcatttctaatgttttttaaacagctattaatgtggtcgagcagtgggttttttttttttttcccttcctcctctatataatcatctgctcagtggtgcgctgtgaaactgagagtaggagccagaggaggagcaagctgtgattgatgggccaggccttcctggcagaaaaagtgccatctgggttggttttgggagcagtcagatgttgagggggaggtcagccaggcggcctcagccccccaccttcctcaacaccccgatcatccacacattgcacagcgcgcacaccctcgctcgtaattgaggcgtgcttggggcagatgctttgtggtgtgggacaagaacagctgctaagtttatggaggagaaaggaagcaggatggtgcagcaggtatttttgtttttttttccatttaatctttcactcaaaattgcgatttgaatgaagctgaaagcttttcttgtgttaagtccgtgctgtcggtgacacgtagcttgctgcttgaatcatgcccggggaaaggagaggagttttggtgaagagagtgtgtgtgtgtatgtgtgtctgtgtgtgtgtgtgtgtgtgtgtgggcgcgcgcgcacgcgcgcacgcgcgctttctgcttgatgtgtggaactgagctgatcttagaaccagcaggttaatggtgtccttttgcatttttcttctttgtttgaatgcccctagggcatgatgcagtttagctcaattcacttctgcacaagagggtttctctgaatatgcgcgatttcttgccagagaagtggtgtagaccatgctcctaaactaaagtaaaacaaactgtcagcaagactgaaaactgcaagcaaccatcaagaatggatagttttcctccagtgagtccatgctggtggggggtcccactgcaggagccgctgctttcctgggctgtgtgggcatatgtgatcagctggcttattaggttttgacaattcctgtgcatgtcttcattataagggttgagttaaggccagaggaggttctccacagcaggaaataaactggggacaagtaaattccagatgcagaaagggagggtgtgctcaagaagtttgactataaaggtggggaaatacaggtgtgtgagtgtgcacacacacatacccacacaggaaaatgcttgcctattttaaagtccacctggacggctacgaaagctggtactttgccttctcagtgaaagtcaggtagttacatggaaaagaatagacccatttcctgttcggccacttaaagattctttttcagttgaaatacggtttaccttcaattttgagccaaaaggttttgcaaaccctgactggctaccactcttgtttctcttgttagtttctcaaaactactttattaaaccactcagggcaacgaatgggagaagggcaatgtcttggggaaaaaacaacgacaacaacaaaactctctcatcttattttctctctgactctgtctcctgagtccacttcagagagaaaattcagggttcaggatatttcagggaccaaagaaattctctgagcatcagaagagtggccctcttattgcatgcatacaagagtcaacacactatgctaatagtcagattacagtgtttgtcttaaaatagcaatgatagccaggctatttcatgcttcagtaaaatatttaaattgaaatgacttttttttttgcttttatgaatcagacttggttgcattttaataatccttttgctcttggtaactggagtgaaagctacacgttggggtgtcttaagtaatgacaggtttccatcatcctgctgtcgttgagttgctctcgttgactgagaggtttggtgactgaggacaaggaagtttcttctctgtttatcctaataaatgttgtttatttcaagcttctagtcagttgtgcagcagcaatagtgggtcttaaagcgtgagatcttggccttctttcatcctccttttgtgtattgagcaacaactcaagaaagtccaggcactgaaattaaacgttaagtttgcaaaagctcctgaagcatttgcttgatgatgtggggaacacttgtgaggcagatcatcctgctcatcaactaggaacacccacaagcaccctgactctgcagatatcagaagctctctctgatcattccacttatttagggaaaggtgggggtttggcattggagtagaagaaagaaggcagcttctgcaaatgagggaatgtctagccagaatgctccaaataattttgcctgtcactgtcccctacatgaagttggcttcagcttccaacccaggagcctgttcgcgtgcctaggatttgctgtgacctggagtggaaaaggtgcccttaatgtcagtgtatttttccagaaaatacatttcagccaagctaagaatccaggaatgtcactagggaggaaacaaagacatctctggagccatttgaaggtgaaaaataattccataggaagtacaatggtcttaattaaatattagctgtaattagcctaaagtgcaaatgttgggaatattaattagggtctctctggaacggctgtcagtgttaataagtaactgtagggggtcccaccaacatctgtttgagaactccaggtacaggatgaaatctggagtcccatgttcctggatgctaactgcaggctccttggctaccatggactcagtccctagagcatggtgctctgtgtttgccagaattgcacaactcatggtagaggtgggtggcttgctttggcaccagtggtgcccccagctggcccttgcctttcctcggatagcctcaaggcatttcaaagtcaggcgtcaggcttgaggtagtgcagaagtttcccaggctgctgccccactcctttcgaatggtcacccacccaacctggccattggaattgctggcatatttgaatcaaataccctagtccctggcttcctcacagggagtaacacaccaacagctaaacacaggtccatggtgtgtgtgatagagagggaactgcttatttaaaaatgggaagtggacaggcgcggtggctcatgtctgtaatcccagcactttgggaggacaaggcagatggatcacttgaggccagcagttcgggaccagcctggccaacagtaaaacgccgtctctactaaaaatacaaaaaattagccagtcatcatggcgggtgcctgtaatcctagctactcaggaggctgaggcaggagaatcacttgaacctcggaggcggaggttgcagtgagccgagagcctaccattgcactccagcttgggtaacaggagcaaaactctgtgtcaaaaaaataaaaataaaaataatgaatgaatgaatgaatgaatgaagtgaactccccaccaggtgattctcttgctagatgagaaatgccttggtttaactcttggcttccctaacaactacctgtgactgtggcctcgaataattatttcccagctttggtctgcagcatctttgatgacaaggtaaattgagattagagatgcattgcatgaaaagtagggattctggaccttggcactattaacatttggggcgggacagtcttttgtggttcaaggtagtcgtatactctgtaagatgtttagcagcattcctggcctccacccactagatggcagtagcacatcctccctcatttgtgacaaaactgtctccagtcattgcctaatgtcctgtggggagcaatcacacctctgtaagaactaccggtatgaggcgcccagcacagtgcctgccacctattaggttttcttctgaggaccagtgaggagaaggggctgcttttcatggaagtctgaggccatcatgaaccttctgctcataagcccacttatgcagatttaaagcctgtgtgcctgtgagtttacaggtcaaagatctgcggatggaaagtaaattccccaaaagattctgacccactgtttttgcaccattttcaatattgccagtctccaagtctagctatcacccctctttggtttggagagtatacaggccctttctctctctttctacttcactgcctgctttatttcctgcccaaactacttatgcaataatggcttcttaactggtgatcccatatctaatgacattctgccacagctattagaaaacattttccacaaaggaccagatgatagatcattcagtcttggtgggctgggcagtctctgtcacagctatccaactctgcctttgtagtacaaaagcggctacagacagtaaacaaatgagcatgggtgtgttccaataaaactttatttacaaaaacaaaatttgggccaggtttgcctcatgagtcgtttgctaggtcctctcttcatccccctaccctatctcctgctgccagactaggctttacagagcccagaggtcatttttccagcacatattcacttggcaaacatttataaatgtccactttgcagctagtatgctgttggaccatggagatgggacagggaatgtggcacagtgtcctgttttcagggagctcacagacaaataatcaggctgtggcagtgcttggtgctgtgtgagctgtggccaccagctgcagtggagcagaggggatgggcaactgaccaggtttcagcatcaaggaaagcctgctggaggagggactcttgatgcggactgaaggaagagtaaggactagttgggcaagggggtaggtgaggctttccaagctgaggggcagtaaatgtgaagacttgatggggttgagaggatggagctcttctcccttaactgaccataagcttctggaaggcatgacccttctctcttcaatacagagatagctcgaagtctacaaggagccttagctcttttgcaagaactagtaggaatgggccacttttcctgagcttgctctgcactgatgaaaagccccagggttatatatgttcctggtgaaagtatattctgctggaggtggaggagggaaacctttgtcttcatatgatcattgtctgtaccactgcttatgtggttattctgtgcttccctgtaagagtttacacaagtctacctttcacttcagagatgggccaggtagaaggttggggaggcagaaacagatctttgagcagaagctgcctctggcacagtgaatttctcatcagatgattcccaagatcccaacatttctggggcttttcatcacccatagagaagtggcatcgctatgaaatttctgtacagaaggatatgttccttgaacagcccagaaaaagaaaagatgctagtttagttataaaacagcagaagtttttttttttttttaattagtcaagacccttttggttgtaagtaacagaaaaagtagcttaaaaaatgagacaaagggtacaaagtgtcagttttgcaagacagatacattctggagatttaagtacagcatggaaacaagagttaaaaatactgtattatatactggaagtgtgctaagaggatagatcttaaattaaatctctccacacacacatacacacacacacacacacacacacaaatggagatcatgtagaagtgatggatatgctaattacctggaatgtggtcacttcacaatgtatacatatgtcaaaacatcaagttatacaccttacatgtataatttttatgttaatggtatcttagtaaagctgttaaaatatgggacatttactgacttgtgtaactacaacaaacagggatggtgctgactgcgggtaaagctggattcaacacttcaaatgacgtcactgggactcagtagaaacctctctgttcctcagtttcttctcttcattttcctctaggttggcctcacgtgtagggaggtccccttcaagtggcagttcgttgttgttgttgttgttgttgttgttgagacggaatcttgctctgtggcccaggctggagtgcagtggtgcactctcagctcactgcaacttccacctcccacattcaagtggttctcctgcctcagtctccggagtagctaagattacaggcatgtgccaccatgcccggctaatttttgtatttttagtagaggcagggtttcaccatgttgcccagtctggtctcgaactcctgacctcaagtgatccacccaccttggcctcccaaagtgctggaattacaggcatgaggcaacatgcccaccctaagtgtcagttcttggcagctccaggcttatgatgtttttacagctgcccatcaccgtggaaagagaacttcttccccaaaactacagcaaaatcccagggtgactgggactcagtggtgtgactagggcttaacgcactaacggactcactagatagatgtgcatgaacgcaaatccatgggactatctcagtgggaccatctgattggccaggctgatgtcctatggctcatctcgtagcgactgggagctgggttcaactgtatctgcaccatacaggctgaaagtgggactgtcccccaaaaggaaactggggctttgttgaagaaacaggagtggagacagaccagcagtatcactgcatgtcttctttggcttcccaaggatggacaaggttaactgctcatggatagcaactcagcctcaacataggcacaccctccatggccccagtgctatgggaaaatgttagaaagagaaagaaatgctcgtgcccttttgtttccagtggcacagacatttggcgaaatttgtctggaggagggaagagcctgatgggaatgatttacttgtaaaatgtttaaacttatcctaagcttagttctcttccaagtgtcatctttaacattctaattaaggtcccttctaaacaaatgcaccagctccgtgtgctgctctgagaacaaactttttttttttcctctcttctttctgtcatcatgtttttgctgcactcaaattgctttagagaaagaggatttcggatgttggtggcaagtactgaagagataaggagaaattctgatatttttgccctagtatcattatatgagggccaaagtcacatctaattgaccacagacaataggagaggcagctatttggtgtgcctaattgctaagtttttttcctcgctctgtctttctgactgtgtgatcccatctcctgagaccatggaaagtttagacctttgggttacaatttcttatgccgtgtgtgtgtgtgtgtgtgtgtgtgtgtgtgtgtgtgtgtgtgtgtgtgttgtggtagaactgtggaggaggaggtaaagagagagagctgtttcctgaaatggaagcatttgtattcaggtttttgttgtgtgtgtttttaaaattcttctgagttggctgtaattgtcacactgcctgttttgcctagatctgaagaatgaattgttatataatactctgtgctcataaaaaaataaggcagggagggagaggcattgactaatgagactgagagttaaatccaatatttttcagaaatgcttaaaatggggatgtcagagaggacagtctttgtccaaattaggccctgaatttgtatcagctgcttcattttggcactggggacatcatacacgcatacacacacacagacacacacacacacacacacacaacataacacacaaccacacagacactgggaccattaaaaggatactccctattcccattatgtgagccaagtcacataaaactttgattaaattcaaatgcttacataaattgtctctcctctcaagaacacacacgttcaatttagtctctcttggcactttaagtatcaaatcaaggttctgctgtcactgcagacaactaaatgctcacagcttccaaaatgggaatgaaataaaaaggatctgccaaaaaaaaaaaaaaatcaatctagtaaagccacagaccctcatgtctttgaatattaggctgggtggcttggaaaaagcgactttatctttatctttccaagcctcggtttctgcatctgtaaaatggggagaagtgatggttactgtttccttatagggtctggtgaagatgacctgagattggtccatctcaggctggtggcaccatggtgacccctagaaagtacgcggggcacgatcgtcctgggatctgggaggaaggtttctgcatggtggctcctcatgacgttctctccctctctgcacctttttgatttttcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacagtaagtggacgtgtttgctacgggtgggaggttatggggaggcgcccccagccctggtaatggcagcgggggtgcacccccatctacccagggactctgggaaacagatcagtccctaagcccaccctcatcataccagcttcctgaagtttacctcatttccatgcattcattcttagcgttcatttaaatcaacggattattaattaatttcatttatttgtaaaggggcacatttatcaattttctattcctatagttttgcctttctagaatgtcatcccaatgaaatctcatttttttggaaaaaaaaaatttgatgtaagataatttttcttcaagtcttacggaggctgggtgtggtggctcatgcctgtgatcccagcactttgggaggccgagatgggagagtcgtttgaagacaggagttcgagaatagcctgggcaacaaagtgagacctcatctctacaagaaatttaaaatttagctgagtgtcatggtgcatgcctgtagtcccagctacttgggagactgaggtgggaggatggcttggggccaggagtttgaggctgcagtgagctaagattgctccactgaactccagcctaggtcacagagtgaaactctgtctctaaataaacaaaaataaagtctttgtggaattataatttacataccttaaaattagtatatttttaggtgtacagttcactgatttttagcatatttacggagttgtgcgatgattgccggatgcatctaatttcggaacatttccatcagcctaaatacaaatcttgtgcccctttgcagccactcctcattcatacctcagagctctgaacctcgcttctttaccttagcctaatacatttgagattcatccaggttgcggtgtttgtccctggtttcttcatttttattgctggaccaaagggcaggggctagaaagaggcagggtgagagaattttgatgaataagggaactgtcctgtatcttaatggtgacggttacatgactttatacgccataaagagtaaattttattgcgtacaaatgatgaaatggattagaaacaggcatgtaaacagaaacattttatcatcactgtaaatgaaaactggtgttttgatcattaatcaaatataactctaaatgaaaatatttatcataaaattaaataatgttcatttgtgtgccacctaaagtaatcatgcataccacaaaacctgtatggaacatgcatttgggaacctttttctgcagaattctttagaagcttgggaaccccaatcctgtcgtctggaacattttttgagtgtaaggcaattctgcctcttcgtcctgtcccaagacctcaggaaagcaagtatttgtgaaggagtttatggctttgaagcatgatacatttcctgtgataaaagaaaacactgactaactttgctacttgccacctcattcatttggaggctagttttgacgttttgtttttgtttttgtttttgtttttttgagatggggtctcactctgttgcccaggctggagtgcggtggcgcgatctcggctcactgcaagctccacctcccaggttcacgccattctcctgcctcagtctcccgagtagctgggactacaggcacccgccaccatgtccggctaattttttgtatttttggtagagacgggatttcactgtgttatccaggatgatctcaatctcctgacctcgcgatctgcctgtctcggcctcccaaagtgctgggattacaggcgtgagccaccgcgcccggcctagttttgaagattttttaaaaaaatggtatacattctgaaatttttagttgccttcctccctttttaatttattgtggtaaaatacatataacataaaacttaaccattttaatcctgtacacatttcaatagcattcagtgtattcacaatgtagtgcaaaaccaccaccattatctagtttgagaatgttcctagcaccccaaaaggaaaccccatacccactaagcagacactccccattctccctctccccggcccctggcaaccaccaatctgccttggagatagctttttgtgtctggcttctttctcttaacacgatgttgtctaggttcattcatgtggagtaccccactgtatggatagaccgtgtttatttattcattagtccattgatggatatttgggttgtctccacattctggttcttctgaacactcctgctgccgacttttttgtatttagttgctgtgccttaggcatgggccttttaaatgagtttgctggttcagcaggtgtttgttgcttttgcgctgactaccaggtagtagtgatggggatgttgtttactgtttgttggctattttgtgacaattaatagtagtaatgcctggataggttattttcagattttgaaaaaagatccaatcagacattatttattaagctaactgctgtggaaattttacgtattcatttatttattcacaaatatttattaagcttctattagggccaggattcatactagctgccatggttgaacaaaacaaaatgatctttacctcttgtaacttagtatgagaggcagaaactgagcatgtggcaaatagcatgtgtgatagatgtcttaaggaaaatatgggtaccgtaggaaaattaaaaaagaacagaggtgctacctgcaaacgtgtagtctgagagcatttcttcaaggagatgatgcttaaggtggtaagacaaagcagcccaggcagagggaataccacagtcagaggtcttaaagttggaaagatctgggctcactcaaagtcctaagaagaggccagtatgttttgggcatgatgaaggggatttggaggtgatgtggcaaaagatgaaccgggaggaattagcagggatttgacatcctacagacctggtgggtccaataaggagttgaaattccacgttataagcaatgggaaaccattaaaaagagtttaagccagaagagttatgaaatgagacataaaaagaaagggttagtgatgcctagcttaaaggaaatttaatctagttggggagctgagatgctccacatctttgccctgcaaaaagaacactttagagatcaacacaattgaatttaaatagcgtgttgggtgtccacagtgccccaggcactgcagcaagataatctgatgtgcagacaagctctctttccttggagagccttaggagaatataggatttgttttctgttaattatgataacgtgccaaattctagcatatagattttcacaggttttatctatcataatgacagtaggagaaaacattttcaaaatcatagtcagagggttatacctttcagagacttctggttacaggaaagagaaaactcagtaggaagcatgttggcccatacaataaaaagtccaggcggagggtggacacagcctggtttttggaacgtgtccatcagcttctaatgggaaaccatcctgagttggcttcctcgtcctcacctcagctctctggctctgtcctgcaagttcaggctccagtcaccacctgtgaaaagctcttggattcatcccatataagccctctcgtgggaatcaatctccattcctggcttgtgtggtgttatcttcattcagtggctgaggctggtactgagtgtcccagccctggggtcactgaggagcttcatatccaaatacatggaatgaagaccatttcatcagagttcatgatgagatgccttcagaataaatcattaaagaaacgaagtagacagaatcttgtccgagctaaaggtagcatggtgaaccttttgtacaaagaagcttgaattggtgttaatcaagagtagggagtgaagagaaagacaaggacagaacattggagagctcacggggtggggtttgaaggaagaggaactattgagtaagacatcaatgggatgttcagattgggcattcaaccagttgaatgttgggctatacagcctggagggtataaactgagaagacattattgaagtgacagtttggatgtctttaaagacctagaagacaatagttttgctagagtagtggagagagatgcagaagggacaagagttgaggaataactgtgatatgttggagtgggtgggcattgcccgttataaatatttggagtgatgaggagaaagaagagattgcatctgagaagcaaagaagtcagagaaagcagttggtaggatagttgatttagattcaactaatttatgccaacaaggtccctacgtggggcacaaaagacaggaagcaagagatagggaataatggtgcaggaaagaaagtgatgaagtgttttataggcgataagaaggaataggatcaagagtattcagaaatagtaggtagtctaggaaaaaagaaaccactttttaacagctttgttgacatacaataaactgtatatatttaaagtatacactttgatacatttttacaaatgtacctgcatgcacaaccattactgctatccagataatgaatctgtccattatctcaaagtcttttcttgctcttttttgatcctcccctcctcctccttgcctcatccccagggaaccagtgggtctgcttcttttgctatagcttaatttgcagtttctagaattttatatcagtaacctcaaacattatgtgctctctttgtctggcttcttttactcagtatcattatttttagattcatccatattgttgcatgtggttgtagctccttccttttcattgctgagtactgtttctgcatggatatgccacagtttatttctccatttacctacacatgggcatttgggttgtttttcattttgggtaatggagaaataaatctgctgacatttggaagtacttcaattttgaaacagaagagaaggaagggtgaatgtgtgaggatgcagagaaattttcaagtcaagagataatgtgaggagttccatctacattgccttcattttttccatgaatggaggcagcatcatcaaaggaaggattcctgaacttgggcaaacatgtcagaaatctgccttagataattcctagagtatttgaatggcaatggatgcccgaatttggagaatgtaaatgtatggtggaccggttagctgtctactctgtcttctccagcaatgtttggatggtacacactcttagaggtaggattttaaaggaaagacagccattaggggctgaagcaggtgggctttggggctgatcctgaaggaagttttaagacttatattctgaactggtattgggtaagtgcgggaatcataaaggggctgtctcgttttttgttacaaacaattacatctgtatactcatctctctttggccaaaaaggagatgtgacttttcagttatcctttcctgatctacaccagcagaacgtggtctatgacaagtttacttcaaattgtctctgcctcctcctacatttatggggtgtaccttgtcttcactccaggttctgaatttcctgtggaacgaatttaacctcaaagtgggtcagaactatggttctccccaccctatatccatgaccctgtatttgcacaaaaagttactattgtgagatacctaggtcattccccataggatagtgctgtacctggaatagctctaactcttctttgacatatgtatccacgatgcttaatatcattctaaggacatcgtagaggccattatttctttgagaaactaagtacttttgggtaagagaaaccagccatccatctggtggcctccaagaacatctaatatatgcacatgatttaacacaaagtgcagaatctgtaaaagggaaggaggatgcacccagagctcccaaccagagctcagtaaaatgcagacagaaaagacttaccaggtcatccttttagttccccacaggctgagatgagtccctgcaggcctttttttctgctgaatttctatttcatgtaggcctccaaacatatcacggatcacattgctgacagagccaatactgtattatgttagatactgttcctgacaaggtattttactcttgacatattatcattagagatttgcaagtggtgaattctccatgtatctccaacagcaacttaacttctatttttaacgcttctgcagtctgttgaaacggctcccaccactttcccactagctctaggccctgattggagaaggaatgtgggtgccccagctaggttcctgagctggaggctctactgacagggaaaagaactatttagagagccaggttcttctttggcctcagccgcttcccactgaagtgttaactgcgcctccaaatttccttaatacttttaggaagataaggtattggttggtgatggtgtcctgttcttaaccctttccatgccagttctgattttgaagctgatggaatcactaaggtataggaaaaacttgttcagggcattccttttgactaactagctattattattatcatcatcaaagcaattcaggcttggggtttaaaaagccagacattggaaaaggatataaaatgaaaactaacatgtcctaatacccacaacccaaattcttagtctctgtgccagaaatgagttactaataccttatatttccttccagaagtgttttatgcaaatgcaagcatatgcctgcttgtcctctatctctatctttatctccctctatctctatcatctgtctctaattcaatctttatatcttataagtactcactatttccattctcaaaattacagaattgaaatctaaacacctactttggcacctgctttatatctcagagattattctgtatcatatttaggggttcagtcattattttgtgtgtgtgtgtgtgtgcatttttatgtacagaagtatcctaatgatggaatttaggttgtctctgggtttaatcttgcactgttgatatttaccatcaggctacagtacagagctaggtacaaagattgctctccatctctgtttgcctctgggtgtgaatggctaaaaggtacatggacttaagatgtggacattgatcaattaccctacagagagcttgcaccgatttgcaccctcatggacagaacctaagaaggcctgacacccacacccttgcccaacccaatgtgctagccaactcttggctcatgtccctgcggactctgtgtgtttgggtgtggctttccccctctctgacaaaagaaagtacttttagaattgttgggtgtcctggagaagaaaaattgaggtgtgctgccattgcttgaggcctcctgtggtccaaagatcatgctaggccctcttttggtcgccatcttgttttgttacatcaaccttttgaatgctgttagaatcccaccaataaagggagaaagaggttgaagatgttttgagttgggaatggtgcagttgaggtcgtcacccacatcttgtctgcctgatgttaaagtccaggctgtttccccagtctccagctgtcttctaaaataggggtacccaactcccaggccacagatcagtactggtctgtagcctgttgggaactgagctgcacagcaaaaggtgagtggtggatgagtgagcattaccactttagctctgcctcctgtcagatcaacaatggcattagattctcagagaagcgtgaaccctattgtgaactgtacatgcgagggatctagattgtgtgctccttatgagaatctaatgcttgattatctgaggtgcaaccatttcatcctgaaaccatcctccctgccccactgtgtccatggaaaaattgtcttccacaaaactggtaccaaaaattttggggactgctgccctagaggatctcttgaccaatggcttagaattctcatgaagattggtttcttcgtggctgccctctagcttagacaaacaggtcagttaaggcctggcctctggacttgacaagatttgaccctccattctgcttacaagcggaaggagctcaagctgaccattgaacctctctgctcttattttttctataactcccttcctcagctgtgacccttctccagatctcctcccttttttcttctaaacaactatcagacgatggattacagaacaacagagttcttttcctttgaggagggtttacgcctcatgtacttacattgaaagtttggcaaaataattgaaggttgccgtctaaaaatagggtgaatagttacatcgaaatgagaatcaggaaaaagtctcaaaaatcataacttttgctcattgactgtcagactatattttaagcactttccatgcacaatctcaactaatcttggccctccccaccacgtatgaagtgttatcgtcccatgttacagaagcagaatctaaggcaaatcacttactgaaggtcactgtggctgagaagcaggagtcagagctcaaaaacaggcatgtcagaccaaaattcttaagggctggaagcccagaaggcatcccccaggcatgcccagccacactggcctcttttctaaataggttgctgttgcagaaaggaattactcatttcaccctggggagggccccagcagacccaagcctgtgcaacattacagacttcgagtgtgctcttgtttgagacctgcgccttgagcaaactccaataacatgtttcggtggcttcaaaattgtcttttcggatgacagtgtgactgagctgttttgtcaataccagttctattttcctaaaattcacatttaatttgaagacatgggtactgtctcttgtttccttaggagcctgagcactatgcttctcactcccatgtattctctgcaatacatggcccttggctttcaggataaactaaagacctttattacccaatactgtgcctgttttattattttaaagaccctggtcatcaaaaactgtctagtcctggagagccaaaatgaatgatttatcccaacttaggataacttggccaggaacaggatatctctgagcatcaaagacccatgtgtttgacgttcttttttggactggggtttcagcctcggattttggcagaattggaggttgttatgacaggtgaaaaaaaatggcgttggttaaatatctttagatattatcgggagaagcagagtagaatctaggtacagagcttgacattttcattcccattctgtctgacccagagtgggaccataggcacgttacataacttctctgagcctgttcttttttatatgtgaggcttagagttgttgtgaaatcctaatacagtaatgtctatgaaggtcttagcacaatgacaaacacatagtaaacattctaccagatcgaccatcctaattatgaaataattacagtacccataatgagaaatcagagcggtctccttggttccgagttcttcattaaaaatgttttatccaggagaatacattcatcataagaattgtgaaatttcccgtttcaagtgccaaactaaaactccaattccgagatttattttaaaggtaattttgtatttaatgatttatagacaaatggttttcaatcactcatgttttagtacaaactatcagtacaagctgttcttggtctaagtctaggtcgtgggcaaacaaagtgagattcattagagaaggaaatgactgaagttttgtttttaagacccaaggacatcttgcttttgctaaatgaggaatgctcaggcatattctaagggtttgatttaatgtttccttagggggcttcactggcttatttccattgcaaatattagagccatctgacaagtttcatcgtgactttgtcctcatttggtgctttgtgcttattcacacctgtatttattgtcatcagtttacccactcaggatgactaagcagtctctatctttatttttggttaggtccttcaaacacccaaatccatcctttctgtagctcatagagactgctagacaaaggactgatgtaagtgtttgaaggacctaattccctctgcatagctgattgccccattaagcaattttattttatttatttatttatgtgagagaggggtctcactccatcacccaggctggagtgctatggcaccatcttagttcactgcagcctgaaactcctggggctccagtgatcctcctgcctcaatagcagggtactgagctcagtagctcagtactgcctcctgagtagctgggactacaggtgttttccagtgaacttagaaataggcattaatctattttgtgggcagtatttgggtcatgcattagtcaacagtcattttatgcccttaattcatggtcatatagtctttaggtgcatagtaagttcctatgaattccatgcaatttttgaattcaaggctggaaaaagaagttggctattctctgttgacagaagtttcaggaatggctcagccagaaccttgcaatgctagagctgggagagccaaagagttcatctacgctatcttctcgttgcacatatttaaaaagatcacataagttatgggttggaaacggaaggccaggcacagtggctcacatctgtaatcccagcactttgggaggccaaagcagatggatcacttgaggccagtgattcaagaccagcctggtcaacatggtgaaaccctgtctcgacacaaaaagtacaaaaattagccaggcgtggtggcgggcacttgtcatccccactgctcgggaggctgaggcagaagaattgcttgaacctgggaggcggagcttacagtgagctgagatcatgccaccacactccaccctgagtgacagaatcagactctgtctcaaaaacaacaacaacaagaagaaaaagaaaactcaaatactttcacatccaggcaagtaacatccatgcttagagagattaacttatgttggagacattggcaaaataaatttttagttttctccattaaggtaggcattacaaaattacaagcgtgatggtatgcaaccctttggtggggaccctgtagtaatttagcaaacaaatttcctgtccacaggatgtggtccctatccatccatccaatcattgctattttggattgttaaaccactattataatttcattgacatatttccactgcaaatgtttagatttctttcttcttaagaatagcagcaatttttatttttctgggttctcctgttcactactattttattcatttttgttatctgtccagcctctgaagatactgaatttacaacttctgacttaatcttggaaactcaagaggtgaatttaggctgggcatggtagctcacgcatgtaatcccagcactttgggaggctgagacgggcagatcacttgaggtcaggagttcgagaccagcctagtcaacctagtgaaaccccgtctctcctaaaaatacaaaaattagccaggcatggtggcgggcacctgtaatcccagctacttgggaggcggaggcaggagaatcacttgaatgcaggaggcggaggttgcagtgagctgagatcatgccactgcactctagcctggaaaacagagtcagactccatctcaaaaaaaaaaaaaaaagtgaatttaggaacctgaaccctttaagggagactgtatttcaggttcataaaagagacagcttggatgcttcagtgtgacagtgcagagattcatagaatgttagagcttgagatgactatcttatcttcctgcttcatttacgaatgatgctcaggttcagagacagaaagtgacctgcctgagtcacacagtgagtatcacagcagaacccaatgtaaggatgtcctaagagaaaactcccactgtaccatgcccttcctctgtccatctcctggattctacagccatttttaaaatacacatacccggggttatctctgcattgaaatagacaaagtcccaatgacactgcctttagaagcacgctgagctgtacactgtaagtctctgtttctctttgctatcctattttggttcctagccagaggtttcagccacaagtgggccttattctcacaaagacttccagacttcttaaaaaaaaaaaaaaagtcttcattttatctagttctctcctgctgctcctggtggttgtatcaatgggtctgtgtgaattcagcaatgtcatgcgttcctgccagctccagtcccaatcattacttctgggtcaggacactaaccagggggtctgggtttcttcctttgtatccccgaagaatgtggagcctgccaaattgtcaaattatagcatttgatgtagagctaggtccaagtgactgtacaatctctgcaggagttcagaagctggcttctgcccctggtagaaacataaccagactctcaagagacagtaagccagacagtctggagatccagggagatgctcatgggttctctggcttctgggccatggggagaaagtcatcaccacccagaaaataagccttcaccctgacagcagcagcagaatgtacctgggcttgaggacctgacttgcatgccatctcagtgtccttaggacagaagttccacgggcaagttctttcagcagtaaaccaaggttttcagcctgtaccactcaaaacaaaccagaccatcaggaccagttaatgtgaaggcttaaatgttgcagatttgttttgaaagtgaaaaggcaattttcttgtaaaaataaaaaaaaatatgtagagttgcaaatcatacaatccaaacaatatgggctgccctgatcttttaaaagggagaaatgtaaatgcccattctgattgtcagatgaggaacatcaaatagaaacttcttgggctgaaaggaagttacaaaagaggaagcagcgatcatttatggataacgtatggtaatgatcactagcatttagtgagctcatactgggtacccagtggaaatggtactaccagctttctgtggacaatcagattgaatttttacagcatccagaagaggcagggactataattaaccccttatggcctagatgagaaaaccagaacatagagaaatcaaggatgttgcccaaggtcacaaggctgataagggcagagatgggattcaaaggcagccacggtccactgtcttacccagtccatgctggggtcttccatgagccatgcactatgttgtgtatttcattgacataactcatcaagaaataggtgtgatcataccacgattacggatgagggaactgaggcacaggtatgaagcaaatgtaaacataggcctggcagattccaaaacccattttgtgtgattaccccgttagtagtttattttacctaaatgacattccctgctaactatttcaattatgataatatcattacaggcaaatatcttaacaatcctgcaagtctgtagagctctcaactccctcaatttatacaactaaacccacacacatccttcccatccctaacccatccccttccccagtggcatccagtggccccatagagtgaaagaggccttcataccatttggcaagctcacaagaggaagcctggatttcccagagaaacttgctacaaggaaattgctataattataacccaaattgtatttgacttctgcatttttgctttatattgttacactataatttaaatagattgttctctggccttttttagggggagaaactagctaccttttttttttttttcactaagaaaagcaacggtaggtgtagcattccaatgacaggaggtgggtttcgtcccccctcttccctctaattggcttgcaagtgggagttgggttagcagttatgccgggagttgcctggggttccaggcggtgacattcatctggtggctccacaaaaggggaagagacaacagtgggtggcgccagcttcggggagatgagccccagagagtttctgtgactccagaaggcagatgttggggacgaggggagatagggtatattaatcattggatttgggaatttttcctcttttgagacattgaagctcttgacagagaagaccagaggggacctaggaaaagggaggacgtgagttggatgcgcaccctggaatacagggcgttggccatctttctccttgcctagtctagctgtggatggggcccagagccccttagcagctcttccttttctctcttctctccagccttctccaggcttttaacatcagcagaagtagcaaggctaggagttggcaaactgtagctcgtgggccgattcctgcctgcgatgtttttgtcaataaagttttattggaacacagtcacactaactggttcacatattgcctatggctgcttttgcatgatgacagcaactttgagtaattgtgacagagctcgatggcccacagagccaaaattatgcttattgtttgaccctcaacagaaaaagtttggcaacccccgatctaggccaaagtgtacatattgttggcctgctggctgcattcaggcatcgggccattttattggactcacattaattaattgcctgcattgtaaaatggaagttttcacaaaataagctggctttgattaaaaaatggaaaaatctaacaaaacatggcagctaatgttggggatgtgtcatccgtcccctctgactatttgtcatagtcgccagcactgcctgtagggttttaccaagtgtacccttttacctgcatggactggtcctcataggcacttgagtatgatactctttcaggtcgtctgggttgtttttaataaaagatttggtatttcttactggactgatgaattacattttaaaaattctttccatcaaactggacttccctgtggaactccagaaagaaaatgaaaaatgtgtttgtgtaatgccagaatttagtgactgccagagttgttatatcagaaatacaacattttcttccaccttgaaacacccatacacatacacacagccctgcattttttaaaaaaaaaatcctttaaaattgagacctatgtcactgcagatgcttcttgacttatgatggggctatgtcccaataaatccatcacaagttgaaaatgcatttaatacacttcccctactgaacatcatcacttagcctagcacaacttaaagatacacagaacacttgtatgagcctacagatgggcaaaatcatctaacacaaagcctcttttatactgaagtgtcaaatatctcatgcactttattatgtactgtactgaaaggaaaaacagaatggttgtatgggcactcaaagcatgatttctactgaatgtgtattgtttccacatcattaagttgaaatatcgtaagttaggaatcatctgtactgaccttgatttaaacaaaagcaggattagtaaatactacattcttcttcagtcaaagaatgagtttctcagttgttattattaatagagcaagtaataatggtgttgggcaatatattaatgatttaagtcaattaattctaaaaccaatggtgggcgatgttacctcattttaaagataaggaaaagagactctaaacggttgtgtaaattgttccaaatagtggcaccaggaagtgatagacatggaactcagatccagccctgattcatgtcaaaggtcccaacgttttttttcttttttttttttttttggacatgcagtttcactcttgttgcccaggctggagtgcagtggctcgatctcggctcactgcagcctccacctcccaggttcaggcgattctcctgcctcagcctcctgaatagctgggattacaggcacccatcaccacacccagttaatttttttttttgtatttttagtagagatggggtttcaccatgttagccaggctggtctcgaactcctggcctcaggtgatccgcccgtctcagcctaccaaagtgctgggattacaggcatgaaccacagtgcacggccaccacagcaactctttaaacactgaggacacacaatagagccaatgattaactaaaataggcaactgatgcctttctctgaagcttacgtgtagaatacggtaagccccaggataacttcccctgtagctagaataactgatcccaggaagagcccctggaagcccgattcgatccactgaaagtcagttttgggtaaagtcgttagtgcgtcttctgttgttctcagcaaatcttcagacaattttttcaccaggctcagcagagggagaactaagtctaatgtatttagccgggggaatgacaggtttccttttcacagtaagggttcctaggataggagactatccactcgtagcagaagaaaatcctaatgagcaggatccaggttttagggggcccttaattctaacacacagttcaccctgggctgctcaaacgtcttgacttgccccgctatgtgtgtgtgtggctttaggaagccctgcgattttccttctttagctcgaatgtcaagcgctgcaggctttctgagaattcagtgtcctgacactggggctgagcccttggtaatgacactgtagacacgaggtaattacagctctgttaactcccaagtcaggctaagtggacctctgattattattctgagtataataggagcataactaacattgaagggaaattgtacttctctcttttattaaccgcttttatattcccttgtgcatggctatgatgctatgaaatctccttaaatgtgatattcctcaatataatacaataataatgcacacaccgtaatgtattggattactttgcaaacagcccttatgaaattgcatttcccatcatttccctgggccagctcagggctgctgggcttacgggccctttctgtagctgggagcctggaatctgccttcacggtcacttagggtttcatggatgtgagcaattggtccacaccatttttattcacagcgaggatgttggccaaccaagtttccagacatctcgctggacattgcgactcagagatgcaaacagtgtttgatacctcagcatagtttgaaaataaactgggctagatggtgtcaggaaggaagctagatacagggaagggaggccttccatgctggaattaaattgtgaagtcttttccactgactttgctggagagtctatcagatctttgttcctttgtaaactctttcctgacaccacctcaaaactagagttggttcttcctttgtatgttttatatgttttgaaaatccacccttagtttggcatcccaaaatacttactgaactcctactatgtatcacacatacattaatctactaaatacacatgaacaattttacaaccacttaaaatttaatatttggcataaagctataaactttttgagggtaccactgtgccttattcatcacttttattctcagtgttaggcaaagtgcctggaacaaagtagatactcaataattgtgtattgttcatttattcctgaatatttcttgggttcttactatttgagaggcgcagaactgggccttggagatacaagagtgaataagacagacatagcttctccttcaaggaatgtacagtctaccgtaacacagaatacacacacacgtcactcacacagttgaatgcagccagccatctgtatccaccaggttcgacatcccatggaaataagaaaacactgtttcttccatctgcaattggttgaatctgtggatgtggatctcgtggaaaggagagctgactgtaattacatttgcaaaaacttctgtgaaggaaaggtagagggtgatgtgcaaacaagcaacagggagacataaatcaaagcggagatgcattcaagacttccttaaagaagtgacttttaacatgaaaattagaggctgggcgcggtggctcatgcctgtattcccagtactttgggaggccaaggtgggtggatctcttgaggcaaggagttcaagaccagcctggccaaaatggtaaaaccctgtgtctactaaaaatacaaaaattagccaggtgtggtgctgcacacctgtaatctcagctactcaggaggctgagacaagagaatcgcttgaactcaggaggcggaggttgcagtgagccaagatggcaccactgcactccagcctgggcaacacagtgagacttcgtctcaaaaaaataataataattaataaataaaagaaagacatgcagagaaaggtgggtggatgtcctgggtaggacagacagcagatgtggaaacaagatgcaggggcgtgtggaagccagctcttaatggcctgtgattgtcgattgtatatgtctctttccaacaggacagggatgccatggtagtagcttgttacctccagggtgagagtatttacactatgggcattggcaatgctacagatgagggcttttctgtctgcttttctggagagctggttgttgatcagttaccagcactccagtgacagaaaggaagttggcatattcctgtgacaggatgaatatcagtgtagctgtgtggacgggcagggggatggtggcccaagttgaggataaacaggtgagcaagaaacactcatacagagccctgctggcctcatctgggggctttgtaccatgggaggccattgaaggattttaagcagaaagaatcccatcattaggtttgattttgggaatgatctgaccaccatgtggacagtggattggagaaaagcaataatggtgttgggaagtggcagaaaggactgccagtaagctcttgccatgggctggatgagagatgttgataggaactagaatggtctggaacatgggttggagtcaatatcaaatgaccaaataatctgccagagctctctgtaatatacagtattcacacctgtggacttttgtgacaatttgggacggtatagtcccttgtaatttaattctgagagtgaccattgaggatgtgatgatgctctctttacagtgaggaaactgaggcgtggtcagttgatgtgactcagtgtgttccctgaggtcatagctgaacaagtctgacttagtaatatgtctgactctagacctacacttataaccacaacttcacactctttttgctgccaccttcttctaaggggctggaagaatggagatgccactgagctgggggtgaagacatcgtaaaaagatctacctggttctatgagatgcatccatcctgaccttgccaagggaagtaggaatcaggaaatggtggcttctaacgtgatttcatccaggcccttatgcttgggtccatctcaggaatagtgtttggaattaacgcaggagccagagactaagcaaaccccgcctccaccccagtgcagatttcagttgaatgcagactagagcctttgaaaattatgcattggaaaacaattctggataaattaatttccatcatacataatgcatgaggggaaatccgtggtatttttaaacaatggaaatgagagaatctgccttttgggcattgatcccaattaaatttatttcagcaaacatttatcaacacctactgtgtgccaggttcttactggaaaacagagatgagtcagacattgtctgtgcccggaaagagtgagaaatcaatggaggtacccgcagagtgatcagctctgggttagaccttgagactgggagacaaagagttgtgagtattgccctggagggacatacatcctagtagaggagaacgaggacctgccagaagatctgagagtgagagtttgttgaggaaggctatctcgtgcctgggcttcacttgaatggttttctttcatgagtccttccgccatcaataagatccttatttaaagcctcctattgtccagcaatggtatgtgctgtccatctgccccattagcccatagctgctactattatgctacttttcctatggtgtccactgttattactgccacaactacctcaacttactgttgaggaaaatgtaattctcctcaacttctattactattatagtgttgctgttattttatttaatgatagatcatacattcgaaattatttgttgagtgcttactgtgtaactggcaccgaagattgaggaacagataaaaaatagctatggtttcttcgtttagaatgttatcttgtaggagagagagatggaaacaaataaacaatgtaactaaataattacaaattgtaatgtttgcttcagttatgcattgctgcctaacaaactaccccaaacaaacattttatttacttacaattctatgcttcaggtatttgggtgaagtttagctgtagagatcagcttggtacatataccacttggaactggggagtaagttccaaggtttcccacagatgtctggaacttggtgattgtctgtacaacacatctcctcccccgcacccccacccccaccccgccactcaatctctccacaagactagcttgagcttcctcacagcatggagttctatggtcaatgagactttcatatgggcatcatcttggcatgtacacacttcagtggtggctgaattcgaaaaaggtgtgtctcaagaaatgagagtagaagctgcatatctgataaagctcagccttggcatttgctatgtgctatgtctgcctcagtctgttgattaaaataaggtcatctcagattcaaggagaggggaaaagactccacctttgactaggagatatgacaaagaatgtgaaaccgtcttgagtccaccatgatactttttgaagaaaacacatattaggttgaaaaagagaagattaaggagggagggacatgagatcagggaagccttctctgaggaagggtcggttaagctgtgttctgaaggatgggagagtccagcaagagaagacagtgggagcagcattccaggaagagtgaagagtatgtgcaaagccaggtgtccctcatctctctctattcccagtgcagcttcctcaccactccccaaccaaataggagtctcttcttgtaggtggaacacgggataatataaagagcgtatttttgcacatctgagaagcccaggtgacatattgtccatgatctgaagcaacagataatgtgtttcctcatgtatttcccaatgggatcacccaaagtaacatgcttaaatggatgagttgtaatcttctacatagaggtgatgccaccaggcattggtgatccagataaatgaaatgcaggaataaggataccgagactgtttctggccacaaaggaccaggcagagtagtctattgcttggcgaccaagtgcatgatagcactgggcttcctgcttctgccctccccagtgaacttcagatgaggcttgggagatgaaagacgagagaggagtcattatcagaatggtaagaatatagcatccagatagatgagaagagacaaaaagataactccgtccccatactggcttatttctcctttatggagaaggcagccccttggaggtaggcatttcctgggttcaaatcccaacgttgccctttattcactgcatgactttgggaaagctattgaacctcactaagccctaaagcatagaaggtgccctataaattgtagctgccactacttctattattatcatgtatgtcattattgctactgctttgcagaaagacatgtgcctcattggtggtgggattcttctaacccccgtctcctcctttcaaaggctcactctgctactttagagttatcttttatagtgtactcccaagcttgcgatgttgcttccctgcctgtaccattttgttttctccagatctcgctgtttccctcgctggaaactccttggtctctgactgtagcaatatgtttaataactcaaggtacctgaaaataatgcaatatggcaccatgtcggcaatgtggctgagagagtggctcctgtacagattgcctgacttcacatccaggctccctcaggtgttacccatgcaagacttggcaagtaacacaactactctgtgttatttatcatcagttatacaattaggataattaaagtgtttgtcacagagggtagttatgaagacaacacatgtcaatgattgcagagttcttagcctggtgccaggtttatacaacacatctgatgatcactgactgctctgtctctgctgtctctatggttgttgtcatggacataaaagatgtccgtaaacctgctcatgatagtcatgacctcttcaggcttaaccgttagtacttctggttgtctcttcttgaatgagaaataaggagatcaataattaaacacctatgagattcttcaccgaagggagttcatgttgtcatcccagcactcatgctaggcttgtaggaatgtttctgttttgcagatttaagaaacctaaggctcagagaagtcttatcactttccttaaaccctaaactcctcatgtggccaaggctggattcatcccaacaccatttaccactaaaacctgtgtcttctagggaccttagtttgatgaccctggttaattcagtgcattgaaggtttagctctctcagaggttcaagtgagagacacattagatacctccctgcccaagacccagaatgtttccttttagaagcacccctaaccacacacctggaaatccaaggcttgtgcagtttatagacgctgcttttcgcccctgactgctgtatgtaccttgagcagcaagataattcactctaattactcagaatacatatttaaggacaagcacaaagaactcttagtgaggcttaaaaataagccattcagcaaaattgcacaaggtgcattccctcagaaggaagagtttattgcttctaaaagtgagtgtctaccctttgttggctgcaaatgtgaggcaaaggaccagctccacgtgaagcagcattttcctctttcagatttacctccagaaggagctccactgataggagattgctcctttctgctatgacatcttctgcgtcaaaggatctcattagtgtttgtttttatcaggtttttttttttcccgacttttatctcactcagagtgaattcagtgttcactgtcatttacaggataggaaatatatgtccgtttgcattgaaaatcctgcttattccatctagactgtcccagataccactgtattcatgtaggtttggtgttttgtctttcatctatttctgaaatcaaaattttgttaaaaatgtttcgggaaagctcaaaagaattggcccattggaatggagtgaatgcaggctttctccatgcaagcagccatgctttcctagtcattaaccacctgggccttgggcctgtcatgttttttgagtctctgtttcttcctctggcaaatgattttgatgggtgtcatgaggatgaagtgggatgatgtgaaggacttggggtgcttaagaaatctcccaggccattcacaagccacatgcctgcaaagaagtcttgggtgagcagatgccaagtttcccagcaaagagatttctaaggtgcagtgcttcagcttgacattagagagatggccttggccggcagctgaggttttccttctcttttgacctgagctgggaagaagtgtgggtactggcagctttcgtgggggtacctctaaaatagagcagcagttccctgttaggaatggcagatgagattgtgatgaatgcaacaagggctggagcacagaacattctgaacggactattactccctcaaccctatgggctacctgggccagagagatatacacagagaagactggtcaaaggggaaagaaaataattccttttaaatatctaggcaagcagccaacctcctctgatacagggacctgtgacaaagacagacttggagcatgtaacttgtgtttgaaagcatacgccagacccgtaacttcctcttgactttccaccccacctcttctggattacccgggtctgcaggtgaaattccagttgatttacccaaacgggtgcaagtgcagaggaaggagaacatggggaaagaggcaaaataaattttaaaaacagagagatagaaagaaagagaagacatgaagggcgaaggaaggggaaagagaaacagaaaaaggagatagaaatagagggatggggccgggtgcagtggctcacacctgtaatcccagcactttgggaggccaaggcgggtggatcacttgaagccaggagtttgagactagcctggccaacatggtgaaaccctgtctctactaaaaatgaaaaaaaaaaaaaaaaaaaaagccaggcatggtggcacgcacctgtaatcccagctactcgggtggctgaggcatgagaatcaattgaacctgggaggcaagactgtctgaggaaaaaaaaaatagaggaacagaggggagagagaaggagagggagaaagagggaaagggaaggatctagctaggcacacataattgttgtcttcctaaaaacaccaccaccaccccacacatacaaacaagaaaggcaagtgacattacaactataggtactgacatttgaggctgtgtggccctgtccaccgctctaggttgcatctcagtgaatgttccaggttctgaacaatcctataggtgggggaaagaggttaggtggaccaagcatggtactgtggcagcacctccttctcctactgtttctgcaccccgccatgcatttaaatcactcagggttggtgtttaacagacacaactcctgagctactgaatcaaagccttagggaatggccaatgggaatatggttttaacaagtattttaggcaagtcttacaaatctggcctgacacatgacttcacataaaggtttgagaactgagagtctcaccactcacatagaatgaagggtgtcagattctgggagatatttgagatctgatagaaattacaagacttttttacaggcctggtaatgatcatggagatgccagcagctatcactgccaaggactgggtgggttctaggcacctgtcccttgtaacacctgaattggaaaactcctggataaaggtgactttcccattttcagaggagacaatggaatctcagagaagttgaaatgtgtgtgtacccctgtggtgacacaactgattgaatccagtcttaggcatattaaaattgagaaccattgcttaaggatttcttaacagctgtattttattgagagtctgcaccatgctgggcagtatctgtgtgtgtgtgtgtgtgtgtgtgtgtgtgtgtgtgtgtgtgtgtgtgtgtgtttattttttatatatttatttttttcaaatggactctgttgtcaggctggagtgcagtggcacgatcttggctcactgcaacctctacctccttggttcaagtgattctcctgcctcactctcccgagtagctgggattataggcacgcaccaccacgcccagctaatttttgtatttttagtagagacagagtttcaccatgttggccaggatggtctcgatctcctaacttcatgacccacctgccttggtttcccaaagtgctgggattataggcgtaagccaccactcccagccatgtctgtgtattctaaggtgtttatttccatttgtcttcccaatgactttataaagtgagagagaatcctcattctatggagagggggaataagaccaggaaagcctgaattgaaaccaacgcttactcctaaagactgggctttgagttgctacattatatttcacacctctgtcctttggaggtgaaagttacttgatggtgatgtctttagggaaattatgacaaaggagaagtgaacgttggagtcaggtcattgtgtgtctgattacttactggctatgtcacctggtttataaaatgggcttgatttaatgtactgagtgaattagtgtccccccaaatttatgtccacttggaaccttaggaggagatctcatttgaaagtagagcctttgtagatataattaaattagatgaggttatactggattagggtgggccctgaattcaatgagtgttgtccttgtaagaaaaccatgtcaagacgcacaaaggtaagaagtccaaggggcatcaaagacagattggactaataccagggacaccaaggattgccaggagctaccaggatctaggaaagaagcaaggacggactctccttgagagccttcagatggagcatggtttaggcaacaccttgattttgaacttctggcctctggaactgtgagagattacctttcttttattttagtcacctagctggtcataatatgttatggcagtcctaggaaagtaatagcacatgagatattttttcttgtttgttgttgttgtttttgtttttgttttttcctttatagcacttattgtaactagtaattttctttgtttgcttaccaattctggacatactggaatgtcagcaccatactgcattttgttcatcatccccgtatctgtgatgcttcactccaatagcagctcagttacgatgtgtgaacggaatgtatgaatgaatgaatgagtgaacagagctgttgtgaggactaagccgagcagtacagtgaaattgcatcaaacagtgtctactaagagcaagcatgcagaataaaagctatcatgattatcattcgaggcaggaattatctttttttcctagggtccctctgccttgctgagcatcaaggtgaacttgagtagttactagttacgtggactgggagaacacggttaaagtaaaggttgtttttgtggagattgacaggcaagagcccctgcctttcctttcctgaaacagcagttttcctttgagacacgaagcccaccactgagagaggcagggtgcgggtcatgggggtggaggtggcggcattgtttgcaatcctcttggccccttgctcacagccaggcctctgcctttatattcttcggggggctttgatctcacctccctgtccaacagatgcacattagtcagtaattctaggagacatcaaaaccccagccctggcaccccccgaccttccctgcagccttcacaagccgctagctgtgttaataggcgccagacaggactgtgctatttcttagagcttaggtagaatgctactgcggctgttttactgaaccccagctcagtctccacttctttccacctctgacccagtacgtttagaattagagccaaatgctctgagtgaagagttgcccgacacggtgacttgatttacctaaggctgctatattctttccgaatgttctttccagacagaggtggagggcaaggaactgggtcccaggagctagaaaacgtggtcttgggtctcagctctgccattctgacactgaataaccatcatcaagtcacagacatcctcagagcctctgtctctgcatcgggggagcagaaccaggaatgctggtcctgcctacctgacagaactgttttgagagtcacgtgcaaaatcagatgtgagcatgccttagaaattggaaagtgtcgtaaaactagaagcacttattactattattctgtgactctgagcttataaaaaaaaaaaaaaaagaaaaagaaaatcaggccaggcacagtggctcatgtcagtaatcccagcactttgggggacagaggcaggtggatcacctgaggtcaggagttcgagaccagcctggccaacatggtgaaaccctgtctctactaaaaatataaaaatcagccaggcatggtggcacgggccagtaatcccaggtacttaggagcctgaggtgggagaatcgtttgaacccggagggtggaggttgcagtgagctgagatcacaccactgcactctagcctgggcaaaagggtaaaactccacctcaaaaaataaaataaaataaaataaaataaaataaaataaaataaaataaaataataaaataaaattggttacttaccttgtgtcagctgttgcagatcaagaaactaatacaacgcaatcccttatggtgtgcttaaacccatattcaatatagaaaatatagtatatccagataaataataataagcatagttatttcatcacctcgttgaccacctggttgtttatcttttgagaggctttgcaatgtttgacaaaaaattagaaaatagataaaaatgcaaagatgatacctgctatactgttttgtggatttctctttaacttaaaataccatacatacaattccgagtcattattcaatgactattcagattttaactttttgttttctctgatggcttctttgtgtctcattgcctgggatcatttggattggacatagtttatttagccaatcccttgtagttggacacttaaattttttcccatttttcactgtgacaaatatcaccttgatgaatttctttctgcaaatctctgcacactaccgtgattgtttctgtaggataaattcccacaagtagaacttctgggtcaaagagtaaaaatgcacattttttaaggcttttgatagtcagataaaactaaaacaaaatcaccctctagaaagatcataccaatttaaactcccaccaagactgcacggcagtgtcctgtctcctgcactcacaccagtatcaagcattatctcagagtgatttaaaatgcctgaagaaaggagtgataatggtttctaaacagcactggctaacgcacagccctgcatattggctttcagcttgataaatactttcttataaggccataaatattggtggtaccaaaggttaacgtagtgtgcaatgctgtaaaatccagcaggcaacctgctagctcataatgatgcattagcacctttcgatatgaagtgtgatgacttacaaagtctgtttgtaagtggccactaactcaacaagtgtataattgtgtcagttggcaccacagtttctgcaaacataatttattaagtgagcaccttgccttctgttatatgccaaaaatgagaagaaaagacaagagaaggggaaagaagaaaatgatcatctgactggggcatttagtcccttctgcaagctagggttacttaaaagaccaacatactttattgaagaaaaaacaaagcaaataatcctttccatattttaatagtcagttgaccacactgctggcagtgttagaatcaggattgaggcaggcatgacaaatagctgcaccattaaaaggcatgtgcatttgcaaattagacttttaaatattttattttcgtgtttttaagtttgcaactcaggcaccttgctcctaccattttatttttgcaggtggaaacagttgtatagttctttgctattgttctgggatgggctagcatgaaggtgaaacctgttttgtgattaatgaacatggaggttgtgtgtatttaacagcagaagagtaatctatcctgataggagacaaaacagaatggataccaccagccgtgttcccgtttggctttgctccttggtaatggaggaaatccaggtattaaggatagactttagtaggcccatctcagcatttgcccgtgtgtagtgcctgttttggattgctgtaaagaggacactctgtaaacagaaaataagctagacaggcacattttgagctacttattctgttcattttcagtgactgttcaccctgtgcaatattttgaaacaaaccgaggagttattcacgtcatattctttcttactcgtttttcatattttatttttacttttgagacagagagtcccatctgtcacccaggctggagtacagtggtgtgatcttggctcactgcaatctctgactcctgggttcacgtgcctcctgaatagctggaactacaggtgcctgccactatgtccggctaatttttgtagttttagtagagacagggtttcaccatattggctaggctggtcttgaactcccaacctcaggtgatccaccggctgcgccacccaaagtgctgggattacaggtatgagccactgcgcctggcctcgtattagttgttctttaaacatttacatttgacactgagcactgggaatacagaggtgaatggcacctactccatccctcaaggaactcatcctagtctagagctgtgaaccaatgcaaggggcaaatgcacacacatgcggttgcacggatgagcaggatgctctggggcaggagcgggggggcagtcaaacaagtccaaagcttctcgcctccagccagtttcggctgctgttcacccatatctcccatcgcctgggagcaaagacagctttgctcagagttttcttctccacttgaggccgccatgtttgcctctgtctggagttgtcagcctggctactgactggtagaaatcagagaggaaattccaggcatgatggcatgttcctgcctattagttagggacccacttcattatgaatgacatagtcactatgaagacctgacctctctggcttctggaagaatgttgaacatgcagaccaaggaaaagccaccatcccagagctcacattccagggatccgaagaaacacatcagagtaatggctagcccagatggtgataggagagaaacagagaagagggtggacaggaaggactttctgaagaggcgacatttaagccgatgactaagtatgaggaggatccagtctggtaaacagtggaaggcagaggttccagagagaagagctggcatatgccaaggccttgaggtgggaaacaccctcgaaatatttacagagtggaagtagctcccaatgcctatgacttcactagcccccaatttggaacaaccattatggctgctgaatgctgtaggactgtgaataagcaaagaagtgtttgaaatgaggttataaaggtaggtagggccatgcaaaccaggtgaggagtttaggtgtaattctaggtgcaagaggaagccactagaaagttttgaagcatgaagagtacctgtattacggttctctaaagggacagaactaataggatagatgtatatataagggggagtttataaaggagaattgactcacgtgattacaataggtcgtctgcaagctgaagagcaaggaagccagtccgagtcctagagcctcaaaagtagggaagctgacagtgaaaccttcagtctgtggttgaaggtccaagagtccaaaagctgaagaacctggagtctgttgttcaagggcaggaagcatgcagcatgggagaaagatgtaagccggaagactgggccagtttagtctttccaccttcttctgcctgcctttattctggccacgctgaccactgattagatttgtgtccactcagattgtacgtgggtctgcctttcccagtccactgactcaatgataatcttcttcggaaacaccctcacggacacacgcaggagcagtactttgcctccttcagtccaatcacgttgacaatattaaccatcatcatatccttctctttttctttttcttttatttttttagagacagggttttactctgtcacttaggcaggagtgcagtggtgtgatcatagctcactgcagccttgtcctcctgggctcaagcgattgtcccacctcagcctccctagtagctgggaacacaggcacacaacaccatgcctggctaattttttaattttttatagagatggaggtctttctatgttgcccaggctggtctcaaacttctggcctcaggcaattctccctcctcggcctcccgaagcactggaatgccactatgcccagcctacccttctcctgagtgagttcctccagagtcttttttttttttggctgggctgggaaatacccttgagttccggagaagggaagtggtttctggaatcctctgcccgtgaaggttaatttggcaatatgcatatctgctctggggctatagaggcagctgtgacgatgcccagagggggacctttatgatctgagagcccgtggaatgtttgtagcagcagagccgtgttgtcccattgaatgtctcttccatttttaatgaggagcctgggggcactgtatcaataaaacgaccaaattattaaattatcactctacagggcatcttatattagtcctaattaaatgatgcttttcatattaacaaacagtgctcaaaaaggattctcatttttaattcggacctcattgaaataggaagccttagaaatttctagaataggtactatgcctctggacgaatatgcaccatgtctctggactcactggagggcacctacagtgagttttcagacactgccctgaattttaaaaatcctcagtatccacaatgactacctgtcttcacccagactcagaaatgctaatgggggtcaggtgcagtgactcactcccataatccgaacgctttgagaggccgaggcaggcggatcacttgaggtcaggagtttcagaccagcctggccaacatggtgaaaccccagttctactaaaaatacaaaaattagccgggcatggtggcgggtacctgtaatcccagctactcaggaggctgaggcgggaaaatcacttgaacccaggaggcggaggttgcagtgagctgagattgtgccatcacactccagcctgggcaacaagagcgagactcaaaaaaaaaaaaaaaaagaaaaaaaaagaatatttacaggacttctgctttcgccacgatagagtaacagggactggtgtgcaccgctgccttaaagaacttttaaaaaggtcagtctcagaaattgccactaaagaattttttccatgcaaccaaccaccacttgtcccccagaaacaactaaagtttagaaaaaagtcaccatacaagcaacagtgatttcagacgttagacagcatgaggcatccacagaggggaagcagatgagatgtaccctccaggggccccagctcactgccttgagagggtctctaagccataggacaaggggtgggggcccaaataaggaatatttggggcgcacttgctgggtgaaagccatgagacactggagagacagtagtgatccagtcagccaatagctctgtgctactgagctgacattgttttgagggaaatggtcaataagtgagcaaataaatgggggtggtttcagaatgtgagaaatgttacaaagaactaaaaagggtaatgcagtggaatactgtgacctggaggagcaggtaggagttactctagctggttcagtggcatgcaggaagctgctggaataggctgccaagggccaattatgagcattactagccaaatctgtgttccatgagatcccactggtagcttgaaataggccatgatgtcaatatttacaccacagacattggcggtgtttttcttttttctttttccaacatactacggatggtatggccaagataggtttcataaagaagtgcacatttctgtatgacattaggataaagaacagcccatcatttatgtgacaaaccctaggaggaatattccagcagaagaaatagcatgtgcaaaggccgtgtgtccacatcctccatttcttcattctctatgatgttcagggcaggtatttttacccctccccacaattgtataaggagattttcattgtcacgtgtgtcagtcattttatctcattctctccaccacccgtttttaattcccatgttggtacagtagagaatatctttatccagttatccttccttcatccttagattttgtttcctgatttctctttccttgtacttcttttttcatagaattttacaacttgttttcaggtatgcttctttatttccatgtctatgagagctttgatcagcagctatagtttcttatgtaatccatagactccatcaatttcttttatagtgagaggcgacaggatactcattttacatctagaggcaaagtacttcagcactggaaggtgaaaagacttcagaagaccttttctggaagccttttctttagcagcagggtgtcttcagagaagttgcagagttgagtctaatggaacggcctgaatgaccactgggtcaatgttaattgataatgatgctttctaaggcgagatctgaactgaacctcaactcaattcttaatatgtgcggcagaagcaaaaacaagaaatccatagttcatgaccctataagatttatgtctaaagcatttccgacacccattctttgttgtgaacgactaatttgccactcttgtttttctttctttttttgcaatggagtgttactctgttgctcaggccgaagtgcaatggcgtgatctcagctcactgcaacctctgcctcccaggctcaagagattctcctgcctcagactctcgagtagctgggattacagtttcctgccacaacccccggctaatttttgtgtttttagtagagatggggtttcaccatattggccaggctggtctcaaactgccgacctcaggtgatctgcccgcctcggactcccaaagcactgggattacaggtgtgagccactgagaccggcctaatttgacactcttaagcataccttctctttcctctcagtaagcaagtcagatatttcaggagaaacaaggtatgtgctccttccttctttcattccttccctccttccttttttccccttcctttttaaaaaattttccagtttccacattttaaaattttatttctttctctttttagagacagggtctttctctgtctcccagactggagtgcagtggtgcaatcatagctcacttcagcctcaacctcctgggctcaaattatcttcccaggtcagcctctagagtagctggggctacaggtgcccaccaccacaccccctaatttttaaaattttctgtagagatgggatctcccagtgttgctcaggctggtctcaaactcctggccccaagtgatcctctagcattggtcttccaaagcactgggattacaggcatgaggtgccacacccagcccagtatctacaattttaaaagtggtatacatagcctaagatcttccataacaattaaaaatgagtgtcagacatgcaggactatcaggcactactgaacattgctgaatactcacaagagaagggggatacatatggcaaaatttcaaactcaaatgaagatctgcaagtggccagtgcacttgaaaggtgcacaactcatttcagaaggcactgctcagcattaccaagatgcagctgtgtcctaacccccagctacaagggagtgtttactgtaggttagagttagctgactcagtccatatgttagggtaatcacaacccaattttgatgaactcataaaccaaggaggctgttgctggagctaagaagagacaagatttttagtagatagtgacatttaacctcagctaagtctaggctgtcagcctggcaggtctttttgaagagctaagttctgcttaaaagccattagtgtatgtcaggctctatacattaggattaaagaatgtaagaaggccaggcccagtggctcacacttgtaacccaagcactttgggaggctgcagtgaggggatcgcttgagcccaggaggtcgaggctgcagcgaactatgatcggaacactgcactccagcctgggtgaaagagcaagatcctgtctcaaaaaagaagacaatgacccagatcctattctctcagagcccaaagcttagttgggctgatgggaaaactaacagtttcaatttaatgtgtgtattctaggatcgagctaggggaacaaagagtagcaggcaaaggaatgcacagaaatatttagtcatagcaggaaccgttcttcaactatcttccaaggactgtgctaaatactttccatgcattattttatccttacagcaatcctgtgttttatatacttttaggtaaaagtccattttagtcattagcaacctgagcacagagaggtcagttaacatactcaaggttgcactgcatgtggtaaagagctgaacagagaaaaccaaattcccaagttcagcctgagtcgtgtagactaagtgttagttggagtaaacagacttagcttctctagatctgcttcctatcagaaatgtggagatgttcaaagtcagctgcttacctttagaattgccatgaagtgaacaccagtgaattcagattagttgagcactttgagcctctaacctttttttttttaatttttttatttttaagcaccctacacctataacttaactattcccaatttggaaaaaaattttatgagtgctgtgcactctttttttcttcttcttctacaaagccaagtgcacgacatcaaacctgtaatcttggccacattatcaccatgttctaaccaagcaagcttattagttcagacaattaagaaaatagaagttgaaaatacttagctattagggagaacggagtaacataaatccaaggtgttgggacaattagcattcgtagtaataaaagccaagtagaacactaaggaaatgaatattatgtttattatttagcatttaggtagtattgcatatttataaaatacctggtaattgtttttggtcatttctttcagaataaatcggataaagggtatttgctattgttgtgagtagggtaagggggggtttttagtagaagcccattaaattacaatgcatctccccaccctcttaccctcaactcagatttaagtacagaaagaaaacattcagaaatcttgctgaaacagaaatcatttcacttttctcctttgttaaaagccttctgatgactcccccatttctgttgcagcaaaaggcaaaatcctgtaaatgcaacttgatgtcctagaatggattctggaacagaaaaaggacataagtagaaaggctgtggaaatttcagtaaaatccatggtttagttaatagacaccagtgttaccttcctcgttctgataaatgcacgtagttgggtaagatgttagtgttagaggaagcggggaaaaggatataagaggaccctgtgtactatctttgcaacttttttgtaaatctaaagttattcaaaaagttaaaaaagattttttgtttaaagctaaagttcttagagcagactacaaagacctgcgtgacctgtttctgtgccctcgtcaggtctctgacgtcatctccttttctcttccccttgaacgttctgtaccagcctcacgcttcatcactttctcaccgcaggacctttgcactggctgtgtctgggactgggctattattgcctgagctctccctgtggcccactcttctttgtcaaattgtgattcaaatgtcaccttcataaaagccatccattgaaaatgtcaagcctacctccacggtcccttcctcctgctcagtatttatctcatggtgcctatgcttccaacatgctctgcaatgctctgattgattaggttatgcttcatcttcctcctgctctcctaaaacttacgttccttgagaggagggattttttcctgttttctccacgatgcatttccaacacctggaattgcatacttagtgcttaatggatattagttgaacctaaatattaaattttatactacaagaaagtaaccctaactctgaatgctttgataaccaaggcattgtggtaaacactctaaattttctagatcttgtggcatcttcatgatagcttaaaatttgagtatcatgaccaccatttataaggccctgagaagtcttaagttttgcacaacatgacgcagctcttcggtcaaatctgagagcccagattcgaacttgcatctcccaacactacagctagttctgtttcttgtacaccagattgtctgctagatttgcatgcttcccctccatttcattaaaccacggcacatgaagaaatagcattactcatcaagtcagtagttgtttgagtaactcagatccctttcttagatgatggtacccaagataaatgtatggaacatattatttcccatgatggccacaggtaactctggaatattataaggtttatttgtataagcaactcagtatgaaacttttaccttgaatttccccttcatgggcctatctttgttttcattttcaacattctcttttggatacagagtttcattcacctaagaaagcttcatgacattagtggaaaggcactggttcagttctaagaccttagttctaggacccactctcctatctgctagctatatggaccccttcttaggctttaatttcctcatctataaaatgggcataattttaccaccaacttcatagaggtatcatggggataaatggtataacccatgtgcaatggtatgcactgctgttattgtttgaaaataattctttgttgaatcagatataaaggttgttattgttgttttctgaaaccgacttagtttaaaattactaagtcattttaatatctatcaaccatttccatagtttctaaggatttctcccaaatgcctctgttaacaacaacgacatcctcctcctcatcatatggatatcatgaaacaccaattatatcaattattgaacagttatttggagtcaggcttgatacagtctttgtaatgttgttttattttttgctgtgagtccacagagcgagtattataaacccattttacagatgagggaactgaggtaccatggaggtgaagtaatttgcctactgtcacgtgctactcatggggccgggtctcgaacccaggtgtttcttcctatagctgagggcttcatcagtacttagcacagctttattgccaaagagaattgtaaagcaactggaaaaatgaccaaaatacaatacctccaatgactatttttaaaaaaacaaaaaacagccgggtgtggtggctttcacctgtaatcccagcactttgggaggccaacgtgggcggatcacttgagatcaagaattccagaccagcctgaccaacatgttgaaaccccgactttactaaaaatataaaaattagccaggcatggtggtgggtgcctgtaatcccacctactcgagaggctgaggcaggagagtcacttgaacctgggaggcagaggtttcagtgagccaagactgtaccactgcactccagcctgggagacaaagttagactctgtctcaaaaaaaaaaaaaaaaaaaaaaagaaaaagaaaaaaaaaaagcattttcttaaactgtggcccagaaagcacttttatattagaattacctgatgcgcttgttacaaacacatattgctggctgtaatcagtgaagtgctagtaaatgcttaacaactagcttggtgggggaaggagcgggagagggctccagagactgatctgaagcatttgccaatttccatggtgcaaatactcccatcatggccattgcaagataccaatgcctcgtcactgaacacagagttaggaaaaaatatgcagaagtggaccatcacgcagtatttccaccatccagatactctaaacaaacaaacaaaaaacctcaagagcacagataatattcaagtatggtaaaataatttaatattcaaaactcattatttcttattaatttttaatatactttattgaggccaggcatggtagctcacgcctgtaattccagcactttggggggccgaggtggtagatcactggaacccaggagttcaagatcaccctgggaaacatggcaaaactccatatccactaaaaatacaaaaattagctgggtatgttggtgcacacctgtagtcctaggtactcgagaggctgaggtgggaggatcacttgagcctgggaggtcgcggctgcagtgagccatgattgtgccattgcactctagcctttgtgacaaagtgaggctctgtctcaaaataagacatacatatatatatacacgcgcacacactcacacacatatatatttatgctatatatgtataattatactgtatgtatatatcaatatgaatatatacatgtatagtacataaatacatgtgtacacatattttcgtatatgtatatacatatacaacatatattaatatgtatatacatatactttcttactatatatgctttaattatgggcttatgtcatttcattttttattaaaggttgtgtttaacaacagagtcacagaattcctgacaagttagcaactggctttcagaaatcagtatcaacaaacttcaacagtccaccagctaccccaggctgacaaaatcagcaccgaaaaggctggagccctggaatgtgcatttctaaagagcatccaactgcttctggtgcacactcaaagtattgagccaatgccataagcctttctgagagcacttgtgaaataagtatatgaaaatactatataatgtggtaagcatctgaaaaatgtagatgggattcatattcctagcaaatgctagtgggcatttatgctaaatgaaccccactgttactcttttgaagatttttttccctacttttaaaatggcataaaattattttatagttttattttattttacccatcaatgaagagtgcctggtctctgttaaaggagaaggtagtaatcctatttcccttgcagccagcataggagaaaggttcagaggcctttcctgaaaggtttaggcaaagataacaaaatgtcagagaaagctgcagggcagggctgaatggaaaagtaggtttgtaatctcaaattcaatataaaagatcgaaagtatcaaatagtcagtggtgagcctctccatcagaatgttatatctgccatgaaattctgctttatgattgtattacgttatatacattatacatctctttctctcagtctctctctttctcacctagtctctctttctccctctcttcctttatatattctcatagaaactagggcacatctgagatccataaggaagtcttgcttgactccagtcagagaaaccattggaaacatcacctgcctccaaccccaaccccatctgccttaaaaatataaaagtctttctttttaggtggaggttttgattcagggaaaacacaggccttgcaaattaagagcagcccaagaattgtgtgcaaaccctgatacacgagacacccaatccaaggcttgcactctgtcctctaaacagtgattgtgctttccaaggtggatatggagggtaattaagaatgaattttcatgacttgtgtctactgtgtgcccacacagtgccagaagccagagtaagaactttgcgggcctttcgcttttcatctaccctccttagtctttggttcttatccaggcacttaggagtttctcaatcagtattctttgaatgaatgaattcacaaatccccattttaaggctgtgggaagaaaggcctttagggatgaagtaacatgtccaaggtcaaatagttgtctttggtcaactgttggtcaaatgctacacaattacaggattgcctccctaaggtatagacagtggctgttaaaagaatggatcctatttgtcacctgtgaaggttattttaaaagatttatcttgagtgcataggagtatgaatgggtcactctgggatggggcccagaaatctgggtgttccacacccttacccaggtgacttagagacattcagcaggctgtacctggagaaagaccagtgcgattcatgtaaatctctctacatctccaaccagaggcaaacctgtcaacttttctggctgcaaaatctgcaccttgctaaaggctgtcaagaaccccctatggggggtggacttcttggcttacccaccctccctacatctctgatccttgcatttttagacgtgacaggtgcctgcaaggccaccaaatttcatgtcttcagtttattcagctgcaaaaaatttcatttcagaaacatgacacaatgagaaactgacaaaaggtgggcttgaattcaagtctcctaaatgaaagtacccccagtgactaaaagtcttgttgctgctccggatttcacattgtcatcctgcggtgggaacatatcttgcatttttatgtagagtatcaaaaaaaaaaaaaagcaaaaattgttttttggaacagccaaagcgtgtcctggagcataatctaatttgtttctctatggcccaagaaaagagggggcgagtgtcatccttcctttttcataaattgagattcagaaagggcgagtgactttctcagtcacacagcatcatgtctaccacccaagtctcacccgcttctcattggagccacaaatgacataattagatgagagatgatcccaagactagcggatgtttccctttcttcattttaagagtttggacttttttaggggacctaaacatttgctcctgagctctgctaatgtgtgactgctgagtttttctggatgaataagacttttttcaagaaatttcacatattcccgtctggccgaattatgtatccaaatgtttttccatcagagaactcatccgttgtcctgtgactgtgtggtttattcatttctcctccacaaagctaggagctccctactggttcaggttatgtcttcttcatccttcagtccccatatgtagcaaatgttctttatacaagcagatcttaaaatggtagctgagttgaacagtgtagacacagagtatttgtccctctaagaaccaacatgggaatccatggagctcagaccaaatccagcccactgtctctgcttttacaaataaagttttatcaaaacacagccacattcatggttcatttgtttacatattaccccatggatgcttttatgtacagcatggcttatgatgcccaactattcactctatggccctttaaagaaaaagcatgctatccccatctagatgaagagacaagtagaaaggagatgcaggcatttctattttcagagtatatttcttagcatttccatttccgaacatatatttactctccttcccacctgccaatgcaggagaaattagcctactgagaaactccgaaatatcctgactagtgtcaatttgcagaaattgtgcagtttatgtgacaggattctttcactgtcaaatttttgttcagagacatatcggtgttcacaaagaatgatatctccatgtctcagcatatcctggaaaaaccccagtagtcctagaacaaaactcttggagtgcttgtctctttgtttgaagcatttatattaatacaaagaaagaagtaattagccaggaaaacccagggatgttcagggagatcagtgccatcttaaattcatcacccattttctgcaactgaattgtgctttcagcagttttcttaggtctgggaaattagcataacgtatagaattgccatttggttcatttaaatcttgcataatatattaggggggaaatctttgagctaagtggaatttaggatttagtaccaaatacgaacttttgtgttaaattgatgtataggttggccttgatttctgagtgggacaggtaattaaagaaaaccaggaggttaagaggagatgaggaaaaaaaaaatactgcaggaggaaaaggttggaggcgtcagccagaaagggaggctgctggaagattgctaagctagagaacaatgcagctcatttttatgagaccattaacacagaagacagtggcaacaatcttgggagtatttgacatgttcccaaaattagttgggtgcgggatgtcatggcacagagctgtgtacctgctttttatctggggatttataaaagtggagccttgctggtgtcgtccaaaacagcaggatgggaaagagctgttggtgagaatgcattagggtacctgccgcctgttccctgtagttcctctggctcttgaaagagcctgaagttacagaagagggcaggagttctaagggtgtccaggaggccaaatgctgaaggagaggaccctcatctgaaaggagagttggaagcaatgaccattggcaacagccttgaagacacgagaccctgggcaactatggagaatgacagaggatggctgatcagtgccccaagtaacctaggaatgtggactccacagccccaccacatccatggaagccaccagtggcacctgagccccagcagaatgagatgggaggcaaaaagaggcacttctcatcaccaggatgcatttgatttcattagctgccttctgcctcctaggttccttctcttcagcccccagtcttgaaagaagcttcttccccagtgggggaaggaggaggaaggtcccagaggttgcacctcatcccactgatcctacaaactgctggagagtttggagccaacaggcaagaaacactctatgcccactgtaggtatactggaccacagatgtgtagcaagaggaagagagttttaatctcattgattttggaagctttaaagtggactggcctgagttttaacaaccaagtgccccgagagctgttgcatcttctttagatgccattaagggacttgacccaggggattgcaatgccagggctctaagccactgtgccacactgcctcccatgtagggactaaacatcccaaagaagctctgaggccctctgaacctcaatttctttgccgtaagatgggcacaatattagaatcctcttgtctgagtcatcagacaatgtgaagagattaatagaatgctaatcactcaaccaggatttattaaatggcaatgaagtattaatcagccactcttctcgatgctggttattataataatcatggtccatcctaagcacttacaggtgttgactcatttggggtagatgccaatagtattcctattttctagataaaggtaatgagacagagaggttaagtaacctgctgcagttcacacagataggaagcagtgaagctggaattcaaatctagataattgtgtttcgaagtctataaatgtgtcttgttgttattgctattgttatatatatacatgtttttttcttttcttgcttcaaacaaagtcttacactgttgcccaggctggagtgcaatggcacgatctctgctcactgcaacctctgcctcccgggttcaggcaattctcctgcctcagcctccatagcagctgggactacaggcacacaccaccacacttggctaattttttgtacttttagtagagacgggggtttcactatgttggccagactggtctccaactcctgacctcgtgatccacccacctcggcctcccaaagtgctgggattacagggctgagccaccgcacccactctattatatattttaactacctatcctggaaccaaaagccaaatctttgcaacaagaagaggagaagaaagagtgctttttgtagtcttgtcattccactttctgataagcagacaccaacctccaaccctgcccactgtaccaccggggcctgatgtatagtaggtgctcagtaaatatattttgaatgattggataactgagcacctgatttcaagcccccaggacaaacaatgcttctttaagtgcaggtgtttgtaggcgctgcctcagtaacacagctgtggactgaattgtgtcccctactccaggtcatatgttgaagctgtaaccaccaaagggatggtgtttggaaatggggactttggaaggtaattaggttaatttaaggccacgagagtagagcccgatgagacagtatccatacaggaggcagagatatcagagcttccctccctcttccatctgagaacacagaaaaaaggcactcaagccgggcgtggtggctcacccctgtaatcccagcactttgggacgcagaggtgggtagatcgcgaggtcaggagttcaagaccagagtggccaacatgttgaaacctcctctctactaaaaatacaaaaattagctgggcgtggtggcaccagacacctgtaatctcaagtactcaggaggctgaggcaggggaattgcttgatcctgggaggcggagcttgcactcagccgagattgcacctctgcactccagcctggctgacagagcaagactccatctcaaaaaaaaaaaaaaaaaaaaaaaaaaaaggcactcatctgcaagccaggaagagggcccttcccaggagctgagttggctggcactttgatcctgcactaccagcctccagaactgtaagaaataaatgtctgttgtttaaaccacccagcctgtggtattttgttataacagcctgagaagactaatacagacacctagacaaggctgtctcctttactgatgtgttaaacacctggccccttgtacattcatcctatttttttcccaaggaataaaaatagcaaaggaattcggagtcagcccttctctgtcctccagcccttctcctttcagaggaatttcatcactggagcagagcattgaattcattcgagttgcagggaaatgtgatgtatttcttaaatctgtgtcacctggccgtggaatcagcccagccaggctcgaaatgaggcattaactacatccaaagctgtgtgattaacttatttgtttgccgacggagctcaaatgaaaaagcaggaagctgggaggatctgcacgagccccgttttgaagtaggattgtgagaagacccgaagtgtgggttttagttcacattccctgggcttaccattattattacttttaatggaaaataacttttcacaatcttgcttcgttttaaatggagaatgtgcaatattgtctaatttagggtgtggagttgatctggtatgcatgatttttcttcccccgcccgccaccatccttggattctttgtacacattcaatatagttacatttttgcttagaacatatatattttcccccgaacttttctcgattgcttttttatcaggtttacaaatcaaatcaaataggtatattgcagagctctgcgatattattttctgagcttacagtacaatgtattgaattatgccagcccatgctctgccctgctattctctgcagactgagagagggggaccgtggaccctgtaaattcactcggcgcccagcattactggctaaatcaagaccgctcttcagtctgcaagaagagacagagcaagtgttcgttacacaaatcaatttggtccaaagtacttcgcagtgggtactcaaccatcgctcacataatattgtcaacttaatcaaataatgcctcgaagacactcagaagcttttctctctgagaaataacttgattggtggaggatggagcagcagctggctcttcaaagtacactttttatttatcactgtgaagagttttgtgcatggaggggaggaagcctgtaggaaaggaaagaggctgaatagtcagtaggctgactgtggggagaatcatgcagcattcatgtcgtgtcttgggtgctgggtttctacaccgtgatggtgaatttggggatgctcgtggatgaagcagcagctgggcccaaatcattagtttcctggaatgattcaggaaagacttgccgagcgcctactatgtgtcatggtaaggggcttttgatatagtgcatctgatacagtgtttatccacgggacgctcatattctaggaagcatttgatatggtgtttagtcatggggtgctcatattctcgtaagcatttgatagagtgtttatccataggatgcttattctaataagaaaacctgtcagtgagggcttaacagaggtcaacccaggactctagtagttcaaaccacacagctgaagcagcctgcttttgattgctttttaattggttggatgagctagggcctcattcacccacctcactgctctgtttccagcccagacctagaacataggcagttagggtttctgtgaatctttactcctgtctatatgtactttgcagctgctctacgtgcctgctcttagactttccagagcattttcaccttgaccttgaaaggccattcaggagcgaaaagagtttaggatacggaattagatatcctaagttcaaaccttccatctcctggctgtgtgacttcggacagatcgcctaacctctctgagcctcagttttcctagttgttatggcgactcggtaaaataaggcatggaaaacaccagtgagatgcttagctcatggtgggacctcagcacagttttcttttccatcctgtatcccagaccatttagccagtttcacattttgcttataaactacgagtggcattcagcatcagtgatagccggaatcctttgtcttaactcaggataggggagaagcaaaagccttcctcagtgatccttttccacatccaagggtgtctatgtatcctccagggagcttgtgaactttctgaaatcgtatgcaaaatttaggtgtatgtgtattttccccccaaaaggtggtccacagttttcataaaaccttcagtgtatccatgaacaaagaaatcgattaagaaacatgtatttacagagtaaagggaaataccacccaaaaataatggtatcaacaaaagtcacagctgacagctactgctaatggaactgactgcctgagcgacccactctataattaaagctggatatatatatatctccctatatatgtatatccatatatatctccctatatatgtatatccatatatatccctatatatatatccatatatatatccctatataaatatccatatatatatccctatataaatatccatatatatatccctatatatatatccatatatccctatatatatatatccctatatatatatccctatatatccttatatatggccctatatatatatatatatatctccctatatatggccctatatatatatccctatatatggccctatatatatatccctatgtatggccctatatatatatatccctatatatatatccctatgtatggccctatatatatatatccctatgtatggccctatatatatatccctatgtatggccctatatgtatatccctatgtatggccctatatatatatccctatgtatggccctatatgtatatccctatatatggccctatatatatatatccctatatatggccctatatatatatccctttatatggccctatatatatatatatatccctatatatggccctatatatatatatccctatatatggccctatatagatatatatccctatatataatccctatatatatatatccctatatataatccctatatatatccatataaccctatatatatccctctctatatatatccatatgtatacctatatatatccccatatatatacctatatatatccccatatatatacctatatatatccatatatatacctctctatatatgcatatgtatacctatgtatatatatatatccatatatatgtatggatacctaaaattaaagctggatattttttacagtattgcccaagaaaaaacattaaaatgccaaatttatttcatttaaaaatagatgtatttgaaacttagttgactcaataatattcctcatttcaaaggattctattgctactggaaaggggtcctgatccagacaccaagaaagggttctaggatctcacacaaaaagaattcgaggtgaatccatcaagtgaagtaaaaataagtttattagagaagtaaagaaacaaaagaatggctactccataggtagagcagccctgagggctgctggttgcctgtttttatgattatttcttgattatgtattaaacaaggggtggattattcatgagttttctgggaaagggttgggcaattcccagaacttagggttcctccctcttttagaccacatagggtaacctcctgacattgccatggcatttggaaactgttgtggtactggtgggagtgtctcttagcaggctaatgcattgtgattagtgtataatgaacagtgaggatgaccagaggtcactttcgttgccatcttggtttcggtgggatttggctggcttctttacctgttttatcagcaatgtgtttattacctgtatcttgtgctgacctcttatctcatcctgtgacttagattgccttaactggctgggcgcggtggctcatgcctgtaatcccagcactgtgggaggccgaggcaggtggatcatgaggtcaggagatcgagaccatcctggctaacatggtgaaaccccgactctactaaaaatacaaaaaaaattagccgggcatggtggcgggcacttgtagtgccagctacttgggaggctgaggcaggagaatggcgtgaacccgggaggcggagcttacagtgagctgagatcacgccactgcactccagcctgggtgatagagactctgtctcaaaaaaaaaaaaaaaaaaaaaaaagaatcacttaaaactgtctgggaatgcagcccagtaggtctcagcctcattttatccagcccctattcaagatggagttgctttcattctcctgcctctgacaattacggtcattgtcctagggaagactttctttctctactttcctcccttttaaacccattatccgttatcgctttttcttcccccagcacaccatggctctaaaacaggaccgtcccattgacagtgatgaaaatgttctatacctgtgctttctgatgagcgtgcaatagttttcttttgctgtcagatgaccatacacctagtaacttccacaacacaagtatattaggttacagttctggagatcagaagtgtagcatgggaatcaccaggtttacaaggattgtagctggcaggatgatatttctataggctcataatttgatctttccccatgcctttcctggcccctgaaggccactgtcattcttgggctcatggcccctttccccatcttcaaaatcagtaatggtgggttgagtttttctcacggggtgttcactctgacattgggggttctcttccatgccactggcctctgtttcacttctcaggaccctggtgattatacagggcccacacaggtaatccaggataatctattttatggtcatgtgattagcaaccttaattctccattgccatgtaaagtatcctattcaagattccaggtattagaaccttaacatctttaaggggtcattatgttgttttccacagaaagccaccaaccacaggtgtctgttgagcacctgaaatacagctagtgaggccaggtgtggtggctcatgcctgtaatcccaacattttggagaccaaggcagaaggatatcttgagcctaggaagttgggattgcagtgagccttgatcattccagtcttgggaatgggagtgagcgcctctgtctccaaaaaaaacaaaacaaaacaatacagctagtgaacttgatttaacttcaatttgaatgtaagtactgatacttgattgttattagtttgtttgggggatccttcacatgtcattttttcaaaggctaaatataaatcaagtatttccaatgacaattcagtttccatatggagatgtgtaaaatacaagatttcaaagacatcctccaaaaagaaaagaatataaaatatcttttacatgatagcatgttgaaataatatccttaataaattgggttaaaatgaacgttcttaaaattttactttttttttttttttaaaaagtgacttctaagaattctaaaatgacgtatatcacttacattttattttacaagacaggcttctctaaagtccttcaccagcatccttgagctatatctaatgctgtgtgatgagtgcatgtatttttcatttccatcaaatagaatttgctacagttcttattttatttctaattatcccctctcccctactgagcacagaacttcaacatctctaatttctgtctgtattctgatttctactgacaacttcatggtggtatcatctaccacattttactcaaccgaaactggatgagtaaggactgccaccagtaccctggacccacagacaaccctgagatagaagtcatttatctacgcttgcagctaggctcagaaggatgtacatagctggactagtgatgaaactagagttttattgcagagctacctagccataaatattccttccctgaatgtacattagctcaaccattgtggaaaacagtgtggtgattcctcaaatacctggaaccagaaataccattttacctggcaatccaatttctgggtatataccaaaggaatataaatcattctgttacagacacacatacacatgtatgttcactgcagcactattcacaatagcaaagacatggaatcaactcaaatgcccatcaatgatagattaaagaaaatgtggtacatatacaccgtgaaatactatgtagccatgaaagggaagaagattatgttctttgcaaggacagtggatggagctggaagctttatactcagcaaactgatgcaggaacagaaaaccgaacactgcatgttctcactcataagtgggagcaggacagtgagaacacatggacacagggaggggaacaacacacactgggggaaggggcgaagggagagcatcaggataaatagctaatgcatgcggggcttattacttaggtgatgggtgcagcaaatcaccatggcacacgtttacttatgtaacaaacctgcacatgtactccagaacttaaggaagaaaaaaaaatccttccctgtgcttctgtacccacttacctggtcatcactagaagatgccacgcaggtggcctcagtcttgtctccctagggtcagacagaggaaaccccaggagggggacagaatccaaaaggcatgtatctctacacgactatgcattttctctccaacagtcatccctggattggtcgatatcaaaatccaatttcaccaggattagtctcgggttgctcagagctattcattgaattaggaacgattatagcagagggagccccgtggttctttattaaggtctttgtggaagcactaagtgatcttcaggagattaaagtgccagtggtgttttcttaacatttataacctgcgccgatacctggggagtttgtgtattaagaaaaattctgccgcacagatcccgcctcctaataaggccttcacactgggcccgggtagaagctggcattgtggtcctaatgagcttatcagggaagctctgccaagtgccgcctggaaacccacctcttggggttaatggacttcccatctgtgtagggtcctgcagcctttcctgtttgatggggaggctgcgtctcagagttgtgcatggcctgagaaataaaacaaaagctaggcccggcgccgtggctcaggcctgtaatcccagcactttgggaggccaaggcaggtggatcacctgaggtcaggagtttgagaccagcctggccaacatgatgaaaccctgtctctattcaatctaaaaattagctgggcttggtggcacatgcctgtagtcccagctactggggaggctgaggcaggaga[145 bp omitted]tctttatacaagggacttaaccattcacaaagacttggatgtaatttcactctaaagcatccaggacaagtatacatttatcattttatgtatatgcaaatggagatccagagacatgaagtgagcagacttgcaggtcgctcatggtaaggcttagtcatttacgctgcagatatttactgagaacttaccacggactccaggtcagcagtttcaagtggtacagttttgcctcccaggagacatttgaatcccaggagatattttttgttccaactcacgggtaggcgactggcatgtggtgggtggaggccagtgatgctgttgaacattctgcagtgcacaggatgatccacccatcaaaaataataataggctgggcgcggtggctcacgcctgtaatcccagcactttgggaggctgaggcgggcggatcacgaggtcaggagatcgagaccatcctggctaacgcggtgaaaccctgtctctactaaaaatacaaaaaattagctgggcgtagtggctggcgcctgtagtcacagctactcgggaggctgaggcaggagaatggcgtgaacccaggaggcagagcttgcagtgagccaagatggagccactgcactccagcctgggcaacagagtgagagtctctctcaaatgaataaataaataaataaataaaatgaaccagccccaaatgtcaatggtactgacattgaggaaccgtactatagtggtagagggtttcagtgaacagaaaagccacagtctctgctctcctcgagttacatcctggtagaaaagataggcaatatacaaaatcacagaataaaataataaaaaggcaagaagagatgtatgctgtgaagaaatcagtggtcaaggggagagagagtgctggtgcagagttgctgtagatcatagggccagtgaaggtttctccaatgggtgacacctgggcagagattgtatcggcaagagggcaagctacaggtggtgtcccagggaaagagtcttccaggcaaagggcagaatgaatgcaaagaccaaagatggggtcaggaaaagcaaagaggccaacaagcgacaatgggagacaggcagcaggcaaagtgggaggcagtcacagccgagaacactgaaccttatagacctagagagccaatgacgatccaggttggagaccactgagaagggggtgtccctggccactttcccgtccacctctaacatccttactttactgactgccctcaatttcctccattctctgaattttctgcatggctatgtcctaccttctgatctcccaaatatggtaatgtccattcaggtaggtctcactttagagccaaacataacttttatggccaggcacagtggctcaagcctgtaatcccagcactttgggaggccaaggcaggccgatcacttgaggttaggagtttgaggccagcctggccaacattgtgaaaccctgtctctagtaaaaatacaaaaatgagccaggcacagtggcacacacctataaatcccagctactcgggaggttgaggcaggaaaattgcttgaacccgggaggcagaggttgcagtgaggtaagattgtgccactagactccagcctgggcaacagaacaagactctgtctcaaaaaaaaaaagaggtcaaataaatcaggagttctctcagagattacttcccactaagctttgatgtgctacagctttaggaactataactatgaattccgtagccactgcccttcaggaatgtgcattctagatggtttgtcctattagcaagtttcctagctttttcacattttcttttccttaggaattacacactatgcttttgtcataacgttcagcaagcttctcagggatgctataatgacttctcaagttgaatgaggcacactagtaggtactgggaacatacaggcagcatgtctgtccttgagtgttgatggcctttcaagaggctgatgaaaggctttccagccaggcgtcattgcatccagggccatgatcgaaggccactggggagagtgggctggagagaggaagacttaagtgttctctttggagagtctcattgaagtgacacctgtatcagggttctctagagggaaagaactaataaaatagatgtttatgtaaaggggaatttattaaggagtattgactcacacgatcacaaggtgaagtcccacaataggccctctgtaagctgaggagcaaggaagtcaggctgggtcccaaaacctcaaaagtagggaagccaacagtacagccttcagtctgtggtcgaaggtccaagagtccaaaagctgaagaacttggagtcccatgttcgagggcaggaagcatccagcatgggggagagttgtaggctggaagactcagccagtctagtctttgcatgttcctttgcctacttttatcctaggcgtgttggcaggtgatcagatggggcccacccagattgagggtgggttggccagtccactgacttgaatgtttatctcctttggcagcacactaacagacacacccaggaccaatactttgcatccttcaatccaatcaagttgacactcagtgttaaccgtcacaactcctattgacagatgacagcctgacaggaacattcattcctccttctcctagacctgctttgaggccactcatcttgagaacttcgtgctgcctgaagtggtggaggacgcattgcctcctggataacagctgcttgtttgtactgcatacacctttgctttatatgtttggtggagagatgtagtagagggaatggtgacctccaaaaaatatgtccttgtcttccataaatgtgatcttatttggggggggctgtgggggaggaggtctttgcagatgtaactaaggatca[143 bp omitted]ctcctgcctcaccctcccaagtagctgggattacaggtgcgcgctaccccacctggctaatttttgcacttttagtagagacggggtttcaccatgttggtcaggctggtcttgaactccttacctcatgatctgccccgctcagcctcccaaagtgctgggattataggtgtaagccaccgcacccgaccctagtatcgttttaagaagaaaaaggaagagggaaattggagtttcacccccgcagagggaagtagggactgtggacattgaagcagaggatggaaggatgcagacccaagccaaggaacacctgcagccaacaaaagctaaatgaggcaaggcatgattcctccctagagcctctagaggaagtgtggccctcctggcaccttgattttagatttctgtcctctacaactacaggagaatgaagtccagtggctttaagccgccagctttatggtcctctttcaggaaacgaatatagagacataaaacgctggctggttctaaatatgttttccccggaaggtcccagaaaaaagagaaagaaaagagatcacactcagtggagggctttgtgatgatctctaaccccaacatgcgttaggctctgaggtagctgctctgtcatctcctgctgcatttcatccttcccactatcctgtgagcttagtaccattagtgtcctttttgtttttgttttagaggcagagtcttgctccattgcccaggctggagtgcagtggcatgatcttccctcactgcagccttgatctcctgggctccagccatctcccacctcggtctcccaagtagctgggatggcaggcacatggccatgatcagctattttttttttttttaatttatttagtggagacagggtctcactatgttgcaggctggtgtcaaatgatcctcccaccttagcctgccaaagtgctgggattacaggcatgagccactgcacctagccccattaccccattaatgtcctttgatggaaaagtaaagtgaaggtcagagaagaaaagtgacctgcctaagattagcaaataacagggatggtctgtgtgattccaaaaccctggttcattgtgctgcatcccaccatataaaaggcatgcaggctgaaagagatttcctttttctgttgttttattcactcctcaacctctacttcctaacactcttctttttccctttccatacacccacaatgacctgaaacacttttggcttacttttttattttgcatgctttaaggattctttttaatacacaggtatttctccataacagtttatacgcatttgtatataagcatacactacaaaatgattaattgagcgttgtatgtttttatcaaaggaaacaatgcaaagatttctccaaagtgctgtttgactagagatgattaattttaattttcacatgagcggtataatgctattaatcatttaatatgtttaatcataatctctgtaattcctaattaggttcattaaactgaaacatccagcagttatacacaaatccaaatctatgtttccttctcaggataagaaggagctcattttgtttttgcattgaaacgggaacttctaacaggatggaagagaatggactggaagcttagggtttcagctacagcatctgtaaactccgagtctgggtgtagagtactaaaaccccttaacttctgaaaagtgacagttgcaggattcgagctcatttctgtgtcatggacgtggcaccaaacctcgtattctcagcggagaaaacgcaaattctgctctgtttgggtttcagtgttacagtgttgctcttcgactatcacatgaaggcggcgacattgattgtacacttcttcatgcatttgtttattcgtgtactaataattcattcggtcagtgagtgagccaactgttaaacagacatttatcatttgtgttacaagctggtcataccacactcctgctgtgacccttaggtggctccttattgctcttaggatgaagctcagactcttgctttgcacagtgtcctttgatctagccccttgactatctttgaaacctgtcctcctgccttcccttcatacatgcctcatctgaccagtggtgctggagtccacacatactctcctgaatccaagacatcatttcacatctctgcacatctgcacatgcactgccctgtcttggaatagcctcagtccttttcacctcttctcttagacatctcccacttaacgtttaacctccagaattggcaagcctggctgaacctccagcagtgtcatatgaccttgatttaaggttactcagccctttgtgattgcctcttatcccaacatttaccagtctctggggatggtggctcacgcctgtagtcccagtgctttgggaggcagaggcagaggcaggaggatcacttgaggccagaggttcaagaccagcctgggcaacttagtgtgacccaggctctgcaaataaaaattagctgggtataatggctcatgcctgtaatcctagctacttggaaggctgatgtggcaagattgagcccaggatttcaaggcttcagtgagccgtgattgtgccatggcattccagcctgagtgacagagcaagacccaactccaagaaaacaacaacaaaagacaatgacaaaatgattctatttatgattgtttttctctattggtgtcatgcactaaagttggaattgcatgtgacaaggagggctgatttatgtgtccaacacaaagcagttgctcagtaaagatgtgtaaacactttaaaaataagcaaatgaaaacctttccttcgtgtttctcaaaggaggtttatttctctttttggtatttaaaaaacttgccatcattctaaacatttcgtcactttccatttattgaatacataccaggaacttggccaagttagcacacattaatcaatcacaaagcctcaaaaggtatgaactcattattctttatttaccagttaagaaaatgaccactgtactgcttcctattcaatccaacagtataggcaaaatgactaaatacattgtctaaatacatgacttgcacttaaaagctgaagtcaactggtaggtcttttgataccagagcatcttggaagaatggtttgccagctaacaagatgtctttatttcaaaatgcgattcagggtgtgttaggaaggaaaatgcaaatgaaaccttccagtacataccagggctgatgagaaacttgctaattatgcccatgttatctgagtgtttgttttgtatttcactttgtaagattgtcttctctcggtcgttattattttacacctggctgcctacattgatagttttgtcccaattatgtacttctagattgcttataaacaggtcaggatgattcctcactcataaatttgataggcttctgtgtaagctttctatcatagtttcaaagttggtatctgatgtggatggcatttactgccagctggaggcaatagttgctaattgcagagaagtatcaaatgctaaatgtctgaaatgttaaaactctagaaccgagagtatggcagtggctataatgatacctaatgtgactgtgacttttcccctcgttcctgccaaatatgtgggtgtcaatgtaacgtcatgttatacagccttatttggaagacaggggaggtgaaacaatcagttatgctgatgatgttacatggtctaggcaaacagagcacaacagcactttctgcagagatggaaacgttctgtatttgcattattcagtatggaagcaataactacatgtggttcttgagcgcttgaaatgcagctaatgcaaacaaagttaaatatcttgttttaattcagttaaatgtaaattgtcacatgtggtcaactgtagtggacagcaaaagtttgtacaattagaacctcaaaagaataagtcaatcagctggttatttgaactccagaatgccaactagtcttttcacattttttacatttaattatgttttatctgcacaattacctgaacaattatgtaggcatatcttcagattctgaacagcgtcggttaagaaatacacactgtcctgcctttaaagattattacccccttcttgatgaggttctcgctccccacctcccaaccccagcagctcccagtccccttcctttgctttttctagcctatagtgcttttctctgtctgccaacactctatctatggatttattgtctgtgttgccctcatgagaatgatgctccctgagggcagggatttttgtctgcttttcccactgcctaatcccagattcataatgagcacccagtggacgctcagaaaacacttgctgaatgaatgcatgcatgcatgcgtcagcattttcttcccttctcagattgcttagttctgatcttttcctgccactcatggcaagcaaaagagcatcggaagagagcactgtggtccactgagaacctcttcggtttcttcttgttcttttagcagacagatgacgcagcaccgacggatggccagccccagacacaaccttctgaaaacacggaaaacaagtctcagcccaagcggctgcatgtctccaatatccccttcaggttccgggatccggacctcagacaaatgtttggtgtaagtatcacctttcttcccagcagtgcccgctctgggggttccagagacctccctgtctcatgtaagtttggggtatttacaatactaaggttagatgtttgtatggggagaaacaatttagagcctagtctgcaggtatattgtggctagaatctctttatggttttagcatgtatttctgtacatatgctcaccatgtatctactttaccaagtggctttcttctaagaagtaacttgtaggccaaatggaacacaaattcctagatgacccactgttgaaggaagcctattgatggtcctaaatccaatggcccaggacatcatactgcagcaaaaatacacatcgagtcctcttggttttgctttcttttacagttgtcaaatgatccagagggtgactcttagtgtatccctgcattgcctagtctttcccaggcactgtgcatttagatttcagatgcatcagcagagaacaactacttctgcataaagctgattttagcaaacaaaacaaaaccaccaccaccgacaccaaatgagctaccagtttctaagtccatgttgattcctgaagtctacgttcttctgaaatcagtgaaaaggattcagaggtacttactgtggtgctatatgccatgaagtgtagccttgcccaggcaccatggtgaaacacagagcaggccacaagtcaccactgacccaggagaaaataatagcattgctttttttataggtcatcttgcccctgattatttttttctcgaagatatcttcactatccactttgggaagacatgagtttgccatttctttgaccagtgttccaccaaaggacaaagctgtgacagggcttggatatcattcatgtttgcagatgtagccaatttgcccatgacatcccagcaatgatagcaggtgcctctggattcaatgaaaagaactacatccttaacatttgacttagagcaatggtgggcttctcagagactcttcctctaagagttaataaatggatgcaaatatcacaaaaggaacaagaagatgcccaacttgaatgcctcattcctagccaagttggtggtgtctccatataaaatgggaggctcttgttcactactcaaaggcactgtgtgttggggattagcttgcaccttttacttcttatacacacgtgatgcttatcaagtatgcatctgacacaaaagcagagcgagcatcctaatattgaagatacccagctttgaatgctgacatttcagaggaaaaggtcagctcttgcacttttatctctctcatttggtaataaccttgagttgagccttccaactcctgcagaacagagataccctcgggcactttcaggtcaaagatgactttgaaaagtgcagagcattcaaagtgagagtcgaggttaagtgtgtgtgaggcagtaagaccaggtgtgaatgatgggcggtaagaggagttatattctctttgccgtgtcaggttaggaagacatcttgctatgcagtctatttttttctcatcaagtgtcactgtgatgttggctttcaatgtgatccccttaatgaccgtcctgacactctttcatggtgtcactcagttatcgtgaaagttactgcaggctacaatgctaagtcatagaggtattcaaaatattcacaggaatcagagaagggatcctgagtctctctagtcttacagaggtagggtagacggcaaggagcaagatcttgccaaaaaattgtactaccggtcatcagaccttgatccaaatctactagtttcagggctcttgtttttaaaaagacaagttctcactctgctacccaggctagagtgcagtggtgtgatcacggctcactgcaaattcttgggctcaagggatcctcccacctcagcctcccaagtagctgggactacaggcacaagccaccatgcttggctaatttttaagtatttttttttaatagagatggggtctcaatttgttgtccaggctgctcacaaattcctggcctcaagcaaccctcccgccttggcctcccaatgtgctgggattacagcataagatgtgagctattgcacccatccagcacccccccccccccttttttttgtgacaaagtcttagtctgtcacccagactgcagtgaagtggcatgatctcggctcattgcaacctttctcctgggttcaagcgattcttgtgcctcagcttcctgactagctgggactacatgcattcaccacttcactttaaagtcaagattttcaagcaactgacaagatgtcaatttggcaagatgatagatacacttaatacctgtcaattaagagaacacaccatgcatttagtgcacaaactcaaccttgttcatcacaaatagcatctgtgtccctttttttaaaagtatgcaagatttatttgtttctgtaaattttgtctataaaagtgccaggaacatacagattcatagacccccttgcaatgactttcaagcctccttagtttacaaccactattctaaagaaatgcagttttatgcactaaaaatctgttctttcctgccaaacaccggtggtcatggagccgttcttgttataggatacatttagtggcaggaatcacattgtgaagcatctgtaaacattctcattggctccctgcactggagcttagggaatttaggagggtttcctcttttgggtcatagttactgcaagaaactacagtttaactccaattcggtacttctcacgttatttggacatgagacatcttctttccttttggtgctctatcctgtctttgtcttcccactttgacaggggtttacagtgaggacaattacagagaaaaacagtcacaaagatctttgtgcttttccccccctttgtctcttgttaaatataggcatgggatttcaaagtcaaaagcaaaacaagacaaaaaagcaacctccttcttcaaactgcctaaaacttggcagtgatcattacaacgtctgtaaccactaataattcgaccataccatctgcaaccgttacatgcctaatggttactgcagatgactcattttatttctaatttgtatcttcagcacatcatgaagattggaatcctgattaccttttccaccttgtgcttcatattctttactttctactcattggaagcatttgttcccatgtttggcattaaatcttctagctcatctttttttttttttttttctcatttgagatggaacattccttgggcaagatatatggctacagtatacaaagcagaagccatcgtcttttaaaaataccggttgaggttcaagggaatggatctgttctgtgcagtggcattgatattaaatggttcattggaagggatgttagttttataggtggctactttttccttgagctttgtcttcacgttaggtatcatgcatgagcatgcattttctttacagataaatgtttgatgatcccaaaagaggaatatatggatttctaacaaattaattgcgatatattgcaccctaaatagaatgtttaacttaatatttaacatttaaacattctgggtttgaagtgagacaagtggattgtgatatatccagacttctgctacaacagatggatggatgttctggatgccttcacggaattgtcagaaacagttgctcaatgactacagttctcaaatttacacaacacccttgttgattccacagccttactttaggggtcaaaatacagaccctcttggccaggcatgatggtggcttatacctgtaatcccagcactttgggaggccgaggtgggagggttgcttgagttcaagaattttagaccagcctgcgcaacatagggagacccagtttctacaacaataaaatcaaaaaaaaccacaccaaaacaaaatataggtcctctgggcaggaaaatggtccactaaacctctctttattgtcacaaaaaaacagatcacatgactttcagcacatgcaaaggaagatttcaagatcactttttagtcacgagacgggcttgcctgtacttatgacgttaatggaaagttccatctaccatgatgttgtgagtgaagtcattatggggagacagggcatggtaccttctacttctgcattctgaacaggaagctgacactaagaaaaactgggatgatgcctttctttggccttcacgcacaatctttgaactaacctttacttttacgttttatgctgtatccattgaacatccctcacagtttttcagagaaatattgtttgatctgagaacatctaaaaatgcttggtaggtatttgccaaagtgtgtgtgcctgtaagcttctagatcttgtttgttttgttttttaagatagagtctcgctctgtcacccaggctggagtgcaatggcacaatcttggttcactgcaacctccacctcccaggttcaagtgattctcctgcctcagcatcccaagtaactgggattacaggctcctaccaccatgactgggtaatttttacatttttagtagagacagggtttcaccaagttggccatcctggtcccaaactccccaccttgtgatctgcccgcctcagcctcccacagtgctgggattacaggcatgagccaccatgcctggcctggatcctgctcttgatacagctattgagaaactttgtgtggatttgaggcgttgttgaatgcagctgaacattgatgttgagcaaacaaatgctagttatgtctgcgaatgagtcgtgtctatttaaattgaaaatgtgccagctgtgtttacatcattagtagcgaacttcccaattaaactgttgatactataaatatagtacacaactgtcttggaaatggggcttacatcagcattcttctttgggcttgtttcaccggctttgagaaccgtcaacctaacagcaactgccacagaagcaaactttgagaccacttcagggcagctgatgtcattgtttcatttagggaatgacacctgccaagattgctgtttgattggttctgtctcaatcagatcttattttaaaggaaatgtttttgggttgactgcctagagaatgttccatagatgacagttgcatcgcggttttggaagaagtccttttcaagcttctctttctgtaaatatatgtgcttctaggctcttatgcctgaaataaatatgatagcgtctgtggagactgaatattcaagggtggttggtatcaaaattactgcttgaggagttcacaaaactggaggtttctttactatgaaattcagctcacgtttgaatggcaaatccttcatttccccaatctgaatgttttcttctatttccagtgatttttctctgcctaaaactagggcactgaaaatgctctgtaaaggaatattctcttgaccaaaagatctaagtccacagattgcaggatgagtaagctgcacgtttgttggcgtttccattgtgcatgcaagcaatgtgacccctttccatgttctcttctgagtattttctctttggtttcttcctatcctttgcttctctgaacagaagtgctggtagttctttgtttcacaacttgaaatatgtgcgtctgtgattcccccggctgtatagtgtatgggtcctgaggaacgggcacatttctatggcacagaatgacaaacttttggttactttgtcccatagtcagaactatttttatttcaagattgggctgtctgtattcaagtggcatatacatttgtttctactgtttctgggagggtggatttctttgtccattccagaggatagctatctgtatgttctaaataatttgtttcttgaatgttagtaggaccctcttgacattcactctctgtgtctctggatactctatgactgaaacacatagtcaggcaaacctcccctgcttcttgtgtggtctttttgtttgttccttttttatcctgccccacccctcaccccagtcgctctgtccgctgccacacagaagcacgcgtaatgctctccactcaagggagagatggaatacaaaacctctgggggtcataaaggatgcaattaaaatccagaatgcagaagtgaatggaatgataggaaagctcaaaacaaaacaaaaaaagaggatggaaatatttatgttgccctgtttaatttttaatcactcaaagagcatttgctctcattctgcatggagataaaattcccattttatttttccctgggccacagtacatgattttacattaccctctctctcagttgctcgtacttatgcaggttaggctactgtactcaagaaatggccacaatacttcatgtgatctcagaaaactgaaaaaattccaaggttgggggaaaggatttcagatgatccgatgcccctagttctagagcccatacttcctgttttgaaacgtgatcaagaattgcttgatgtacatttctcactgggacttccagatttcacaaatttaaaaaatatgtaagacacagtcgttgaatttgaagttcaaataaaccacaagtattaagtataagtatgtcccaaatgttgtgtgtgacatatcctgaaaaatctgaaatttaaatttaaccaagtgtctgcattttatttgtctctatttataatctgagtctctgtttctggacttttcatagagcctattcatgctagttgtctaaaatctatttgtttaacaatgtggagaattatcttgagagaatttcagcccaagcactgatcacaactgctgataccatcatgatgatagtgcctagatagtggagtttgcttctgtgtttgtactttcttgctcatatgatagagctgctcctagattttatgtgagctaggagccaaccccagtcacatcacattctcactggacattgattatcaaaatcacatttcatcaagggtgtttctcccagtgtttagtgggatagaccagaaggatcattgtatgtacatactagccacttttaatctttgctgctcagtgcctgggaaagcagacatgcacacaggaaaaaaagaaaaatagaattaacctcttgattaatattttgtatcaagccttgccggtatattccataataaggagaaaatatgggtggttttattttctcttgtttcaagcacattaaccataaaacataaaatgtgtatccttggtattaaaagagaaaaaaatggacgtgggaaacaattactactgtacatagtaatgtctactgcatttctcttcttgcttataagatatttctatttctttgcagcaatttggtaaaatcttagatgttgaaattatttttaatgagcgaggctcaaaggtaagcaacttaattcactttagaattgtttagtttatttttaaatgtttgttatgaataaggggaaacaactgcactgtcttaatcagctcattgtgaaaatacacttcagtgggaattcctttagagaccaccttccgttttcaaaatggtgggaaagacatcgggttcagtttaaaatgtataaggggataattttaaattgctgttttatatatatatcaagtttccagaggaaaattatacatgcttaaaaaaataatgatgttgctacatttttgtttttcagtgataattatgttctttatattaaaaagtgagttgatagtctcatgagcaggtaaatatgtgattattctgtattaataaagtgcagttattttcctgggttgtaggggagaaaaatctcatatacaccaaccttttgaatgtaattttattctttagtatgtttaccgatccacatttagcaatttgccattgctttgagtttgttttttcaaggaaaccaatttttaaatagattccctagtgctaataaaagtcaggggctctatggagaggtttgggttcaggagaggttctgtttcaaaacagaaatatgggctgggtgcagtggctcacgcctgtaatcccagcactttgaggtgggtggatcacctgaggtcaggagctcaagagcaacctgggcaacatggtggaacctcgtctttactaaaaatacaaaaattagctgggtgtggtggcatgtgcctgtaattccagctactcgggaggctgaggcaggagaatcgcttgcacccaggaggtagtagttgcagtgagctgagattgcaccactgcaccacagcctcggtgaacagagcaagatcctatctcaaaaataagcaaataaacaaaagaaatatgttgggagaagagaaaaacagaaacatttctaaaacctcctctctatcagtggctaaccaagggtggtcccagaccaggaatatcagcatcacctaggaactgattagaaatgcaagttctcaggctccagccctgatctgttgaattcaaaactcccaagttagggctcagcaacctgtgttttagctccactgaggaaaacaacacatgaggcctataagcagacacagggggttaacagggagaatgatggagaacaaagatgtggatcttggtaaccagaaagtgaatgctttcaatagctctgacgggtctcctggctgccagtccccaggctattaggaattttaagttcccttctccttgcatcctcagactatgaatgcaaatgttgagagatagtgatttcagcccattgactctccttacacaggcgatttgaggcaagtcggtatcacggagggtcagtaagcggtgctggttttatttgaagtgtcacaggccacattgccagctcttttggatgtgtataaccatctttcccccataaaacaaacctttgatttttttttctttattccttggacagccttcctccctcctaagtaaatttagtactaattaactaggatgatgttgatcatatcaaggaaagaaaaccccagtattttctcctccatggccagagtgatgttgtaatctgtcagatgagcaaaaacaaaagcaaaacagaatcccttacactttgtgataatactccttcagggaccttgtcatttttccatagctccagatattttacaatcgttctcgaacttaagtctcttcctgcttcttgtaggaaagttattacggggactattgctatacctgcaaagcaaagtgcattgagagaaaaatgtgcccagcctaattctgttcactcgagccttctgtattcttggcgaaattgtagatgacccgaatgttgaccaacttcgttctgaccctaggtctgtctatagcagcactgccttcaaagatgtgttgttgttgttgttttttaatatgtttaatttatattttgttttgtaacttttgccagttacaatgaagaaagctgtttaattccttctgagagctgttttgggacattagaagaatatcatttgccattttgaaagtacaatggtgatactgtttttaagacatcttccgtcattcccatgattagcctgtctctgggggcttcaggaaaaagaccatttaagtttgctgcatccagagcctgactttgtgaagctgcctttttttggtctttattcttttggtttaggaaacatccaaaatagcctctctcggtgggtatgcgccctctgaaagagcttgtcttgcaggtgttggagctgactgtttaggtactgctggaatggcactgagacagtccagttgggactgctaaatgggggcagcagctcacacagggatatttttcatagttgacattatcctttatgggaaagggccttatttagaggagcatttccattttaatggttcagaaacctgaactgttgctatggcctcattttcatcgtttggtgctggacagacagccaggaaatgagtgggcccttacgagccaggaactcaccttcttgcctttcattctctagagcagttcttcaggcaggccactcaatgctgaaggctgtgtgtgctgggtgtgtgtgtgtgtgtgtgtgtgtgtgtgtgtgtgtgtgtatgcggacatataaacccatatgtacttaagggatggacgcagtgtctcatacctaacattctagccctttaggaagctgaggtgggagtattgtatgaagccaggagttcaagaccagcctggacaacagtgagaccccatctccacaaaataataatttaaaattagctgggcatggtgatatacacctgtagtccaagctacttgggaggctgaggcaggaggattgcttgatcccaggaggtcaaggctttactgagctatgattgcaccactgcattccagcttgggtgacagagtgagtccttatctcagaacaagtatctatattactttggaatatagatccagtatctatattccaggtagtatctatattattttggaaatgtatataactcaagtatttaatgtatgggtgaatagcaagaatgcagaaaatccacattttaaagagatgtcagagagaaaatgagaattcgtaagcatttaggggcgaatgatcctgtaatttatttttcctttttacgagatttacccaaccatctcgtttacctctgatatggtctatttaagggctgtatgcagatatagctactccctacgtatatacttaagatatctggccgtgtgcggtggctcactcttgtaatcccagcactttgggaggccgaggcaggcggatcacctgaggtcaggagttcgagaccagcctgaccaacatggagaaaccttgtcttgactaaaaatacaaaattagcagggtgtggtggtgcatgcctgtaatcccagctactcgggaggctgaggcaggagaatcacttgaacccggggggtggagattgcagtgagccgagatcaagacattgcattccagcctgggcaagaagagggaagttctgtctctaagaaaaaaaaaaaaaaaaaaaaagctacactttgatctttgattcagtagatatcagtaagtatttgctgcatttcatgagagccaaccatgagtaagacagaagtacttcctgtcctcctgggctttcctgagtagcaggagagatggactaggaagatgagtgactgcagtagcctgtgctgttctgcggtgatgggagaggccactgagagtccggacaggcaggctgatattgtgagaaggcttctggaaagaaggaacatttaagctgagagtgagagttgcgtaagaatttcccagggaggggaaagagggatgtgtctcaggcaggagaagttgcatgtgcaaagatcactggagtaaaagtgagatgagagggctcatagtcccatcggaaaatgaatcttcagatgctcatcaacagctcccctcttctaaatatgaattctctgcaccagaaactagaggactggatttttcatctaggatgaaaaatcagtaccttcatccatccagggtgctttatttaagtctttaacatataaaatggtgtatttgcatgaatgcaaaaaaggaagatatcacctaaaaatacaaaagatgaaaaaagaacaataactaggatacaagaggatcagaatgtatgatttgcgaaaatattttaaagtaagcaagtcacgttggtctggcaatcctcttaaggtccccgttatctgccctactgattatacctgctcatgacagggcacaggccaccaatctcttttcttcagtagcattaaaggtaaactctgggaaggtgtgtctctgactccccttctctgtaccccttcttgcggtcttgattttttaagcagttacacatcagcatcacacccagccctttgccgagcaagccaagctcagaatgtgcttgttttgttctcctttttaaggcagaggtaaaaatattcatcatctttttaaaaactgcaaattgctgcttccctgagttagaattccgaccatgaggcgggtcagaaaaaacaaccttagcacccgctctcaaggttgcctggcacctgtgcatcgtggcaaaggttccctgctcatagagaggaccaggtgaggtctttctggttacattgcaaccctcaggtgagaattttgataacctgataacccagggaggccatgccacttcttgtctgggtgggaggtagaattgcccaacggaacaggtaggaaagtctgtctggcattttgaggaccgtctggagcacattctttctgcaccgaactttgtcaaatctcaactctaaatgaggaataccaagtagctgacaagcaaagagagaaagaagtttcgcagaaaaacaatgagaataataaaaaagaatgtattctctttgcttaaaaagtgagaacttgagaatagatgaggctatttcctttttagttcatgccccttccttgggattcaaaatgtatttctctttccacctttgtctttcctaaacatacttaatgctgatttcggggcagtaggtttgccttgggttcagacatgaagcatgagagcaaggttctggagtataatgttggacaggagggtgagtgttcagtctcacctggctgtgttcttcccagtgctgtggtaataatgactgctagttccaaagggcagaaatgataccacctggccctccagctataccagtggggctatggattttcttttcttgccgggagagaatataaatccaaagccctcgtttctctgattctttttggaatatgtggcatggctatggttgctaggaagttaggcccatcagggaggaagagaacgttgccaagaagcctgggacatgtgcttttggctgtacctctacatgtaagctccaagtaactgagtcaaaatctatagccaaaaatctatagatatcagcaatataaaattctatttattacaaaggatgaaaacctctttttcagatagggtgtcacccaggctggagtacaggggtacaatcacagctcactgtagcctcaacctcctgggctcaagcaatgaatgctcccacctcagcctcccaagtagcagagacaataggtacaggctgtcacacctggctttttttttttttttggtagaggtgaggttttgccatgttactcagcctggtctcaaactcctgggctcaagtgatcctcctgccttggcctcccaaactgcttgcattacaggtgtgagccaccatgcctggcccaaaaccttcttttgatggtttcgatcacacgtagtgaaatgagaggtcatggaaatcaaatcactgggccacacattttaagcaaacacatttctggactccagtctgggattctaatccagtggatacaaagcaaggctcaggaatcttaatgtttaatgtcctcccaagttccttctgatatgcggctaagtttgagatatactggccaagagttagaactgtcaaatagagcaaaatccccctaaattctctcttttttccctttgaagaacaatcatttccaaactatacagttggcgagtgtatttgcatacccaatatgggcatactttgtgcacaagactaagcaagacccttctgttatggagcaaataatcttaaatgaatcagataattcaggcttatcctaatcacagagcctcactatgggaaagattatggaaggtaatttggttcaatcccctaaagtaaagaaacgttatttttctcgatacagttcacccttgaacaacacaggtttgaactgtgcaggtccacttacatgtgaattttttttttttccaaccaaaggcagtattcccaggatgtgtggcctgtatatatagagggctgattttcttctatactcacattccacggggtgactgtgggacttggaaatgcaaggatttgggtatcaggggtggggatgtcttggaactaatctgtagtggattctgaggtacagctgtctatagaatcccgacaaataatcatctaccctcacttgaatacatccacatcccctgtcttctgtggctgatgagcctattccgactgttgaaaagttccgttagccagcccattgcacaatactttttttgttgttttattatactttaagttctagggtacaggtgcacactgtgcaggtttgttacataggtatacgtgtgccatattggtttgctgcacccatcaactagtcatttacattaggtatttctcctaacgctatccctcccccagccccccaccccgtgacaggccctggtgtgtgatgttccccgccctgtggtcaatacctctttagccttaaatttggaggtgattatagagaactaatgtaggactgggagttatcaccagttggttataactaccatgtatttgtaattattgtgcatttctttagtaaaactaagtattatactgtcccaactcaacttggagccaacaaggattatttgatgctaagaggagccccaacatattgcatgatttcacccagtttacagtgaaaaatctgaaagagctgggtaaatttatgtggaaattgttcgaaaggttggtgtatatttctgaacaagatgtacaaatatttttaggggctttaaaaataatgtgtcgtattttctgtacttaggaacaatgtcagtgaagacaaaatacggattttgacaatatagtttagtggggttgatttttgaggctgaaatattaaaagccaatgtacctgtggtaaattaaaaggtatatatgttatctatcagtaaaagaggaagtggccagaatattattacaaattacattctattaacaaagtttctttgctacctgttgatatgaaaaataaatattgacctaatgccagaactttacaatatgggtacacctttccctttctggttaacaaagtaggatggaaggttgtcaaattcaaaagcgtgtatgcaatttgaagagtggggaaagtatgagcacaaacattgaattgtttgtattattaatcaactgaagtttatttctgttcatttcatgtgacttttttgtttattagaccaaagagtttaagatttattataaaaaaggtctttccttttttaggcttttaagttttatttttgagaagtaaaggctgtagaactgacaaatttgaataaccctaaaactgcatgaagaagagatgttcttaaaaccacacggcatgactctgtaggcaatgttagaggattttggcattcattgttgaatttcgtgcacacgttttattttattttatttttaatttgcatgtcaaaaaagtggttcccttttcttttcctcattatttcattttattctctgtgaagacactgtaaatttattttgatctcattttcttttcgttagatttattttcttctgtagtgacatttagaaaggtatttttggtatccttctttgaatacttcaggggttacagctaactggtgacagaaaaaaatatcttgttcacatttgtcgcttaattattgcacatctcagtactcttataatttctctaatttgcatgttacagaactgaagccaggacaagaaatagaaattaaagcgagagaacattaccaagtggtcgttgactgaaataataatctgcatgttgttttcccttctccctcctgcatgcagggatttggtttcgtaactttcgaaaatagtgccgatgcggacagggcgagggagaaattacacggcaccgtggtagagggccgtaaaatcgaggtgcatgttcaaaatattttccttttcatcttttttataaatgtctgcttcacgctcattcgttgttccagatgcatcattggcgtcttgtatgtgaccctattccccctcattgtttatatatatatatatatttttatatataaaaaggaaaactggccttacttttttttttaattttactttattatgttactcttataccgctgaaaggtggatggcaaacgtgagacaaaagaaaggttaatcggaaagtgtttttttgttgttattttccatgttttataatcaatgggtgcagtaggttccaaagaatagacagtattgcaaaccaaacaaaatacagaacagtttctttttctttttctttccacttcagggttgaagagggatccacagtggttggcaaattaaaccaaattgggaaagcaaaaaagattgtttttttgtttgtttttttttgtttgtttgtttgttttttgtggaaaaaaaaacaaaaaaaaaaacgagaggtttttactaaacctctcgtttttttttttttaagaagccagtttgaatttctgtattcttttgataacaaagtgaataaccaaacaggatttcctgttcaatatctggcccctgttcactgaaagcataaataccaaaatactgacattcagagtctgctatttgtcccactgggatctcccgcaacatagccacagggtcatatttgttaattttttttttaataccagttacaaatgctttagtctttggagtaagatgttgcatattttgcctttcattttccccttcgacgataacgcttaggcccctcaccaaactctcagtaaccatggtaactgtatacaaacccatgctggcgatggtggtgaatggtaagtggtgaagtccatctgccgtttcacgtatttagtgctgatatatctatatacatatatatatataccacgtgaatttttttgacttgtcgtattaagttttcttgatgctctatttttttggatattggtacgcctgtaattgagtgtacgttctaagctagcctgggaggcactgactggattgagttatgaccggtgcacatcttactcagattgttaaccccatattgtgttaaacaatgcaccctctcttttatccttttgttagctgtgacgttaaagcttgaatgattttgttaattcttgcgatgtaaaaggctcttgttccaagtgttgaatgctagatgttgctttcctgatggttctttcctcctaaagtgttgcacacggctaagacttgtttgtccctttttttgacatttatgttcccttgtaccttgtctcttctctcttctccactgcatgctccttcatatgaattttattttatgtttaaaaaatatttcttgtttctgtgttaccatggagtacacgcatgcttttaaatcttcaattatgcagaatcttttaatttgcttttactgtccctttattaaacactcttaatgatatgacattgctttattgaaatgatttgtaagttaaacggttatgaagtaaatgtaattttaaaaatgtatgattttgttatgcacctactgccttttataaattaaaatgcattttactttttagttttcttttttaataagtaatcacggtcataatgcatgcaactaattgaattgggagctggccctagaatatgtgcttacttgagttttctatgtacataggtaaataatgccacagcacgtgtaatgacaaataaaaagaccgtcaacccttatacaaatggtaagtagagattggccttttacaagaaattctctctacttctgactctttaagtaatttaaccagagattctattacaacaagctgtgtttgcctgggcattgacactgtgtttttactactgacctgctacagtgaaccacctacatcaataagatcattttcacaacaaaggcaaatggagtgttcaggttaagtgtgcctgcccttcttcccttctttctagaataactctgtttgggattgagatgcactaattatttggaaattagtttgctaatttcattggttattacagtaagttgaggggagaattggaggtttagtttgtttgcttttcaataccatctgctcgttgattactaatcattcctggacgtgcagtcacgtaatttattctgtctttgagtcttctccagagagattagtcatttgaagtggtttagagtatacctcatgtctgaattccacagggttagcagaatgtgtgagtgggttatttgttcttctctgggctgctcagtgttattttgggctagttgagaatgttgctttgtattacagaccccatcaggacaatgcaatttctgtttttatcaataaaacttctgaaaactcctcctaaaaagcattcacatatgagttattaaaaatgtttgaacattttgattctttaattcctctcaaaataagtatctcttaagatatatggggaagaaacctgccactgtgttaatcacatacttaattgtaccaaaaattaaagcaatgcagtaagttaaagtatatacacatggtagaatattatacccattaaaatgagcaggataaggatcataaagggtctcataattaaaaaattgacataaatgtttgtcgcataactttagataaatgatgataatatgccagaatgctaatggttgtgctgaattgtgagactggcaaacattttttctttgattcaggttcataaaaataatataactttattacatcaaaaggagatatatggaattttatacttctaaaattttaattgcacatggagatacggattttttaaagtaaaaaaaaaattaaaagaaacgttaaagacaagtctaaaatatattttaaataaccccattgccaccctggtttcctacctcccccctcacaggaagccgctattacagattgttgtctatagttttattttgcgtattcatgcctatatatgtagtaggtgttcatttatagtattcatagtgttgtatacatttttatgtgaatgatataaggatacacctggcatttttaattgggttttttaataaatctatatagagttcctttaatttaatatatacagattagactaattcatttcagtggttatgtaatattacacaaaacagataaataggttcagtcagaactaaatactgattgtttatcacaataaaagaaaacaatgatctagcaatgtattatcatttggtagttttgattttcctgtttcttttgccagtgactaccaatttgacagtcagtttgctcttaattttaaaaggggcatcattcaacagggacataccgtctatataatagggctctaagttgaaagaccagaagaattacctattctgctatttttctcagctttgtcaaccaagacatgcccttaaatggtatagactattttcacaccagactttaaatgcccagtgctgaactgaagcaaacctctgatttatatgtcatacagcctttccagttgggtaaaagtaatgactctgaaacttgccagatttcatatatggtgacatcaacctgacggttgggcatagtctttaattatgaagttgcactggtgcccaggcacatgtgtgcttgtctacatatgactagctgctcatgtgtgctgagtgagaaactggagcgagaaaagccaaatatttcataagccatgtgcatgtatatttattttaaaagagttattgatcaattttatgaccagggactgaaaactagacctgtaggattttttaacacaattcaaagcccatttataaataactagcctttctggaatatgaggtatgcattatgtgaggcattttaagtgcactggacacaaatgaagtcctataaagaggacatcattatccctattttagaggtgcaacattgaggctagagaagatgaagaaattaataaagacttttttttttttcttttttttttttgagacagggtctcactttttcacccaggctggagggcagtggcatgctattggctcattgcaccctctgcctcccaggctcaagcaatcctccctggtagctgggactacagccacatgccacaatgcctggctagtttttttttttattttttgtagagacggagtttcaccaagttgcccaggctggtctcgaactcctgagctcaagtgatgtgcctgtcttggcctccaaaaatgctaagattacaggcatgagccaccacttctggcctagccttttctttttgttatgaagtaacaaaatcttgtgaccatgcctgtgtgtatcaggcatcgctttccctttgtcttcttgtagaaatgcactcaagtggcaaccaactacaataacaaaaaaattattaaatgtgcaacctcgtgttcctgccagattttggcatgcacatcccatgtcccattccaggtagccatgcactcagtttccaggaataagtcagtcatatgggtctgtcatccacgtacctgcaaaagggaactcagagaattgttcctgtcacacatactgtgtatggcacctaaggggttgatggatagacacagtagaatttatttaaaacacaaatgtcaattctaattatataaagactttggcttctgtagtggagattatggagaactttggtgttcaaagaaaagtagttctccaagctatcccaagtttcaactcaggagtatcaccactacagataaattcccttaagtggcaatacaatataactgaaaaaatatagggccctttcatatccttaataagcaagacgatagagttatggcaaaagagggtaagtcgggaccaataaagtcacattgaaatgagaaaattaagccatcggtgaggttcactcattagctacataattcattctcacaaagcatagaaattgtacttcagcaaaattataaattactggagctatcaaagtttcaggtcatctccaggtgatgaaatatagttatcaatgccagcatcaccttcatgcattacttcaatcatgtatccagaaaaacttttagcagctgcaaagtttccagtgataaataagactgaattctaaatgtgatgagatacctgtccattatagagggttacagttaataacatggagggtgtagatactattctcaggatatttaaacaatgacataatgaaaagctgtagaatgagccgtaggcttctggacattctattaaaaagttccacaaagaggggattggactatttctctattgctatttctctgaaggacacctacccacacggaggagttggggtttgctgtgttctttggggatcaaatgttggatctgcaatacaagattgagagctgaattcacaaggatttcctggatgctggggaagcatgggtgctagacatggctttttcattttcttagagatgttaggaaggatgaaaatggggcaaacatattcagcgctccagagagaggcatactttgttgcccggatcagttcttccattcactggctcttgaattgtaggaagttgtttaaactctccatgtgccagctctctagtgggaactgtacaaatgatgggaactacatcacagttctttgtgataattatgagagaaagtgctcaacacaatgctaggtatgcaaagtggcctaaaagattatttttactactatttatagcgcagtagtatttgattacacatagtttcaatattaagtcatcatattattcctttattgtcatgggtagttgaattccctgagagatactagtttaaggatcaattcttcagatgctaaaaggggctgaacaggtaaaatcagcaaacagacagtctttgaaaaactcagtcttttgggactagctattgttttcttactgaagtaaagcaaaatatttatctacgaggaaaaatcaacaccaccaccaccaccaccacgaattaacaataaaagatctcaaacatttaatctccctatcagtctcacaatggggagcagtggtaaatgtgactaagtggggagttgaatgcagtagcccttgaccacctctaataagtctgtctgtgaggcattctcaacttaaagttaccatttctaccgatgtttcaagagaaatagaaatcctgtattttagacggaatttaaattttggcaataaatacacgccgttaaagaatattcagtgaacccaaacaaaacacctttgtacccagtgcgaacctcacttctttttgtttggtatttgagagttgccacctgtaccatgtcagctgccaggtctctgacatccttagtatatgtctttagaaagcattgacaggcagtttttgtaattcctgtagcgtacataagggtgctctctggaatgcgtttctttgatatgtaacccagcaaagccttaagagaaagcctgtgctgatgttttttgtgtacacattcagacttggccttttaacacccaatgcagtcatagttaacactggaggtcttaaccagcatattttagaaatactgacacttgacctttgacaagctaaatttggggaggggagtgcaaattcagatgtggccccttgagtcctggccacggaggggtctaaactgcttgcgtatctgatacagagccagaccccaagacgtctgttctctggctccattgccttgttgtggggctgggggggccctgggaggctgggaccagtgggccttatcagccattctccttttgttgtaagcctcattgttcagtttaatgtccttgatcaaaatctctgaatttgcaaggcctggggacatacacaaactgcctaagaaattaaaaaggggatcattttgttcatcttcctgacagtgcaggctcttatctccagcagggttatcccaagggtctctttcaggtacgaggaggagtcacagggaatgtgggttcatttgcatgtgatttgcatatatttacataagcccgcatgagctctgtaagtctgagtggaggcgattttcaagggctggattctagaccaaatggacataacagacatttacagaataccttttccaacagctgcagaatacatcatctactcatcaacacacggaacattgtccaggataagccacatgtcaggccaccaaacaagtctcaacaaatttttaaaaaatctaaactatatcaagtattttcttagaccataatagaataaaactagaaatgaatagcaagaggaacttcagaaactgtacaaatacatggaaattcaacagtgtgctcctgaatgtccattgggtcagtgaaggaattttaaaaattcttgacataaattaaaatggaaacacggcatgccaaagtctatgggatacagcaaaagcagtgctaatcaaaaagtgtatagtaataaacgcctacatcaaaaaagtaatttcaactaagcaaccgggacaacagtcatccctaacacgattcttctttatttaatgtagagtctatggaaggaagcaggtccttgaagattggaaggagacataatcagagccaaaaaaaaatttgtctattaggaaaaactatattcctttagtttctttagagaaaaaccaagtaaatatttatggaatgcttactttgccaaacaacattttaggtgctggagattcatgttggacagcagtcttgcctgcttgactgttaattttaatgagggagaatggttataaaagacaagagcaagcaaagaaagaaagaagctaaatccagatagcattaacggcaatgcagaaaataaaactgggaatggaatcatggaatccaagagtaactctaagaggaggtgggaaagtgacattaactggcatgttctgaaaagactccagagccctaaataacatgaagtcgactttgtgaaaagctagagagttctccaagaagaaggagaagtggatacaaagagactttgatatacggtggtcttggggggttttataaagatgaaaatggccagtgtcactgtagctgggagagacggggaaagggaaaaagggaagtggtaccaaagaggtaccaaatagtttggttaatggttagtgtgtgctgattgactaaggtaagacatgtgtgcttatctcaaattgggaagaagctattgaattctgagtatcaggatgacaaagctgatgttttttttaaaaaaattgctttggtcaccatgaccagaatggacagggggaaggaggaggaagaggagacagtgagaattagggcatttctgctgttgaacttgtccaggcagagataggaatgccttggtctgcagtggtggcaatggagaagaagggaaggacttttcaagttttaaccaacaggattttctaatggatcacacatggggtatgagggtaagagaagaatcaaggaagtgttgatgaattttattttgagcaaccaagtagatagatatgccatttgctaaagggagaaggacttgctgagtaacaggtttcatgagtggggggagaagagggagactagaaattgggttttcattcccatcgcagagttcagaaaggtctttggtctccaacagtgggagtggagtagccttgtttagaagggatcaaggatgggaagaaggttgacacctgcactcatgttcccatgatgacccaagcatttcattttgcagcacacagattcccagctggtttcttgtagaggagactttatcaattacctttctcacgattaatacttgcaaacatgagatagcacagatctcctgatgaaggagagtatcatttattttctttatttttttatgaagagattgccatgtgcagacttggcaaactcataacttgcagaaagatggggaaataaacagcagattatagggggatagacagattatagatacgtttatagatagatcagtagatagatggataggtgggtaggcagatgagataaacatgatttctaggtagcctcaaatgcctctgagagatctggaattttttgctttgttcttagaaaatgagagatcattggcaaatttataatctttaagagctacaccaaaattcactgataagtataccttcagtgaaaaggaaaaggaagtcttatatgcaaaagaaagtatttaaggtagtaaggatattcaagaaacaagacctgagatgcacagtatgggaaagacaccatctccactaccaataagaggtaggagcatcagtagagtatgagatgggtaacagtggaaagatgaagagtgatcacttaataattattcatttaatatgaccccatatagagtttacaaattctaggtttctgtgaaaaactagaaagaaagaacattaaatatgtctgcagctttattttcaactagttttttgtactttttcttagactccaagttgaaatgtagatattaattcccatatcctcaggaattagacttttttttaaaaaaaggaagcagtggaatttcagttgatcaaattgaagtcatttccatactcataaaacacattctgaaatgtctgaactaatatttatttttacgtcactatagaaattcttataaggcaagatgtgattaatacaagagaagagggtgtcagtatgaaatttcagaaaccgctagggcagtaggtctcagaatttcatgtttctttctgtcactctaaaaagggggcccaggaattaaatatgcctcccaggtaatagaagtataacactttgagaatctctattctgagatcatcccgggggctgtaaaccacctagcttcttcaggttggaactgaaagttcttagaaaacattcttatcaagttttagaaagttctggatttcgatagacatactggcctgtctgttgagttagtgagcctctgttttccttagtggatgttaagaacacctctgggctattcttagttcgggcagaaaatcacacctctctcttctcggcaaacctcagaaagttcttactgtcaaaaataccttccttcacattcaaactttaatcattgccttctctcaaaaacatttattaaaggacctttggtatttggccttctgctcaaggactcagagcaaaggactacacaccttaccctcctctgtctttcaaggttttttttacttcttgagacagagtctcactctgtcacctaggctggagtacagtggcaccatcttggctcactgcaacctctgactcccagcttcaagcgattctcatgcctcagcctgattagttgttactactttgtatttttagtagagtcaaggtttcgccatgctggacaggctgctctctggaaactcccaacctcaagtaacctgcctgccttggcctctcaaagtggtaggattacaggcatgagccacggtgcccgacctgcatggattttttttttttttttttttcccgagagagtctcacactgtcacctgggctggagtgcaatggcgtgatctcagctcactgcaacctctgcctcccaggttcaggtgattctcctgcctcggactcccaagtagctgggattacaggtgcccactatgatgcctggctaattttttgtatttttagtagagatggggtttcactatgttggccaggctggtctcaaactcctgacctcgtgatctccctgccttggcctcccaaagtgttgggactacaggcatgagccacttcacccagcccgcacggatgcttttatgaagacttagccagcaggagcaggaaacaataacaaaaccctaaaacgtgatcagtctctggaaattgttcccctaaataatgcccagcatatatgtaatgtgctttccaatttgagaatattcttgtatgctctttttttgtgagtaaagatttctaaagggtcaggattcattttacaaaaaactctccatccagaacatttggaaaattacaggattccattaatcatatatacagattatttgaaagttaccttagatatcatacattgattaagaattttttacagttcctgaatgcatcaaaatgtaggccacagtaaatctctaggggataaaatatcattttctttggtttttatgaagcactttggaattctctagtatctcgaggttataatttggaatgacaattgttagaatatattgctgccaagaattttgtttatgcaagctttctaatttttgtgaacttaatgcagaggggtgtgatggattatctagcagtgatatataaaataagaaaaaattaaaattattatagtagttctaaaaaatattgatggagtagaaaattaattaccatgtcattttcaaagggttcacttgtggctggtcagtagtttccattccattaacttgcactggcagaaaatcaaagaagggcataaatatattttcttatgtgtggtttttaagtatttttatgcatgcccaaacgacacctcctttacattttaaaatacaaaatgagatactttaacccatttgatttgtgattcatttgcaattatataagatgttgaatcaaatgtgataataatgtttttgtgtatttgttttaaggctggaaattgaatccagttgtgggtgcagtctacagtcccgaattctatgcaggtacagagtttctctttgcacgaagtcttctcagtcttttctaaatgtgctttgcctgccaagaatgaatgagttttgtaaaataacctgaagcaagtgaattcctatcctaacaagttctgaatgatttctttgggcaaaatcaagagtgcttaaaacagtttaaaaattacaagggaatcgtctaagtttcatggttgggggatcagcgtggagccactgctccttaggacaattcacattgattttgccctaaaaaaagcattgtgactttgttcaatagtgtattgaacaaatggagagctgctcacacccattgtatttcaatgtgcctgaatgtgtgttttagccatacatttccatttggggttggcattttctttttcctggcaaagcagagagtcgagttggcttaattattccaataatgtgggagtgatttagaattgccaagggaaggcctttttcgataactaaaaagttgtccgtcttcgttcattaatcaaattcccttagcaattccttttctctctactttgccttccagaatatgtctctctcctcaccccttccctgcctaagcaccaattacctctcagctgggaaatccattctcttagaaattttgggagagcataacccagaagcagtagtggctgagatttcatgtctcgatgtcctcggcttggcccgtcactactgcctgtatgtctccttgctcttgaacaaggctgcattgaatacctaggaccttagtaggtttgccacatggctatttaaaagaagtctttctttgatgtggctcttgctttttaataaggagaaataaataatccgttgacctagagccactcccttagtaacctcttgacggtaagtcataccccttgctttgtttcttcctgggctgcctaacttttgtcattttcctaatactgaacactgacccttgtagatgagaaaggaacacagaaaacttagctactctggcacaacaaccagtctgacaaaatttaagttaaaaatctggtaaatctggaaaggctcaacaggataactgattcctggattttacgtaggcgatgtttggagttgttcttcatgtatgagttttaccgggagcctgggttaagtccagggattctaacactgcaaaatagctgtgttcactcttgtgggggaagagacttagccgtcaggctttccatgatcatattgcaaaccctaccacctgagaagacacctctgctgagtaaggaacatggaaaccatgcctacacagctcgggttcaaattctgcctcccctactcaccagcagtgtgactctgggcaagttacttaacctctctgtgcctcagtttcctcatctattaaatggagatgatagtaacaaactcatagtaatttattagaattaaatgggttaatatatgaagagtggtgtgtagccagcaccgtgtaaacatttagtaaacaaaaatgaatatgttaatctctttaccaggaaggcaaagttagctgcatattctgctgaattttgagtatgctatgagacaaagagattctttccttcattgatgagagtactagtccttcagttctcagtgtgttcatttagggggtgttaatttctgggatcgggggcatggcagtttattcaggggacacacagaacatggcatgtattgctgggatgcatctttgtgcaaagctgcaaggaaatcaaatactccaaatggttgaaaagtcagacaacagcttccatgtgtccgcagcaggcactgcccatgaatggagtagttagactaaagaaatgtcagtttctcctatatgcacatatctgagtgcatattttcagcctaaaatagtccagtgaagaacaagaagccttcttgtggggaggaagggtatggatgtgagtgttgtggtggagagggcaaaatgcatttttacatttttctggtcctgtgcgatggagttgccagtcacccttgggtctattaagcaggaaaatacctaatatccccgttacttgtgctttcgtagccacagacatatctgtgggtgttgaggaggacattaagatgagagaaacagttaagactgatttgtaactataagaataaattcatctgcatgacttctagaacattagagcagctattcagattagcccagggcccaggttcagaagttagatcattaagttagaggaaaagaaaatgttataatgtaagttaatatttactggatactttctatgggccagcactgttctaagcactgtacataagtttaatgtatttaatgctcatggcgattttccaaatgaggataccaaaatgcaaaaagttggtattactgctctgagatttcagctggtcaggaggaggccagattttgaaatcaggctttgatcatctcagaaatcgtgttctttacaaccagttgatactggtggggttttgtttgtttgtttgtttgtttgtttgttttgagatggagttttgctctgtctcccaggctggagtgcagtggcgcggtctcagttcactgcaagctctgcctcccgggttcaagtgattctcctgcctcagcctcctgagtagctgggactacaggtatccgccaccatgcccggctaatttttgtatttttagtggagatggggtttcaccctgttagccaggatggtctccatctcctgacctcatgatccgccctcctcggcctcctgaagtgctgggattacaggtgtgagccactgcgcccggccccctttttttttttttttttttttgaggcagttttgctctgttgcccaggctggagtgcagtggcatgatctcgactctctgcaacctccgcctcccgggttcatgcaattcttctgccttagcctctcgagtagatgggattacaggcgtccaccaccatgcccggatcatttttgtatttttttgtagagacagggttttgccgtgttggctaggctggtcttgaacttctgacctcaagtgatgcgcccagcctgtttatttatttttttttttaatattaaaggtcatgattccaatcgactgtctcctatgatcatgctactgctctgtgtgcaaaccagtgaaataaaagaagagaggtaacataatcattctgtatgattccagctgccaccaccaccaccatattcacaagtgttacatgacaaatctgagtatctgtgtttcatgctgccactatccggattatccggaaaatccacatgctttcctcttttcagctgtacgtttgtatgtaggtagacagagctcataatattcagaaatgtggggacatgtagctgtaattttaacactgcagagcaattcctttgaaatatttgaagacctgcaaacactgaaagtctggctggcttaaatctgaagtttcaggcacctgcatctatggaatggacctatgcaaagcgatagatgcagagtgcattcatttccatatccaggtataattattactgtcacgcatctacagatccatgactaagaatttatggggcatttaaaatttccccagctataaaaatagtctgaatttatcttgcaattctgagtgtgcctcaaagctgaaatgaagaccccttgtcattgatttgctttgtatttttagtaggctggctctgtatctgcttaagatagaaagccagacttattagtcatttctctatataaggttgtgtgttaatgacatgttttataatattctcatagtgtaattatttgattttctgaagcttatgcagaattaacaacccagcctcccgttgtctctcagaatgaggcatgaaaagttcacatattttgtaaattaaaatcaatattttcaatctctcctaaaggtaattttcttagtttagtagacttgtccctaacatttattttctcttttaattataaaatggcaagttattgaccaggcgtggtggctcacgcctttaatcccagtactttgagaggccgaggagggtggtctcaggagttggagaccagcctggccaacatggtgaaatcctgtttctactaaaaatacaaaagatctagctgggcatagtggtgtgcccctgtaataccagctacctgggaggctgaggcagaagaatcacttgaacctgggaggcagaggttgcagtgagccaagattgcaccattgcactgcagcctgggtgacaagagcaaaactctgtctcaaaaaaaaaaaaaaaggcaagttattgatttttgtatgtaatgttttgactccccgagtatgtttttattgcaaacttgggtggggtgggggcgaggcaggaagagccattgcacttaatgaggacctttaattactatttgcattgataaattatgacattccttctccctcacacgtgccttccagaggaagcattgagaacgttctaatgtattttggatggtttttcttttctgaattctcatcaagtcatacttataaaaatctttctaaatgcttattccgtgccagtcttcagagcagatacacatacatcagcacatcccatgacatatattaatataaaccttctcccaggagagatgggtagttttctataaagcaaaaacagcattgataatttcttctaaaatctaatcatctccagagtccttgaggcttattcaagacaaatgatttgccgggcgcggtggctcacgcctgtaatcccagcactttgggaggccgaggcaggtggatcacgaggtcaggggattgagaccatcctggctaacacgatgaaaccccgtctctactaaaaatacaaaaaattagccgggcgtggtggtgggcgcctgtagtcccagctacttgggaggcagaggcaggagaatggcatgaacccgggaggcggagcttgcagtgagcccagatcgcgccactgcactccagcctgggtaacagagcgagactccatctcaaaaaaaaaaaaaaaaaaaaaaaaaaaaagacaaatgattgtaagtccccacacacaaatccaggtgagtcatgaagtctttggccaatgtgtatggcccttctttagagtttaagtaaaatcaaggcagtaaggagaagtagactcagaatatctctacccagtagcaggcctcatgttatctagtgtagttaaaaatagtgtttccaagaatgtggaggaataggcctcagaggggattcttacactttctctgtcattgtgagaatttcccttgtcttctaataaaaaaatatatatatatatttttaaaagcagtatcttctagagataatcacgatatccagccaatgaaactgttgatttacggcacctttaatcttcatgaataagtaaagcaaaatcaaaataaataacagaaggttacacaaagttgtcagcacggggctgtcaaatggtaaatttatctgtttctcaattgccagtaaaatacacactgcaaagctcacccacgttgtatatcatatctgccaactcatttctgtgattaaatattccatcagcgggactataaggcagcaaagcttaacaagattcataagatgcaccacttgaacacacataactcacttccgtggatggagagcaccccgcctgcaaagggaaattggaattgagttaaattactccatgagacgtgatcaatagggaaaggcaaagatcttctaacggaaatgcagatctaagatatagttaggtcccagagatgagatacatacaattaaagtaaaaataaggagatgcagagtagatcaacttgaaaaccttgaagaaaacaaaaaccacccctagggatatttattattagtggaatttggggggaataaagagattctgaatggatactcctgaaaagaacaatttgtggttttgagagggaaaagaaaatgacaggaactaaaaatgcgccatgcctgactgcaaagtcacatttgaaaggtggtcaggtcttgaaacaagctcaccctagggttacaggggcgatcagataatatgagcatcagagaacatcacagactgtaaaatagaaatagaagagattcatgtgatcaccaaagtcacctcgactgattatatccatttcagaaagaacctggccacggatcacatgacttgatgctgggctaggtgatgggaaagtggatttggatctcagtatgaagtttaaaaatgaagagggtggttataacactctttgattgcttatctcaaaagggcaactgtatttgacctcggatttacccataccaaaggtattggttttctgtgggctagagtgaaccatgattcatctcagaattgggtcaaaagaaggtctatgaaggctccctcacattttttcctcccacttccaccaccaagagtctattaccgttaagagaatgacttttagtcatacttttagctgtacctcttttcaattcccttcctacaatttggatacaatagcatctgagaaaagttaagattgtctagaacccacctttgatcactgtggtccctgacacaagtttgctctattttattcagattggcattgggctcagggtgatttggctataaaaagtcctaggtataaagcatgccctgtttgggatgaaagagcacagtgtgggtttacaaggtaactgttaccatccaagcccttcaaagcagcaaatattcaggtgcccctcttggctccaacactttctcatacccaccaggaggactagactcgaatcaatggccatagggagcagttcctcatgaaccattgacctttggctctgggatgttttgcatagtttacgcatctgccaaattcaaatgcagtgcacttcagtgaactggaacaggagagtccagatttaagtccccgagcaaaggattttcagcctggaaatgttccacttcaaagagtttatcttgcacatctgtttacctttgcctccccttttagttgtaattcacttcgcttctctcctctcctcccctcttctgtcttatcagattttattccagccctgcccatatttggccttaatttttatctgcgtccttctagatcccacagagggaatgcaactcatctttgatgaagcctgtggggttttttgatcttcagataagatcagtacttgcttatgtgctaaaaactgcatttttgaagtaaattggttctttttcttgtgtgtgggaagtctgtcaagaactgctccccccaaaagcagggggtgtcaaggtagtccttgtacaagaagcttcacatccaggctatgggaagcgaatgaggtttggatatccgactctggaaaaatttcacaggggaagttttaagttaccattgtccacatagtgagaaactcaaaccatcaacaacagcaagccacttgcaggtacttgctctgtgctgaacaccttgtttctcctcaaatccttatgaaaatgctatcccattattttcatgatcaaattatgaagtcaaggtttctgggaaagcttacctcattcgccaaatcacagaactaccatgtgaaaaattctggttattatataaaggtcttttttcctaagtttcaaccccatgttttttcactgctttgctacgcagcatcctcaggaggtgtagatgagggcatgtcctcagtgtcttctattcatgaggtcacagaatataataatgaatgaaggccgggtgcggtggctcacgcctgtaatcccagcactttgggaggccaaggcgggtggatcacgaggtcaggagattgagaccatcctggctaatacggtgaaaccccatctctactaaaaatacaaaaaagtatctgggcgtggtggcgggcacctgtagtcccagctactggggaggctgaggcaggagaatggcgtgaacctgggaggcggagcttgcagtgagctgagatcgtgccactgcactccagcctgggcaatagagcaagactccatctcaaaataataataataataataataatgaatgaaaacacatttgcatttaatattgtctgccacatgccagagttcatgttgagaactttacatatatgtacgtaaattagaagttttcaggagaagtattgttaccttcgatttgcaggtaaattagatccagtgaagttatgatgccagtgggtgctgactctgaaagttaaggagtagggccaaagctgttatctttgtgactccaaagctcattttctacctacaagctgcctcccaccaatgctttagttaacccaagtcctagattagtgattcttaatatggagtgacctttctcttaggggaatttggcaatttctggaaacatttgtttcattgttacatcttgggtggtggtgggggcggggattggggagtgttgttcactgctgacatctagtgggtggaggccaaggacgcttcaaaacaccctgcaatgcacaagacattccttgaccacaaatcgttatctggcccaaaatgtcaatagtgctgggtttgagaaattctgtcctcattgacgctattcgagatgccacatattcacggaataccttaacaactctcatgccccactggttgctaccactaataatgtatgaacagctgcagtcatcaatggcagtcaaagaatttgaagactttcatgtaaatgtttcatctttggagcattgtattgtgattatttactccagaagggaaaagcataaactttgatttgataccacacagctgtgttgggagtccccaagaccactctcaggctccatgattgattagaaggactcagagttcaaaaaggctgttacactcacagttagtttattataacaaaaggatacagatgaaaaattagcaaagaggaaaagtacatgcagtgaagtttagaagaaacctagcaaaagcttccaggtgtcctctcaccgtgcagtcacacagatgtgcttaatttttccagaaatggcatgtgacagcacaggcatagtgttatcagtgaagctcacctgagccttagtgtccagcgtttttgttagtggttactcacataggcaagctgcacctgcatgactgaccaactctcaaacctcagcccatgctatggaggtgtgaggaacaggaattcaccataaatagttaccataaacaattggatcaaacctatatggtgtggtccaaggcctcaggcatacaaaaacaattttgtttttgtttttgggatggagtctctcactctgtcacctaggctggagtgcaggggcgttatcttgtttcactgcaacctctgcctcccaggtagctgggattactggtgcccgccaccacacccagctaacttttgtatttttagtagagatgggctttcatcacgttagccaggctggtcttgaactcctgacctcaagcaaccctcccacctcggtattccaaagtgctgggattacaagtatgagccaccatggctggcgcaaaaatagttttatcaggcagataatattctaaggcctgatattttatctcccaggagctggccaaagtccaatcctaaggacaagctgttgtggaaaatgtgcaaggtttgagatagcccaggcctgctagaatccacccttccctgcacaaccattaaaaaaaaaaaaaagtaaacttgcaatttatagtgacatctgtaatgatggtagtagtgaggatgatgatggcataagaaacatgataccactgggtagcttgactgtaagaaaaccaagccaaatttagttatgaaagagaaaagaatgtacagcttgttagcttaaagcaggggtcttcaaacaacttatcactgtaggcacagatagtgtttttgactttgtaatccctatgatccctgtttcaactactgagttctgccattgccgtgtaaaagtagccatagacaatgtgtaaataaatgggcatgattgttttccagtaaaactaaggacgtggaaatttagattttatacaattttcatgtgtcacaaaatagttgttttttttcaaacatccaaaaacgtgaaagccattcttagtttatggcccgtacaaaaacattgtccctactttgctgagcttggcttgaagagctcagcggtaataaagccaccagtttaagcccttgagagtttttcttttggttttttaaattgcacagctttagcggttatatactacatgaacccatgaccttagctggatggcactcagttgtttgatgttcatcagggaagggccaaagagacagaccgtgtattaacacttaatccttgtttccatgaattcaccttttattgcagaattatagtatcgggcgctagacactgtgctaggtgccgaggtaccaaaacagacccaggctttccctctagaagtcaacagggtagtagaaggatgcaaaacaaactgtcaatgcgggtatagtacacagtgatacctgctagagccaaaagaataacaaggctctctgcatgaggagtcaagggggtggtgtaaattgagtcttaaagggtaagagttcacctggtaagaaagtgggtaaagatcattgcaggagggaatatggaggtggttggtagggtcccaagctgtttctcaacctttatctttagaatccattgagaaaacttaaaaaaaaaatacacatgcttgatcttcacctgatacctactgatgggaatttctgagccaagttgacgttttttccaaaggctaaggtatattgatctgttgagattagagagtaccttctagagaaaggttgcataagaccttaaaattttacataatgaaatctgaattttggaatttatcctttcagtggtaggcagccattgaaagctctattaaaaataacaattataattaaaaataaataaggaagacacctgttggtgagttagtacttgtatctatattcacactgagtaacagtcttataattaagacttgtattattactaatatgtgcgtgaagccctgtggtgctgggagacttaggagcagattatcaactgttcagcaaccctgcagattgggttcttaattactaatctagtgcctaggacaaaggctattgtgaaacttatttcgtggttttctctaaatcttttaagaaagtaaattaccagcgatttcaaacgcaaggtgacatgtttttttttaatgttttaacttgttatcattagattataaactctttagtttgaaagactttttgcttcccactttcattgttcttttcaaaatttattgttcttatttccccaacaaattaagttggtgtataaatagaaataaattcacccaatagtgtttaataccctttctgttaattacatgtagatactcattctctacatataaaacagagctgtcctgttgtcttttgaaaatgtagttttgaagaaccaactgacaaatggcaaaaccctactttgagtaacttcatcagtgacagttaatgcatttctagaacttccatggaattgttataacacattacagtcgacatattggtttatgaaaaattaataaagccagtggaaaatggaattccgcatctgcattagctatttacaccaaaagaatcagccagaattaattatgccgtatgctacgttctaatgagtttttcattaaactgtataccattatggaaactaaacaaggattattcaaagaataatgccaacggctgttattttgttgagagattaaattagttaatgggttatacatttaaatctgatgcaaaggttaatcgatgcacacttattgtattaaacccagtatcattttaaaacacaaacaccccaatatcactgatatttcctctggagaaaaaaaaaactatttgtatgattctagtgtttggttgatgtgcatgtgatattgtaaagattgaaatccaccctattctctttcatttttgaaaatgattttcactagctgaaatattatgtttgtttttagccatagcaggggaaggggcagtgtgtgcgagtatgtgtgtgtatgttgtggcaggcatagacaacttcatccaatcactctttgagagattgaaaggtgacgtgtattttctactctcaccaaaaaagtcaggttaaaattttaagcctaatctgagaaggcttagaaggcaattcaagatgaaggatctcatcctcattccacaaatagagtccctcctaaatagttctgtaatagtacttgaaatatgaaagaagtgacaatagagaagcctgtctagacagctttttaggctcttacagcatcttagaggctcttattcccaagaagataagaagagagtatagaaggccttctaggttctttgcacagacttgtaaattccactgttttcagttgaatgacagtttctaattttttttttcctaatcagagattgcaaactaaaatgtttttaggaacaagctatgacataaataagtgaaatgtgccaaattggaggagctgtgtctcaattatagcaagtagtggcttctcacctttgcctacagtggctctgccggacaggaatcctagcccagacacctatggtctgtcccctgacttcccactagaagctagacatatcttatcacattaaaactcctaagtttaagtgcttgcaattcatttaatactaaaatatttgccattaactattatgtttagcattatgtttagtggccaaacacaatagttcaatagctataaatttgctatttcctttctgaaaaccaaagtaagtcctcagagcatcattgttttagatacccaataataattgctatttccatgattatgattgattcacttactgattactatttgccaaacactttcatgccatagttgtaatcctcacagcaatattcgatcaagtacacatttttatctctatttgacagatgtaaccactgaggctcagagaagtacagagttttacccaaagtcaactcaacttccagtcagcaagatcaggaaacaaaacaaagttaaaagtttcaaagcctacactttttcagtgacactatagaaatctcagacgttcattatttctcctctgcatttgcctcctctatgtcttatttcaatcttgcaagtaggatttttcttatctgtagaagatacattctgcccaaaggcttccttggttggatttaaaaccctatcacagattcttaaacatgatcaggaggttctagctaacatctttagccaggaagagtcaggtgtttcctgccagatggcagcttcggaattcttagatgtggctttgttgtaatgggggtaatggatattgatcattctcatgctgaaggatatgtttttatcaactcaggaccaagtatcaccattgataaacaggtgtagctttgagagagagtgtctgagctttggagtcacacaaaactgacttatagttcagttttattatactttttctctgagctttcatttcctcttgggtttgataagaaaaagacgtgcatgtggagtacatcttgtatagcacctgaaacctagggccaccttaatgggcactgtcaatattagctgtacatgaggttcctatgtaatccctagcaatttactgttgtcagcaccatctgcatcccctggaagcctatgagaaatgcagagtctcaggccccaccccagaccccctagataagaatctgcatttagaagagtcccaggggattcagagcatagtagagtttgagaagcaaggccctagtagtcttatcatctatatattgacacctataactttgaaggacaaacatcttgcaagatagaacttattttcattgtttttgttgtggctgaattgatagacctccacaaatactctatggaataactttttgaatttttttttttcttttttgagatggagtctccatcacccaggctggagtgcagtggtgcaagctcagttcattgcaacctctgcctcgcgggttcaagcaattcttgtgcctcagccgcccaagtagctggggttacaggcatatgccaccacgcctggctaattattgtatttttttgttagagacgggttttgccatgttctccaggctggtcttgaactcctggcctcaagtgatcctcctgccttggctttccaaagtgctgggattacaggcagggtcaccacacctggcctaattgttttattgttttgaaaaacaatccaaaagaaattttgagcaaatatttttaaaagcctgtgtttgaaaaaagtttgttttgaacaaaaatgaaataaaattaattttttggcaagtattgatcaaatgatagcctctgaaatacttagtgccagctcccttgggaagggctaatggtgtactgagagacagttactgttagtatttttgcaagcagtaaagggatcttagaacactgatcagcaaactttgtctgtaaagggccagacagtaaacactttagcctctgcaggccataaggtctctgtgcaattactcagccctgtcattttagcagaaaagcagccatacacaaaaatgaatagatgtagctgtcttccaatgaaactttacttattagatactgaaacttgagtttcatgcaattttcactagtcaaatgttactgtgatttttgtcaaccatttaaaatcgtaaaaagcattcctagctcacagaccatacaaaaataggtgggggctcgggggaggggagcagttggatttggccaaaagtctgtagttggtcagcacttgatttagaagatgattgttagaaccatgggtccaggaatctggttggtatgacttgcagtttcagcatcacgagatctgtgtcacctcaggcaaggaaaaagagttctctatgcttcaatatcctcatctattaaatgggtataaaaatagtgtctgtcctacagggtcattaagagtaaatgatgatctaagttaaagttgagcaggatacccagtgattctcaggtattcagtaaaacactttgggaactcttattgttaggtttatcatattaagttaaatatttcctgtcaatgccactattagcctacattttggctgcaggagattaagtgaacagttggagtgagtcattaaaattttcaaacaataaatagtcaaggaacaaattcttctttgtattattcttgtgacttttccaaaaagtctcaagttatgtcaaaataaaaagcaaaaagaaaacaaacaagaagtggtgtattttttttttgaatattatgaaaaccaaagcttatgaaaataaattggagtgagggattatttacactatagacagatgcgcttcagggcccctttaaatatggaaatcccttggtacaattaaaacatgatttgatttataagaagtaaacatacagagcaacattttttctgcaacatctgtgcccaaatggaaatatccctatacttaaaactctaccataacccttcagagaagctcatctttcaggctggtgtaaaagcattagggattaactgtgaaaatattcttacatggattagctcaatgctagtcttgcgttcaaaaatgcatgactgtaaaagtatccaccgtccattcgggctttgggtaaattttggaaaaatctgtcaattgaaagcagtcacctccattgctaggtaccttatggcaacctctttggcttctaagtccaagagaagtttgaggcttatgggtcactttgtaggggactctcattataaggtaggaaggtgtagtagttggctagtgctgccatagcaaagtatcacagactggatggcttaacaagcagttcccaaccattttggcacccgggttgggttttgtggaaggcagtttttccacgggtcgggtagcagggatggtttcaggatgattccagtgcatttcttgtgtaccttatttctattattattacattgtaatatataatgaattaattatacaacttgccataatgtagaatcagtgggagccctgggcttcttttcttgtaactagacagtcctgtctgggagcgatgggaggcagtgacggatcaggcattagattctcataaggaacacacaaccaagatccctagctcagttcacaataagattcacacttttatgaaaatccaatgcttccacttatctgacaggaggtggagctcaggtggtaacatgaagtaacatgaacaatgaggagcggctgtcaatacacatgaagctttgctcgctcacctgcagctcacctcctgctgtgtggcccagtagggtccgtggcccaggggttggggaaccctggcttaaacaacagaaatttattttctcataattctggatgctggaagtctgagatcatggtgttggcagggttggtttcttctgaggcctctctccttggcttgcagatgaccatcttttctctgtcttcacctgggtttccctgtgtgtcctcatctcctcttcttgtaagatctgtcagattaaggcccacccatatgacctcattttaacttaattacagctttaaagatctctctgcaagtaaagtcacattctgaagtactcagagttatagcatttaaaaatgattctacaacagtggactgaaggaaggactcgatgaaatgagtgacagtgtaggaacccaaatagcttgtttttcatctaaaatttacctctggttggtaaggtttttggtaaaggacttagttgttctgtgccacctttgtaatgccagtaaaggaggactaatggcatcagacgcctactatggagggacaaatgcaaagtaaatattctttggcaaatattgaaaaaagctttttctttatgtagaatcaaaacatttctagcattgattcctattactactaaactttcagttatgatagaattatatagcagaaatagagaattttggccaaagccataatagttatatctaataaaaattgttctcgaataattatacttatcttagtgagcagtgtgactaattatgtaggctaaggtttggtttgatattcagaatcattcttttgttccttttcatgtatacatttgttactgaacctatgagcactaaacgtgataacatgtcatcctctggaaaagcacatggagttcaacagatgtaccccaaagcccagcacagtgcctggcacatagacgagtagatgccaataagtaccagccaaatgaatgataatactcactacatcatagttgcctagctgagcactagaggcagagggactaataagcacttgtgctactcagacattgccctgcagggttctagggttctcctcttagccttcttccctgagtaagctcctttcctcggctgagtgacattaggaaagccagacatcagtggagagttctatttttgtgtgactctgcaccaccacacagtagaggtttgttgaggtgatacggttctgatgactggagaaatgccaaggttgttggttttgcgccgattggattaacaatgtgaacacacgtggagtggttttaaggagcgaaaagtgtaataggcaagaaaggaggaagaaagaaaagaacagcttccccatacagagaccggagagtggggcctggaacagagaaaccttgtgtgtggcagataagtggtagattataggggaggcttgaggaggcggtgtctgatttgcatacagcccaggggattgctttggccaggtgtgtcatttatgcagcctgcaaaaaacctggctctcccaccttagtcctttaatgtgtaaatgcgggtcgccatgatgttctgaacacatggtgttatctggaggtggccattaaactgggcacaggtggtgacaaggagaagacagcaggaatcgccacattgagtgaaccctgttcctaatggcgggtatttgcatatcaaagcttgcccacccagcccttcgagcagtcttttctgttataaaagagatggtttgggggtggtttcttattacaggaaaatttccacctagaacctttacccttactatctgcctaaaataatttcttaataactcctgtattagaggtacagacagtgcatgacatatacagaaacttcctgcatgggggccccagaatactcattccatcttaggtatttcataaagtctagctgttgttctttgtgtcttcaagagcatcctccagatttcctaacccattttaatcttcgagctcttgaagctaattggccactcccagttgccaggcagttgagatgttccgttcacattttttgtttaaattcagaaattatgtaggaaaagttctagttattcaccatgtactgacttggaactgtgcccatttgatactaaaagggaacgggcagacattgccaaacagcctttcttttcttccttcccatcctccattttaattttatttcttggaagtgtagcatggctgcctatcagaaacctttggattctcacttcatttgctccctgcctcttagtctaggttcctggactcatgaggataggaagataaacacatgattcctgatctctttgaattagtagcatcaatgggggaagacactcattaaatagattacacaacacaattttaaaaagaagagaaaggaagctgaactctgccagacaaaggtacatagatagggtttctaggagaagccagagctgagtccagaaaggagttacctagagcaaggaaaagatttcctggaaaaagacaaagcctctgcaaaggcatggaggtgtgaaactgcactgctgttccggtttgagtccagttttcctcacttagggggttggcagcagagtaaacagttttcgacacttcctccttcctgtctgtgatgggaaacatcccttctaggcttgtgcctgccccttcaggggccaggaatgatcccctgcatgccgtatggagactactgctcagcagaaagggttccgatgccccatctgagaccttggcactggcttactcccttcctcactggaggattcaaaatcctgctggagagtggctgtgggacatcttgccaggttgtggggatgccgatgatcccggcactcagagtgggcgaacgtgacaggctttggaacgggctctgattattctgagattgaggtctgtcccatggagccaaatgtctgccaggtgctgatacagtcatcgacagtccaggctgcgcaggtttcttgttagagtgggtgagccaactttataagaaccaggaaagaagagaaaacacgtgaagtagattgaagctatttcaatctgtaaaagttatttacatgtagtgtgtaaatctatttgaacttcaggcatgcaaatttcctgccatgaacaggcggaagaaagattggttgaaaaaaaacactatttttagcaaagagggtagaagtggagacttgtttttaaaaatgtattataattcaatcatatgcattaatccttctgaggatcaggtattttcctaggtgttggggatgaaaagatgagtatgatttggctctaccgcaggtggattttgtagttcagacgaccaatgtctaagtagaaaattgtagtagaggaccacgaaggatctatcagggaggtttaaaaatgcaagataagagcatagtgtaggtaataactaattcacccctgaggacaagggagagaagaggtcacttttaaactatgttggaggaggacaggggaagcccctccgcctcctttttttttttttttcttttaagttgaaccacatgaacttggcaacattcaattctatttgacaaaaaaaaaaaaaaagtcaatttgaaatggtttaatctaactctaagagcaggaacagcatgaaggtttcatccacttcaccaactctaatcaaatgggaatcattgcctactggctgtgttgagaatgattgtgaggattccaggccaataggaaaggataatattgaaattgattaattccgttctggctaaagaatgggtaggtagtggtataaattgaccccatttgccatccctagattataaggaatttgataaaagcacagaagtctgagaagtacaggatgtcatcatgtgatacaaatgaaggttcctggcatttggcagtagaaggtttatgttgaaggctagggacagatagaagatccagctcagtggactcaatgaagagctatgttgaagctatattgagaagtgctttgaatgaccttgtaggccctctccatactgctgcttgtaccttattacctatttgacttactttttaaaacaaacacacttacctttccctgcccaaaaaaatgcatggaggttgcagtgttctctgctgctttggttttgtcgaattcaaagcgtccttttaagaaaaggtcacaaagcactaagggaacatacagtaagtactttccaaattaaattggaggatgcttttagataaaacaaaaaccaagtcctgtgaaggcatagattttgttttacaaaaggtcaaaatcattgcataaagattttttttttttttaactacgaagaaagtatccaaagaaaatatttcagtccaggttctcagaatccacagcattaaaaaaaattaggaatgcttcattatgccgtgccagaggttagctttccaggcaaaaatctgtgctgtgtcccagtggaattctataaattgcatcgaggatattgaaaattgacccaagggttttaaccatacaatactgaaatgtccttctgtgtatgtttgtgttacagttatacatttttcttttgaaatttagcaccccaagaaacttcatagctgattttaagtgtttttttaaaccaggcgtgcacaggagagaaggttgaggagcattccctaaatccacttgctaggatcctatcgtagatgattccgacctgataactctctgtatatcctatagaaacacattcatttatttctaagatttctagcagtgagcagaagcacatagataaccgctgcagagtcacacaggagtactcattgataaacaccactgactgtagaggggactaactgtctttcctggtaggtagcttgcctccccttgcttggtttcatatcccaatctccattctttggagtttggtttgtttgctgttaatccccagtgacctgctaaaactggaaatacctgaggcgaggttaaaccatggaaagtatcatctcatacgttgtgataaacttttttttttgagatggagttttgctcttgtcacccaggctggagtgtaatggcgtgatctcggcttactgcaacctccacctcctgggttcaagtgattctcctgcctcagtctcctgagtagctggaattacaggcgcctgccaccacacccagctaatttttgtgtttttagtagagacaggatttcaccatgttggccaggctggtctcgaactcctaacctcaggtgatctacctgccttggcctcccaaagtactggaatgacaggcatgagccactacacctggccgataaactgtttttaaatgaagaagaaagaactattagtttagcacaggtgaatcatactgacactccgccagactcttgatatatttactacccagagaaggttagttaatttcgagttaatttcactgttgtgtgaagggctattttgcgggtgggggtggctgttctccagctataagcatgggaaaccagatcgaaaaagaccatgggacattccttcaggtagaacctctggccctgggctgcttctccctgggaaaaagtggatggagttgtcagaccggtaacaggggaagagtgagatgggttagaaagaattgtgtctggtttactgtcccttgatgacatcaccgtgcagtccctctgtgtggcaggaccccacacgctttggaagttttaactacatttttgttgatcatagggaagatacagaaggagcatagaaccattccctagggcaagtctccaaggatatagaaaagttccctgttctgcgggtgcacttgtaaggttggcttcttatcatgggagattgctttcccgttgcggtcctgacaggggaatccaaatcaaactggggcggttgaccttccccagtcaaggaagtgaccagaaaccacagggaggtatttccatcaccagtaatggccttaaaactcctcagaattctaattattttcaaagtcttggagtttgagctttgcagcagtgggaaagtagcactgataccctgacaattcctgaccccagtcatccctggagtgggtggttgttcaaaatctgtcatagattgaggaggtatctcaggattccaccattatttgccgctgtaaaattccaccttgcaaggatgaacccagtgcccttcgctttaaatcaggaggaggcaagtcattgctgcaatgcagccgcagtttgcaggatgagctaggcagcctttctggctggaaggcagagagctttagggaagaaagcgggaatacagaagccgaagattctctcatccagtgtccagtgtgggtccagggtgggtcccagggatggcaaaaagttgcaatttttctttctccgccttacttctgttcttcctctgaagaactgattcggaaagactgacatttgaaggaagttaccgttttctctaaacctatcaacatgtatgcttactattgattgagtgattattacatgccagcccctgccctgggtacgtctccagtcatatgatgcacagccattctcggaggtaggtatatttacccctgttttccagatggaaacactgaggcacagagaggtacagtgacttgccaagatcacacagtgaagaggtgtctgagtcaggcttactatctagctccctccaatatttctcaagttcccttttcagtatgccacgctgcttccattcctgatctgaacctgggccctggggcaaccagagtccgctacacaaccccgtgtgaaaagtcatgacgtgtgcttggtgggccgggttgtggtgggtgggggggcttccattgattccctttggctaaggcagggggctttgttgggtacccttgtcctgcgctctgggatgtggctatgttttcatttctctgcatttctcggttgcattgccgtgatctctcaggtgtagtgtaccgattcccaaaccagataccatctctctctctctttcgtaggcacggtcctgttgtgccaggccaaccaggagggatcttccatgtacagtgcccccagttcacttgtatatacttctgcaagtaagcccactgtcgtggctctttttgttttgtgacataaatctgagtccaatcaccttccctgccatgtaagttctctccccctccctctgccccaccctctcttgtggctctctctgaggtgaagttaattttcataagcatgtctgtctcccatgccacttcccagatgtcctggacattctctgttagatccgtcaggattgggtccaatggttgggaatgtgggcatggggttggtggggaggggcatgggagggtgggaagctttagctcattgcctgccttctatcatagctttgcaaattaatataaaaataatttaaatagcatatacaggccaccccaaaggcacccttgcctagtaaaagatgcttaaccaggattcttgtacacagttgtctcacgatggaaaataccactagcctgcagctagtcacttgtttgcaaggctgttctgtcctttgctatgtaattccaatgaggaggaggaggaggaggaggagcagagagagaaatgtggttcccccctcatttaatcaagtgcaggggcagcaacattaaataactgtcttttaaaaaatcggggcacttttaaacgtagataagtatacccatccagtgcgggagggaagagacccaaaataaatacaggaagtagatcacaacattgacatggaagaaccgaagatttctctgcctcggatggatgctctgggttcaaggatgccctatcctcaccccaattcccagagcaggtagaagaattaaagccgccactgactctaccatgttctcccagagggtataccccttcttaaagaatctcccagccacagctgaaactttaacatctgttttatacaatgtgtgtaaatcctgtggagttgccgtaactgcagaatgagtcgtctttagggtcagtgcttaaaagtgagtctgggtgcctggagtgggggtggggctgtttctcagagtagttgtaaaaggcagggatggggaggagagcaggagtaccaggctcaagggataagagacgtaggagaatcctcaccatcgtgccaaaaccaaacatcttcgtttcctaaattgtgaagctgaggaaaaccaacctcctcactgttggggcagcacctccctgttaccagcagtcacagggaatcaaaaatataatgtgacacacccaagggtctgaagtcttcaggaggtctgacagccagttgtttctcacagttagaggttttgagacaaagtctcactctgttacccaggctggagtgcagtggtgccatctcagctcactgcaacctccgcctcctgggctcaagcaattctcatgactcagcctcccaagtagccgggattataggtatgtaccaccactcccactgatttttgtatttttagcagagatgaggtttccccatcttggccaggctggtctcaaagtcctgacctcagatgatccatccacctcagcctcccaaagtactggaattacaggcgtgagccactgcccctggcccagactataatctttaatggcaattttggcattaattaaatgcaagacatttttctgtgcctcccaagaagcccaaatctaatcatattggcaagaagtggttctttctgaatttgtgacaacaaattcagaagggcctccttggggccagtgtaaatgtgtgtgcatgtatctcctgaaattgtaatgttactacacattttcacatgtccagccttgtgtattcctctcaaaaccagcaccaggtaggtatcacaatgtttgctttacaactgaggaaatggagggcaatcccagagccagtgtgtaatagatttgtcttctgaacctgggaacattattcaaccttcagctacctttctgagtccatttgactaaatctgatcgctgtaccatttacctagccttcctcgtctatattattttctgaaagagagttggtgtgccaaaacttaccatagggctgggtcctagagtattatttttttctctaacattgcggtcctatagaagtgtctgggataaaatctttatgctatccagcatagtgctgatggaactgagacactcatttttatgttatattaattagccatataggggctaatggttaccatattggacagtatggctctatatgatgatatgacatatctatatttcaattttctttacagaagtgaacaaaacaatcaactccaaaagtgtgctagtttgaattggtatagctattctaaagtgaattggggaagcatctctcacatcacatgaaaatatttcccaaattctccataataaaatagctgaagcatagagagaaaatgaaaccatctaaagcgagggccacccaagccagcccatggcctgtgttacaaggcttatgaatgaagaatgatgtttagattttccaaggattgaaaaaaacaaaacaaaaacaaagaatgtgccagagaccaaggtggcctgcaaagcctaacgttttaacagtccggctctttacagaagaagtgtactgatctccaatttaaagggtcgattttagtattaaaaatacaaagtggcaatatcactgcactgtgtgtagctgtacctttttctatgtttaaagtaaaaattaacaattatgaaattgtataatgtgcatccaacatccttcatttctaaattgtatcagtcgtattacctgcacattatatgccatgtgctttttataaaaatatgttaatgaacccatagtattgtttcattatattatattttaatctattcccccattcttgagaacttaggttcatagcaattttttttcaaaaatattaaacaaaataaacacccttcaatagagcagttttaaagaaaatagctaattttaccaccccattaaaaagcaaaatgaaaactagtttcttacattaagaatcttcacttgtcgaggcttaagcaagggcattcagatggtcaatctcgattagtattttgtaatggtgaccaactctgagacccctccctctccaattgggtaggcagaggggccttcagttatttctgtttgcaggctgtgcattggtgttgaatgttaagtttatccgcaaatccctaagacacattgctgcggtttcctttctcttttatggctttttggtctaggctgtttgtggattgctggcttggcaacattcacttaggtttttctcttccagattaggtgcatattctactacaaaaccattccccatttcctgcaacaggtcagctggcacataaagggttatttttacatgcaggcctgtgcgcacacacacacacgagttatattcatggtcatccaggatttttcttctcccaacagtttcgatttgcacagggctgagagtcacatattttatctttgctctctgatgggtgcagactttttctctaggaatccaaccattgccctcaaagctgaggctaccatacttttcagcaattgtgtaggatgctcttgttttttaacttgaaaatgcatatgttcctcatttctgtttaacagctgtgctcctgaaggaaggtgtgtgtaaattacacttttgtatgttggatcctatgtgtctacagacttgcaagataactctggagcttcgtttttgtttttttgcgtttttttcctccatggatctttaactggcctttgatgtttgtttttttttttcgagacttaaattgtacctcttcctagtcaaatagctaatcatctgtaaataacatccttaaatgcagtaggggagatggtttttaaaggaaccctgctgaattagtctgtaatgaaaataattcctactgaagttatctgcttttgatatgcatttttgcataacagtgaggttttctcccccattaagtgaatcatcctaacaatgtgacccaggactcataaaagtattaagagaaagattttcactgataactttgtgtccatacaactaattccgtagactcttccatcggaccccaaatgactccagtttttctccgtcacccctgaacttcatgcaggtttaaaaccctagttcaaattgtgtcacaggtcatcatgcatcctcttacacgtcctaataaactactctcatccagagtgtaaaatgggcctgctttctatgaaacttaaatgaagaaagaacaaaactctagagaattaggcaacatcacctagtgtcaaatggaaaacatttgcaattaatatttttcaataggctttcaatagaaacaattcaaccccttaacagaaaggtttagtgaaatgggcagggctgcttggtatgtggactgttcattccattccgaaggccagtggtcagcctgctcctcttgttgaggggaaaggtactaggtgtattattgccagcgctgttttgcatatggcgaatgctcaacatcaaaattggcaccaggcagaaataggaaggtaaagaacataccacatctcttccaaattaatacatgagtttcattttcattagttgaagtatctaaaggtaaatcattggttccatgaatgaaaaagttcacttctgattcagattagcaaagccagctaccgcagatccttatttacatatgaagtagatgtttccagaagcacgtaaatgtttattttgttttcttcaggattttatgaatatgttttaaattacaatagtaacaggtgctcattgcaatcaatgtgaagtgtgcaaataaacatacacaccattgtaataatgtgggaataatatccccactttatccagtaacataaacccttaaaagtgtgtggacgcccagtatctttctacattttctccgtggttattcaggaaaggacatacacacatgcaatggtgggggcgggggacggtgtgttattagtttgactttacagaggagagtatacacagatgttacatggacattacatatatcaatcatatttagtttcacataatacattgtgaccgtctccctttaagccttttagatattttcatccagtttgtttaatgacataaatggttgacagtcaattcaaccattctctatccatagtcattcaagccacttctttttactttttattttatttatttatttttttattttttgagatggagtcttgctctgtcacccaggctgcagtgcagtagcgcagtcccggctcactgcaaactccacctcctgggttcacaccattctcctgtctcagcctcccaagtagctgggactacaggcgcccgccaccatgcccggctaatttctttgtatttttagtagagacggagtttcacgtgttagccaggatgatctcaatctcctgacctcgtgatccacccgccttggccgcccacagtggtgggattgcaggcatgagccactgcgcccagcccaagctacctctttttctattccctccacaaggagatagtaaaaatatttgcaaatacccttacgtgcaactacatccattctacacttaacattgccaaacatggaactgttggttcccttccagcatgcttgccagcactgccatgttttgctctattttgcaaattgcatagtgaaaaataacatctcaatttgttttagtttgtctctgcctttctcctattaatgatcaccgtctttcacatttttcatttagactttacctctttgaatttccagtatacatcttcctgtttgagatttttcttattttattatcagttcacacgtgagtgacacttgtttactaggataacctatgaatggttcagatgttacacgtgtatttcctgttttgacgattgatgttgctcagattccaccatacatttttaattacataggcaaatgtatctgtcttttctgatcattttagacgtcattttggattacaaaatccctgtcaagagcaagttttgttttgcactgtatcagtcagtttgggctgctataacaaaataccgtagactgggaggcttaagccacagacattcattttctcaaagttctggaggctggaagtccaagatcagggtgccaagaaagttaggttccggtgagggctttcttcttggcttacagatggccaccttctcccatgttttcacaagagagagacagagacagagagaaacagagagagagagaggaatagagcaatctctggtgtctcttcatataagggcatgaatcttatgaagggcccaccctcaggacctcatctaaacctaattacctctcaaaaggccccatttccacaaagcatcacattgggggttacggcttccacatatgaatttgagtggagaggacataatttagtccgtagcaagccccttgatacagggatgtcagttttatttgtcaagggctagaaaagcattttctggaagaaatttctttattgttccgtatgcttatcaatgccaatgagcgcgttttccacagttccatgaaagccagagttgaacagtagatccccatcaggataaatcctaaagttaatagaagattaattatcgtttcccctgaaattttcaccctgatacccttccctcctcaaaaaaaaaaaaagaaggaaaaaaaagatatcatgggcaaatgcttgggaacctgaatgttatcaaaatgcaaaatcaattcctcatttattgacttctatgaaactcaagggcaggtggtaggggcatagtttcaactgatatattgattgcagattttaaggaagtaattgtgtggaattcataaaacgatgatttaagtggcagaaacatacataaatcaggcctgtactattttacttttaggtaattgatagaacttccatgggtttctgtaattaaagtaaggacctaaattaatttacggcttcctttttcttctgcacaatacagaaaatgtcagtgggctggactcagttactagaaaggacacatacaggtcattttgttactgacacattggtgtaaagaattgtgtcttctttttccctcacttgccagtgtctgacagcttcttgctttcctcctagatatttttctactattttatggagggggtgcttaacaataactagctccgggactagggtaagcaagtgacgtgctcacttcaaagattaaaggggtatccaaatacctcataaatagcattttaatgcaatatttttaaaaatctaaagtaacagaaaaagatccatgattaacagaatatcaagacagaataagttttattcctttttccttttggagccttaagatcccatatggcttaatccagcactatttcaattttgatagtctgctcatcgtggatttaaaaaataatttgggtgttaaaagattgcattaaaacatgatctatctccattacagagttttttggtgtttcctcccttccaccccccacttaagttctgcaacgacagtgaacgcctgttaacctagttgcagccctgaaatcatgatgatatccataatcataagtagtggttattgggcactcactatatgtcaggcattgtgctaagcccttctcattagctttcttaagaaggaactataggacaggtatgattaattatgctaccttttctcaggaggaaatttaggcttgggggcgttaagaagcttgtccgagatcacccagctagatcagctttgaaccaagcctgtttaaatcccaagccgccttcttcactactctctcaacttaccccagaggctggaaacaggatggactccaagaaatggctgagcagggagtggtcacggggaacctctcagcagctgtccagcaactctatttgggccaaggctgtgctgtctcctccccatcccatcatgtttggagaggcagttttcccctctttgagatgtctggccagggcttagcaaaattattctgtaaaaggctggatgttattaatattttcagctttacaggccatctagcctctgttgcagcgactcaactcttgttatagcttgaaagtagccatagactactgtacatatagccatagacttctaggttgaaacatgaatgaataggcgtgactgtgttccaataaaactttatttacaaaaatggtctgtaggccagattgggcccaagcgccatagtttacccatctctttgtcaggccgtaattcttacttaaaaggacagaacatggtggctggctgcttgggggtggaaataaggaaaattcttttaagtgtgcaccctcatgtattttttgcattttgtaccattttatcacattttaaatgacgtgaagtagtacataaagataggtacccttctcctggtacctattaagatcaagatacaaattgatcttgatttaaatgatacaaaatgatcttgacttaaatttgatcaagatacaggaattgggtggttagttttgcttgcacaatgatcaaatctggtttcagaggcttaattctactgacattagtctaagacctgccccagtttccttgggcaaaatgtgaagactccattgtcttacccaggatcttctgtctgaactgtttccatttctatccccacactttcaacaatgctggctctaaaagatcctctgggctggacccttcccatcagggaatcagacactccttcttctcttttgctatggttcagcattacggtggcagcctacctgtgtcctctttgtcattttctcagagataattccttctagtttttagtcctttgatcggagagggggttgaaaggtgttacttcattcaaccaatctttattgaagttttttctatatgccaggtgcaattctacatcctgaaaatatgctgtgaagatactctcaagttggcttctattatacctatattcttggggggacacataacagacaaatatatataatgctaaggtttcagaatttcaaacgcagtgctcctaggggatatttgggaagtaacacccaacaggagacttattcactgttagcactgccattggggtgcctctcagtaggtgaattaagtgtccctattttcaccattcttcaacactgtagacaggtgccctttgctactgagaccctatttgcttcaccaaacccatggattgaggtgttttcagacacctactaggtgccatgctctccctgccacctcaatcatagcacttatctatttatgaacaatagttgcccacagcattgcagaattatccagctaccccccacccaccaatggtgaactccagagattattctttctccatcactgaagcaccatctctgcttttctccatctgctcaacttttcccatgtcccagcacatttgattaacagatgatttctaagaggcttttactagctctgatattaacttagttattccacctggatcacagtcctcagaataggttcatttgtatttttaatccctgcaaccactacccccaacttcttcatccgtgtgttgtttctttggctgtcataatcataacccactttgttgtttgtcctttttaaccaattccaagaaagaattaaaaccactagtagaacctctcacccccagttgtttaaagggaaagttctgcaaagaggcagccacatttcaggcagctgccatgcagctctctgtcattgctttcgttattaatctcaatgcagaatggtgattttcattttttcagatgggtgtctggctgcaaaaggccgccagttgcaaaaactaccatcccatggtgtgcccccaaacatcttatttgtcttgatatttctttcacagaaatacatatgacagataaggagtcactagaggatgcttttgctttgtgtcagacagatattaaaacaataaactatgttgccctgggattccaatgcatacacagccagagaacaaggccgagatgagatgtttcagaaaggcagtgaggcaattattctgggggaattccctggaaaccccaagtcctgtgatagcattgacagaaagtgttttttaatgctcacattttcttaagaggatcaactggctagtgcagctcctgcatttaactccttgacaaaactcaccctcatccggcctcatcagagtcaagagaaatccttcaatagtttgagaggcttattttgagagtttattttttaagcacttatctgccctttatttgcttccccaaactaatgtggatttacattaaaaaaaaaaaaaggaatccattttacattcagagctctgagcaggtaagttgcaggggccaacggcaagatcttgcttggttcttggaatgtaaaagaggacagtttgatgcaatggagcaggtgcacattcccaagggccccagctttataagttgagtcaagctctctctgggtctacagagctgggaaggaacagcttaggaagggagaggctgaatccaagggcactcataattcaagagctggagcaatcattctttcatcaaataccagtcttcttggatagaaatgtgtccaaccatagaggtggctgctgcttcttcccttgccttatttcttttctaaaataaatctcagtgcaaagaccatgaggagcagctcaggttgcctctcatccaagggaaaaagagcctggtgtagttcatataaacccagtaatgtaaacacgtgcttcaaacaccattttcttaaatcatgtttttatataaaagaactgtcatgccaaaagctatttatccctaatggagaacttcggagcactgttaagaaaatgcagtttcagaaccaaacaccacaccacatgttttagatttatctccttgagttttgtttgtatgcaacataggctcttgatgcctaatacttttcatatgaaagcaaacagaaaggcacaaccatctatgggtatttattatccctacccttactatttgctacaggagtctcaaacatttccagaagatcatttttcctttctctggcaagtcctaattcccactagtggttttacagcatttttcttgagctacagcgtgacttagtgaaaagagctggattcaggaaagtctgggagtaaactgtcacggtagactagtgctgtgaccttggccaagtctcctcgccatgtaaatagccatgactacctacctacccatgagcactaaatgagattgttgtgcagcgtcctccaggctgcttgaggcgttacagctcctcaaatgctactctttctttttctggctcagaagccaccttctccaggattttttaaagtccaccaaaccagatgtgatggtgtacttttatagtcctagctactggaagggctgaggtgggaggatgacttgagcccaggagtttgagattgcagtgatccatgaccacgccactgcactctagcctgggggagaccctgtctcaaaaaataaagttcaccaaagaagcgggtttggatggtttatattagtccagtgactggactggtggaccactcctggatggtagttccttagtctattctatatgggtgttttggaggctctggctcagatatcaggcagatgatccctaggctcagacagtacctgtcctccaggttggctttgggcattgatcaaaggatcaggactcttttttttaagtctgaaagctgatgctcaaaatcagatggcctcagcactgacacacagatcagctatccccacagctatggctgggactgaaatgaacaatgcatgtgcgtcgcgtacccatcttgtgagccaccgtcagacccctctgaaggcttcatgttcaggagctgcgtcagcccaagagaaccttgggaaatccagcccagcataaggaagctaatttatctcacttgccctgtttcctacctggagaggcaattcaccgagcttgctgtttcagccagctgttagatagaacatgaatgatttaacaattgaaacttcagtatgtatatgcactggataaagtaattatataaattatttgggttttttttttccgtggtttcccgggaaacaacaacatggttatcagtacagattttgttaaactaatagatgatgacgaactgctgcatccaaattaaaataaatctcagctcttcagggctttgtcttctccttcaaaggacagaaagcacctttgcaaatgccttttgcagttctgccaagttaaacactccaagactgagactcattctcattttgccgaatgttacaaaaatcctgcccggcgggggaaattgtcgatacctgtgagtaggcaaatcacaaatacctcttctgcatagtaaaaacatatcactacacatttagcagccatgacatttgccacttgtctgttggattaatctagccatttataacctgtgaggaaagatacaacagctaactttgggaggtaagcaggaacagcacgccaattagttaccaccaattctactgccttcgctcagagacacaaggaccttacatgatcaaagaatattcatgtgtgtgaatggtgtgtgtgtcttttgctgttgctttaatttgttaagttaggggaactttctcctttgggaacaccagactcgttgctcagagtaaatcccagtgtgctcattacatgtaattttattttcctagatgactatttttatttccacaaaaagaagacttatttcaaaaacccaagttgtaatgtgatatttgataacatattaaaaaagcaattatatatagaaaaacgtgcaatagcccaaaatgttatgaaggtttcttatgcagatcttccaaggctttgaaataagtttctcattccagtcttccaaattagaaatttctagctgaatttagttgtaaggagctcatcattgtgacagtaatcaggtttgtgttcatctgcagcctttactcacactgtactagtacaaacctgctcactaactctacagaatctgcattcccaatatttttgggttgaacacaacctccccctcacatcgagatgtagaggtaaaccctagtggcaaagggaaacagcctgcctttgaactcttaccaggaacataaatcagtggtgatccctatggccggcatccaattagcagaaaaggaacagggcctttccaggtgtcttgaaatctcagaacttaagtatctaacagaagaaatggcgggcacacacacagaccctctaatgtctcccctatcccccaacaagaagcatattgagatctctgggaggactgtcaacagattcccctgcaaattaacccagtctatgatgaattggggctggctctgtctcagatgtggtatggatatagggagatgatgtagcagcttgtacaggcaataggagggaatccaaactgagagtctctaagaagcagagagagagtagaagtagaaagcttttcccggagcctgactggggttgcctttatgttgcatgatggataaaatcataggctttggtgtcaggctgccttggttcaaaccgctgggtgagtatctgagccactctatacctccatctccaccccaggaaagtgaagatagcaacaatcatggttcatatggttttgtgaggcgttagtgggttaatctccgggtctggcaattagcaagtgctagtaaatcctagctgttatcatcatgcaattgaattttctccacctgataatggagcctcagaggttggaattttgccaactgcaatcacatcgttccttgaattactccagttatcactgcctgggtttttagacaagggaggtccaggatcccttatcactaactccatcaccccagagtttctgtgggaatatgcatccctcacaggccgctccttagcaactctcacccgtttgaggattgccacccattttctttcgtaactgtaggactatggcattccgagttcatcacacaccgtagtcaatacacatatcagtgatcaccttgtgctcggtcatcttctagatgttggagacacagtagggaccaacatagagtcctcaggacatccctatagagagatgtataaggaagttgaaatcaactcaggtgataagaaactaatgggaaggaaaaagaaaacaacagggtaatatgatggtaactggtaacagttgtgggtgtcaggagatgtgaaattagataaagaggtaaagcctttggagggagcgatgtttgaactgagaactgaatttgggagtcaagttcactgttagagcctggacaaaggagagagaatctgccaaaagccactgaaatacagccaagtgaggctggagaaaaaagagacattttagcctcttacaatcttattcccgaagtctagctgaagtcgagatttagatcaatatattcagcttggacaatcaggccagcacgttgtcaccatcttttttttccctttcaaaaatgtgcatttctctccaagttcacattcttgccaattccttcgatgcatcccaatcagacctataacagcctagaaacttctggctaatttggatttgactaaaacttttctaccatgacgttatgtaaagagattcaattatggtgcgcagtgttttgtgagtaactaccacccataaaaagttaattaatcagggctgtgtcaatttcctcgtgccatgtcaatttgctgcaaggtaattaatcactaatcacccaccaagcagcaggctgagggacaatccctgagtcatttattgtctttccccaaataaatggcacacgcagccaggaagaaacacatcttgcctttcataatatttttatcgacacttttgcatgttgtaatagactgcagcaacaagcagctgcagttcaatggaatatgaatattaaagaaacaaatgagcagagatttataggacattgcgtttctgtaatgtcagtgttgagattaaaccaagcaaatgaacagtgaaaaattactcttccatgtggagcatggtgattagacttgtacattaattagaaatttttgttttcctattcaatgcatttcaaatgagaatgtcctagaagaaactgtttgtccaaaatgtagatttattcacttctaaacagcagtatttaatatcaacatgcatttcatactgaaacaagggtcaatcccaaatgtgtgtttcagggataaatgtatgtgtatatgagaactggagattcgacaaattaagtggccgttttggtctttctatcagtgaccgaaaggatggaagctttctcccccacccaccacccacccaccttttttttttttctgcgaaactctgaaattactggatttttttaaaaaaagaaaaacctttccatttttgtttggagctagaacttaataagtgccatcatgttaaaattttaatttaaggccatttaaagagagtgacctagttgtctgtaaaatcctatgttataaaccaatttgatgtacttttgagattcgttctgaaaaaggagaaaacatattttgccatttggaaaaaatcaggttttttgattcttcattgtgatgttcattgcacgatgccctgcctcggaaattgctgctctatgagctatggctggtggtttatttcgcctcagtatgttacctattatgccacttcttaatttatggtccagcacatggaatgggagttcccccaaggggaatcctgcaaaaccatcaacccgctgttgaaagcacatctgcacccccagaattgtgtaagtgaatatttcctaccataaattacccacagaacaatttcaccccaaatttgcatgaatctctctccatcttaaaaccttccaaggctggggaaatgtgtcattatggagcaaagggagaggaggagcaggacaaagagagcccccctcatccattcggatgcccaccttttccagggcatctggcagtctcatgcaaattcaaaccagtgcacaaatgcaaagaataattgcccattaaagcggttgtatatttttatggctttggtgcagaatccgcccccctgtcgggttttgcatctgctactcttccatctcccccagagctctaaaactttaatatgcagtttataaccctcaagtattttccactggttttgtgttttttctcttgggatttcctggctggtgagatgatctcatttgtgtttattttcgaaggtaagcaccatgttcgtaaaagagggagagaagacacactcatcactgtaaatacattgagtgcagggctcattggaggtgggaggtgggggctttgtttttgagggggagacaggcagttagcagttgacactttagtaaatggcccatttggctggtggatacacccacacatcttccgttctaaaatgttgatttgccgtgatacttgagcaccaccacagcgtgcctcttgttacatccctaaagcttccatttcatcgagttccatgggacagaacttcttattcccaagaactgagatggttactctactaacctcccccagaatatgctctgtatataaatctagctgaagggtgagagtgggtgggctggaaattctcatgtgtcaacaagatgctcaattggtattttctctgaaagctcttgcctgttttgagagaaattcatttttagcttatgagctgaatccaatttgtgttgtagtgataccagatttttctctttgattcatgctggataaggcttcagaaggaatctcttcagtataatgaacctatgggttttcttgtttccctcatgccaaaaactaaggatttatactatatccacaaatcaacctgcgtcctttccattgttccttattgatggtctgcttacatgtgagttaacttgaaattgaactaggaaaaaaaaaaaaaaagcaaacttgcagtgctggggtttagaaatgaccattgtttggtgtctttttcccctaacattgttttttaattaacaaagaggcatttacaaatactggatagggtgatgtttgacttttaacattgatttaaatattttatttcatattctagaaatggagagaacattgtgagtttccactgggcattttgcattggctttattaaatagtcattcattgcccacttactggatctagacttctaagccagggtatttggcatgtctggatccagacatctaaactaggatagatgacataactctcactcaacaaaatataagtgccatacctcaaagtaaacatgtaagaggttctctttctatgtggtcaaaaaacagttttagtcttgtttaatttgtgtctgaatcatctgtccaggtaatcatctcaaatatacattttaccatgttccagaatcctacagaccaccacacctgtaggcaaataataaaagcatccattcttccacactgtgctgggttttttaaaggaagtgtggcaaacagttgtgtgtgtgcatgtgtgtattttgcccttgaaatggattattcgtgttagtggcatgcgaagaagccatgttgtccctaaaccaacaattgaggaaaaaattatttatttatttattttttttgagactgagtcttggtctgtcacccaggctggagtgcattggcgcgatttctgctcactgcaacctcctctacctctcctgggttcaagcgattctcctgcctcagcctcccaagtagctgggactacagatgcataccaccacacccagctaatttttgtatttttagtagagacggggttacatcatgtttcccaggatgatcttgatctcttgaccttgtgatctgcccaccttggcctcccaaagtgttgggattacaggtgtgagacactgtgcctgaccaggaaaattcttctaataaagatgggaagaaacacagaaggcacagtcataagtcagaagagtttggaattatcaagattgttattttctattgttcctggttgcacataattattttattcagggactgttgttgctgggttgtcagagagcatggtctggggctatatggaagggtgagatgtgatgaagaccctttaataggtgttacctgtctggggccaaaactggagtcccgcttttcccctgaacaagaaacaattttaaatcctgatagtgtgctgccatcgaggagaatttaaatgaattgagggctctgacaattccaagtgcaacaaacttggtccaagcagcctccccttgcttgattgaaatcatactctttcaaaatctggttactttttccgagacagtgaaaaacgtacaagggtagaagtggaaattatctttctagggattgtgactaagtttcagttgtgttacaggaaaagggttcctatccagaccctaagagaggattcttggatcttgtgcaaaaaaagaattcggggccagtccacagtgcaaagcaaaaggaagcttataaagaaagtaaaatggggaaagtacagctactccatagacagtaggatgttcccaaaagtaagaggaggagcatgtccaccccttggtataatacttgtttatataggataaaaaaaaataagatcatggggaaatgtgctctgctacaagggtttgtgataaaggattaattttcttaattactatattttgcaagaatcaatattatctttaaagcaaatttaggaatgcttctgttcacaagatattgggatatcaggacactcctaaagtctgggtctgtttagtaaacataatcaatctgtttccttaaccacaaacatctagaggccaggaatacctaactttctggaaatgtagtccagcatgtcttggcctcatttttcctagccttcacttacgatggagtcgctgtggttcgaacacctctaatggttgtgttgcttgcatgctgtttatctgcaaattctgagcaggtcactttgtacacaggacagtgttatagaaggtggacagtgaagaggtggtggctgtactctcccagaaggaagacaaacattggttaaccactgacagggtgtccaggcacagtattaggtacctgatacctgcttggtaccagttactcatcctaactgatgagcagaacgtggagatcaccacccttacgcagcttgcatgcacgcaccagtaagcgtccttctccttcatttctgtgactcaagctaatgatttttacatgaaccaggggaggaacagggcagccctctttagaaaaaaaattccaaagtgactgaaaggaaggattgtaatgaaggcaggaattaataaagaaatgaagggagaggagaggaagaagagggagaggaagaagagcgaggggagaaaggaaaaggaggagggaagacaaaaggaagaaagagggagggaaggacaggagggagggaagacaaaaggaaggaagaaaaagggaggggagaaggaataaaaaaggagcaagtataagaaggaaggaaggaatgtaagaaagaaaggaatgtgatcgatgagcatttttctaactagagatttcacgaaagggccccttggccagccctagattaacaagaaagagaccactgaaaataccaaccacccaggacacttgaatcctccagccctttctccatgaagcctctggcccaaagcatgacctgtggaactctcttttttttttttttttggccaagggtacctagccttccaggaaggcactatttaagccaggaattgattttcagtccttcctgtgttcttttcacaaaataagaagtcccccaatgtgccctgcttgggagagcccaaagaacctcctaggaagccttgtaaatatcctgcctcaggaaatccattttctccctgtaatgaagagggtacaaaatggaatcctggctccacgctcttaacagcacgtgctcccctctctctctcttgccaagcttctgtttcatgttatatctcaacatctaaatcctccaagaattattgtaaaagctgcttgtggctgagagggagcttgtctggctcactcggctccatagccagtgacaatgaatgggtcagcataattaccgtgtttcctcacacaggcagccagctgctctgccagattgtgaatttttcattttctttatttcaaaatccagggtgttcctctgaaaacttaatagttgaactgtggcaagacagatttggagtcaaggccattcccactcattttctccccagtcctgaagcaagcgtctcatctctcattacttatgggcttttatgatattaggatttactcgtgttccccattaagaccccacacgtctctgcggtttcaagcataccagttgccacgtgatccaagaaactcaggtgctaggagctggcaaaaaaagttaaataaaatggcatgatctatctttagcaagaataaaaaaagttaaaaataacctttatggtcttctcagatacaaatagaaagacggaatcattctgggttctacaatcctcgtattttacccgcattgtgatagaaagatgcggtagaatccatagaacaggacggctgtgggacctttaagaacacacagaattccagataatagccatttggtcttcactttggtcgggttcgggggttttatttgggcccttaaaattgcaagagtaatttggaatggctgctgtggcaaaccccacccgctcccttcacccaccatgtaagtacaaacataccctatctatgggtgtaggtgtaattcttggagttctaagtgcactacatggtcaccccgtccaacctccttggtcgcagccagggcctccagtgaggcttctcatgcacattttttccttccaattcttttgccttttgctccttctgcaaccctcacctgggtccatgcatcagtgtatgtggaaaggactctgaataatggggagacataaggtggaacgcttctactcctgaagctgatagcgggaagggaagaagctcttcttggcagtttggatagagggtggagacaactttaacatgaaatgaactacaacccctgccccttgagaggtttgctcttctgcagaaagcctggaaaaggagttggttgtgctgggttaactaagagcatttccttcatggtgggccttttgagcctttgctgtggctctcctgggacagggacttaccaaatgcattttttcagaaaagcattctctgtggacacagtttgggaaacaatacctgctgcttagtgagatgggacaagcgtagtgagtatggtgagagcactgggagggttagagaagcgaactgagcttgaaggaaaagtggtttgctgactctgtgggccctgatgagttaggatttgcatgagaagggaggaagggcatcccaggtagaggaaacagtgttggttatcaggggacaggggtaaccggggtaaccatcaggcatcctctgcggacacagtttgggaaacattgcctgctacttagtgagatgggacaagtgtggtcattatgctcagagcactgggagagtcagagaagccaactgaacttaaaggcaaaagtggtttcctggccccatgggccctgatgagttagttaggatttgcatgaaatgggaggaagggaatcccagatagaggaaacagcagtagttatcagggggctggggtaatcatcaggcttaattccccttcctaactcctcctcacctcctcatcttgctcagagaattttacccaagggaagatatccccgcccacattcttcttcttatttgagaaaaagtcttgctgtgtcactcaggctggaatgcagtggtgccatctcgactcactgcaacctccacctcccaggttcaagcaattctcctgcctcagcctcccaagtagcgggaattataggcatgcgccaccacgcctgaccaatttttgtatttttagtagagatggggtttcaccgtattggccaggctggtctcgaactcctgacctcatgatccacctgcctcagcctcccaaagtgctgggattacaggcatgagccaccgcgcccagcccccacattctctttttaagggtcggggtcccagacttatcgcgtatttgtaatcatgctggttgcctttgcctttaaatgctgcacaggagttcagcagacttatcagatgttggtaataagctgtttctcatggcatgtgtggtttgtgcactcataccacatacatgtgtcagtgggaatacttcaattagaagttttaagaagtgatatctgtacatgaaggaaactggaaaaataggatgggggaaagttatgaataaaaaccactcatgcagttcggccccagagattgctagcatgtggaaagttgtgtgtatgtgtatacaaatatgttcatatcagcatatgtacatatatgtatatatacatgcacacattcatacacatgtacacatgcatatacacatatgtgtattttgcatgcaaatacacctgtacatatatacataggtatatgattgataagacatgacacatcttgcaatctgcccttttaaaaatatgtttgtgggttgggcgtggttggtccataactgtaatctcagcactttgggaggtggagacaggaggactgcttgaacccaggacttcaagaccagccggggcaacaaagggagatccccatctctacaaaacatgaaaaaattagccaggtgtggtagcacacttctatctatggtcccagctacttgggaggctgaggtaggaggatcacttgagccctggaagtcgagggtgcagtgagccgtgattgcaccactgcactccagcctgggtgacagagccagtccctgtctcaaataaactcattaattaaatactcatgcagtgagcttttctcccgttatatagaattatttgcaaatgtttgtcagtcaccacattctcctgggcaaagggcccactgtgttaactactcatcctctctggagtcccaccctggccaccgtgctgctctctgctttttaacctcttgattccgggaagcgggcgggggtcctgctgggaccctgtgcagggacaagggttcccggggcagttccctccacagcagggtgtgcatctgacagcctgtgctctctctctctctctcctcttgccccgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcgggtaagtggggcagcctcctgggtgggcctccctgcaccagccctccctccccagaggcacggagctgtttgcgagcgcatgatggtcttgactccccctccgccacccccagaaccgcccccagcatgcagcccggccgcgcacctgcagtggagcaccttgctaagagtattgaaaaatgagtgtaatttgtcctgtcatggttggtgcctttaagcattctacatgtcacatgttgttatgtaaattctctttgagactgaatgctggagaacagagaaatggttacagccaaagatgtatttctgatgattgcaaacatctggttattaaggaggttggaccacatttgccccttgaattcctccacagaaagaagtgaggttttcatacataaaaatcactggggtcgtcttgctcgcctccccagggatatcttggcttcaagggtcacgaacctttgcctgcaaagagaaaattaggtgttgagtcacatgcaaacatacaagaattaatgaaattggagttaagatgcgttgcagttgcgttttccaaaatggcatttgccttcctttctcctctgtgggaacaatgcagattagtttgtttcccattgccaatttggtccttctctgcacagactttgatattgccaggcgaatgtcaaggaatggtgtgaatgctcagtaaaagaaaaaaaaaaatgatactggtgtgtttggtggcagtcttgaaatgctagtctgtccctcttttaaggctcctgctagaatattcttgcacctctgcagccagggagaaagggatacctccaaggcagtggccctagaccaggggacatttgcaaggtctagagacatttttggttgtcacaacaggaatggagagatgctatgtcctctattgggtagagtctagggatgttgtttgacagcccccaacaagaaagaattatcagactcaaagtcagtcatgctgcagctgagaaaccctgctctatgttaaattcagcgatccccagaaagcctggcactaggcttccctggccagtgactggctttctggtgtgtagaagaaaatatggctgcatttaagactgtgtgaaaagggttaaatgcccttttcatagctctgttgcttgtaaatctttcagaaaatctacattagcctagatcatctattatactcatgacaaaaagaaacactttttttcattacatattcattctaaaccagagcatttgaaatgtttgtttcaaaaataaatgcaataaagttaatggtaaaaagaaatgagagtaggtaaaaccatcagagaagggaaagttaaggaaaagtagtaagacaaagtccatcaaatttcttgtgtagtcatttgaattgggtcaactttgagcttcttggacaaaacaagagctctctctatgcatacacatattttaactgaaaagacggtggatagtaacaaaccaagaatgaactggctataaattctccctaatgcctgtcaaatgtatttgtatgtcttaagccttttatgtgaccatgcaatataaggagttgtcgatagtataatttttatctctggtatcacagcaatgagcccattttatggatccagaaatgtaaaaataaagatttgttattcccaagatcatgtaatgagttatgaaggaaaaagaaaatcccaagttacctttgggctcatgtaattactaaagcaagatttgtatgctataaatccaaaattgcacttataccacattcgtttgaaaattgttctcagtacatgggagttgaagggttttagtatatctaccatcagtatctcactactatattgaagagcaaaagaaacaatagaggaaaattatatggtttatcctcacatgaccaatttataaacatctcagaatgacacacctgctgtaaaatcaaaattaaattagctaacttataatgaacatgctctttgctgggaataaccatgcataactaattaatgccatgtttcaccagggagagacacaggcatttccaaatgatgaaacaatgtgtttgtaactacttgggatgaaaattaattttaatattccagcaatatctgtgatcagtttggttatagtggtggattgtacctccttgctgataatagtatggctggcattctaaagccatacttggaagcaagatcaaattctcagcagagaagcaggagccccagcaggactaagattgcaagcattcatgtctgcaataacctattagagcaaggtactggtcaaaaagaaggaaattcgtcttgttgcctgggtgtttcactggattacagactcctgggaatgaattggcacggaatgaaaaactttgaggccaccatcttagaggtttccttttcctctggaataaacagattaggttgcaggagatggcaaggggatggctcctcttggaaaggaagagagcagagtgggacccagggcaggagctggctggaagagcaagaacccctatcttgtgttcagggagagcaagaacccctatgttgtgttcagggaaagcaagtagcatagaggttagaaatacttgttttcagaaagtaacatcatcaggattcaggtggtccagagagcagatttcctgtagccttttatctctaaattcctttggaggaaaactaagatttgactgacgtctttaccccagcccagtgcagctcaccctatgactcacacctattgtgttttaggcactgttgtgtgctgaagagacaaatggcaccttgagaggtatttcttctggttggggcagggggtgacatacaagccaacaatttcaataaatgtgataagtgatacaagaggatattgtgtgaacactagggaaaggtccttagcccagcttgggtgtttacagaaggcatcccagaagagaagaaatatggggtatatataagtccaaacatttcctaaattgccacagtgaaatcttatcctgtgacccctcctccacccacacccccagcaatctccatcttttctaagatgtcacctaacaaactacatttaagaatttgtttccactgtcaccaattgaaggcatatctgccaacctaaatctgttcttcctgaagtatccaatatgaatctatattgttactaaaataccagtcaaaaaggtgtcctaggtccatgcatggcttccacattttcttcctcctgggagattgaagaaaatatcctttaggatctccatggctacctttatggaagcttgggtaacccttggagatatccaacataaagatagtcacaccagtagagtccctaaggatgccctacattcatccatttccttttaaaaaaaattttttttgagacggagtcttactctgtcacccaggcttgagtgcaatggcacgatctcgactcactgcaacctccacctcctgggttcaagtgattctcccacctcagcctcctaagtagctgggattacaggtgcccgccaccacacctggctaatttttgcatttttaatagagatggggtttcaccattttggccaggctggtcttgaactcctgacctcaggtgatccgcccatctgggcctcccaaagtgctgggattataggcgtgggccactgcgcacagacattcatcaatttccttttattgatttgccttttccttccatgtcttgatattttctgaagcccttccatgcagctgaagaacatcggttatgaagaggcccttttttgtctcacatgcctaaatagaaacctcttgggacattaacacatgatcattcctccaggggtagggaaagttgtggaccatggtgggatcataggtacaagtggaaaaccctgtaccaaaccaaccaactcccaattgattgccaacatcaattgaatgagactgaagagttagaaagtaatgtctacatagcctatggaattttatagtcctaggaagacactggatttaaggtaaataagactgggccccaatattctacccatactggcttggatagcttacttaacgtctatagacacagtttgcttaagcgagagtgggggatatatctgcccccatagagtcgatagagggtgaagcagggaaatccatgtaaggtgacaacttggtccatcttatgacatgcattcagtgaactgtacctactgttctccaggttgatgaacttagcgactttattaaccacccacagtcttctttctcaacatcccccttttgcttgtggttgagtacaaaagaagatcccatgtctctccctctatgcattatttatctttgctagggggcacttgcagtttcacagacctccatttccttcaagccacagaaatggttgaggcacttgcattgcttatggaatatgtagattgaaaatacaatattgagtagggaacagtcacagagcagagtagagttttccttatttctccttgcatttgatcctggactcaatttgactgagaagccacaatgcccagtctagcttcctatgactcacatttgggaggaattacccatcaggtaattgctgttcagggagctcacaagctgattatctgtgcatcaagacagcaagtggaggctttggagacaaaccctgtagacttagtatctttgatgttagaaaacagcagctaaatcccaatcccctccctcaaagaggaactcgatgagtacctattaggtaccgtgcatatttcatgtgagtacaatggggtgctctaatggagcatcacatgagttatttttgagatggagtcttgctctgtcacccaggctgaaatgcagtggtacaatctctgctcactgcaacctcctcctcctgggttcaagcaattctcctgtcttcagcttcccaggtagctgggattataggcacatgccaccacacccagctaattttgtatttttagtagagacagggtttcaccatattggccaggctgctctcaaactcctgacctcaagtgatctgcccacctcagcctcccaaagtgctgggattacaggcatgtgccaccgccccctggccatgtttttattattattctaagcctaagcatctagtgtcagctgtaggcttttggtcttgttctctaggtatctctgagtaagattttctgccctttctcaggtaattgtcatacatctgtgtaaacttcccagagttaccttgagaagtatttgagaagactctatattatttggggtataggaaagatagagcagtatcccaggagaaaacttaaagctggtcagtggaagaacaaatagatcctttggaaatgttttcacgttaagtcctaaaaaagtctccaacaacagtctctgggactatgggcatatctttctgtgtacagatcagccatgctttctggttttatcttctaaatatctaaatccgcaacctgtagtatctgatgcttaggaactgtatttagtataaatactaggaacaaaagtcatcattacccattctcagaatactttagacacaggggcgtccaatcttttggtttccctgggacacactgaaagaattgacttggaccacacataaagtacacatacactaactacagctgatgagcaaaaaaagaaaaaagaaaaaaaagaatctcataatgttttaagaaagttaatggatttgtgttggggctgcattcaaagttgtcctgggccacatgcagcatatgggctgcggtttggacaagctgcctttgcagaattctttttataaagtgtgacttcttatttgctagttttaaaatgtaatccaaacagcctctgaatagcatgaacttatagacaaacatgatgaataagtggtctttaaagcctttttttggaggggagaatgtgaaaagacattttcacagatgcctttaataatctgattaaaaattctctaggaaaatacgtacaaacagcacacacacacacccaaattctatacacatgccagctagtttctgatccccccaatatccattaaaaaatagcggtatttgaacaccttaaaaagtttattttctagttggaaggggcctcagggtagaacaattgtaaacagccttttctataagaatatacttgtggctggtatatatcatattacacgagcagattgtatagtttgggcattttatactttttttttaaagtaaactaattttctgtagtgcagtcactccctgctcgcattcattcaaatatttaactactggtattacttttctaagaaaataagatgtgcatttgcattatgtccttgcaaaagcacattgagtcccgatgtgattgacaaacaatacaagtacctttgcatggctagacggaccatctctgcattgaaatatgactgcgcctgtttagtgcgcaatggtaactcccttctctcctaactgttccgtggttaatttatctatagctgcaccgcagacatggatccctgtgcctctttccctgcatatcttatattttaagtgcagctgtttgatgaggctttacaaattatttggatacatttttggaaactagcatgaggctttgtgatgagaactttcccgtaaccagctcctccattagaatataacctaggaggctgaccttcagttttgtctcaaatgtaaagtaaaataacacttggaggatggtgttgcatagagctatgattctcatattcctgggaccaatagcatccgcatcatctgttaacttgttagaaatgtaagctcttagatgctgtcatccggatctattcaatcagaacctgttggctgggcatggggcccagccatctgtgtttcaaaagtcctccaggtgattctgctacacattcaagtttgaccaccactgcctgccatagtacttaagagtttgcactgtggagccggaccccctgggctcaaatcccagttcagacaatacccaactctctttcagtttctacatgtctaaagaggcaatgatcatattgtccatctcatgggggtattctaaggactgagtgggatcatgagcacagaaaggctagactagggactgatccatggtaagtgttctgcaaatgtgagtagtgggagtaatggtgctcgtgctgttactattagggagaaaaacaatgttttggtaaaattggcttcccattacatggctttatttcacactgccggtgaggatggctacattgcttccacattttttagagttatcctaaagatagatcactcgtcctttccatttctctccaatacatgtgcactttgaaaacaagtaatcccttcatgatggggtttataatggcagctacaatcatctttttgctgtgaagccaccatatttagaccctaatgcttatacgtttccccccagccctccaagaagccagagcgtgggtcttccagccataggtcttgccttgcagtaccctcaccccaccaccctttgccttgacagcacttcactcctctctaccgagccaaggctttgaggtttctgtgccatttgcttagcctctctcgtctctgctgctggccctgcctccttccgttccacattcagggcacctctgttgctgtctcctgcagtatctatctcagctgtgattctacagttttatgcataatttgtgactgtgtgtcccacttcctgtacactctgggagggcagggttactgagggggctttcttcttcggtcttcatgccttcgcatagtagttggggtacaggaaagctttcagtcacagagaaatagtatgtatttggcttgtttgagcttttcacaatgagaaagctacactagttcttctttggttcagtgtttcatcaatgtaggatgtcagcaacacccaagtaactttccatagcccacagtggaggacaaagcatggcaatcaggttaccctactgagcagagactcctaagagcaaacatcccggcatgttctttcctcacctctgggcaatgttggtacaaataggcttgacatggaggcacaaaactggccatggtgcataacaacttgtcttaatgaaagaagggatcagtttcttggccagagctcagcctcagccatatcaaagaaccccaactcttggcccacacccatgccatgtgccccgttggaacagcctccaaggcctgggatcaattcttctctccgtcatttacagaagatcagagacagatgaggttccaccattgagatctttagaagtcattatttcccatatttaaaagtatgtttcatatctcatgaaaaatacattgtttacttctagactgctgtctagtctcttgccctggtctcctaattcaggttcgagtctgttaatcgtatttctcctccattgacaacagccactgatactgaatagccaaatcagagacaaacctcagactcctcccgacccattattgaattctacctggagttggtaaagcaatgactcaatctccttctgacgccttctcatgcccacccttccctctaaaatatgaaccctattcacccagttattgtccatcttctaggtaacaagcagtgtgtcaggaactgagaatagaatgttagttaagccacagggtgtagcttttaaggtgcaacgagtcacatgcacacagacctttaatgtgaggcagaaattgacgagtggctctgataagagtctgaaaaatgatgctggtgttcataatgggaaaagtcacccagctgcaggtgggcaccgggtctcaaacatggtgacctcgttagagctacagtgttaagcatgatgccacccatccctttgcaagcattatcttacgaaaccctttcttgaggtaggcacttacctattttccctttttaacagatgagtaagtgaggttcagatgtctcaagtaatatgtgcaaaggcactgcactgttgattgaggatgctgcagtctgattcaaatgcccatgtgcttcccatctaacttggctcttgaatggtcatgtcactgcttttggatgaggatactagaataaagggcattgccagcacaaggcattgcacgtgcaagggcatggcagcatgaaagaatgggatggagcggttttgatatggctaagtgatcagtcctgtggtttgggacccaaactaaatatctgttgctccctctctttcatcagaccttggcagagggtggctctgccttctgaccccccaaccgacattctctatgttggaaaagttgaaaaagaattcaaagcatagctcaggacgatgcacacctcagcatcttggattagggctttatgccacttcacaagcgctcttgtgaactgtagccctcccggatcaaatatgaacaacagctgaaagctattcctaccaacctccttagtgtgtgaaatccctgccacatttttaaggacaatggtacttggagtttagtcaatcaactctgaaatactctaagcagcacactagagtgttctccagcaaaccagtgtcacagctgcgtgtgtgtgtcagtacagcgtgtgtgtgtgtgtgtgtgtgtgtgtgttgtaaaatgccttcccttggctcaatatgctttgcttacatgtgggttcattctgctacagaaacctgctggaatcctttggtattaaagttgtgtttctattagaacctcagcttcattcaatggtggggctcattggtcctttgccagaatcataagtcatctagaaacatcatgggaaggtatcggggaagattgtaaataactatgatccttttaaaaataggcatttagaaacagcttcatatgcaagatgccttgtgatccttacaaaaacctgtgaaggctacatatgattctcgttaaactcgttttcatgcttaggaaatacaaatcagtttctcacgaccacgtagctaagagcttcttttcctggttgttttactcaaagcataccaaaaagcttctggggaatcattccctaacccctgtccccagccctctgaagtctcttctttctgggatggtcactacatgggtggcaatcagagagctgctatcagattgggcttgttcaatcaaggtgtgggtctttgtttagtctagatataatttacgtgaacatgcagatattcacatgtatacacccttgtacatataagtacacaaatacatataaataagtatacacatgcatatatacatgtttacatacgtgtatacactatagacaaatacatgcattcctgcacttgtccatattaacacacacaaatatgcacacaatgcacttgtacacatgaagacatgtctgcacagaaaacacattcttgcacatgtacccatgctcacccacatactattagagatattctccattaaccataaaataatgcacgtgcaattaccaaatataatacaatgtgaaagaatatagaagaaaatttttgaaaccatatgtgttgtccacctcacctaaggccattcagctctagcccatactgagaatgctgcaatctgtgtgtcgacctttacaatccgatttttaaatagatgttttgggtttttattctgtggggtagggggctatgtggtttgattgccaactctgacctgttaagatgctcatgtctgtctgggccacttaaatctcagtcctctttgcatttcaaagtcgtgcctttctgtacccactcctgagagagtgggaagtttgggacctagcacaccgccaccaccacatcctaattctgggccaacaccaaagcccggcctaattttctcggtttgctcaactgccgttgtctccaacctccttaatccaatgtgaaaacgatcctcggttcctgtgttttggatcttgtgaccagactaacctcgccagtgcaggggttggtgtgtctgcatgggaaatgcactaatatggatgtttctctttgtgtgtgcacccttgcagtgttgtttaccaggatggattttatggtgcagacatttatgtaagtattcattcacgtgcatgccatccccgtttcctcctggagtcattctttttacaagtttgctgtgaatttctctacttggcgtagttgagtttctctccttggtctgtaggaaataattccgtggtttgtcttgcaggacagaaagccttctgctcttgaacttgtggcagacatcactggctgtttagtggggtggaattaacccctcgatcaacttcagaacgaatgcaattcccccaaaaaggtggcatttctttcatgccaactaaagaccccacttcacccacaaagaaattgtctctcaagttctcgatatgttcttcgttttcagtataatatttaggataacagctgtagtcaccagctgcagagggttaaaagatattttcatggctgctatttttgatgttttccctaaaatatcacagtagccttaggaacactctttctctctctagacatggacaagtttagccctaaacatctcctgattctcttaatatgtatgtcaaattgaacattgagcccccattttctttaaccttttattccatttcccccaattacctgacttaaaattgcttgctaaatagtaacactttaagtttatttttagaaaagagtaggctatttctcattatgagaacaagaatttaactatgttcatctagaggtagttattctccgacattatgatatgagcattgacgatatgaaaatgacttggagtaaacacaattttgaataagtaggcagtgttgggagatattccctaaatcacaatttttattacaaaagacctcagtcaatgggattatatttgttttacagactagatagcaaaaaaatcatatttctgatgaaattggtatcatgtactagaagatgaataaggcactgattattgtattccttttgaatttcaaatcattacaattttgagatatagtatgtatctccatcaataatagacttagttgagttctactattgcatcaagtatacttactataatctgtgggttagtattttttcccccgtaataaaatgagtgaacaacccatatgtcctaattcactcagtgatcaattttcttcttttttgtggaacttaagcttttctgtctcatgtcctcttttttcagactttcagattttaaattatgaggcaggctggggctgagcagtctgaagcccattcatttcctcaggcacctgctaaacccaatcaccagtcctggctctcgactccatgcagcccatgggtagattattgcagatgggaggagccagaatggtagttggcatcgcagaatttagggctttagaaatgaaagggaatagacaagggatagagaaatggttttttaaaaaatccaccaaaatggaaactatctccagcaacacctacccaagaaaaaaaaaatgcagattttcctgagtttagttaaaagtatttcacaatcatttagtgagtgtccacctcttcacgcctcagtttcttcaaactgacaataatttattgaatcattaatgtgtggtgtcttatgcagatatcaaattggtgtcttcttggcctcagattcttgagtagcaggaaggagaggctgcctgaaggcagggtctgtggagctcccacaaataaggaaaaagaagggactcatttaagtgagtgcgagtgtgtgtctgtatcgattggggcatatcgctgcatcagagaatccacagagcaatgcaaatagagaaaaaacaaagttagaagaaggaaatatgccaaccacttgactagagaggaaaaagaaaatttattcagggaagaaagccacagaagtgtccctttgtgcttttctagttcctttaggagattttgtctctcacacattcatcatgtttgggccaagcccactgggtgcagcggtgcagctcgggaagcatcagggtgagcttcaaggacagagtttcttccagtcctaagttgtctgatatgtttgttcataaaactgccctttctctgacttttcaggccacgacccccagccagaaattatcgttttccccactctttatattataatgacaataagatttttcagtgggggagcatcacatatgcaatcaggtggcagaaaaagttcctgcaatatgaatttagagatttgattacccagcacatgtttctgtcctgtctctaacagtctctggaatctggtagaccttcctgaatattttgctttgtctgatgatgactttaacatattgctgctggtgtgcatccgtgtgtatactggacagcaggaaactagcctgtgccactgcccagctcagcagcagaacaagaggtctttgatgaccataagtttaagaaatataaatatgttctgcaccacagaatatacagaacaagattcatcctagctagaaatatatcataatcttgaatgtgctttttaaagccactaccctacctcccttgagataccagcatgttctgatgagtggaaatatccccaagcttcgtttttaaaagagatgatggttaaacagactcttagaaagtcatgtgagcttctactttaaagaaagattttggcttactccttcaagctcgttaaaagtagtacacaataaataggtttagggcaattgtcaacggccccgggatatatgttagacacatcagatacctcgaatagatttaaacctctttttgttattattatattttttgagacagactcactgtgtcgcccaggctggagtgcggtgcaatgtcatctgtctgcaacctctgccccctggaagcaattctcctgcctcagcttcctgagtagctgggattacaggcgcctaccaccacccctggctaatttttgtatttttagtaaagacaggatttcaccatgttggccagggtggtctggaactcctgacctcaagtgatccatccgcctcggtctcccaaagtgctacgattacagacgtgagccactgcaccaagccataaacctcttctttttaagtttattgggtagtcagtttctagcttcggtcactgctaaggaagacaaaggaggatactgtcagattcttcctgctcaaaatgttctccatcctggcagtatatcagagcaggtcaacaactcaacagcttgcatctcagaactactgggcttttctaggtgccctgctctctcccctcccccgtcctttgttcttcaaggtctttccatgcctaccacctgaggttggagccctcgggcattttttagttctgccaaagcacatagtcattgaaagacctgcgtgatccctgtaactggcaagccacaacctcttctctcaaatgacctccttctgaaagttttcagaggaaagaggattgaacagagagggacagatgatcacagatatcttgaaattgccaaagggagtagacttgttatgaaatgctgtgagccagacacgaagggaaaaaaccaggacagctcatttgggcagagagcaaagacaaagccttcaatcctattcaggagctgagccctgcaggaaacccactgcctctagccacagtggagaggtgcaggcacagtgtggttggctactcatcggaggtgatgcgggggttgtctgagaatggagggtaggaatgatctttatctgagtcccttctacctgagaacagaacagaacacacacacacacacacacttttgtataaaaagatagataggaatttaattttcataatgaaacatatcaaatcttttgatatgttcactattattgcttagtggtgcacctttaaatacattcattttaattaaaaagtggatcaagttaagcaaactaaatggtagagtttatacaaacagagttgcaatgcaaggactaaggttcttagatctacagagtctctcatacttggaagtgaagctatagatgttttttgaggtggaatctcgctctgtcgcccaggctggagcacagtagcacgatctcagctcacttgcaacctccgcttccagggttcaagggactcttcaacctcagcctcctgagtaactgggattacaggcactcgccaccatgcccagctaatccatgtattttagtagagatggggtttcgccatgttggccaggctggtctcaaactcctgacttcaagagatccacctgccttggcctcccaaagtgctgggattacaggtgtgacccaccatgactgacccctgaagctataggttttatgaggctagaagttgaccaaggagtggaaaacaagcattgcttaactgaaccaagacatctgttggttgaccttctcagaaagagaccaaaaagtatagcatttgatcaaaagataactattaatattacaaatgaaaagagggagagaaagaaattataatgaactgttaaaaagaattgacaaacggatagaaactggaataacatagtgaggtgtgacaatggtaagagcagagagaaagagtgagaggatatagagtataaatgttaaccttgttcctttttattaagaacatcctaagcgtcctaacattagacgcaaccatgagggccgcctagcaaatatgtcttgagattccagtgcatttttataccattcctaaattctgtataacaagtttctggttaacaccatggctaaacacaattatttctgaattcctgtcactctgccacccatatgttttaaaacaaagaggtatcctcatttcactgatgtttaaactcaggaatgagatgtgtcagtagctttgggaacatgtaaagctggaaagtaggaattctttaaataaaaactcctagtctttcttcctgagaccttgctttcagtgtgaggtggctgaggattggcatttgacttgccgtccgcagtcaccatagtggagacctcagtccaccaagaaatcaggcgaatgctgtgtttgcaatgggagagacaagatgttgagtgttttacctgtattacgtcatctctcctcaccacagcccttgaaacaaggaatcttacctctatttttctgttgttccagaagagaaacttttttgggagacatagcctccctgtatcacccagggtggagtgcagtggcatgatctcagctcactgcaacctctgcctcccaggttcaagcaattctcctgccttagcctcccagatagctgagactacatgcatgcaccacgacgcctggctaatttttggatccttagtagagacggggtttcaccatgttggccaggctggtctcgaacttccgacctcaagtgatccagctgccttggcctcccaaagtgctaggattacaggtgtcagccaccacgtgtggccaacaggaaacttttttttccagaaaaaaagaaaataatttgtccaaaaatcttcagacactgggccttgagcccacatgatttgactactgagtttaatgctgaagccctgagcccacaaactcaagtcattgcgctagttgagcaatatttgaaaagtacggtgaaagatgggaaaggaagagggagagaagtaaaagcataacggggtggttagaccactgagaataatatttgtactggaaatattcaagtaagcagtgaactaggagcgaaaggaggagagagaggaacaagaatgttatcaggcatcgctccgtaagcttagacttttaacataaggaagcaaatttaaactggaaaggcaggctatgtaggaaaaagtatacacaagcctttatagggtacgtccctcagtctcttcaagtgttcagccatctcagtgtctgccctagaattggagaattttatttcaaactgtgaccactcacatggaagattaatcttgaccatgaatgactcttatgtcaaaaaactgcatcctagtccgcacaaggattctacagagaccttccttgccagtgctagatttgtatgaaatgatagcattttgatatgtatattaacactagtttacacacacgcacacacactcatatatactcacagttctctagtctgaaagtattaaaaggagccatcgtagcttcagtgtaattcatgaattcatgaactgcaattttgctgttagttgaaattaatttaacaagtaaaggcatttatgcagttatggttgctactgtgctgttttcttaactacttcaataataaggcattcatcttaaatccttagatattccagaaaattccaatcatgagataaagagatgaatgtgaaatagttaatttggactgttggaatatgctttaagaggcaagaagccatgaaattatctttttcttctttagaaataaacacaagttataacacaaagtggtttgatccccatctccaccttgatactctccattgcagagatttgcaactaaaaatgtttgtcgatgcccagtgcccctttcagcttggtgggccagtcccaaggcttggtgaagtaagagagaagcaaacttgtaaatgaattgctctggaatttgtctgacttatgcattctcttttatttatttcatttttgcattgaaaacattacatttctgtttccttatagagtagtgtatcaagagcctgtgtatggcaataaattgctgcaggtatgaaatcccgactggtggagaaactcatcactatgattgtgggtttgctgtgaaatccttactaacaagataattctggggaggggaacagttctctaacataggaggaaagacttaactgaattttccagttttaatatgaaatctcctagaatagaggtgaggtggctatccctgtatctatcagtatatccactgtgttgtggcagtttcttccaaatatgggtgctgtttccatgactgagtgctgttagctggcctcagccatgagctttgttagatcctgagtgtgtcaaatggtggtctagcttggctgttaattttttagtttaaaagctatctggactcaatcagtataaatccaatgaaaataattcaaggttctaattgaaccaattgtctggataattttttagtaggttcccagagtgaaccggaatggggttaaatcaagaatctcatgtgcaacattaagggccagcatacctgacatctaacataaccctccctggtcttagtagagctgatcagaaatttatttcaagcctgttgttatagcttttaaacctatttctcactgctaaagcaaccaccaactgaacaaatttgtaggaagaaaaaaagtcaacatattcattggaatgtggctggcctagagtctccaaatttggtctattacccacattgaaaccgtcaaataagatgaatgtcaaactgaggatgatcagtgagagttgtaggacattactttccctatctctgcaattcccttttttcttcagtattatgagtgaattacgaaagtactttttgtaaaccatgagaattgactgagttttaattaaaacctgaatgtgagaaagaggtactttgacctagtaaagagcaatatggttaaaattcctgagatgaactttcactgtcacatttcaagagaactggacctccaactgccacccttcaaaaatagatggatgtggccaggtgtggtggctcacacctgtaatccccgtacttcgggagacctaaggcaggcagattgcttgaggccaggggttcaagacggggccagccaggcctatgtatcaaaaccgcatctctactaaaaatacaagttagccaggcgtggtggcacatgcctgcagtcccagctactcgggaggctgaggcaggagaatcggttgaacctgggagacacagattgcagtgagccgagattgcgccattgtactccagcctgggtgacagagaagactccatctcaaaaaaaaaaaaaaaaaaaaaaagaacatatagataaattagggagataaatttttcattttaaaatgttcttataagtattatatagtaaataagatttaagttgtatgtgtatataccagcacacctgttttgcaccaagtgagacttgacccttgcatattttcatcataaagggagcctttacccctagttaagctgatttactttcctatgcactccagctgaaggaagcatgcgtaacacgtacatgttacagtcctaccgacgcccacgtctccctagcacacacaggtttcccctcccctatttcactgtttggccggtagaacatttattttcaaaagtgatctaaagtgaaaactttgatttaagcctcaaattctctgagatgccttggaggtccctcagtgttcatgaatattgtcccaaggagttccacaaacagagtaaccagtttaatttaactgagcatctgccaaaccagtttggttgtggaaattttcctttccttgccaccattaataccccacaagcataattttgaaactgctttattagctaggcacagtggcttacacctgtaatcccagcactttgggaggctgaattgggaggatcgcttgatcccaggagtttgacagcagcctaggcaacatagtgagaccccatctctagtagtaataagagaacaaaatgctttattggagcatcatttgaggtgcttaatgggtaactacctcaaaggacctctagaggttttgctaacaaaggaaacttctcagtccacatgagtggatcactttggtggcctcactcatttggtggtggtggcaacaagatgcacaatgacaatttgaaatttttatataaggttacatttatattttgctgcccatcctgtgaagaaataaatgtttcatgaatgggagcgtagaactattttgtgtttgtcatgcctcgttcctttggtttggtggtgggaaaaatttaattgtcaatgacacatttttgtcaaatgatctcggaagaccaggttcaacatgaacatggtctggtgacagcaattgaaagtgagtgttccttttacagacatcactgtggaaccttgaagaagttctggatatgctcagtgagctgcaaaatacagagcgataaaattgattcaagtcacctgttaggaaaattaaagcaatttgtatttttgtatgtaaagcaatttatattttacagtgtatgtacacatacactgagttaatacacaactcttatttccctagtatgaattgcatacagaagaaaaatagcaaaggaagaccatgcagtaaagatagaggagagataaaaccaccctaatccctttttccctaattattacatgtttcagggatcatttaggctggtattgtccaatcctttggccaccagtccccatgtggctatttacatttaaattcaaattaactgaaaagtaaatttaaaaatcagttcattgcactagttacctttcaagagttcaatagtcatttactagaagtagctactctgttggacagcacagatatagaacattcatctccaagtggtctactgcacagcaatgagaccactgatcaaggtttaaaatctctccgctggctctggagagttaaggaaattgtgatcttaaccctggaatcaggaatgctcacaagcaaatttctagataataaagtcataaataatatcagaatattgacgacttgtgcccgtcttgtctggaaacacacattttctgtaactggccaagtcatatgcaaacagagtagaggtcattttgagaccttcatagatgaccacatttgctgtgcagcggaatcccaggtgtacacacctgcatttgatgtttctactatacataacctactagtcagtgtggttcatttagttgtttgcaccgcagcaattcttcccatttatcggactcgctgccttcttccattgactgaaactaaggcagaaggtggaggatatgcaaagttcaaaccaagaggcttgcaaataggatgttgctagacatctttggtgggaccaaattcagtcaccaaatcatgattcacatggcatctgattgctgcaaatactttttcttgttccagagagaaacacattcataccacacacattctctccactcaaaactttaagcctgttgcagctaatgtcttctggaaatcagctagccagttctagcccctccctacctcattaagtttaatgtatgtacctgcacacctgtatctttctgtgaactttatgaaagccaagaagatgaacaagctatatagaaaaatggctccataaacctggtgacccaatttctctttagtccgtcactctgttgaactcagtgctgttataactgctttggttttataactcctcagcacatttaatgagttccccattcctaattggagaacatagtatttggaacaccaggtggcatctggctaagacctctttttgttgtggttaacttccattacctctttaagggaaacaaaaaaaaaaaaaactggttctaaattattggtgattatgtggcaggatgttttggatgtgtcttctccaggactgatccaaagaataaactttaaaagataaactcgtttctttgaattgctgtgcaaatgatagcatatttactctgaaagttaactgtgcaggaaagaggcagaaagaaattgagacccgtgtacctacatcttgaaagaggctttttgtagcttccctgcttcatctatgtcttatcgtatttagtttcatgaagccaaatgccatgaacctacctttccctctcatgattctgctgttgtataccttctcacacactactttgtcctgagttgcccctttatggtgatggtgaggacacttacctcagaggattatgggactgtgtgttctaattagaacctgaatggtcctgtgttatcagcggacactggatcctgtttaactgtgctgagttcattgtacactggttgatgtatcattgtggtccactgagcaagaagctctgttatattcacagtttgatcatcaacgctccactgaacacaattccttttgaatatgcctatttgctcgtcctctttgcttaattgaacaattgcaattactggtacatacaactaaatgttaattattttttcttttcagattttttctgttaatgattttatttacaaattagaagactatcatattttccacaccaaacaaattctccgtctgaagcagcatgatacataaccatgtgatatctttggccaaaaagaaatgttcagtcatttttgtaataattgtgtaacatttagacagctacagacattcttcaataacattagtggtttaacaaccagataggtaagagattactaataaactttcaatcaaagggtgatttaataaatataaaagacaggaaagcattcactttataagaaaataagaactgtttgaataaaatttaagttaatatctgataaaggtaaagcagaaacaattttgaaaatctggaaagttcagcaaagtataaagagtatttaaataattccccataatcctctccaccccaagacaatcgccattaacatttaggtacattttcttccaagggcctctaggctcttcttttgggatgtgcttatgaccgctaacctttaacatccagctggggttggtattccaccccttgtttctccagggtgtttttgtattttcgctttgatactaagctttcattaacctcaactttagctcagtagatttgggtaacagctgctctggtgtggtcttgccactgggcatccctgcattgggctccgctacattcctgagtcacatttctccttgtgttttagggtggttatgctgcataccgctacgcccagcctacccctgccactgccgctgcctacagtgacaggtaagggtcatccttcttgtgcttgacaactacttgtaaattaacttagttgatgggagaggagattcttgtatggtcttggtgaaactgcatgactgctgggggaggtagcaccccaaaagttaggtcccatggtgaacgtgaactcaagtccccatagagagagggcaaatgcttcagccaattctaaactactctctctgctgagacacaaagaaaatgatagccttggtccttgtgtagtttttcacatctcttaatttctgtgacaacgcaccttgctcacatacacatacacacacacacacacacacacacacaccgtacaaccttcttatggtcttccacataagaccacggtttcatctaactcataggaagaaaaacagaccatgatcctacaaggtttacttcaatttcaagcccctttcctttttacaaggtcttatacccaataaatcattccctccattgcattattacaattctaaataaaggagagggagagtgtccctggcattcataaggagattgattctttctagcaatgcccagtgtccaatcctacaaacataagccagcttttatttgtaatgtacaccacatgttaaggcaggcagtggaaggaacacagtgtgtttgaggaatgcagaagtcagaatggatgggcaggttgcgggggtggggtggaaatcaggggtttctatcacccaggctgaacagatgagttggttcctgaaacagcaagccgtagctacttttgtatggttgccttgaaaaggaaagtgtgtgttttcatattgaatgcaactccttggctctgttttctgaggacataaatgtgaatgttcagatgctctgcatgcacaaatgtcattgagggtgcttattttggtaatgagtcctttattttaaaaatatgtttcacgaataaaacaatgataacaatttgcatgtgtggctggggcatgctgggtcagacaggtaagcaggcgatgtatttgactcctgaatgggaagcgtcagcagcctctggtcctcctacctggcctgttgtgatgtagttcctacctcggtttgctgtggtgtgctttctctgcagttccattccatttctcacgagacgtggtgttagctaattgtagctacagaattcttgcaatataataaagcagaataaatccctgaatcctaaaagctgcattttgaaaaccccatgcatacacttgtaacaaatggctctttggcaagatggagttgagatctgctatctggttctatgcaggtatcattttcttataagcagccataacaagttctcaaggctgtagggggccttcagagaaatccagacaattgtcaagacaaggttctcaatacataaattatacatttaccgagtaatcagttgccaagatgcaaaatgtgtttcatgtaagttgttatctccaacacactttgacactggattaggaaagtagagagggtcaataagactaataaaaatgatgacaatcttgaaatactcaagatcattctacaaaggaaaaggcctaatgttattaaattctgcactgaagcttcacaaagtatcaattgtaatgtggttcagctgcaacccttaattattttttatgaaaatatctctagatgctaaattctcaaacacccactttgtatataattataatcatagtaactctagcctgctgtataattataagaatcttaaacagatttgatttatcttgcttttcagtataagtgcatctatccccaagttgaaaaaaaaagattacaaagatatgatttaaatggactccttcaataagactggtctagacatttaaacaattaacaatatttaatgctattagaattacctgagattctggccatccctacttgcattcatctaaacatttttaaatttctgcattttggaacaccatacatgtaaaatctgttattttgatattattcagatttctcattggcaacatgtcccactgaaagattgcccttgttcttggattggtgaatctttaataactgcaattccaactttagtaccatagtttcagttgaagaaaccaactaactaatactgttgtccatataattggcctcttgttgttcattagagaaatttgcacatttggtcttcttggttgctgtggaaattgataactattcctatttaactttatcataagcaagacacttgccacatggtattattcattgaagtaaattaattaataagtaaatggacagaaagcaatctttaaagttgtatttctgatgttttaaaatgtctattaaatggtgctacttccttttatctgtaataagcagatattgagaaagaatacctttttatagaagacacgtttaggggaaaatgtgaaattatcagaatagcttttgaatctagattaaagatgccaagtacctataatttctctcagaagtagcaattgtgtaaccaattatttttatatcatcacagcatagaatcagtaagtgatggaagcttagttcctcttctgtagaagacaggcaagataaagaaaaacttaacagaaaaacttcgtccaaaataggaagtaaaatcagcaggcattgagaatgttttggtaatgctcactggttgtcagttgatcaaaagagaaacagcaacaaactttccctgtaatcatgagattcactcttcagacatcttgaaagcaaaagaagtttgatgtccccagttggtaggattttaccttttttcagcacaaattaagccctcatcaaatgaaagattcagggatctttgaaaaatattgaactccagtaacctcaggactgtccagaaggtccttaatgggcaccttgcaactccctgcccatcatcttcttggttaaatgatcacatgctgattatctcggagcaacctgagagtctctgaatgttgacctccagaaagaagaccatctggtgtgggcagagatttccccaaaagaaaaatacctgactggactaggtaattttatagtctcattgacaaatttaatgggaataggtgaacatcttttcttggcatttaggaaacatttggcaaagcacttgaccttcaccaaatctttatttctaatctcactttgatttatgcaaagccaactgtctgaactttcaaaggagagcgtttcctgagcttgaaccaactgaagcatggcagaggggcctttggtcatccggtcattgcatgccacttggtgttgctgatgtgtctgtgatacgttctggattggacaggtccatcacatcagcttgatgaatggcttgcttgaattaagcctgggggcaggcttctctttattgattggctcatggtttgtgtattatgacttggttgttgttgcatcttgaagcagccaaactgggaggtgcggagggggtggaaaagattccctgtttgatcaactgtgccacaaatatttgggaaaatgtgatgtgtacatggctttgatgaaagtgttatctccccagacagacagacatttgtcatgcttgtcctgcttgctaacactcttaacatttcctaatgatcagtgcatgaaaatgtccctccacgtcagggctgaaagtagctagatgcagaccgcctagagacggaagcaagacagtttttcactcagatttcatcacagtccaattacactgatagttaccaggggccatttcttccacataaaacatgcatttcttgtaaagatccatgaaagccaagaagcttttgacattaattgcggcaccaggccacacaggtatctctaaactgagcaaaagatggcaaccaacataattttgttttaatgtatacctttttggattctgaggccttaaagtttcactgctaatgtagagttagaaattgctacttttgtgtgacaaaaatgacatattggctctgttgtaatatgaaaatatacatatatctacataaatgttacgtagctcaacttaatagaaatccaaataaaatgccatattatcttcctctctgcacacacacacgtacacacacacacactcacttgtgccttggggcctcacaagggacttataagtgttttcaggtaaagcttaatgcaaagagaccagggcttgttaatttcaagtggtcacaaactacatgctagagaacgtaagttaaatatgacattcataacctatgaataaaaggttctatttcagagacagatttgtgtttcttagaacctagtaaggataagtaggcatattttcaggttcatagaggatttagtcttattttaaaattatttaagtgacagagatagacatatacatacatccatgcttacacatacatagatgggtgaaggatgggtagatggatagatggagataaatcgatacataggtgggtggatgaatggaaaaagagggaaggaagcaaggaagggaccatctttctgccctctaatatttcatcataagctaaatacagaaaataggactaaatccttatgcacaaaagattgtacaagctgaactaaaaaagtaaaaggatttgagttgatttccattagcgcaggctacttcctgtctattttagaatttttctggcctcagattaagtagtagagaaaggctgtcatgaaaatagacaggcaaataagtatatttacagtgatattccattttaattggagttcttatccgatgatatatactaaaaattaaggaattgtcagcatataaagtatatgagcatcctgaatagaaaatttaatttaccatttaagggcttatttttgtaggaaggttaattttttaagaagatgttgtattttatggacattatgttttcattttttttttcccatgggataggatatagtttaacctgtggataatttggaacccttaatgaaagtacacatgcaaagcagacaaagggggcacttgctttgctttccccagtcctcttatctgaaccaagtttgatagggattgaaaatatttctagctaaacagcagtagcagcccttgttcttattctttgtgatgtgtggcaaggagagatctcaagatcttattctagtgccgtattgaaagcagtatctcccaaggccagttcaagacctggcacctgcctttgatggcatatttacggtttatcaaaacggaagaacaccaaccatgtaatatggttgtcaaccctcttttctgggaaataggctgtatctattcttccttctcacatgctgtttaaaaagatttataaaattagaacaatagcaaacggtagttttagacatccaattttgtttttcatgttcttccttggcaaagtaaacattggcaactttatgctagactctgtatcattttatttacatttgcagtctctgagaaatctgttggaaaaatatagtgagagcattgtaaaacatggccatgccagagatggtattctcagatcaacaaggaactgaggatggagttcttgggggttcagaagggatgggagagttttccatgccatcttcccagctgggatacagacccaaaggcagagagaagccacttgcaagtttgagtctaggctgtggaatcaatacgtggcaaataagccaaagtcatatctctgtgccatttttgatggtgctttgaagaagctgttcttggttttagttttttttttttttaatcttttatttttactcaacctgatgaactctcttgggttctataattttttttaaaaaaaagatgatctgtcaagttgtaataagaatgtagcagaaatgagtcactcatgcctttatttacatcctcctgtgcccctgtgtctagaaaagcacgtccaggttttagttagaactccaggttgagcacgtgtacatctatacatatctacatgtataaacacacactttttcttgttcatttaaagtttactttcctaacagatccattttgttgttgttgttttttggggtttttgcctattcagactctccttaggaagaaaaagtgaaagcaattgtcctagacagctttcgggtaactagaaacacacagttatacctgtgagattcctattacaaagcacacatgccagataaatttcttaatacttctatgtgtgtgtgtgtgtatatatatatatatatatatataaaacagtgctcctcttaaagtgatgttgattgtatattctccaaaaaattaggataactaagataattctatttcctcctgatctgctctgtagactgtcactgatgtatggagatggctctgaaatagtgaggaagggaaggtacatctcagcttttgatagtagagtcaccgtaattttttaaaattgggtttatgcatgtcaagctctcagtactgagaagtaatatggctgtaactgatagatatatttcctgagtttctcttagtttatagaaatcacacacacacagagacagacagacagacacacacacgttaaaagaaaatgtgttcaactttctctctcaagaactaattgcctttggtccataatctataatggcttcataacaactgttatgcactattggatgaatatgtaattgaatcagtttaaaaaaagaaccaatcctgtaacagtcaacagactggaccaccaaggagttggggagagattaaaggaatttccaagcccaacagaccgtagctgtcacagccacgtgggtagacacttttgccagtgacaaggcaaggtgtaacaactcctttggtcatgtcatggcctaattacacactttttaggtcgcagatcattgacttgataggccacaaaaaaggaaataaagcctgtcttttcagtagcagcatcagaacccttcagctgtgaagggtttagaggcaggttgggaaagcctaatgctttctaggtgtagctctgttgagaatatacgtgcaaagccctatgaatgagccatttctattgctaaaaaaaaacctgcattctagaagacagtaatccagtaaagcagaagatagaatatcttagctcatgcagcatttgtggatgtggcaataaaaattaaaccgctccactttgttacgttgttctttgtttgggttttatgtcactaggtagtatactatggatggtagtatactatctttcaagataagatgaaatttttcagtaaaagtgtctaatatttcattttaagttatcaaagcaagttctgactctgtacttaccacaagttgaaattcttttccagaagaactgatttctatttcaatgtggcctctaatttatttccacttttgtgtgtagtacatgcatgtaagcagtcaccagacagaaatgacttatggcttccttggtgtaaatcacaatgcttggttcctgtggaattaggcacttctcaaaaactatgatgaatttcatatttaattaacatatgaaacatttagaataggggccactattggaatttgaggggatgggagtctgtggggcaaaaactagggagaatagaaggagtaactagtcacttttctttttttccaagctaattattgatacattatgatgtgtgactgttcaaatagattaacagatttctgaaagctgaaacataatcaaagccaaatattctcgtaattatcccaatcatttagattgaaatgctttggcctgagattatagaaatatgccacacatatgataagctaaatcagtggttctaacgggtcttggggacctggaatttaaagaaaaaaaaaaacatgattgttagatgcttctaacatcctctcaattcttgcctttcatggtttcaattttgtaatttaaaattttagaatgtattaagagatgaagaacttgttttttccaccatttctgctttgttagagtgtttgtggatgactactaccaaacagaatatgagcccaggtagtgggagtggaggcactttaataattcttcctggacaataccagcttccctgttttttcagaatgatcgtttccccactatttttgttttcttccatttctgtctcccaaacttagaaaatgaacaaatgggggaaaaggaggattaacttgttctgttttgaaatttcaagatttgagtggatcatctaaaaagcctgcagagccttgccttgtaaagtgtagtttccagaccaacaccattgggctcaccaggagcctgtgagaatgtagaatcccaaaccccagtcccagccgtgctgaaccagaagctgcacttcccagactccagaatgactagtgaagtttgagaagccccactttagagaacaagcttctgttctaccccgatatgccataatgttgacaaagggttgtcctgccacaaaccttgcaagagataagaggatctatctttataaattattgacttttattaccattgcctctctactctcccttcttcaatgagagagtaagaactatcaacagctgagtgacttcttccctctcctggcccagggccacaattaattctttaccccaaaagatccgtggacggaaacagttatttatgctaacatcgtgtcattaattgcatagattcacgctaatataaaggagtacctgaaaaagttccatctgatttcactttactgaccctcagttttttcctatgctaagtggaaagcatggtactaattagaatcagaaagagatgaagaaggtgaacattataaactgaaagaggtggtgcaaatgttatcaataactcggtttcagattgacatattttggaatgtatgctagtatttgcagtgaatatatagaggcagtagcaagtacattaaattaaatgcatttaaaaatgtaaggttatttttagtctaggcaatctctaagacacactgtaacactaaccctctgggaacctgtgccttgcttagcatcccaggtcttgtaggtaactgtgtcaagatttgaaatcagatcttttattctcattggacctactctgatatagacatgcactagcaaatcattgctgttgatacagagaataggattacagattgagatttacacgtgggtcctgaatctctgtgaggttacttactacacgagataatttgggcaggccaacattgagctagttgaccctcaactgcctcatctataaagtgggattaatggatgaccattgcttctttgcgtggttgtgagaatccattgctgtcatgaacagaaagcccctctaagagatcctgacacttagttctcaggatattagcagcagcagcatcactgaactgtgggattatcgtgttctgttctcgagtgaaaaaaaaaacaaggagtttcctgtggaaacgggttttatgagttagaataatttttgactaaatacatttgtttttggttgttttaaaatcttgacttctaccctagaaatataaacataggttggggaatagaaattgggaaccgcaagatcaaatatcctatccttctttttcaacctgtgccttggatatttgttatcttttctgctcatggatcagcttaggccaccacacatgcattagctttgtagaagaaatgcccaatctcccagtataaacccagccttcgaactatcaccgctttggatttttgtaaaaccaattgcctgccctcttctttgggtggagagagaaagagactttcctttaggagtctacacagacaaaaaaagaaaaagccaatttttctaccaataaaatgacttcacatttgtttctcattcaacttgcacaaaaggtctgggaagggcatgtactgtttttatatctcaatttttccaaatgaagaaactgaggtccagacaggtgaaatgaattttctattggaatacagcttatatgcaacaaagcatggttttcagattcacggttggttctctttcacctgagcctagacaagaagtgcagtgggaactggggagaatgttaaatgttggaggaactaaaatgacaaaagggaactgttcaaggtctccaagtaatggagatgaacttgggtttgaatttccaaaactcagatctttttttggtagaatagccaaactggggagagattcacagaccttatcttctttctgtttaagcttctttacgaatatcatgttagcaataggaactgtgtctaaatgaaatgtttttaagtgtattttcatgtgttcccccttttcaaaaagagataggtgtaggacctttgagagctttctataatcaatctgtttggttacttgtctgtgtataccctgtctcattctacaatttgccacagtgtattgaagtacacgtgacaacactaaactgaataaaagtgacagggcaggtaaaaaatatgaatctgaatgggatttgtaccattctggagtagagtattagtattttatgtggaaaggaggtaaaatactgattgcaaggaacctccctttgaaggtgataaaactgaaatataaattagattatgagcttccagacaggcaagtccaagatactccagtgatttaaaggatatgagcatagcatcagaccccttagacttagctcagtgcctgatatgtagcaagcccctcatttacaatctgagggctgaatgatgtgagtcaactctttggtaagatcagcaatatgaattttaataggtacatcctatctgcatattatgtttaatattcagaaaacactcatggctgagttccatatggcacgtctagcaattttaacaacaagaataaactgattattgtgactttccaccttaattttacatgtaaaaaaggaagcaacctggtaagcatgattataagacaattactaattataactactgtaattagtataattagcaattaaaatattaagtataaaatgttaaaaatcaacactagtgcaatttaaacccaaaagacacaactgtttcctgaagaggcaagatacatatgttcagagaggtattcatacagtgagatgagttctccgtgctggctgacagatgagaatcaaccccaggggtttttcaggcatatctgtacatgggaaccactctcaaagatgctcaagttaaatgaccggggtgtgggcctggtcattggtattttatttaaaaaacaatcctagctgaatatttattaaaaaacaaagtattggctgggcagtcagggctaaaaacctctgccttataaacaacagatatcccaatacgtacaggtagaattggattttgtcccactgctatcctggggcatcttggctgccatctaccaggccagaagaccaacttctcagctgtagggattgcctagtaggcatccttggcaggtttaaatgtgtgtgtgtgtgtgtgtgtgtgtgtgtgtgtgtgtgtgagagagagagagagagagagagattcaatattcatagcattggatacaagaagaatcttgctatgagtgatatcgatcctgagatatatttaacaatagcaatgtaacagaattaagaagccaaataatgagaagtgagcagaatctttgcccataagacttaaagacagtattatttgctatggggaatgtttacgtcccacctgcccgcaccaaaagttttctctgacttgatatctagcatctcatgtcccctccagcaacacaggctggctactgttttaatttaactctgagaattcagctgtgggtaatttttcagaaggaaaactgccaagagatgagatttaacctaaggaacaaaagtgggctatgagggtgatatgcggcaatccacaggactaatttaagtgtaccaccagctgaggcagatagagtatagatggttgatctataaaaccatcttaaaagattagtcaggctagtgacataagagtgaaagagacagaccatggcatatgccatttcataatcaagttgttgttagaatatgtttttaattctttctctcaattattctcaaagaggagttcaaatatttcttagaggaaatgaagattcagaatgttaagttactccacagagacatcacacctcactgctgattaaataccccctacgtgaatgttccaagcagaaccttagatagtaaaagcttggtcttgagccaagccaactgtgttcaggtttcacctctaccacttaacagctgctcgcattatgtaacttttccatgcctcagtttcgtcatctacaagacgaggataaaaagaagggttataagaaaaattaaatgaatacataggtatgacacttggcaacttgcagtcataagtgccccatcagtgttagatagtagccgttgcaatcaacattcccatgagccaagacaaacacagccttctcccttaaactcaatttggccatttcatcatttttcatacattggtaatccttcctcttctccacccccaaccaagccttcccagttcaaaataatcttcctgggacaggtgagctttgaagtgaaaatgggaatgaacttgcagatttttcagcaaggttgcccaaacttcaaggtaagaagcagcaggaggcgtgattccctcacagcagaatctgctacctacagaacagtgaaaatgagtgcctgtggagctgatcaacaggcaggcctgagttcttattaagtgtatagattaccagacctctctcctggaaattctgattcaggtggtcagagttgaaacccaggaatctataccttgaatgagcactctaggcattcttatcttcagggaagttggagaaattttggagtggaagagaggtagaatatagaaaagttgtgggtgacaggaatgggaaaatacagaagtaggggccaactcaaagaaaaatggaaaaacccaagcaaggatgatcttgagtaaatgcataagaagtggtccattaagaggaacaggtaaggaagaactcaaataccaagagtatgatatggccactgtagagcagtttctctttcaggatgaggtttaaagtcaactcttagaaggcatctagaaactagaagtaccctttcttggatactgtatcaggtttgtgtggttgcatagtctaaaacctaagtagctaggttgccctggaggcaagcatggtggccaaacagaagctgcaaaagtagaaaccaaagttggaagagattcagtgattcaactcccttgaatcccttccttgaatccacttccttgaatctcttgaatccctctgccttggtgccataacactgcttctcagctgggccacatattagagtcacctatagagcattttccgaactactttccaggccctaccccagatcaattaaagcagaaacctcaggaatgggccctatcactggcactctcttaacctctatgaatctaaggagcagccaaggtgaggaccattcacctcaacaagtgattttcaaacgaagaacgttagcacattagaatcacttggaagcatttaaaaactgctgaggcccgagacccagtttcagaggttaccatttaattggtcttcagtgtagcttggtaaccagaaatttttagaagtgcaccaattatttacaatgtgcagccaaggttgagaacgactcagccagacttgttttatgaacaactaaggaacagaccagtttgtggaaaatcaggtgcattttgaagtttaaattcacgggtctgtgttgagagaaagcagcacactagggtttgcataaggagacagaccctggtaccagccttctttcttctcctgagaggcagccccactgtccagaatatacctgcattgttctgatcttttaatttttctgaagttgtttggatatagcggagacattcgtctctttgatcatatgtgtctctggtcatctggggcaaatggcttgagagagggtcatagatgatccatttatgggccctctaaatcaatagtcttaatgttcaaggtgaaacagctgtacataaaatggcataacatggtgaatatagacagcaacatgcaatctccccttagaactgtaccagaattcttctgttgtcctgacactgcaggccaccaaagccaatctgattttacagacatttcctgttaattgcacttaccgattgatgaaagcattgttcagggaagtagtgatcacacagattgaattcatggaattaattaatgaactctatagaaaggcactttctgacaccttatggtgacctttctgggatgtagtgggattgtttatgtggattaaaaaataaaatagtacagaatggatacgtcaaaaaaatacttaactggtagctgttaactccttttaaatgtcactattattgagaactctgccttgaaacagatgtgaatttgtagtcagaagtaatctaagccaactcttttgaagagggtgagttgtcaaagggagtagtcccttttgttctgaaacttagggatcaagaagagaccaggggtaaaaaataaaataaaaatcaatacacataggttttcaaaaaaaaaaagtgggggagagaaagaatgaagggaaaatgaaaggagagaaagaacggaaagaaaacggaaaggaaaggagaaaaggaaggaaagggtaggagaggaaaagaggaagaaaggaggaaggaaaaagggtagtttaaggttaagtgcagactcaaaaagaatactttcaaggacaccatcatactataaaattctgaaacaatttttaaaaacaagcctagtttcttagagggctgtttctattcatacttgtaggttgcattttaaaagttacctattcgttcagtcacaattttacatctgtttttgtctccaagtggctttcctgatgtctagcacattggacagttccttagggaaaattgcagaaagggaacacaagctagcaatctgttctaggattaggcagtagaaattgggtagagctgccccaccctcctgccatagatatgtgaatgcctagtgcaaagaccttgccgctttggataaatcatgtcgccattcttgcttacggtagcattcttaggagcattctgtaaatagaggttattctaagtgcctgttttgtgcagcccagaatatcatacctgtagttaggaattcccgtgttattgccccttctataagtcaaaggtgagtaagtcaaatattcaaccaaaatatctcctttgttttcagggataaattttattgctcctctaacatagggaatctggggccagatattcatgcggctcaaaaagtctgtgtcaaaaagcccaaaatcttatgttaacttttattgtcttaaggaaagtgataaacttagttgtgacttgttatgtaggagaaaagtactaaaaatattattctcaaagcatgtataacttgtttatattttattggtgtagaaatgactagaatttaactgaatgtgaaattctagggaatattcaaatggcagctctatttatattccagggtgtacctcttgcaacagtaaaactttcttaagatgttttaagaaatgctccatcactagataccttttgaagcactgaaacatttgaacaaaaccaatcatactaagaagaaaaatgcatttatcttggttcttggtgatccataagcataataaaaatctaaccgatgaaaacccagagcccctgtactgctacttttgaggcatttacgaacctagccaacctcattgtgccatttttataatttgactcagacgatcttatttgtagacgaattagtacctctgaattagaacacataatatcgtggaagtgtcacagttggaaacgtcttaagagagttttatcatctttctgggtttactaaaagtaaaatagcattttctattttcattatttttaatactgcatcattaaaaataattagggtttatttcaattgacaagttctcttagctctatgtagcaagctgggtttgatgaggaaattattatccataacacatcaccatataaaattgtcttctgaaatgacagcactttttcttatttttttttgatattataagtctagaattttataatttttctagctagctgtagtataccctatttcttaatcattagtcccattttaaaaagtaatctctttagcatagaaagtcatatgagcacaatttgaaatgctttagccttagaaacatatcctggcatgttttggtaacacatagtattaatatttggtgcaacagcttgtacatagttcgtattctgacattaccatgactttaagaggtccccgcatgcttatttcatgatctttctaaactctgaggtacatcagcacatttcctcgcaacatccattcacacgcagcacccttccctcccctcatctgtacacatcgaagcaattggcagagagcacatttccccctgagcgagcagtattgtgaattttatcttctcttccagaaatcagttcgtcttcgttgcagcagatgaaatttcttgtaacacctctgcaggtaacaaacgttgctacttcttgatgcatccatccaagtctcagtatccttttttttttttttttttcttcttcacatgctgcagttggtcactctagaaagtttagttaagaaaaaaaaaaaagatcttatatctttggagtacagctgaagccttgaggctctgccatataagacgacattaggcattttgctaactttgatgttttatttctggttttaataatacatggtccagaaaagtaagagtatgttgaatgaatccacaagaaaatcttacagtataatcagtgctcttatggtaaaatagggaacaggaagattaggtacacagacgtatgacttccatgttttttgacgtgttatgtctgggttcatagagactgatgtgtgaattatttgggatctttatggaatattagaggctgtaaaagactgaatctataaagcttagaggcattcgagaatataattatctctgtcttataagaaggggatcttcattctattagccaaagatcctctatttcctttcttataaaacatctctcaagtagcaggacttagagagaccaggtcttttggttttgaaaccaggacattggcaaatggaaattgcatagctgcatgatacgtccatcaaaataacacctgtcttttttctttgatgtggttcagaacagttaaatttgtactttgattagtatggagttaattaaatgccaagataggtgaatgccttaacactagatttccttctttttccttttgtcgtttttaagcctaaactatgaccaaaacaatcactaggaagtcttgccaatgtgttgctttcagcctgcgagggaggacgttacaacttatcactacataactgagcatcccatgaccttcagacacatacattaaactgaaccttacaaataaacactcatctgttaccttttatcaatgctgcagtaaaaaaaggcttatgtgccaatgtttcactccctatttactgcctttggtgagaatgaatgaatgaaaggaaggacagagagctaggaacatgcacccaactatctctgttctaaaaggcagggtcagttttatttatatggtcagcctcaaccttcataacgggttaaagtcttacctggtgagttcaagaggtatgcatgatgcatgctgacattttaaaacaatggtatactctttctataaaacctctttgctgatggtcctgcaatttccctcttaacccctagactcgtatctctgcttctcattgtgagaggtggcgacatccttaacactttactaatgcccagtgctaggtgcaatggttaattgaattgctgggagtggcagggaatgttcctgcaatacaaaagttgtttaacattttcagagccttagtggaatggagcatgaaacaaaaggggagaccgcttggaatgggaggtaggggtggggaataatgttaatttaaaatgttcataggcctcatgtatagatgcctcagtgcactagagcttctgccttctgttaacccctgtgcatgttccagtatgttaggttatatttggacatcttagatcaaacatgaaaaagatattgattttgccccgtgacttaaaccctgccttataagcaagtgatccacacacaatatttctaagaaaggcgacagaaaatgaaagtttgcatgcgtgtggtgagtgtttccatctacctaatctagatggctgctcagtaaattcttaatgaattgctattgatcacatttcagattgagagagatatccctagtcctttgatggccattttaatattatgttgcatgcttcataaggttccgtttgaactctgaattttgaatgaagcatgaaaaaggagacacccatatccatcaaatgtcagattatctcccagcaagttcaccttgctcatagagcgaaaatgaaaaatcaaaactgctcagtcaacaaaggttgtaactcgtggtttcagtgaaagccttctagggcatcatctcctacatgctgaaaaaacctgctttgggaggccaaggtgggtggatcatgagggtcaggagtctaagaccagcctggccaacatggtgaaaccccatctctactaaaaatacaaaaattagccgggtgtggtggcacatgcctgtaatcccaactactcaggagactgaggcagagaattgcttgaactggggaggcggaggttgcagtgagcagagactgcgccactgcactccggcctggacgacagagcaagcctccatcaaaaaaaaaaaaaaaaaaaaaaatcctgctgtgcccactacccacattctaaacagcactactgtaatgagctctcacctccttataaaaacatttattagagcaggtgtattgaatcctgctatctactggatatcagagtttgacaaaagacaagttctctatttttaaatggagaaaaaaaaatcaacatgcttaaaatctcagtgtggggtttgatggatgttataactgaaattcttataaagaggtgctattgtcacattgatgcccatggtggatgggctaagcataggcagccatcaggggcttcgggtggagatagtgagatgaaaatcattaagcagtagaacagcagcatttcaggatttgttcttcacgtttcccaaagaaaagcaatgccttttacgtgggtcttgtgtcgagagtgccaacacatctggtctgctttttctagccacatggaataggcatttttcattaacatttgtggtctgtgagactaatttacaaggatatctattttcttacctaggagtttcaacaatgctattagttgtgttgttttgttttggtttttcccaaagaatgtgtgctctgttgggtatcacttgggactaggcttttataacagggcaggacacctcctaatgcatccagcttggacaactgagtaggtcctcattcagtaacatcaagaacctttgatgagttggattcttcaatagatggtgaaaagggagtaaatgattttcccttcttagacgggaggtctccgtctgtgattcattaggaattttccagggtgggctagtgattgtagtagttgcagaagaagggtctggtatgagaatggaggttgaaaagcaagttacttaatcagtgactagaaattcattttagtcgattaatatctctagtcctttgtgggtgtcaggaactgttctaagccctggggacatagcattaaatgagtcaggagaaggtctcatcaaaagaccttcatggtatgggagaacagatcccaaagcacgtatatgaataagcagataatatatatgcatagtaagttatgtacttactgtaatgaatcaaaaagcaggggaggggatggaaagtaaggtgcaatgctattttagactcagccatcagagaaggcctgtctgagggggtaacatttgagcagggatctaaatataaagtgaacgtgtgacccatgaaacatacagcaggtgcagagaccctgtggttgagacatacttgaggtgtccaggagtaagacatccagtgtggcccacggatatgagtacaggtgagtttaatagataacatctaggaggtagacaggggtcagaggaagttaggacttggaggctgcagaacatatttgggattttaacagtgatgcagaggcattggagggagggttgtaatctgactttaatgatcagataagactgctttgtggagaccaaactgccaaagaacagaagaaacagcaccgaagggcaatgggggggcccttacagctgtccagagaggggtgacaatggcttgggttagtggggtggctgtgggtgagaagtggtcatctttaagctgtattttgatgggagaacaaacaggacatactggcagattagaagtgtacaagctcgagtctgttaaatgtccactccccactcttgttctaagggtctatcagttaattccatggagcaccaaggctttaatccctgaggaaagcaaaccctttatccctgtagtaattgtcccttgttgagggctttgctgaactctccaaggtgtaatagtaacttactgtcatttattgagcaaattatgtgtgctagtatgatatacatacatgcatgtatatgtataatgcatgcatatgtatgataaactatatatgcatgtatatatgtatcacagtagttcaacgaggtgttatccccattttggaaagtgaaaaaaacatacactcaggtccagaaacatttagtagcttgcccagtcacactggagtccatctgatgccaaaacccttcccctgggtcacactgcctccacacacacctttttcttcacccttggaactttggccttctcactccagatggaattctaccttccccagtatgctatcttgctcctatgaaactagtattttgagtcggatgacaaagttgttactatttggaagagacccaagggcactgtatgattctttagcagttgttccactggaattttatttaacttggcttgtccccttcaggcagcaggcatatgtttagttccgtgtgctgggagtactggtgtagttgtggggacagagggagcagatgtcaggtcaggaagcatgttgcgtattagggaagagagggttaaacaggccaagtgtgttctaggttaattcaccagacgtctttttgctgaaagttagtggctgaaaaacaattaacaatatgctagtccctgaaaaccccagacaggttgaaacagttgttttagacacagagtccaagagggtgtgtgtgtgtgtgtgtgtgtgtgtgtgtgtataaagggggtaggtggaggctgggactcactagcaggaagatatgccccttccaccatgccaggacccaccatgcattcccttagcaaatctggggacatgttttcatctcagttcctgatgagtatgggacacaaccatgtggggtgagggtagggtctgcaagaaagccttgagcaaatgaacaatctgcaaaagctgttgaaactgttctctgtggggcaggttgctacccaagttaccaattagaagcaagttcaggggtacaaggaggtgtcaccagcgcctttcatttttctatccccacttctcaacctacacatgctgccagctacattaaaactttaggtaatatttaatatttagaagaagtttcccaattggccattcctctaactgatccttcagcaagtctcatctaattgtcttttctgcattttagtgatttgattattcagcaaagttgtcatgcagtaaattgatttgtggctaattggtccatttccaataaagtgtgatatgtattataatagggaaagtacagggagctaaggggccatataagcaaaggaacttaggaaacatactcccacttattgagaaccttctgtatatgaggcatagtctcaggcttgctgcatgcaataacaataccctataaagtgtgtgcaatcaatttgtgaaaattaaagatgtctagatagtctgaattagcctaagtgggaaagtgctgtatccatgcatgcagaattttaaaaaatggaatggtggttatcaaattctagaagaatgcaccaaagtcacctggagaacttgttacaaatgcagagcctgttttgtcgccttcccctgcccctgagattctgattcataagtccggagagggagcctggaaatctgcattctaacaagttgccccagataattgtaatagaaaagacctcacaccttgggacacactaactgatcaatcagggaccttttctctttgagatagggtctctgtcatccaggctggagagttcagtgcaatagcctgatcttagcttcctgtaatcctggacctcctgggatctagcgatcctcccacttcaccctccctagtagctgggagtacaggcaggtgctaccacacccagctgatatcttaattttttgaagaaatggggtcttgttctattgcccaggctgatctcaaactcctggcctcaagccatcctgcccctttggcctaccaaagtcctgcgagtacaggcacgggcccaccacacccagccaacgttttttgtttcaatggtaaaaagagcacacaataggacttgctaaagttgtgttcacatgtggctgtggagcccttgagatgtggccagtccacaccaggatgagttgtaagtaaaaaatgcatgctggatttccaaaacttagtacaaaaatgatgtaaaatatatcaataattgtgagttacacattgtagtgatgacagtttgaatattctggagaaaataaaaatgagttcaccttttttttttactttttaaaatgttactgtaaaatttaaaatgacatatgtcttgcatgtgtggcttttattatgtttctctcaatcccattttagaaccacatttttcatttggctcaaatgaatattgaaagagtttgtgtgtccccaagaactggtcatttggaggtgggggatgttcaccaggagttaaaatgttgtgacagataatctggacattgtcagtgtcttggtattggattttaacgttgcctcctggtgctaggtgggtgtgttggtgctgtagagggacattccttggggttcagggcccagaacctccctacttctcaacctgcttgttttgtcttaatctttgatctgcttgctttgaggatgggagatgccagtacataagactttggatcatcaatccaattcaggggtagctctgacacatgtacccctggggctttaccgggaagctcactgatcccacataaaatagacgagaggcaatagctgcagtcctctcagtcttaataactgtcacttgtttagtccttaactagtaatcataaccctcctctcaccctcactgtagccttgtacgatgaggatgcaccattatcatctccatttatagatggtataaccaactcaaagagaagaactttgagatagcttagcaagaagtaacagtcagtgtttgactctagaaattctgactgagggatccccagctgctgttcaaccctgcttcatggaagggtattgaaaatctcataagggatacaatttgtttttcctcctatggggtaaagtatagctggggtgccatggtgatttcaaagcacaataaaaattcttagtgattttggtagagcaggagtagacaaacaaaggagaaatgaaatttctaagagaaggatggccttgagctctgcattaaagagaatgtgcctacagctccttttttagaggaggtattctagggcaggagaatttcatcaccaaaagtgggacttacttactgtgtcttctctactccgagagtggctgctattctgctttccctcaaatctgctgttgggtttcagaataggaagaggttttcagaataggaagaggttttgaatggcattggtgggctagagaaaagatgatgtgatctgatttgccatgggtaaatggtctgagtcttttagatgccacagtgttggatttgtgtacgtattatgtatgcatagttctgatgtatgacaggtatccatgggcaaaaaaaagcaagttctgtggcttctcatgtagggtctaaaaagctcagatgtgttccctcctacttctcaggggaggcagggaaatcacgaggttgaaaaatgtgctaagtgatttctgaagttaagcgctttaaagacaagctaaggaagtcagcagcaatgaaactcaaacagagccaagtagagatgactccatgttatcttggagcatttcttccacttctagttttatcatttttggagactttgctgcatttttagtcattttgtaggtcaggggtccccaactggacacacagcaggtggtgagcggggtggggggtgagcaacgcttcctgtttgcagccgccccctctcactcacattcctgcctgagctccacctcctgtctgaccagtggcagcattagattctcatgggagcaccaaccctactgtaaactgtgcatgtgaggcatctaggttgcacactccttttgagaatctaatgcctgatgatctgaagtggaacagttttttttcctgaaactattctccacctccctggtctgtggaaaaactgtcttctacaaaactggtccctggtgccaagaaggccagggacttctcctctaggtgtttagggactggtttagttcctccaacttcagtatcttgagaagctttgaggataagtgagcttggtcatccctatggtcaataaatgtataagtcattgctcaaattaaaactaggagaaggctatagtaaccacagaggagtatttccctaaattcactaactgaccaacagatctgaagtccagaactcagttgacccttgtagagtgaaagtgaacaggaacatttcctagataaaccattgctttctgaatttcccaatacatccaagtagttatgttaatgctttcaggagggtttctccctgttgcagcaaaccagggtgcatggcctgaggttctggaaaccctctcaaatctttctgtagggcagaggtggggtggttggcacctgttgtctctccatgtacctgcatagtgcactgagataacttgtcctttccttgaatggctcttctcctgcaagattaaaatcttggccataattaccccaacattttctcaaatggatgcgcactgggattagcccagaccttacaacctgggattctgcgatttgaaaatggagattttggttgtgtggtaaatatttattggcatgaagataagagactgatcatttcagagatatactgaggtgtcctaagctcggaatttttgaaagatcttctgtgaagtcccatattctgggctacatttctttgtcctttgaagtgagcttttgtctccattctgaccccacagaatccccaagaagctgaggggacctctctgcagttgcagaattgccaagagatttgtcagaagccttcagcctctttcagtaggactgtgagatcttactgttttgctgcattttcatttagtgacgagtatgggatggttgagttggaaaacataaatgcccataacagtttatgattgacaacggattcatttatttctagttggatgagagaaggaagtaaagcagtagctggggcagtgctgcagaactcagaagccatgcgccctccccttctggtcttgttctttcttttcctggccaatattggctgtgactcctttccagcccctgagaattgctgaaagccgagcattttgtccaaacacagaacacttggtctggaatgtatgttccagatgcagttcctccggatgggcaaaagcaacaactcattggtaatgataccagcaacaatgcaaaccaaaggattgtcttcaacacatcatttatttttcatttggaaaagtcctcaaaccccaaaaatgagggcaatgaaataggatgaatatctgagtgggatgagaatcacttcttcctgggtgcaggttaccttctgatgtcccccttcttacctggtgccccagagcaccccaaccaggggggtagacagcagaactgctaaatctcatttgaccctatacagggaagtgaaagagaacatccctttagctagaccatggctctctaaagagcatgcttttagaaccactgaaccacagttggtgccctgttgctatgctgtacggtaagtgtgcgacttgcatggattcatttttccaaatacttaagactatgccttagatataaggataaaggaggcactgtagtccctaattgcattgcagagacccgggccattcattgatccctggtgagacatcccattttgaatgcatactctgcagcccttctctgtgttgggaggggtacaagcccatgcattttcttgctgccatttggctgtttaggatgtctttgctaccttctgaacttcatctgagagctgagcagatttcactcatctttctgctccacaggattcacccagctatctctggggtgagaagcatggggagatgatactaatggaagaataaaaagttcccagggcataaacgctcctcatcaaaatagggagtaaaatatagtgaaattaattagtgttcttactgtggccctataagaaaattatgttaaaaccctggtgtggagtaccaacatgggcccattgtatctcattagcatccagcttgtttcaagtaggtgtacatagtacttcttgctaacgtgtctcagtagagttgataaagcactttaacaaacacgggtttatattcccattcaagaggctgcatacttattcattttgctccaacacaaccttaagttcaagtaagtatatccatttgaactacatctgtaactcataaattagatctcaactccaaaagcatctgtaatttgatcggtagagctgcatgtgattatattagaatggaatttttcaattgcctctgcagaccaaaagtctgggcaaggagggagagattggtttgtgaaatacaatctaagaagccatgtatcataatctcctctatctgtaggtggcttaatatttacctggctttcttgaatgcaccttgagttaggtagggctcagtcagaaaactactgctttacaaatgaggaagatgaggctcagagagcatgctctgtccaagtcatgagagcaaggacatcataaaagcagaactcaaacctggatctttttgccccaagtcctgaatctccaagccctcgggttgcttcccagttttaacttgttgctaaaggtcaaaaagatgaggtctcatgatggttgcaagccatggtgaattagccaggaaagcagtcctcttttatatctttgtttagtttttccctgaaggcttttgatgagttttatggcaacttggccagtgttttgcaaactcacagaaatgatgtaaaaagtgtacactatttctagagtccccagaaagttttcttctgtcttgaagcatcctgaatgtgtctgggagcagctgacccagagtcttcaaaaagcgtatctgaatgggatcataattacaggcatgagtgtctctcccaggccccatttctctctttactcctttgtcttgctgcctcctctctacctgcactgttctagacagtggggatgcaatggcagacaaaatagacactgccccagcctccatggagttctcgttccaggagggtgaaaggtaaatgatcaggtggagtgggaaataagattattagagttgctatacaacatgaaggggtagggatgaagttggaaagtgcccttaaaaataagagcagtcaggctgggtgtggtagctcatgtttgtaatcctagcactttgggaggccaaggcaggcagatcacttgaggttatgagtttgagaccagcctgggcaacatggtgaaatgttgtctacaaaatgcaaaatttagccacgtatggtgatgggcgcctgtaatcccagcaactggggaggctgaggcagaatcgcttgaacccagaaggcagaggttagagtgagccgagatcatgtcactgcactccagccgaggtgacagagcaagactctgtctcaaaagaaaaaaaaaaaaaaaaggcagagagccagagaaagaagcatctcttcatctctctagggaagggacatttgatttgaaacataaaagatgaaagtcaggtggagggtgagcaagtgccaagactaagcagagaatggatttgcatgtgtgcaggaacgatcaagaaagcctgtgtgggccgggcatggtggctcatgcgtgtaatcccagcactttgggaggccgaggcaggaggatcacgaggtcaggagatcaaaaccatcgtggctaacacagtgaagccccatatctactaaaaatagaaaaattagctgggtgtggtggcaggtacctgtagtcccagctattcgggaggctgaggcaggagaatggcatgaacttgagggacggagcttgcagtgagccaagattgtgccactgcactccagccttagcaacagagcaagaccaactcaaaaaaatattaaattttttaaaaatcctatgtgcctggagcacagtaaccaagggaaggaagatgaagattgaaagagggacagaggcagcttattcaagtttggattttattctaggatcaatggaaaactattgaagggttttaagcggggagtcataggattagatttatatttaagtggagagatggacagacttgagagatttgatacatgtaaatagctgctggtttgaaggagcaagagttgaaaaaatgagacaagatttatggctgttgagttggtgttgatgaactagtggcatatattagtgtagtcatcatgtgcatggagtaaagtggacacattgaagatttcttccgaaattactgatggatgggaagtgggcacatggagatcatcatgatctgactgcactactgcccactttggccagggatgcatggtgtggaggatgaccatatagctggtcgtgtcctaacatggcgaccgtaagacctcttcccatcattcctgtggacatcctgggtattgctgtgctctgtctccgggctgtgcttagccagctctgaggacatcagattgctgacgtgcttggcatatctgctgcaaacgtagcactcaagtccacatcttccccaataaccttgtgactaaattgtagtgtcacacaagggcgtgttcagaaattagcatttgaaaagaagcctccttgctttcagtttgagctgacatgatctcttttcctctggggaaatgaaatttattaatcataataaaaccattggattctgaaggtagaggtcaccctgaagagaaaaggaggcagctcatttctgaggagtagttcaatgctgctgtattttccttctgccttggaagagaatactgccaaattgttaccttgggttttccacaaaggttgaaactatgcccagcgttatagaatttaccactgaagtatgcagtaggaaaaggtgggagctacgcttttattaaatacattcaaattgcccatatagtgtctccccagaagaggaaattattgccacagtaaaaccatttccccaatttttaaaataatatatctgaatttgcatcttttcacatttgttttgaggtaacaccttgccataacatcacttaacaaactctcaaggatttcagtttgcctctgcacttcatatcctatttatgaaacagctttgccaaatttaagtaccttaaaaataaccctattaacagatttttctctggaccaatcaatcacagacttcattccctcatgaaataaagagcagtaccaaggttatagttttccttttatgcctgttactatgtacttctagttaagtgggtaaaggcccaggtctcaggagtgagctctctgaatatattattattttatcaaaaactttttaacacatctgcccttggaccgatacctgtttttcctcccagaaagaaggataatcgttgattaaaggccatttttgataagaaggactgaagggtgtccccaaagaatgaaaggcaagagggagatgactgtcagtttcactgacagattcacctcagaagagaggcatcccttcaggtccttgtttgaggatcaggagaatcctcttgaagctgaaagcctcatctagattatttgcactcatcaagtgccctttgacacaggcagatgggcttgagagttggaagatgcccagtgcaaacctggtataatcaattgttttattccacctagggtctaacttggagtctgagaaggtccatcatcacgctttcttcaccttctcagactccatggtgtgaggtggtcaaacatgtattggattggtatcacttatctaccaaccatgagaaagcttggaaggaaaatggggggaaaacaggaaaggagagggaaaaggtacgtgcaaattgggctctaagggatgagagacgagctgaaggttgataatacagacaaaccatttcttccaccagccttgttccttcattcaggaaatggtcaaagaatcaaaaaacgatgtcgatcccagtgagtgtctgatgcattcatgccgagctgctgtgaatgttggttgctaacagtacagctgttcccttctccagaaaattgccccatgtcagaggaagccactttaactcaatggtgcatcactcactcctcaggaaagcccacagctaatgccgaaaacttatgtaggcattaaaaagccaacccacttgcctctaggtggaacctgctgtagcatgaaacccataggatcaggtcgcagatattcatctcagacgttgcgttttttttccccttgctctgacctacttgcccctctcttcctcttgaggacaccccattcggtaagtcacttgcacaggaatctattccagtatcagctttcaaggaaggacgtcagcttcagtcagtattaagatagcagcattcaaactatctccaggaaaatatctggcagggcaaacaagtatgggcacaggatacggtggaccaagcacgcaagttgccctaagagattcaagtatcaggctgagtgcagtgactcacgcctgtaatcctaacactgagaggctgaggctggtagactacttgaaccctggagttttgaaccaacctgagtaacatagcaagactttgtctcccccctcataaaaaatcaagatctgccctgtctagttatgcgaccttgagcaagtgacttcacttgattcctttaaaaaaaaaagttaacttccagatatttagtaggcattcagcacgtttggtttccatctcttctccatttttatcctaaagcctataccagaagccatggcaggtagtaggatggtagagagaaaaacacaaagatgagtaaatgtcattaagatttgttgtttcaaatgcctcccccttcccagaacctggccatggattaatgtgacagaagttctggaataataggatcaaaaccaaatcagtctgattgaatgggaatgggaatgggggtcccacagaccctttaaggctgcttccattcaaatatacttgttcctttccattctaagatgctggacactaacttcagacaggttcacttcaccctttctgattcaccctatttcacttgaatggtgacagctgaatcaggagaaaaaggcactctcttgagaattaaaataccctctgtgggtgctgggcttaatacttgaagttgtttctttcttacctacctcagtctctaaggcagctacttgagcagtgtagaaacagtattatggggggaggcagggaaaagcatatgtaagtacgtgtgtatatatgtatttatctgtcaaacatagcaatagcaaccatgttaaatgcacaaaaaatgtatcatgtacagatgaactcttcttatactacacagcagagtagaatttgcttctcactggaagatgagtagggcccctgcatactgtcttggtattttggattttatgattgttattgttttgtaattgcatactgtggatcaatcttcacctctattttcctttcagttacggacgagtttatgctgccgacccctaccaccacgcacttgctccagcccccacctacggcgttggtgccatggtgagtacaagtttctccttgtcctcactttctcctgcctcccttccctttccccagctgggacctcagtacgggttgacgtcctctcacttcccgttaattgaatttgtctcttgtgctaacagcagctaaaatgccacattaatcctcccagtaaacttgataaatgtcttaatttcttggcaatgtagtgcatgtaagttattatatttctaattttgcaagtctcacctagcagagcacttaccttaatggaataattagtcattttgataattaaatccatcactaacagaatgcagtgtcaatgcagaacttttttttttctttttttttccctcccttgctgctcattcacatagccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggtaagggtggggtgaacttgcctgtacttgttcaaacttctatgcactgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaactcccttctcaagatcagattccatacagcttacagagccaagttaagtaagaagtaggttgagattttcatcccaattctgcattcaacaactctgcttcaacacctagtccacatgaggaatgtgttggagagttgaattacattcaacaactggtccaaattcaacctcaagtgcagattattctgttataaaaaaatgagacagtgaaaatccttccattgtccagcttataatagagtccttttagctaagaggactggctgacagaatttggttttgcagggaatttctttaggaggagctattggggaaggtcaggaatggccctatctttagttctccaagaatgacctgggatgggtagggggtgcctccatttcggttggttttgagtgtctatttttcacattagtctttttgatgatccacatgttgcaaaaggaaaatgtaaaaaacacacccctcaaattgctttgtttcagaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 348 - DNA, 380590 bp, Homo sapiens
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcaggtaattcaaggcctctgccagccagcaacttaactccagagtgctcagagtaataattggaatttttatggttgagaaagcaaacacttttaatacaggaaaaagccctcgcgtagtcagtgagaagacagtaggaaatcaaaaagatggatcaccctaatctagctatcgacatctctcatggctgaataaatggtgtagttgagctatatttgcttgtattgatctgactgctatttaacattcatgtcttagcttcaggaggttgaccacggggcaaaggatttgctctccttctcagctttctgagggactcagtctcccagagcagatcatgagacaaagtaacttatcatgaggtgactcagttaagagctttaacccaggaaatgaaaggagcatgaaatatgcattaattcataggacgcctccacacggattgtctattttcagagaaggctctccccacctgaatttgagtggtggcactgaggcaagaaggaacactctattgatgggtaatttatgaagctcagagattattctaggaatcccttgccagatgtgtacatcttaatgatggcaagaaagtggagggttgatatgtgtgctggttttactttgaagtcttttaattctgtgcagagaggattaatctaccaataaacaattggggacctttttttttccccctcatcataaggttttctttgcaagcaggtattgccttccgcgtttatgtctgaagttctccgttgaaagctaacatctactagcgatagaacccacagatcatagaaatccaaggtggctttttgttgttataattagttttttgagtataatcatccctttgcaataaattctgtatctcctttctacagaaaaggaaaacaaaatatatttaggtacgtcctttcacctttactcctgtgcctccctctgtcccctccagcccctcatagttaaaaactatatgataccctagctcattaattacaatttctgggaaccattctggtcacttttccccctacctcttctgaactttgctgttaccttttgttaagtgtacgaacctgggtgattagagtcatctgggggtgattccaagtcacaacaaaacattctctctttctggatttatggccgttcctctgtttggaagcttttctctgtattacctgttataaacaaatgggtcatctggagaacggtcctttgcagcgtggaacttgttgcgtcttccctggtatacacaggccggtatgataaggttgccatttctgaagtagggctcagtggcaacttagaaagttaacaggcctgttgctgctactggaaacgtggggtgaaggtcggctgttggagctttgtcagaccctctgccgacccatctgataaataattacaggcaaatcgtggccttcactctatgctgattgatgctgaaattgcttttgaaagttctcataagttcctgttatagattaagtgccggtgtaggaaaaataacggcacccactgaaatgggtgaatgtaatcaggtttaatggactccagagcttgttgggaattaaataactatcgatttgttggaatgttgctgtcattacgaaatgccactctggacgtattaccccagtgatagatgagaagatgcaagggccagctgagaaattggggaggccctatttcttcctcctttgcagagcatttgagaaacatagccagttatttttggaaagaacaagtggtcttacttgtaaatcttagcctgatcatactgtgtttttccaagcgacacctctggtaactagttacccataagttaggagagcagtttagtgaggagcctctagaccagctgctgtgatatgtgttatctcctttctttctcactgctgtggaatgcactggaaagctaacacacagagagaaactggctttacttatggtttgctgagacagcccatgttatttaccctttggcatcaagtagctaaaatcaccccagtgcagtaatatttgcaaggggagaaagggcagtgcaaagggagaaaaaactgtatcactcacagatgctcagctctgagccgatgtttctgctgccagctgtcctgcattgctgcagactccacttgctcactagtttcttgaccttatgggtttcttcctcactcaggaggcaaagtatttcctctagggaattaaggttctatcaccacctaaatatgtcattggcaagatgttaaaatgagccaaaataaaccatgtgtactccatcactgggagtaatttctctgtgactggagatgttgaaacagagttcatagtgtccacttggaaggattgttgtattatagttggagattacttttcaaggtctttccaacctcaagagattttgtggcagagtgctcccttttcatattttcaagagtcattttgaaaattcagaccagcatcgccctgttttagttgcctcagataaagaaaaaaaaaaaaaaaaaaaaaaaaaccaagtgatttaccagtcatttggtgtgccagactttaagacggcatccacctaatcctgcaaaggcagtggatggaggtatttactgatagcttcaggaaagttactcatacaggatcttttattccaagcaataattgatagttatcatctgccctacccttcctcctttaggaaaatcagaatctttatcatattggatctcctgaacccattattttatgtctacacttgttgtgtgtagccaaatagagagtttttccctccagccaggtagagaatgacagaatgactatggagaattcagctgaacctgtctggactgtctcatgtgcagaaaaagcagagaggaaaggataagagtagtattcccaagtgcattgtacaaatattggctgctttcccccttgatagagatcccgatgttgatatctttggataagaagaaccaatgtactacttaacactacttatttctgaatttctagtgatgccttgaatgatcagtgaattgtctgacctggtaacacaggagcctcagtcacttgcccaagtcagcctcgagtccagaagctactcagaggtcttagccaagccatggaccatggccaaatgacataaccaaaacaacagctttgtaactggttaggctatttggttagtgtttgggtctaatgtgttggctctgggctgcaagtgtggaccctcacccctcaatctaggtatctacctcatagatatgcccttgggccatacatggccaagtcactttcactattggacaaatcgttcccatttcatccaggtctgacagatgatgagtcagcagattattttcctggatggttgatggtgtaaatagagccatattcacctcatcatgcatttgttccttcagttatccattcactgtatactcaacctataacaaaagtgacagtcatagccactgaactgtgggttcacaatctagtggaagaactagtaggtaaaccccaactataagactataatgaagtcagagggaggaaatgataggtaatgattgttgaacacaatattgtcatgtgccaggctctgtgctaaacacttagatttaggatctcaatttatttttataataaacgtaatgcaattgggcagtatttgtccaccttcctatatctgtaattgtaaattccaaaaagctctgaaaatcaatttcttttggaagttgggcaccaaagctcatttaggaacagaaacttgacctgaaatgatgtgtagctatttatagactttctttatcccagctaatgtaaatattcatgtattttgctgtaggaatatttatgtgtttgattttcagggtgttgtcctagaccctgctgagggctttacataatcagcatttccactgaaataactttctgaaaaagcccccaaaatctgattttcaaaatgctggtgactccaacgggtcttaggtaagaaattgcagtcatgcctttaattcccctttgcctatggagaacctaaaacctacacttagacaaagctaggtagcccaaggtcacaaagaatgcgagtggtatagctgggatttggactggatttgttgaaccagggtcttttatccaccaagctaccctctaggttgaggtattcaggcagggtggcttatgaaaacacaggaaaggaagtaacccagtgcctcttagagtcgggaagagggtggtttcaaaggaagggaactggtatttgagttgggc[450 bp omitted]agtaactgggattacaggcacgtgccaccacacccagctaatttttatatttttagtagagacagggtttcaccatgttggttaggctcatcttgaactcttgacctcatgatctgcccgccttggcctcccagagtactgggattacaggcatgagccaccatgcccagcctagggctggtgaatgtttaattttctgggtttgtgcatcatttaccattcctttctcttttaaagtattattttatttttgtaagttccagggtacatgtgcagggtgtgcaggtttgttacataggtaaaggagtgccatggttgtttgctgcacctattaacccatcaccgatgtatttagcccagggtgcattaactgttttccctaatgctctccccacccccacctaagcatggcaattatcatttaccgtttctatgccttcttttctctctgagatggtaagctctcagagggctgagatttttccagcctaaactttctatagctagacagtggcagaaaaatgccaatgtatgcctctctgacgtggatagcaatggtttaaagaaaccctatactccatgtttttatttttatttcttttagagaaagggtctcactctgtcactcagactggagtgcagtggtgcaatcatagctcactgtagcctcgaactcctggtctcaagtaatcctcagcctcctgagtagctggaactacagacatgtaccactatgctcagcttttttaaaaaaaattcttttgtagagatgaggtctcattatgttggccagcctggtctcaaactcctggtctcagacacacacactgtattttgaagcagaaaccagcgtatgtattttatgagacatctacatacctatatgtagtaacaatgcaaattatagaaacatcggccttaacaatggacagagagtaaccatccttatagaaagataaagaaatctataaagaacttacaagtaatttgggtaagtttctggttgaacttgaaaaacaacagcttgtttggctctgtggctggcatttcaggtcttgatattgctgccctgcgattttatctccatgtttggaatgtctgttgattgggaaagacatcagcatgcacacctgatataaatgctggtggcgtcatttactctgaggctgctccatcttagtcactaagcggacttttctgtactgccaaagaggccatgtcaacagcggactaaattaaagagtcagggaggtggcagagagaatttggagtcaaacaggtccaggttgatatataggctctggcatttactaagcctgtggcctgaggcttgtcaattaacctcaccaagcctcagttttctaggctgcaaaacaaaagcaggaaggcctagcttgcaaagtcactgtgagttttcagtgtgattcatcatgtgtttattcagcaattatctattgagcacctactgtgtgccaggctgtgaactaggactaggtgatgtggtagaatagaacacactctagatctcttccaacaggaagttgatattctaacacatgggaaaagctagcatataaagtatgtttattctgtattattctggagagagaaggagagaggaaagatatttatgtattattattattttgtgacggaatcttgctctgtagcccaggctgtagtgcagtggcatgatctcagctcactgcacctccacctgccaagttcaagtgattctcctgcttcagcctcctgagtatctgggaccgtgggcatgcaccaccacaaccagcttatttttgtatttttagtaaagacagggtttcaccatgttggctgggctggtcttgaactcctgacctcaggtgatccgcccacttcagcctcccaaaatgctgggattacaggtgcaagccactgtgcctggccagaaagatatttgttaagaattcttttgtctgcgatgaagaaaattctaagtcctattggttaaagggggaaaaaaagcatctagctccagcttcaggcactattgaattcaggaattttgacaagccaagggctgtcactctccacctctccacagtggttatctctacttgatcctcactcacaagcacaccatgtccaagtggtggaaaagatggttcttggcaactccaagcttacatctcatctccttttagaaattctcttcccaactattccagcaagaattccagattgcagtctcattggtagatcttatagtccatgcacatctccaaatcaatcatctaatctctggttgcccactttagagccagagggcagggtcagccccaagaaagctgcatagactatgaacggaggccagatcagggacctcttaccaaaatgtgttggtggataagcaaaatctaggttcttgttatcaacaacaattatagttaaagctgtcacagacattcaaacctgtgctttctcccccataactttgcacacaccatcccctggggagcaagtggtgggtttcagatcttaattatcctgatcacttgttgccattgatcatatttactaggtagttttattgccttccacttcacttggcttctccattcatgatcagatttgccaaaggcagggatggctgttttacctggtatcttctccgttgcactaattacagtcatgtcttccactcgtgtatttgggatattccaactctttttacagactagtaagtcacaacctagggaagtcaagacagtccaaccaggacatccaacaacacaataatcagtgcaagattgtgtttctcagattcatgatccatgcagccacaccacttctcttcacatcagtgatgcataaataaatatattaaaaagagcaaacagagccttccagttattaactttgtcatgacgtagacctcccatcattccaaagcactcgaagatgctagtgacttgtcctattctgttttatataaattcacttttttaaattaagagattaaagggacactgtcaatctcttctgattaatatcagtcctataaaaagggtgtcttgctgcagcagccatctgtcattttgatcattttaaaggcatgctatatcagcaactatgctttttataatacgttggcacagggcagggagggttggaagacctacggatttcacactctctgctgctgctttggtgttcggcaatgtgagcttttgatggtggagcagagtcccctccctgtcttttaaaggttgttttgggtaagtgcttttcctgggtgatttatgatggagatactcacccctatttatgtttttcccccgtctaaagatagacctctcacacacacatcccaccagcttgcaaggagccagcatgttcacttgattcactgctgagccctaagagatgcccagaaacattgaactcaatactctgaaggtcttttcctctgagcaaccgagaccattatcttcagcaatggtcactgtctagattgagcttttcaggcttgtaaaactaggaggcaaaggctccatgaaactcattcatttattaagataatgatttatcaatcatagatttcgtgactgttgtcttgcaagctctggaggtattgggatgatcaagtcccagtctccgtcctcagaggttgcgtaggggggccatgccattcgcagtagagtcagaggttaagcacaactgtttgaagatagaactcttgagtctccaccccactgaccgactcagtatgacgtcttcattgctgtcagtggtctgacactcaagacaggtttatgcacagtccaaagaagatggcttcctacagagagatactccaaatgacagagttcctgctacatttcagagaacaatggtcctaccttccttccttccttccttccttccctccctccctccctccttccctccctccctccctccttccctccttccctccctccctccttccttccttccttccttccttccttccttccttccttccttccttcctttttgaggtgggaagatgacagcaggagctcctgcccccggcccccttcccaccttgcatccaacttagactaaagtaatagagttcaacacacccactgctgtgggagaaggtgttgcttggccattccttctcttctgctctttaatctgtattggctcctggaggaggggagaattgcagtgaggagggggatcacttgttcattccacattgttctcaggaactgctctctgaagacctatttcttcttatttcctgaggcagcacagttaaatttgaaaagaacaggatttacaacaaggaaacctgagtctggccattactctctctgtgttactcttggtaagttgcttgacctctctgaacctccacttcctcatctgtaaaatgggagtaataccaagtgtactctactcacaaggcctttgcagtgtagtcatggtgtcattagggcagcaagacaggatgcctagggctgggcttccaactcagatcttcccactcagacgcatctgagttggcatcctggctcctgtgtgatgcggggcttcagctctctgagcacccatggtttcaacctgtctgcggggatggtcacatcgactgcagaagggagcaatccgatttgacaatcagctcattgtaccaacgccacaactgattgccagcagtgttgtcttggtttgttcatgatttctggagttattgaatgttcattttgataaatcgagatgctctaggttgggaaaggagaatgtttacacttctctgctcccattcttggtggagattcctggtgagcaaggacacatgtgtttggcctgcgtggacagtgcagagatacaactggggaggtggcgaaggagagggagagatgccaccatggagtttgacatcttggctcatggctctgggtggtgtgaaaccaccatcctctttccacatggctggtataaaagccaccatcctcttcccactccctaagccaatagcctgcatagttggaatgactaagtcccagcctctgtcctcagaggttgcatcagggggccatgtcattctcagtagagtcggaagttaattacaagaaacacgtgaaggagagttgatcagtttcaataatgttgaatccttgcccaaatctttgtccagaacatgctgggactggaactggagctgggttgcaggacggggagggtggactttgtagggggaagagaggcctgtcccctccgttccatgtggccatagccttctggggacagactctttaggaccacccacacccctgttccatgcagctctggcacaccgtgggcgcttaataaatgttaaataataagaatagctcccatctgtcagtgcccggtggcaaggaggatgtgtgagtgccagccgtcactgggcagcttatgggaagcctttcggggggaaattgtagctctgagtcgcttcgaagtcccgctgcatccagatgttcccccaaagctgctatggatcagtgtccaggcaagggaggagcatgggactccagaacatctgcatcagagtgacagggggcgggaccagagagatgagaatctgaccagcagtgggatttgggagctggtattgaccaacagtacaagggctttgttgaggtttaaaagggctagaggagctgccctctgagcacacagcagcataaattcatacttccgtcatattcttggaagcaaatgccaactgggacttttcagattttgttataataacaacagcagctgctgtttttaggcatttactatatatgaggctgtgtgtgaggggtttcacttgtcgtacctaattgaagtaatatatcttagggaggaaaaaacaggcaaacaggaggtggtatggagtagggtgtgagctctagagcagactgcctggttcatctgctgcaaccattgaggcctccacctctgggaccttggatgccatttgctacctgtgtgaccttggcacagtttttcccttctgggcagtagtcaccctctttgagtggttgttaaaggaaccaaatcatgtaaagtccacaatatagcacctggcacatagaaagtcctcaataaatgtatttacaagtttatttccaagcgtaaagcaataccaccacaaccaacaccaatgcaattaaataatagcctcaatcttgagtgttttctatatagggaagccaataccttctactggctaagagtatgagcccttgagccagactgcctgggttagaatctcagctttactttttttttttttttttttttttttaactcctaagctactctgaactgcagttttctcttcggtaaaatggcccatattaaaagtgcctaaattcaagcttcgctgtactcttctgtaggacagggataataccaaagtcatttctgaggatcaaatcaattaatactccctaagtacttaaaatagtaaatccaatatagtcagggctaaaaaaaactgatagaaataataattgttacatgattattttatattttatattatttgtattatgcattattcataagatataatgcaatatatatttcaataatatatgcaataatatgtattttatgtaacacatagttataaatatataaatatataactacataatgccatatagttataggataattatatataatgattagatgacacatatcattgtgtaatactgtataatagttacatagtaatgattatatgtaatataaatgataataataattattatttctactcttgctactatgacaagttactccattggggattttttcctaaataatttctaccactttgaagcattctggccagacttattttaaaaggaaactgaggctcagcaaagtggaacaatttgccctcattcttaggactggggaagggcagaccagccaggtgtctggctgcagagcccgtcctcccgcagaccacacaattctgcaaagctttggtgtctgtcgtctccccatcctccatggggaaatggccatgtctcttgcccgtacaaccgactctgagcagaaggctaatgcgatattgtgccgctgtcatttctgatcagtttttcccccactgtctcacagcgggctgtcaggaggccttgttccccatggaagcctggctcctcgtggagaagatcaaacctggaggttgtgtggtgacaaaggctgaggaagggcactgctgggactgggtcttgtggctctattttcaagacctttatttttggttatcagtgttgaaacctggaaatacactttctgttttccgtttaaacacaaatcaagcaacgttaccaacacacattctctgtcaaacatgtcagttactcccggggctgtggacagcttgcaagcgatgtcttctattgttactgtggtggtgtgttatttctccctctacagctctgcatttgttttggcgagcagtgtaaacactgaggggcctgctctcggggaggttttgacagaacatgtgaaattgacatggaccgtccgatgaccatcttaataaggctgttcgggcagccctgtatttgcctgtagcattttccatgaattttggtgggggcttaaggattctaatgagctgggttttgtttcacacctggtgttttggcagacagttcccactgtgacttagcagagggacttggcacggcttgccagagggcctaagatttgtgtgggcgcccagcagatgttggatgtgttcacccatcatacagaacgccagtcatcagccgccgagtcccctctctgtctacattgtaagggaccagagctcccacttgctgccggtgatggagccgtctggggatggataaaaagcctttcattactgaggataatgcagagcatatgggattcttatctgtccaaacagttgtgggatttgggttagagacgccgtctgcatgtgtattttctttttctttttttaattttaattttttgtttttatttttattatactttaagttctagggtacatgtgcacaacgtgcaggtttgttacatacatatacatgtgccatgttggtgtgctgcacccattaactcgtcatttacattaggtatatctcctaatgctatccctcccagctcctccaaccccacaacaggccccggtgtgtgatgttccccttcctgtgtccaagtgttctcattgttcaattcccacctgtgagtgagaacatgcggtgtttggttttttgtccttgcgatagtttgctgagaatgatggtttctagcttcatccgtgtccctacaaaggacatgaactcatccttttttatggatgcatagtattccatggtgtatatgtgcgacattttcttaatccagtctgtcattgatggacatttggtttggttccaagcaatgcccctgggccacatgggacacacacaccatgatgtgtcagcaacgagacgtctatagagtaaaccacgatggcagaggagcattctacccaagagggcagtgtattttctttagtatttggttctagcaagtaggagcttcattaaggagcattttgtacagttccttcctgggaatggacacgacacgcgtttgataatgtctctgctttctggcttcacaccttcctcccatgttagcattggttctaaactcccaagcacagatgttaccaagccactgccctcctgtgtagaatgctcctctgccatcctggtttactctatagaagtctcgttgctgacacatcatggtgtgtgtcccatgtggcccacgggcattgcttcgttcaagcctttgtgttcagatctgccctgttatcagagacaagttgatgtcaacttacctcttatctctgatcaataactgttgggcttcctgtgggttgactgaagacccataagattcatgagacccatacgatcatgtgggttgatgatctccaccattctgaatctcaagaaaccaaagatgattcttgaatgtgtgtttttgttaagatccctttggctgaaggaacagaactcaatcctgtctagcttcaaaaaaaacgagaggggcagcatttatatgtttactgtgttttgaggtgtagtgcatgaacaattgaatgcacagaaactcttggactcaaaagagaaagaaaaaagtcaagccaaggaaagcacaagaggtaagacaggcctagtgatctcagcaggcagaatttatggacatattttgcaggcaagtggttctcaatcaggggtgatttttggcttgtaaggacatttagcaatatctggacacattttttggttgtcgtaagtggatgggggttgctgctatcatcctacaatgcataggtgcattagtctgttttcatgctgctgataaagacataccggagactgggcaatttgcaaatgagagaggcttattgggcttacagttccaggtggctggggagccctcacaatcatgttggaaggtaaaagacatgtttcacatggatgacagcaggcaaagagagctcgtgcagggaaactcttgtttttaaaatcatcaggtttcatgagacttgttcattatcaggagaacagcacaggaaagacccgccccccaaattcagtcatttcccaccaggttcctgtcatgacacgtgggaatcgtgggagatacaattcaagatgagacttgggtgaggacacagccaaacgatatcaagtggacacctggaattatcgagcattatccagaattatcagtcacgccgagattgaaaaaccccactctaggctgtcacactactgtgactcagctacagagactatcagtctctgcaagtcttcattcaacttttgctttctcagctaggatctgatggacccaacctatcgtatgtctcaatctttatatcagtgaactatgcccgagacccccatgtatttgcagcccgttcaaagtattgctgagtagtcctgggaaagcaggagtaggatgtagctggttgtgagctgttagccattccgagacaggcgtcttgcagggtgtattgatagccttcagtgcaccctatcctgtggctgacactcattcatgctagtgccttccatgcagagctgtctgtttgtagaaagcaaggcccaccttggtgccagtcttaacgagcagtcaattgatttggttttcgatttaagctcgttgcctcctttgacttctgtttaacagaaaattcactttgcaaaactgttttaaaacattgttgcttacttttcttaccataaaattaatgtgggctaaacctaagttttcagaaacaaaaagcacaaacaaacatacagagatatatgcatataccacatagatacataaaccacaatccgctacccaaaaatgcctactacaaaccactctttatgtatcctggatttctttgtggtacatatattttcttccctaaataattcttatctactctcatcgtattcacaaagatttgtaaaacttgcaagcagctgggtttttaataggaacaccttttgaaataaaattaatgaattttttttttttacctcatgaatattttctgttaggtttttaagactaaggtgatgtcttaaacaaacacatattccgtgtcctttccacatgcccctttgctcttatccctctccttcagcccatggcaaggtcgtatatgatatcctaagtaaatagatcaccaaagaaatgacattactttagtcagttgggaaaagaagatagggacaaagaagagaaagtagcaaaacaatcctatagattacagaattacacaaaaggccggttgccgtggctcacgcctagaatcccagcactttgggaggctgaggatggcagatcacctgaggtcaggagttcaagaccaccctggccaacatgatgaaacttcatctctactaaaaatgccaaaattagccaggggtggtggcacgtgcttgtaatcccagccccttgggaggctcaggcaggagaatcccttgaacccaggaggcggaggtttcagtgagccaagattacgccactgcactccagcctgggtgacacagcgagactccacctcaaagaaaaaaagaatgaagagagaggcagagattgatcggctccagtcaaccgggtgagtaggaggcttctgctttcagattttcttgtaaatttcttgaaatggggacattgaaaaatgtgctagttttggagaaaataaaaatttcatgaccacgatggaggtgtggttgctcctatggttctcagaacacaaaaccatctcctagagacccactgaagttcatgctcattttaggactaaaacttgggttaaaaatcaggcggctcaagagatcaagatatcttcctggcagccttctatcacaagtggagactgggagaccaaccagacttgccttgtcagctctcatcactccttctctcaaaccaaacgcatgtctaaggcgcaagatcggttttcaatttaagtgacttcgctttctctcttaaaaactaaatcctcctcctaattcccctaagtcctcaaagtataacatttttcctttgtagattggagaaagaagtcatggatcgggcttgccaatggcattaggatgaggtctgccagccagtccttgtcagaatgtgcacagaaaatttaaaagacttttttttttccaatcagtagcttaccagttaatactcctccctttccgttttgatagctgaccctcagaatcaaaatgaggatggcgacataccacatccgcttgagaggctgaggagggttgggttcagaaagacggatggctgtggcttgctttccatatgtgttcaccgatttagtaaatatttattcaacattcagtgtgtgctagacaatacagttccaggtgtgagtaagaccacttatatcctattaacaggaaaaaataaagcagaaaataaccaggagaatatcagatgctgttagctgctaggaaggaaataaaataggttatgggccaggcacggtggctcatgcttgtaatcccaacactttgggaggccgaggtgggtggatcacttgaggtcaggagttcgagaccagcctgggcaacatggtgaaacctcatttctactgaaacatacaaaaattagctggcatgatggcgcatgcctgtagtttcagttccttgggtggctgaggtgggagaatcacttgaacttgggaggcagaggttgcagtgagccgagatcaggccactgtactccagcttgggcgacagagccaaattccatctaaaaaatttaaaaaaaaaatggttacatggtagtgactgaaagggttattttagatagttgaaacaggaattagagctcagatctgattgacaagtaggtgccagctgtgtacagtcgtggggtatgggaaagaggtctaaggggaggaaaaaagcaaaagtcctgagatggaatgaaatgggtatgtttgagaaatgaccggatggtcagtatggctgtgacacagtgggtaaagagggaggatgaaaaacacaaagtcaggtgtgcaatcagcagccaggtcccattccaccttgtagggcattgcaggcagtttagattttgatctaggggaaatggcaaacccctgcagaatttcaagtaggagaacactatgatctgattgtatcatgttaaaagattcctctggaaagtgggaggaggatggacaaataatctttagtgggacaagatgcaaaacagacaggacagctagtatgcatggtactggtgaagacgaccagtaccatgttatccacgattggctagtgaatatccatatttcatgctgccatttctttgatcttcattgaccggagaattctgccctaaaaagagggcccgtttcagggatgtggggtaacagaaaaatcacagtgttaatggaatgagaggtagaggaccagggagtatagaaatgtatctgtgtctgtgcctgaaggtctggtattttgtgtggcttcaggggactgtagtatgtgtgtttaattgttaatgacccaagaatgcatccaaaggggttacatgcaaacctgcctgagcatggaagatcagtcttgagtgctttattaagtctggctctatcaaagctgtaagcaacatatggtgtgccatgtgcccatggactaggttttccatcacaggacagttctgtcttcgggatggctggttttccttttattttagcagaagtagagaaggccccttgggactggatctctcacttttgcaagttatgaccacaggggacaacttgggagtttggattcagatggaccgaggttccagagccagcctcactcactgttagctgtgatcttgaacaggttcttttacctctctgagcctcagttcattcgtacctaaaatagagggaaacttttctatgtcaaagggtagtagaaaggttattacgcattgactggttagttcattcctttgataattctttagacatgtattaatcaccactacgtgcaaggcacgatggcaaacattaggaacgcaatgaagtcagctttgattctttttttagtggaatttatgttcttgtaggggaaggagacaaaacaaagaataactaccataatgtatatataaactgattaattttagattgaagtgagtgctatgaagaaaataatgtaagagggaagaaacagttaatgatggtgcggtggatcatgatactctgctcttgagctcacatcctttattgtcttgaaatttttcacccattagctcacttgttctctttttttcgcttcctgggtttgccttagagacacctggtactttactctcccatgccctaaatacccatgtccacagggagcagctgacttactgtggtacaaggaatgtgcttttccagattttaggagccacctgtttctgggagtgccatggaaacacacattctgcctctcaatcttcaggcccaggcaggaaattttcagctgtcagcagctgtctttctgatctgctgccaaggagtttccaaccccaaccccaggaaaagcccacagtgaccctcaccagggactttgatgccattttttggagctgaaaaggaaggaggggctcctgcagagtgattcgtgggctcagttcttgacttggggtggctgagagtttccccttaaataatatgtcacgctgtaggcatatggtcttgcaattgcggggtgtatcatttccacttgattgtcaaagcaccccacggcagaaacatactaaaggatctctgctccagatacagccatggctttgcagcatggcagatttgcagctttgaggtggaaaacatttttcagcctttcccaagaggtgaactggatacagctgtgcagtgtaacctaaatctttgcacgtgtctttaaacagggcagaaacaactggccctgtccttccactctgggcctgatgatgaccaagtcggagagaactgaagctatatatcctgttctcagaagttgaatttccccatcttggacagagtagtgtgctgttgtgggaatgcgtagctattgccttactcaggtgaatgtcatctgaagacgtggggtgggtaagaatctgtcaccactaaacgcttactccgggctgcccatcactgctgtttggtcagtccttttgttctagggccctttgcagccattctccaggaagagtcatcctggccttgccttcagaaacaagctcgctatatttcccatgtagttctagaaagaatcctggtgcagggattctgaaggatgcactcttgtcctggatctgcccctcaatgtctgtgtattaatgagcaaattattattattattattttgagacagggtctcactctgtcaccaaagctggagtgcagtggtgcgatcatggctcactgcagcttcgacctcttgggttcaggtgatcctcccacctcaacctcccaagtagctgggactacaggagcatgccaccatgaccagctaatttttgtattttttgtagagatgaaatttcaccatgttgcctacgctggtatcgaactgctaggcttcagtgatctgcttggcttggcctcccaaagtgctgagactgcaagtatgagccactgcacccagcccataccacttttccatatggcttcaggttacaggtttgtgcatgagttacatagtggaaccctaaagccatacctttgaccagttgtctaaagtttttagcaccactactactgtatagctaatattttctttgaatggattcaatttttgtagcctaaattgattcacaaaaaccatacttttcgtctctaatttaactggacattcaccatcactagccataaataaatggtacctattacaaatgcattgatgaccctagctagaatggctataataaaaaagatagacagcaagaagtgtcagcaaagatgcggagaaattggaatgcacatacattgctggcaggaatgtaaaattccgcagctacttagaaaaatagttgagtatttttcttaaaaaaattactcagttattatgacccagcaattctgctcctaggtatatattcaagataattaaaaacatatgtgtacacaaaaacgtgtgtaccagtgtttataatagcattattcatagtaaccaaagcatggaaacaggctaaatgttcatcaactaagaaatggataaacacgagatgatatagcatacaatgggatatgttcaggtataaaatgaaatgatgtcttacatgctgtagtgtggatgaaccttgagaatgttgtactaagtgagtgaagtcagatacaaaggactacatattgtatgattcgatttatatgaaatgttcagcataagcaaacctatagtagcttaaagtagattaatgattgctaagggctgaggggagagagtatgggaagcgatccttttatggatatggattttctttttgaggtgatgaaaatgttctggaattatctggaatgttctagaattgtacaactatcaccactttcatacacagttgtacagttttgtgaatatgttaaataacacagaattgtatattttattttattttatttttttggagacagactcttgctctgtcactcaggctggagtgcagtggcatgatctgggctcgctgcaacctctacctcccaggttcaagcgattctcctgcctcagcctcctgagtatctgggattacaggatctgccaccacgcccagctaatttttgtagttttagtagagaaagggtttcatcacattggtcagactggtctcaaactcctgacgtcaggtgatctgcccacctcggcctcccacactgctgcgattacaggtgtgagccaccatgcttggcccgaattgtatattttaaagtgtgaactttgtggaatatgaattattatttcaaaaaatatgttgaaaacaaagcaatgtcatcaaattctttctattacctgtgtttgttgaaggtgtttgctgtattcaaggcctgttttccctcaggaaataaaacagaggttggaaagtattaaagaggtgttgttaaacacggcctagcaccagctgagactgtccttcaagcagccagaaaaactgaatgagcttggaaaaaaaactacttcctaaaaccttctaaactcagcttttcaaaggccaccaatgtgaaatgcttaggatttcattcaatttaagcactattaccgtgcccaatttttgttagctgtgtttatgaggaaagaattaggatattttagctggggaagatagcactctctggaaacatactgtgcgatatgacggccactagtcacgtgtctctatttaaatttaattaaaattcagtagccctcaaaactgtgccattgacattttcagtgcctaggagctacatgtggtttgtgttggttgtactagacagtatgatataggacattcattttattgctaaaagttctgctggacagctctatgctaaaagattaaattaattgtattgctatcttgtggtctctttgctctgctttccctcatttaagcaaattcgaatgctgaaacatgacaaataatgattataataataaaaattaatagttaacgtttgtacttgccctgtaccagacagtgtgctaagcatttaacgcatgaggtcttagttaatcctcccaaaactctaacaggtagctaccgctatcacccaagctttgaatgtgagaaaactgagcatcagagatgtcaattgctgaagtcccagggcattgggaggcctggatttgaatccccatcagttggctttgtgctcctcgtccttctaacctctactttttccacaaatcccatcccaggcctcagccagcaactcagagtccctctgtcaaggtctctgagaaattttacttgtcacgttttatcatgaccgtattttctcaggacagtttcaagaaataagtcagaaagcagagtaaagtttgtggctctgcctactgccccctttctcctgtcctacctcccacccagagacaatacctgctaacgatttggagtgtgagtccgaaaccctcccatacttttcctatgtaattacatgcataggtatgtgtacaaggacaccatgcacgtgtgttaagcaagtgggatctcatcacccacatgattttgctcattgcttttatttatctaacagcatgttttggccatctccccatgtcagtctgtacaggtccactctatcattctatattgtgacggcacacaattctataaacagtaataccatgatttatttgcccttcagcaaatggctttgccaattcttacacacaaaaaagggtatgatggaccagtttcttgcatctgtgctcaaactggacatcatcaatcttttaagtttttgccaatctgttgggtgataatttcttttcctttcaaccttcagggtcatttgcagctccctccacctgctctgcccaggcttctagctgctgacagccaaaggcaatctgccggaggcaaaatgaggtcaaggccaaaaaccatattttctttcagtgagagagggcatttacttgggtaaatacggcccatgcactgtgctttattggtttgaaaaatgaagaagcaagctccaacgagttctctctaatggggctgcatgtctccaatacctggtgctccaatgcattgattgacgcattgtcatcacttataaggtcagtatgttcatccaatcctttattcatcacgtaactatcaggcattgattccatgctaggcagagttctaggcactgagaatacagcactgaatagtgagtcaagacccctgttttacgggacttagattctaatgggcaggatggaggcccacacaggcatcatcgttatagatctaagcaacaaaagactgaaatgagaggtatgccccaagacacagagggcccatcacagagaggacagtcaggtaaggcctctctgagcatgcacactaaagaaaagaactgaaagcaagaaggagcatcccactgagaagaaagtgactggagagtgttcaaaagaagccaggatggccagggccttgtgatggaggaggagcctggcaggaaatgatgtcgggtggtaggtggggggccgattgaggcagggccctgcacagcatgataatgagtttggatttttatagaggtgcagtaagaagccactggaaagttttaagcagggcagcagcagaatttggtttattcggtaagctttacgttaagggcatttgaagttctgaagtgcatgaatactttgctttttaaataagacaaatacgttaaagaagtgttaacagttttcttaaaacagggacactctcacatggcttctgcagtgccttttccagtgatggaaggaagggtttggagccaggtttagtggacttactattatgcgtagtctttcgtcttcagtatctgggtcacagcttataaccaaagcatggcaagaacctccagcaaggttgatgcaggggaaagaagattgagatcaagtcttgttgcctctagtttctgttctttgtgtgaatgctgagggcccctctgtgcttggccatttcacaccagcagaaagcttttgggctcaggaatccagggatctatctgccttggaacattctgcatcaaggtaaaccagtttggtccagtagtgtcatgaccagagatgggagaagaaactgtgtgctcgaggtgctggggctagcatgtaggaacacaaggattttgaattctgcaagcatacacgcagttttgaaatcatcctgataagagtcggcaggagaaatggaaaaaaaaaaaaaaatctcttggatggaggatatcagtcctgtgggtaagaaggttcttggttatcatcattatactcccatttttcactacaaaaacatttttagagaaactgatgatgaaaacaaaagattccaatgaatcagaagcattgattaagcttaacagagagcagagtggtggtgaggtgcatgaattgcagtggaaccatccaggttttttccactttctttggcctcacctttttgccctacaactgtcctgcttactgctgtttgaagaaatgaaatccaaccacctccacctcttttcatacttacccatcttgttttgctgcatacattttgagccctatatgtgcatttcacccatcttcctggactctgaactgagccttgtttctgagccattttcagtctcttgcgcaggacttttattcagtctcggttgcaatgtcagttttcttgccctgcccatgctcagaggagaccaggctagtggaggtgcttcctgtgaccaagtggtgctttaactctttattttaaataattttggagcattcagcattgctccttctccccttccttactttgttactctcctctaaggcttcttttccattcatggaagatatttcttcagtctagttttggttcctctttaatttttttcctctctgagggaaggagttgctgttttttactttttactgtctctgtcttaatagggagggttactttcatctgcctgagaatcacgttatcttccatgtgggctaatgactagtgcagcctgagacctgagctcgaaccagccttgtagaagcagaacagtgaataggctgatcttcgataggtaatttacaagacttccacttcttactgattaactttcataactcactccagaaaataaattgtgtatctgttatcatcctattggatatgcagaagctgtcctgagagggttgataaacctttgaaagaatacataaccaagtcagcctctgctgcaaataaaccgtgacagagaaagagggtggccgtgccaccgaaagggacaggtgacagtggcatcagagcaaataatttgcaaattgtttaataaataatgataaatctctaagcagctcctgcattttattcaaggaaaattaagacttaagtatttttgtgttttttgttttttgttttttgtttttttttgaggtggagttttgttctgtcgcccaggctggagtgcagcggcgcgatctcagctcactgcaacctccacctcccgggttcaagcaattctcttgcctcagcctccctagcagctggaattacaggagtctgccatcatgctagctaatttttgtattttttgtagagacagggtttcaccatgttggccaagctggtctcaaactcctggcctcaggtgatccacccacctcggcctcccaaagtgctgggattacaagcgtgaaccactgcgcccagtctcttaagtactttttatatgaataaagtagtcacaggtggtaggtggtacagcaatgtttgtatgacaaagcccagaaagtagcagagagaaggaaggttatatgtgctcacgatgacttatctacataatacgagagaagtaactttctaaggacaagacatgagacagtaagaccattctgcccttgactctctaagacttggaatttcggatccataaagtaaaacatttctccttttaatagacaattagattaatgatgtttttggaatgaaaaaatctaagattagttgagttctttgctgcctccaccttccttcaaccttgactcacttggtaattgtcagctacagcatagccatctaaggaggtacagaaaactgtgggtgagttaaacatgttggctttgggtccaattcctagccatccgtgcaaatgctgtgtgacctttggcatgtctcagaacctctcttatctgagccttggtttctaatccttacctctcagagggacgattatgagaaggaaatgaactatcataggatatgtaaaatagtatatagctgtatgtagcatgtagctacatagcatatgtaaaatgtttatcacatagtaagcacctgttatatgccatctaattgtgtgtatatctgtgtatatgtgtgcctctgtgtgtttgtgtgcacatgtgaatgtgtgatactagggaaaataatttaccttcattaaataactaaatgctttttactactccctgtggagcttgatatataaggttgctcaggaagggagcagtaatttggtgggaaatagtcacttgtgtgtgaatcatctgaagtacccatccttgtgtccggatttggggctcttgagttaaaccactgtttgcttcccctgtccacaatggcttgctgtctacagcacgtctctccatcagcaatgtcaaggatgttttgttgaatctcaaatttaaccactctggacctggcatggtggcttacccctgtaatcccagcactttgggaggctgaggtgggtggatcacaagttcaggagatcgagaccatcctggctaacatggtgaaaccccgtctctactgaaaatatgaaaaattagctgggcatggaggcatgcacctgtagtcccagctgctggggaggctgaggcaggggaatggtgtgaacccaggaggcggagcttgcagtgagccgagatcgcgccactgcactccagcctgggtgacagagcgagactctgtctcaaaaaaaaacaaaaaacaaacaaacaaaaaaaccactctggaaaatcactttttttaattacactatatagtctttctatagttgaaacaacttaaatattccctccccctatgatgaaaatgggattcaaccaaaagacagatggatggaactttatctcatgtatatactatttaatacgctacatgcattctgcatgtcacatgctatatatagcatggtattatgttgtaattacatttaataaacctagaaatgccccattttttcccaatagcctagaattcttagaatagactcaaaatgtgtcacatgttagccaaactgtggtcaactgaaaacagtgactctgagaagatcagaaatggtggctctgctgcttcatatgtggctgaaataaatgaagtggtctacagtgtgcctgtatgtatgatgtgggtgtgcacgtgtgtgaatattagcgagaatgggagaagcctttactaattcttgaaaaactcacataacccatcctagctacaaccttcctggtatcagaaaacccaggaaggtaacgggtggcctgaggaccaagcctgtgcctagggaagtgaggtgtttgaaaggacgtttcctgtaggccacaacaaaggcaaaggaattatccctccctatgatacaaagttcctctcccttgcttggaatgcctgtgtccctgggatctgttgtaaatcttctctggataatgctgtcaacacacagccaatgtcccacacactgggatctcttttttcctatctgtgttggccaagtcttcttttcactttgcctttcttcacacagtgccattaattaggcttgtacattccagccctgcctcccagagatttcccaggtcaccttgacatcttcgagtatctatttagagtccctgaatgtatccttatccttggagagtctcatccactgcgtatgagtttttcttctttcattccaaaggcaacctgagtcctcagcctctgtgtgccatgatgagaaagaatgaatgggaatcaacccaaccaggaagctggctttgtggcgtggtagatgtttgtaaactctgcctgctgggggtttcttggccattgttgaagaccacaagcccagggacagaaagtggacaccttcctccacctgccagccctctttccaagcttctgctcctaacctgggtatgaacctgctcagtgaagccagtttcgttttatgcaggttctgggctctgaaggcctgtttgtgtcattgcacactttgtagccattccgtctcgctgggcctgcctgtaatagcagtgcagcttctaggtggcacttagaggatgcctaaattgacttagaaagctttgcattaagcagatgtttgctcttggggaagattaaaaccattttgcatcaaagaacgaggctgcggcacttccctaaagcttgaaagaacggtttccttttacttggctgagggttacctggtcccctgcttgacaccctcctagtccgtgaaatggagtaaatccaggttagaccaggtgagtccgaaggtggcaggtggctaaggaggatatttcctttgtagctgttcccggccttgtttctacttatagggataactaaagcaaccaaacacacaccaaacaggtgggagacagcagggaaggatgcttggatatggctgagccacgttcctgcctggtagtatgagaattcgaagatgcttgaggcatgctggtgaaagtaggcaaaagcagagagactcgaggctgcatcaaggggcaaaccgtgtgtatgtttgtgtgtatgccagtgtgtgtatgtgtgttagtgtgtgtatgattatgtatatatgttttgtgtgtctgtgtgttagtgcgtgtgttttgtgtatatgttagtatgtgtatttttttgtgttagtttgcatatgtgtgttagtgtgtatgtgtgtgcatgttttgtgtgtatgtttgtgtgtatgccagtgtgtgtatgtgtgttagtgtgtgtatgattatgtatatatgttttgtgtgtacatgtgttagtgtgtgtgttttgtgtatatgttagtacgtgttttttggtgttagtttgcatatgtgtgttagtgtgtgtatgtgtgtggatgttttgtgtgtgtgttagtgtatgtgtgttagtgtatgttttgtatgcttgctagtgtgtgtgtgtgtttgtgtatgattgtgtttgttttttatgtgtttgtgtgttttgtgtgtgttagtatattttttgttagtatgtgtgttttgtgtgtatgttagtatgtgtatgtttttcgtgtgtttgcgtgtgtgtgtgtatgttttgtgtgtatgttagtgtatgtgtgtttgtgtgtatgctagtgtgtgtgtatgtgttaatgtgtgtgtgattgtgtgtatatgttttgtgtgtatgcgttagtgtgtgttctgcgtgtacgtagtatatatatgtttttgtgtgtgtttgtgtgttttgtgtatatgttagtatgtgcatgttttttgtgtgtttacatgtgtgtcagtgtgtagatgttagtgtgtggatgttttgtttgcatgttagtgtgtgtattagtgtgtggatgttcttgtgtatatgttttgcgtgtagtatgtgttttgtgcgtatcttagtatgtgtatgttttttatgttagtttgcatatgtgtgttagtgtgtgtatatttgtgtatgcatgctagtgtgtgcatgttcttgtatatatgttttgggtgtatgttagtgtatgtttctgtgcgtatatgtgtgtgtgtgcatttcaagtgttcactgccagagaagtggcttatcagtgggtcagaagacagcatgtacgttttataatgtaccagttaagagtccagatgtgagagtcagatattgctggagtcatttcctaactcagctctgcactagtgtgtgaccttggacaagtcacttagcctctctgagcttttgtttcctaatttttgaaaaataggatgagacccacatggaatgtctcctgaggcttaagcaggatggcctgtaaatcacccagtgtggggcctggatcattgagagcaatgggatgcgctgatggtggtggatactgctgctcttacgctgtgactgctggggctgttgttgctattttcattatgagaggctttgggagagacagaactgcacaacggattgccgtcagcctccatcctgagttcctggggtctgggttctttgtctgttgtgttactgggcggggggaaaacctccagataaacctgtcaagctgttgagaaatcctgtctcccatctaactacttgtgtgttacttacaacgtgtgagacttaatgacttcttctgtccaagggggtaaaacaaagccaattgcattaccttgccatgagcagccaatgaaatggctagcacagagccgttagaacagtgtctgagccagattcaatccttcctccgaggtcacccctggagctaataaaggaaaaaaaaaataagtaaaggccgggatcttgtgggcctctcagcctggcaaagtgcctggcataaaatgggtcgcctggcttttaaggcagtgtgccgagcagctggggaaaggtcatcatgagttcacagaacctttaaacacactgggacttaaagccatcagatcccttttgctggctccatttaagttgttttgttggaggacaaaacctttttgcttacggctaagtacattttatggagcatttaatgattcttctatagacgtttgagtagctgtgttttggtttcaggggccgaaaataagtgcccagaatctcccgtcagtcttcttgatgtttattatctgggtggagggggagggacggggctgcttagcacatgttggcttctgggcttcattgttggcacttcagcagaagtgggaagaggcatatggccttcctggtgtcttatggtgaggaaaagaggacatttgaggggaaatatttttgaacaggaagacagcaagatcgtatttgtaggtgcgatggaaaagtagaacagccagtcagctttgggactcccaagtcctattaaagctcacatcttttcaaagcattttaaagattaggaatccatctctccctgtctgttggtaatcgtggggtgcaggagtctacaacagctcagcttacgtctgacgagctcttgtctgttacatcagtaccttgggatgtgccgggctagcggctttcccatcttctaagcacttggctgccaggaaagacggaaccctttgaagtatgagatctgtttatcttgcagttactatggagaaagggccctggaattaattgtaggttattgaatttgtcctttttaagaggaaaaaaaatgactacattatggtgctaattcatagatcttgagatgctagcatttttttgtgcgtgtttaacatttcatttgaccattattagcagtatcaggttgggttgctgagtttcaagtactagaaatctacttggactatctttggcaagggagagcatttattgggaggatattgagtagctcacatgatatcaagaagaccaaaaaaaaaaaaaacaaaaaaaaaaaacttggatcccagaagagaattattcagccattagaggctggctgtagaatgaatgccttttcttctatctgaatgatcctctagtcactttttctatcatcagatctctctggttaaaatttgaagtcccagggcagggaatacttgctagttgtgttctctctctaaggtaatctgttggaagaagtcagaagaaatctttagagctcccattgtgagggcaacatacttgtttttctgcttactaacaaggaagagacaatttctgtaaaaggatatcaagatgctgttaggaaggtgtaatggatactagtgaatgtgtcaattagatgccaagcactctgactgttgatacattcttgagacctacaatgatcagatgattcttttggggaatctatctgtctgtctgtctatccatccgtccgtccgtctgtccgtcgtctatcaatcatctatctatcattcgtctatctatctatctatccatccatctatccatcccaatacaaaccatatacaacctcatgatggatagggtttcaagactactgtcacgatcatgggagactttttctttcctctttttaaccataaacatctttgtgagatataaatgtcattagaaaccagagaaacagatgatacactcaatggggtaataaatatgtaaaggaccttgccacttattttgtagcagggaagaatgtagagtatatctgagactgagaacctaaatcaggacttacctttttttatagtctcagtccatccaccaaaccatagccatagccaggcaggacaaaagaaccttgttagttattaatgttgaattgctgtattaaaattctttcagtgagtgattctcaagaaggagtgatttttttcccccccacagggaacattcggaaatgtgttaagacatttttggttgtctcaattgtgtagagtgatgctgctgacatctacgggatagaggccacggatgttgctaaacatttgccaaggcacagaatcttgtgctgatttacagcatcatctttgcaaacattaagatggcagggcacagtaaaggtactttacttcccacagtacagaattatagcacccaaaatatcaagagtgcagagatagagaaaccctgttttagtaagagatgtaaacacaactcaagtcagtgtatgcaaagtgatgactcaacagggaagatacaggtatctcttacgtgactacatccagggtagctgggacccagggaaaatattaataccctaagactctccttctttgtctcctttctttgtgtcagtttcacttccacaaactagcttcctgcacatggtgggaagtatggctgctaatagaaggtgggtgagaagactcatcctgtgatatcagaacagaaagactctgtgtcagaaactcccagggaaggttttgattggcctggcggaggtccagggctcatcactgagccaatcagctatggcctaggtgtagagctgggtcatgtggcacagacatggcagctgaccctctaaacagtgtattgaggcctttcccagcaagaccaggatgattttaagccaggctgccaccccattggtgtctgctgccattgcatgttctcttattgccaggacatttgtaaatccgatgttgtttccagcagagctgtgtcagagaatgtcacttagccattgccagatcgttgagcaccctggctgaaaatcacaaaggcacggcacctagagaggaaacgaaggctgtgcatgtttccagggaagctgcgccctgacatttatggctgagccgagtttggccttgaaaaaaatcatccggtccagccttctgcctccaggcttgtgaattgataaaccctccaggacagacaggctgttgaggcacagcctgagatgatttctgtccttcctccctggtccaaccatggaggctgccttagtcggcttgtgtcctagttgatatatttgttggaatgtatttgaaactctggtcagtttctctgatgatattgatagttttcttttttttttttcccacttagatgaaatttgtcaagcctgcattgtgctaagccctattaaaatggtgccagagacccaattatggcagctacaaagccgttcaagagtaagcagagaaaaacacataaagggattaaagatcaaaaatgggattccagtgaaagtacattaggagacatcaggcagagacacatgaaagaattagaatatgaagaagaaagcgcatagagcttttgggatgtccttacttttcatccccccaaatcatttaattttgagcatgtttactcttttaaaaatgaattgaaatgatcgattgtacttttgtcaggtggacatgtttttaactctggtgtgaaatgaattgcagatgggttttctggcttgattccctcccccaaaccccccagttttttttttctttttgtcttagacaatatggtgtcagtgaatcatgaaatactgccggtgagcccatttagtgagttgggaaagatggtctcctgggctaggtggtgttggcaatgacactctggggaatggctgaggcccccacccccatcttactgtttgcaaagacgagactgtaaatcagcacaaagtgtgcatttgagagttgctgttttgagataaagagtgcagttcagtttgtagtcatcatcatgttggttctgaagaagtcctgtcacaagcagagctgcacagaatcaggtgtaaatctgtcattttggctagtcttcctctggtccctctctcttcgatggattccatgacaagtccttaggcacatgtttgatttgcactctgttgtttgctatagaaatgtgtacgtggcctctcaggaaagagaagtgaccctctgcctatatcatcgtgaaacatctcttccaggtttgcattctggagttaatggaagagatggaaatctaatcagctcacaatagtctctaactccagactctgatgctcacaacattctgtatatgtgcatcagtcagttcaatgggaatagtggagaaacagagaacaaatgtcccatcccatctgttctatctaaaggaggcagcttctccttagctgcagtcatttttttcaatgcaatagtgcaggctctgcgttgtcagattttctgatatttcaaaagaaggtaaaaatccagatttttgtggggatattcattatgatgatatatatatatgcatatatatgtgcatgagcacgtgcacacatgcgtgcatacacacacacacacacacacacacacacagacactacacatgatcaaacacatcattagcccaagggtcaccagtttataatctttactctaaagagagagccaggcatggtgtcttatgcctgtaatcccagcattttgggaagccgaggatggtgaatcagctgaggtcaggggtttgagaccagcctggccaacgtaatgaaaccccatctttactaaaaatactaaaattaggtggacatggtggcacacaccagtagtcccagctacttgggaggctgaggcaggaggatcgcttgaacccgggaggtggaggttgcaataagccaagatcctgccactgcactccatcctgggccacagagtgagactgtctcgaaaaaaaaaaaaaagagagagaagaaaggccgtaagtatttttcaaattagtgtttgatagtctatccattttggggtttctttccctgtttatcttcaaaagtgccatattttgaaagtttacgtattaccagaaaaccagcatcattcatggagtctttatatgcttaaaaagttttcttggaggtctcgaaacacccttagtcttaattcactttaaaaaaaaattggagccgggaacagtggctcacacctgtaatcccagcactttgggaggccgaggtgggcagatcatgaggtcaggagatcaagaccatcctggctaacacggtgaaaccccctgtctactaaaaatacaaaaaaaattagccaggcgtggtggcgggcacctgtagtcccagctactcaggaggctgaggcaggagcatggcgtgaacctgggagacagagcttgcagtgagctgagatcacgcccctgcactccagcctgggtgacagagcgagactctgtctcaaaaaaaaaaaaaaaaataaaaataattggagtgtatgtccttctacagtttagggaattaatggtgagaaaagcaagccagacagttatcttcagattaagtaacaaagaaagtgccctctaatggcctgggaggtttcattcattttttgtggaatgagaagggaggtgaatctttcttttttttaacacaatgatcctgcagctgagcaagaagtgctagatgatcctcctggctcgaacaggatgatggtgaagagatagcatggtggtggtagaagtcgtaatgaaggtgaaagaggaatacagaaaagaaggaagaaggaggtttttcacaactcagcgtggattggggtatcccactccggtgggacccacagtctgcttaatataggagattgactccaagtcttgccaccttcccccagcccaatagtaaaaagcaaacacacccaaacaaacagaaaccacgatgttcctgcagctctcgggggctgaccatgtcttccagaggaagctcaaagcctgttgttgcatgcttcatccagcttttctgcaaagtggaggccctagcaagaagcaaaggcagacagatggtgtcccgcagactctccctcaagccctttcatctctcctctcactattaattcatctgtttggatggatatgttcacgcatggaaccaagatgaataataatgaggtttttaataactccctgcatttgcattcctagttactctttacatggttctagctgattaaaatgaatcatttacataattaacatatggttatagtgttggctttaatatgctgattatctcaatacttttgtctggagtcaattggattctaactgtaacaattgtttgaagtgagactagtttattcctgggaggatggaggggctatttgccatggtgtctgattagcaatagcatacctttccaacaagtttgttgtgcttctgttttgtaatgtgattgaaaaataagtaaataataataataattgcagtgatcataatagctcccattaattctgggacaagtactatcaatttcattatctcactttcttgcagccagcctgcaaaacagcaaggcttatccccactttacagaggaagaaattgaagcttggaaatgttaacgggcttgcttgaagccaccatgctattatgtgtcagagccttgagctaggctttctgatcccagaattcatactttttaattactctaagtcagcttctgaaccttgagactattgacattttcaagcttggcactatgactatggccagaaaattctgttgttgaagggtttccctgtgtactgtaggacaattggcagcaactctggactcctccctgtggataccagtagcaccccttccctcattatgacaaccaaacattgccattgtcccctggggaggggaatggggtaaagtggccattgattgagaactactgctctaagttattttcttggtacccattaagacaaaatactaagaagcagacatgttatctaggttggtctttcagtgatgggtaactagggcctaactgcagtaatggtatttggaggtacattgtgatgtgtgtgactcctgtaactgattctgaattttccaattatatctgccaggaatcactgtatttgtcaatcaaagcgatctttgttttttatcaacgcgggtaagttctgtctccctcactttcccttcttcccccacgctccctccccactctttttaactcctctaaagggcatgcttgatattttcagatgtgctgccttgcagagttgatagcatgcatttcaggataccattctctcattagcacatcctaggcatgggtgccatccgctatgatctgattatcttgctagttcatattgaatttgaaagggacttgtgaactagtggccagttttcctgtttaggtacccgaggttttggaatgtgagtgctttctgaacattcatgcatatttgaaacgcatttttgctaattgcaggactgttgtccacaattagtctttggtaggcatgattaattgcaaagaacactgacatttatgcataaaatgcttgaggtcaaaaagaaatggagagaaatggtgactgcagccagggtgagtggaatactgatgcatggtgaccccagaagcaaagccccaatcaggaaattgtagcatcagcaggacaggtattttattgggatggatgtgtctgtatttttgacttgcctgtattttgttctcctctcctctaagcacctttagttttacgcaggttttcagaagcctgtctgatgttttcataaatgccaaggcctgccttttactctccttctgcccttctccctcccaaactggccccatcacttgaagctcataatttacttctttaacataacatttgtgtgttgtatgtgtcccaggaagaatcaagaagtaaacaaatgtgccacagtcctaccactgagattaaccagtaaacttttttttctgcttaaagtggtacgtgcctgtgattaataattcaaatgatgctagtaacggaagacgggaaatgaagcccatctccaaatcttggatcttactaaagctaatcagtatcagcggccattaggagaaagaaaaaagcaccattgtgtatagatatgcacatatatggccaggtgcggtggctcacgcctgtaatcccagaactctgggaggatgaggcaggcggataacctgaggtcaggagatcgagaccagcctggccaacatggtgaaaccctgtctctactaaaaatacaaaaattagctgggtgtggtggcaggcgcctataatcccagctactcaggatactgaggcaggagaatcgcttgaacccatggggcggaggttgcagtgagctgagatcacgccactgcactccagcctgggcgacaagagcaaaactctatctgcaaaaaagaaaaaaagatatgtagatatatgatacatacatgtgcatacagatatatgttgttttcacatactgacaaaaaaagccacatcagtctaaatgccctgtgtgactttatcttgcttaatttcacttgatgatatgccatggagcctccttcagtttttctacactaggtggctgtgacataccttatttaagtcattcccttaattcctttttttttccattataaacattactgctacacatgcatacactgagttatctgatagagatatttaaataaaacatatatatgggccctgattactttttactgccatgttaatttcctagcagtgtgattgttgggtccaaaagttggtgtctcataacttccatttaaagatgtgattcaaaacttacctcctactatatataatgctattcaattcacatcactttctcaccatcagtgcagacatcctatttgggcctcggagctggagttcacgtaaggatgagtaaccacttcatacttcagatcccatgagagcgggatcatgtcggtactagcaggctctaaaggacacagtgttcaccctgcttaggatcagacaactgcctagtctgtgccaggcatctgatacttgccttggtaataggattttgcttgaagttctccttatgcctctttatttcttttatttatttgtgctgacaagttagagtgtaagctcattgaagcctgtggccatgtacagaaagagaggtcacatcttctgccaaccctgattgattagtagtggctgttaggagctctgtctggagaaggattgcatctgacttaggaagaaggagtttcagaatcaattagtaatgtctgctaagtgcacagaatggtggaggggcagcctgtgtccccagtattctttttccattcttccataataaattaggattattattatggttattgagggcttacagaaaatttttgaatcaatataaaaagcagcaatgggaaaaggagaagagagggagaaagggagggaggaagagaaggaggaaaagagaagagcaggagacagagagagagaagttatactcaaatatacgaagaatatcttgcttctaggtggctttatatttgagcttttctatagttttgaaatttataggaatttaaaaacatagaaattgcatttttttttttttgagatggagtcttgctctgttgcccaggctggagtgcagtggtgcattcttggctcactgcaagctccgtctcccaggctgtagccattctcttgcctcagcctcccgagtagctgggactacaggtgcctgccaccatgcgtggctaatttttttgtattttttagtgagacggtgtttcaccgtgttagccaggatggttatcgctctcctgaccttgtgatctacctgccttggcctcccaaagtgctgggattacaggtgtgagccaccgcgtctggctgaaattgcattacttttaattctaaaacaacaattagttttgcaccaacctaaggaacatacgttacatttgaatttagaacataaagatcacaatacatgttatagtaaagacagtcttttgaagcaaagctacaggtactattaagaggcacagtgatcctgagatgggaaatggagggcagttctctgtcgttctgcagtttcttggttttgtgagaccactaagtgatgtccgttctctcctggcagaatagatggtgttaatctccagtcccttgtaataaatgctggactgtgaacaggagatggctaaaagagagtgcccgggcaagcctttatctttaataaggtccacagccagtctataattgtcagaaatgacagaggaaacagggcttctgctattttgctcagaataagaagtggtgtctgacctgtgttggcagcaataattgcaatggtcagttattgaagttgatcattgcaatagttgatacaggggcccagctctttgcgctgatattgaggaagccaccaggccccacactttggggtctggaaacattcacagagcaacttttttcaagaagatggacacattcacgttttaaagatgctcagcttctcgtgagagagagtttaggtacattctcattccactcaaatcttagcttataacttaggctcctcgtagcagccctttgcaatgaaactgtatcacttttgaagcttagcagatgggaattgtcataaatgatattttagtcacagatatgagccataaaacttgaaagataaagtatctttctgagacacacatggagaggcagatagacccagatacagcgtgagcttttctgcagctctgatggtgtggaacgaagggccaccaataggtactttattgcaggtgacagggtttgcagatgatgtggaatagtgggaatggcatggagcatgaattttggggattcaatatggggtcaaatatttaccatcccgtggaatcacatttcttatctttttctgaggctccgtgttttcgctgtgtaaggggaatagcggaatgtccttcttaaggtgtttggcacaatacagataaacactaaataaatattcctgtctgtcctccctacagcattcccctcaaatgaatgtgttgcttattgctagttatgctggattattctgctcagttgaataattcattagggcttgagttccaagatatggtgtaactgtatccagcagactctagccttaagccaatatgtatattaatgctttttactcaaggaatctacctggctcttagcaatcctaaccccacccccacatttttaacctgacaggaagattaatctgcatgagatgaagggtgattgtcatgtccaaactaaaaacaaaaaaattaaaaataaaaaatgacagaaatcttctagaaatacctaaacattccctcttttgtcttcaacacgtactcggtccccttcttgtgctcccaggagtcttttaatgcctttgttttcacagcatcaagatatcctggcaacctagagttaccgccatgaggtttggccaccttatctcaaacaactgcgtattttgaaataggtggtgatagcatgcttttcattccatccagaaagtgtctcttccatgacctgccagcactagtatttcaagacctctgcacttacaaatttaaacggagcctggagtaatttaaattaatgtgtacaacatctgtcttggtgagaggagatgtagagatattctccgtttatgcccatctggctttgttagagtagataggcgtatgtttcaggaggagaaagaacattttttatttctgctatgtttcagacattatgctagccattacgcattatcctgcttaatcttttcagtaacgttggtagattaatatcattatccctaccctatgataaagattctgaagatcagagaagtacatcgtttcagtgaccaagtcactgttaaatgacacagtctgtattcaaagacaggacagcctgattccaaaactacttctatgccatcttattagtctcaaggtaatacaagtctaatgtgtttttgcttctgataattatagcagtaactacttagggtaaattaaaatggaatatccaggaaccccattatggtggtaagagtataaagacaaattagcggctatggaatctcaatccaggaaagagagacctgcattgggctcccatgtgttacgagaggttttgtttttttgttttttttttttttaatcatcagatgttttgggtgttcccagctgtgcttgagtgcatttgagaaatgggtttatactcttctcgatcccctagttcttcccaaaaggtagataaggggactcacataaacagtaactgaaagtcattctgtgtgacaattctgtattccttgttgttttagtaaagtttgtcctgagagcaccttgcctataaataaatacagtgacaaataaaatgaatgatttttctgggttcctttcctactctctctccccccatgctttaatgaataattttaatctactttgtaattaagacactagcaataattttattatttggtactacttgggaaaagtaatctttgatatgagatactttgcaaagggaagaccttgtgcccacgtcctgccttaaatgcgaagtaaaggggaaacctggattcaagaactagagccattggtaggccaaacccctatcccacaagccagggaatgggatcttttaccagacactcagacatgaggtttggttttattttttattgttctgaaaagtacattgtaaaaaagggagtgtacatttctaaggcacttttctaaaacaacaagaaataatacaaatatttagtaagcaagggatgattgcatttttggaacatatatgtttatgagctatgtcaatatatatgttgatgtgataccatgaaagctgttttagatgaaattctgataaacagggcattatattgccacttacttgctcttaattcgattctattagcagctcagctttattaaaatttctcaaatgtattccatgtgaaatcattttatttcatatcgctaatgtatgactcaacgcagcatcgcctttgaggtgatccaggactttcatccccatttcacagatgagcactggagataagaacaggttaagtgatttttgcctgaggtcaaacatgctgggagaaagattagaagttggtgagtgtttaccacagctctgtgtctgtgataagtccctaaattcagattttccaacctccgagttttctgggttagacctccagctaactaccaggggatgtcatgttatgtaattaattacaactgtaattatcttggtttctgggtcatttgaagatcatcggtgctttttgttttcatggttcatgcagcagaggaattttttttccaaagtacaagtataattaatccaggttttagactcttaaataaccggaaagttaaaacgtcagtgcagaaactgagttcatcttggctgatgtcccttgcagtagagatggggagaattcagagctgttaaaagtcgtggtcatctctcttgaaacataaaacttccctaccagtgtctggatttcctaggaggtacccagtgcatagacccatgttgtatgaatgactggcctcatacaagaggtaaacatagtatccttgtatgtccctaagtgtcaggtggttgcttggaaaagcagtgatttccataggtccctgtaaagatttcttcaaaactgatggaaggtataaatgtttaaaattagctttcagtttccacttctttttcatgatatcttacatgaaggtaatctattgaggaaattaccttttatatcagtttaaatgaacttatttagataaaataccagtttaaggcattcttgactttgttctattccattcatggagatttgcttgacaggaagtgctctggcatatgtcagtgacctccaatgctcctggagcagatgatactgggacacaggtggtccgtatcacccacgtgaggtggtggcatgtatttatgtgctgaaccaatcggaagacatctcattcagaagaaccaggcctgtttaccttattcgtatgtcattataggtgacacacaggaagagtttctgaagaatcatttcatcattaagatatattcaatatgacagcttggctaacacatcaatcatttggaaaaaaaatactgtagtaacagcctaaggagaatttaaacccttgtgctctggaatctgtatttgcagggcaggaaaaaatgttttagatttgtctatggcattattctttatcagtataactttatagcgcttgaatgtctgaaagatgactcattcatttatttgtgtattcattaattcattccacatatatttgtagagaacctatctgggatctaagaacaatttcaggcaccagagacacaggggtaaacaagacgtctaggcccctgctgtctcagaacttaaatttagtgggacagataggtggtaaacaaataagaaggaattgagagtaacaagcacagtgaagtgaaatatgccaggtgatgaaatagcaaataggagattgatgctcccatagtttggagactcagagaagttttaaggaggtgatgttttagctgggacaggaaagaagacagccagggaggtatggagaggaagagcacggggaacagaatgtgcaaagtctctaaagttagaataagcttgacatgtctgaagaagagcaaagagactccggtggctagaggattctaatggagaagtaggaggcagaaaagaataattgagaagtagatcagtcagatggaggaggactttgatgggcggcagagtaaggcagtatgagctttatcgttgctgagccggaagttgttatgttatgcaggaagctgcgatgagtgtgtacacaaaccatctcctgatctcgagccttttcctcctgagggcaaggaggatcgggaggcaagggaaacgtagtggtgatgacgaagcttctatctttcagggtctacggtttagggattgagagtatgtgtttgctagcgagacctcacgaaaccaagccccctggagagtccctgacaaggacgaggtgcaacactgttagcggaatccatttcatcgcagaactgctgtcttccaagccttctgagccggctggtacttgtgtaacatttctgtcttgggtgatttccaactggatatgtcatttctaccaagccagtggcaactccagcctagggatgcatttaatctgggacatggtggtgggagaagcattaggcacattgtttttcttccttttttttgaagaatgcttggtacaaattcagttttgacctcccaatgtaggcttttatttcccaggcacttcctttttccctgcatccgccaaaccctggtgagctttctgctgcttttctcaatggctgatctaagtactgcagaacacggacactcttgggcacactgcaaagtcagcctggctccttggccattcctcttgcagggcacaaaaggaccttccaaagaggtggggtagtgtattattaagtggcaataacgaaggacttctttagattatcactgtttcaccagaagacacaacaggagagcacacagaccttgaaggaaatcccaccactgacatttagaatctggtggactgcaagcttagatatctactctctaaatgcagttactttatctatgacctggcaatattaacagtacttatctcatagaaatgtagtactgggtatgtttctggccagtcataaacatttaataatggtagccaatgtcatcacttgttgttaatagtggggatagcagtaaactctctttcctctcaaggttaaggggagtgtttggaagagaaaaaaaagctgagactgaatgacgtttagctttttgatttcaccataaactaaagagtttcattggtaactgtgccctgcctctttctgtccaaaagagtatcttatttttagactgttttaaaataataacagtattatctgatggaggagacaaaaatacttcagtaatagcctaattggagcgaataagaaaatagaacacttgtgtgcaatggaatactagaaagcagtgggaatgaatgaattggagctttatataagaagaatggcttctgccattatgactgtggataatttactaaaaaatttaaaatacactggagttttagtactttctgctgtccagaaatgcatacatatgtggtaaatatatatagacaataaagaaactcaaaattcaggatattgtctgttgtagaggtgaggcagagggctacatctcaggagggttttagacagggtatttagccacactgaaattatttcttaagctgggtagtaactacaggaattccttccttccttcctttctgcctgcctgcttgcctgcctgcctgcctgccttcctgccttccgtcctgcctgcctgcctccctgcctgcctgcctccctccctccctcctcttccttcccttccttcctcttttctcttccttttctttctttctagatagagtcttgcctttatcacccacctgaggtgcaatggcaccatcatatctcaccccacagccttggcctcctgggttcaagcacaatcctcctgcctccttctccaaagttaggactaaaggcacacaccaccaaaccttgcttattttttaaagaaaatttttagagaagagtgtcttgctatgtttcctgggctggtctggaactcttggcctcaagtagtcctctgacctcagcttcccaaaacactgagactacaggtgtgagctgtgcctggccagtatttatgttttgctgtataccttttggtatgtctgaactatatcacatcatgattttagagtcagaaatgctcagagtttagaaaataaccatcttcaccacatagaatcgtataaaataaaaaatgttttttctccttccctttcttcctcccccatcatttaataattgtttagtacatacctttgcagatattttgtgcatattaaaaatatacacatttagaacatatatgcttaatataaatgactttatgtctatgactctgttaccacttaaaaatagtgtacaggcttttcaatgttggcacatataaattatgtacttcagtcttaacatctgtctggtaatcatctttcagtgtactgtaatttaaacaaccagtttccctattgatagacatttgtatttaaaaaacaaaacaaaacaaaaaccagtttccaaactctggtctgctttcaattcagacgctggcagcagctcacaccgctgatcatccaaatgttttgtctttgctaggacgataacccagtcgtttcatacaactgttttcgtttgcacctgaatattccatggctatagccacagctagaaatccattctctaggggaaaataagaaatgtaataataaacttaaaatccctaatgagaaattcagatttcatagaagcaggggtcttctccctcttgctaaccttcttttccaagatgttagtgtttttcaagaatcgcaggctttttaaatgtcctccgtaaagtgtaaaggggaaaatggagagaaagaacagtattttgaatctccagagttctcagtgaaagtagacaggtctatcctagtgttctgtcttgcatgaaacactttcttggtattttgtctacatgagtgtttaatatttaggtcatagtttgtgaatacactggagatgttatgcgtcaaacaaacccagtgttctggcttcacagcagagtaaacagacacagatagttctagatgcttgaacttctcccacgttaaacttaaaacagcctctcatctcagggcttccatcaaagggattgaggccgtgtctctcaaacccaggtgcaagtggaaatttttatgggccctgacttttcttgttgtccttgttggctcataatattgccttattgtgcaagtaatgcatataacttgtgggaaaaggtatagtactataagtaattagaaagaaaaccatatttgaaatttaaaatccttaaacacatacctaattcctactcttcctttctgaaattcctgttttctcaatgatctgttagtaaaatatatagactacaaaaatgggttcatacatcgttcccccccgccttttttttttattttattaacagcttcacagtgttctgttgcatgaatataccctaaaaagaggatttgttttggcattggtgcctgttctttttcagtgttattcattattttgggatgttgcttttattatttttcatattttattttatttggtaggaaaaatgcaaatgtcccaccgtatggatttgggatttgcaagtcaggaacagtgggcacactttcccttaatggttggcgtaggcatttggatactgaatttactgtttatatcacggtttctccaccttggcagtgtggacgctgggctggatcattctctatgtggggactgctgagtgctttgttgggcatttggtggcatctctagcctctcctgactaaatgccaactgtagttctccccacactgtgatgcccaaagatgtctctagacttggctcactgtcccctgggggatgaaatgtttctccctttgagaatcctgcttttacgcgattggattcttaagttgtctgaaggatgatcttttcttgtagcatttataaatcagttggaagttggttctggattactgcctaaaataaaattcaacctattctgagaaaacaatatatttgagtagggactaattacctcttttttatttcaagtgacaaaagccaatatatcacacttagccactatgaagactccatttcagtaaactaattaaactaatcctatctggactcattattctcagttccactaaatattttaacagttgagatttatctcatttcataaattatatcatacttaaagctatccacagccctcaagagtttattttggacttttaaaaaatgtgactttaagctgctctggaatgtatatttttcatatcttttctagataatcattcaccttgattatgactaattattaaacatgatatatggctttaattaaatgaaagtacttggtttcttgttagcgcttattaaatactgacagtgttacaaagatagtgcagcagaggaaatggcataactcaccgaattgattccattttcttgctgtaagccagtgaagatacacattttaagagactgattaatgcgcaagatggcaagaacagtgtttttcatagttaaaaggaattaaaatctgtgtccatcctggattcattttctaacagaggatagtcacctaattaaaacgttaatacacatcccgctatttgtatgtacgttccaaagccagcatacattaaatagaaatttatcccaagtgcttcatggagaagccaagaggaataatgcctaagtaccacttcagagtaaattgctccctacttataatcgtgtaatgcaattaaattgaggagctgtaagctgcctacatcaagtatgtttagtttagatatttgcctttagacatctccctgtaaagggttccacattgaagagaaaagaaggaacatctagccaatgagctgttcattaaacttgacatatggtaagcaaggccagaaaatgcctaaagagtagagaattttctttggtatctaaagaaaaaaaaatgcaatatccagttgatcttagattctgattctagcaggtgttcatggtacagtcttgttctgtgcttcattcaagaatgggaaattcttgtttatcccgttgtccatgatgtgcttatttctcatggcatgcctgtatcaaaacatctcatgtatcccataaacatacacacctactacgtacccataaaaattaaaaaaaaaaaaaacgtaaaatgcaacaacactaggcacgcattttataatataacttctctgcttggacaaaattaggctccccagtggaggcaaaaacaaaaaaagcagatggcaaatatgttagtgacattgttttaagtgtttgaggtcatggagtcttcacattgaaataatctcttgaattatctgagttttaggctagccagggccaaggtgccagctgaattaatgaaacttggaattcatcttttgagttcccagtgaacatcaggaaatactttcctgacatattgacctccttattatccatttcccattctccatgttgaaaaccatttcatatttgagagctgagaatatgacaccttcatgataaatttaaaaataagatgcaatattattccagaattgccttaagttcccattctgtatattaaacgcctattcaaagggtattcagatccaagttacatcatacaaagtatgttaaagtatcccaagtatggcctggcgaggtggctcaagcctgtaatccccgtactttgggaggccgaggcgggcagatcacaaggtcagaagatcgagactatcctggctaacatggtgaaataccatctactaaaaatacaaaaaattagctgggcatggtggcatgtgcctgtagtcccagctacttgggaggctgaggcaggagaatcacttgaacccagtaggtggaggttgcagtgagcagagatcgtgccgttgcaccccagcctgggcaacagagtgagactccatctcaaaaaaaaaaaaaaagtatcccaagtatgagaaacatcagtataaatagtgagaaaacatatatacatatgttcttcttatatttacgggagagatatgtatgcttatctgtgcttttcatatatatatgaaacatatatgaaatatatatgaaacatatatgaaatatatatatgaatatgaaaagcaaggagtatgaaacttatatatgaaatatatatgtatgaatatgaaaagcagggaaaaggggacagtcatttagtgttgctgctgaaaatttcaatatgaaaaacgaggaatatatagctcaggtgcaacaggcacctttatatttataccattacaaaaacatggctctcctggtattttggttcttgaatttaggcttggagctgatattgaagagctgcttattgcagtgggttttcatgccaaacatagctgagtttgaatgacatttctgttactctggctacagaatcttgggcagtatcatttatctatccatctgggctttatttttcccatggggaaataggagggagaggggtcatggagtgaacagctttgcaggccatgccaactttggaattagtggagagaatataaggtaaataagaccatcctgtaatgacaacctagacttagacttgcacgaaatagagatgtaagtcaggatgagtctctcattcactcaacaaatatttattgaatgccaacccttctcagccgctgggtattcagtggtatagagtgtgaacaaaatgctgctggcatagagcttatattctagttgaaaggaggcaaacaataaataactgtgtaaattaatatatggttagtgacaggtgcaagtcagataattaaaacagagagtggtggggagctctagaaaggctcctatgaagaggtaagttgacatttaagctgagctcgcaatggcaaatcatgccaaggcagagagaaagaacattccaggaaaataccctaagaggagaggaccttggaatttttgaaagatgaacagatccctggaaaatagagagaggggcaccagagaggtctgagaattgggcaaaggccaggtcatacaggattttgttaaccacgataatgaatataagttttatatgaattacggatgcagagatttgcatttcacaaagatgactgcttgccacgtgaaacatagaccagtggggcccaggagaagaaggcaggagagcagttaggaagctgtctgggagtccaggcaaggggtcatagtggtttgaactggaaggtggttctgaaatggaaggtgaaggaaatggaagtaccgttgtagaaaattaacaggcagatctgggaaaacccagtggaggtgaagggagtgaattaaaatgattccaggatggagaggtcggggcttgggtgaatggtgccatggaaagtaatggaggtatctcaaatagaaagtagtgagtgggaagagcaggagtgagcttgcagaagttctagcagaaatgtgaaaggccatggttatttgccaagatggaagatagattaggtggtggtcatctcatttgggcgttgaaacttgttttcaaaacctgtacctggttttgatttctacacagggatgcaactggcagatgacatctcaagaggtgggtttgtcatggtggttattattgtacatgtgagacttttagcttttaaggtttttggtttttttcgagatagagtctcgctgtgtcacccaggctggagtgcagtggtgcgacctcggctcactgcaacctccgcctcctgggttcaagcagtttttctgcttcagcctctgagtaggtgggattacaggcacatgccaccatgcccagttacttatttatttatttatttatttatttatttatttatttattttttatttttagtagagacggagtttcaccatgttggccaggctggtctcgaactcctgacctcgtgaaccacacggctcagcctcccaaagtgctgggattgcaggtgtgagccaccatgcccagccagcttttaaggttttgccacacgctaaacaaggcatggtgaggactcttgggtttgagatcccaacagcctcagagatatcagatgtagggcaaagcgggtatctgcatcccccaagttctttccttctcactaaagtgcttgaagtactggtcctttatgatactttcagttctggagtacatgtgcagaatgtgcaggtttgttacatagctatacatgtgccatggtggttgctgcacccatcaccccgtcatctacattagatatttctcctaaagctataccccccagcccccaccccccaacaggccccagtgtgtgatgttcccctccctgtgtccatgtattctcattgttcacctcccacttatgagaacatgtggcgtttgattttctgttcttgtgttagtttgatgagaatgatggtttccaccttcatccatgtccctgcaaaggacatgatctcatgtttttttatggctgcatagtattccatggtgtatatgtgccacattttctttattcagtctttatcattgatgggcatttgggttggttccaagtcttttttattgtgaacagtgccacagtaatcatacgtgtgcatgtatctttatagtagcatgatttataatcctttgggtatatatccagtaatgggattgctgggtctaatggtatttctagttctatatccttgaggaatcgccacactgtcttccacaatggttgaactaatttacactcctaccaacagtgtaaaagtgttcctatttctccacatcctctccagcatctgttgttttctgactttttaatgatctccattctgactgccatgagatgttatctcattgtggttttgatttgcatttctctaatgaccagtgataaagagcatttattcatatgtttgttggctgcataaatgtcttctcttgagaagtgtctgttcatatcctttgcccactttttgatggggttgtttttttcttgtaaatttgtttaatgtatttgtagattctggatattagccctttgtcagatgaatagatggtaaaaattttgtcccattctgtaggttgctgaaacaggcagttttttgagtgcttgccacacaccaaccattgtgcaaagtacctaccatgcattatcttgctaaattagtataggattagtaataaattctatgagctatgttctatttttatcctcattttatagataagaaaactgagacccaggtatttgattaatttcacacagctgataaagagaggatgtggattctctaagtccagaattgaggccgtcagtcactggatcgtactgacatgatattcattcatatacccctgtcttccaaatgcatagatgtacaatagctgtcaggattgtatctccctgggtctcgtttcttatcaaaattgcacatttgctggcaagaagagagtggcacattgatctcaaactgtgaaataaatccatacgccttcagagaggttcttcgaatgtatggtcaagcattgcaaaagccgctgtgtgtttggaagaaaggtgaaactggaaggtctttggctcagggtgccattaggagtggtgtcggtggcagctgtgggccatcatggtacacatcctgcgtcaactccaggcctccccacaatcccatgaacagcaaagcccctcatcttttgaatgctggagaaagctccgtacgtgtagggcttcgccatcagtttaaaacgtctctggaattctttgattattttaatgtgctaatttcttgagctttgtttttgtgctgtctttgattttccactttcgcctttattttacgccattgttggaagggtcaaagcatcccagagcttaatggctctcttgttcagctattgtggggggaaaaagagcaaagcaaacaaaacaaaacaaaatatccttttttttgttttgctttttttttaatttaaaggcatccaaaaaattgtttcttttgcctttgatcaagatcatataaacataatcagtgtttattgtgtttgcataatcgaaaatagcaggaaactgatctcagattgcatggagctagaaaagattaagcctttccttcttggcagagttctacagacacacaaggttggtgtgatggatgcagcactcggtatccatgatgtgttcgggaaaatcctcagaagaaacttgcattgctttctggggaaattcctgaatacaagtggcaatgagatgcatgaaaattattttcagctgatgaatactgtctgaacataactattgctggggtgtataatttaaaatctgtagagtgaagtgtgcaatatatgggctttgggatacaacaaatatggatttaaattctactcctcctttttatcatctctctgcccgggataacttgtttcatccccttccctgagcttaagccccctcaactgtaaaagaaagataacaacccttacctcatatggttctagggaggacaacatgagataatacacatccaggcagtccccaacttaaaagtggtttcacttactttttttttttttttttttttttttgacattatgaatgacgtgaaacctttctgttttttcacatttggtatggtattcaatgaattccacgagatattcaatactattataaaattagctttgtgttagatgagtttgtccaaatgtaggctaatataagtgttttgagcttctttaaggtagagaagacaaagctatgatgttcagtaggttaggtgtatggaatgcaattttgatagaatattttcaactcacgatgagtttatagggacataaccatatcataagtcaaggaaagcatgtacgcagagcttaatagagtgcctaatacagagtaagtgcttaaaacatttttttaaagtgtgatacaagttctttggagagcctgaatgaattgggggtatggccatatgtaatatgttcagtgcagcaccattctttaataaattacaagttggtctatttctttgttcctttttatttttatttttatttttggaggcagagtctcactgtgtcacccaggctggaatgcagtggtgtgatcacagctcatggcagctttgatctctccaggcttagatgatcctgtacctcagcctcctgaatagctggcagcacaggtgtgtgtcaccacgcccagctaattttagtatttttggtagagacgaggtcttgccatgtagcccaggctggtcttaaacccctgggctcaggtagtcctcccacctcagcctcccaaagcacttggattacaggcatgagccacagtgcccagccagatgtaactatttaatgaaatgttgattggggtgtgcttgcttcccctgaagcctgattcttgatctttgttctggactccaggaccaaagatatcattgcttaatcttgcgaacaactctggaagatccttacagaatgacttgctttagccaaatcctatggtaaggcaaaacactacctaaaaacaataataagcataattgtcatccagatatgttgggaccctacagagaaattcagaagacaatctggctggagtttacagtatgtacaacagcagtcttggttaggccatggtattataattcagcaacaacaccaataataatattggtggttaaaatttcttgagtatatagaatgttccttctagtatgcttaaggcttgatatgcatacaatctttatggcaccctgcaaaatccatgagtccactgctgttttccaaataagaagatgggggttgtagtagtccattctcatactgttataaagagatacctgagtctgggtaatttataaaggaaagaggtttaattggctcacagttctgtgggttgtacaggctctgcttctggggaggcctcaggaaacttataatcatggcagaaggtgaaaacgaagcaagcacatcctcacatggccagcaggagagaggaagacagaaaaacagagcgagaagggagaggggctacatactttcaaacaaacagctcttgtgaaaactctatcaaaagaacagcaagggggatgtttgctcccattattctgtcatctcgcaccagacccctcctccaacactgagaactacagctggacatgagatttggggagggacacacagccaaaccatatcaggggtctagaaaggtaaaccaattttcccataacaatagagagaatacattataataagtaggacttgatccaaatctgagagacacccaaactcatgttcttaactatgagatttcgatacttggagtcagaagacttgggtttaagtttcagttgcagggaccttactcacatcttctaacctctcaaagccttgccatatcatctgttcaaaagaataccttcttcacaaaattgtaaagactgaatgagaaaatgcacctaaagcatctttgcacatcgcagagattatgcaagtataaggtgctatatttcgcattaacacctgagcatagatcattttcggattgtgtgagggatggtgaatttataaatttggtgatttttgatgaaaagaatcaatatgctgtctctttacagaggaattagtggttataagaactgacaatgcatttagagatttgtttttttcaataggacagaaagagactattttctttccatttataagaatatgaatgtgcttaagggaggacagattccaacaatcgagttgtttgctgtgatttgtacgccctggggatatggagagttgggaatgtagaaaaattacaattatggaataaaaaaagatccagggagaaggattttttttactgcctgttttgcttgtgtggcttggaacagggagtttcctggagggtgtggggtcttccttgctgaccctcgtgctttttggaggctcattggtaagccttgttgtgcctgttccttctgctcctagtccttaagaacatagctcttatccttaactgaccttttgcactgaatatgtgacagttaatccactggaaggttttagataggcagcatgtccagacactgccccctgcacgtgactggccccacctccgtcccaccttggtgttaatcccatggggtggattttctaggccagtctctttttagaatagcatttgctgatgtccctctaagagagtttttgggcatgtgccctggtttgtaaaagaagggccctcatggaggtagaggaaagaagtttcgcgtcccaagatctccaaggataccaattataggggtagctgggtacctgcctccctctgctcttcgtttctcaccgcaagagctctgctatgattttctccacatctggacttctttcctccctttcttgcatagctaacacccatgtgtgcttttggaccagtttccttgtcccgttcacaaaattaaaacttccttgacctcactgacttggttaagtacctttactgtatcactttataacttcagtaccttcatttgtagcttgcatcatcatttcagttttacaactttttatgtaatgatttggtttatgatactcttcccccaaaagactgtaaaggccatgcagatgaggaccaaatgtgttttttcttcctacgcatcctcagcatatgtgccttttatacagtaggcttttaacagtgactaaaaggaagagtgagtcggtggatggatggagaaatgaatgaatgaatgaatgggttacacaaccagcctgtccagacactgattcttttacgtaggctgagattcctgaggtaagggacaaggatatcaacttgcgttagtttaccttatgcactccatcgcagcctaaactgtcactgattacttgctgcccttagaatacaagctctctctgtcttccttcccctcctgccttttgcaatctcatttcatgctttgctcatttgccaccacaatacttaagccaggccagaattattttcagtgtttgaaagttgcacacccacttctcccttgcagattctgtacacgcttttcctccatcaaaaatgttttattctgcctcttcaaacattgcattttcataatcattttcagacctctgcctacatgtccctttttcatggaagccctccctccctgaatcctctaggttggacaactttcccctgtagtccccttgtatagcaccttgcatttccctccagatcacgtcccaaaattataatgaatatatgtttgcatttggacaatggcctgtttcctccactcaggagtaatagctacttgaggaaatgccttggtcatcaaaaagtgtctggctcctagtaggtactccacaagcagttatcaaataaaattgtaaaacccaggcactctttatggtcctaccaaaaccagtgacttgaatgggagatatttagggtcaaggaagaaagaaggcaggcatgttcatatttatttacctcctgtgggtttgtgatggcccctccttcttcttgggctagagtcagagccactttctcctaatcccctataggttaagctgagtaggtgataaagcccaagtcatagtagcataagcacaaggaattctgattatgttaagaaactgaaaacttcaggagtggttttggctattggtcattgctgaatctaagggtttgcataattactgtagggatgtcctcagtccgtggattgttttgactctctttggtgtcttggttttttgttgttttggtttggtttggtttgtttgtttgtttgtttgtttgtttgtttgttttgagacagagtcttgctgtgtcccccaagctggagtgcagtggcatgatctcggctcactgcaacctccgcctcccaggttccagtgattttcctgcttcagcctcccgtatagctgggactacaggcccatgccaccacacctggctaatttttgcatttctagtagagacagggtttcaccatgttggccaggctggtctggaactcctgacctcaggtgatctgcctgcctcagcctcctaaagtggtgggattacaggtgtgagccaccgcaccccacctggtgtcttgatttttattgctccttgcatatagtcaatggttctgagatctgacaggaaatgcctgatggaagagctatggcccatgcaggatctcacttcagaccttaatccttaagtttgtgtctgggaagatggggtacttgattggcaagatgctcgtcacttcttgctcacctctggatgtcaatccacaagttttctttggtatcttcactgtatgaaaaacccaactataatattacactcaagtacacacttataggagcacactttttatatagtttctatataattttcctaccccatctgtcttaggtcagatttcctagggataatgccatgcctgagatgggtgcaagtggtgaattgaaggaatgctctctggacaatgctatagggggtggtggtaatgaatcaggataaggcagaggaaggtatggtttcagggggaaacatagcctcagcctgatcttgtaagaagatctggattattcattgtgccaaggattatttcactgagtcttatccccaccccgtttcatccatctgtctttggccacaaggtgtcccccaggaaggggtggtagccgccttaccccttacctccacctttactccaggcatctctggctaaggtgaatcatgccagccaagtccaaacattcagagaagaattcaggttgtcagcagttagctgcaaacacccacgtcagcaggaagatggttcatcaagctagggaggatggctgaggcaccagctttaaggagtcatagaatggcctggtgtggtggctcacacctgtaatcctagccctttgggagtccaaggtgggcagatcacctgaggtcaggagttggagaccatcctggccacaatggtgaaaccccatctctacgaaaaataccaaaattagccgggtgtcctggtgcgtgcctgtaatcctagctactctggaggctgaggcaggagaattgcttgaacccaggaggcagaggttgtagtgagccaagatcgtgctactgcactctagcctgggcaacagagcaagactccgcatcaaaaaaaaaaaaaaaaaaaaaaaaaaaaagagagaaagaaataaaaaatagtcatagaatgagaaaaaaatctgaaattagagggattgctgtataaataatgacctctgcttgtattttctgagtagttccaattttacccagtcccttctgtctccttagtcttcagcctgaatctcttgcttacctcccctaatggccatatggggaacaggattttattaaggaaacctcgaaagggttgacacaagagtcaaacccccacacctttagatgcataggcagtgaaaccaacctgtacttcccatcttcttgcgtttccatttatccattcctcttggggtccagggtcatagcctctctactgtacctccaacgggtgccactacagtgtctggattctcgatcaccacctcccttttcagtttactgatcaggcagtttcggagaccacgccagggtttcatgtgccccggttgaggcatgaataacagcagtttgaattctcctttgtaattctcatccaggcaagtcactcttttttcctggtataaatgatcagatcgctgctgcagactcatccaggattcctctgccttattgtttttcaatccgtctacttccacgatcctctcttcccaccctccttgccgtcccctgcagccttcatgtctgtgcatacataaataaggctgttatgcacgcatgtgagaatatatacccatcatggtactgtgtgagcctgtgtacgtgctgaggaaatgtaatgggctgtggttgtgtgtttgtaggtgtataataagtttgccgcagactagggggataaatagagccatttgttgattcaaaccaatttttttttctcttgagttagtatccaatctgtagctaagaactgctgactacagcatatttccaagtgtggattttttttttttttccctgacagccaagacctaactcttgcctgatctatgtagatgcattgttcaaattacaaagcttaggtgacagaattgctctttttactgggagcccccaacacacctgtcatcagatagaagggagaatgcagaagtcatcactttacttagaaactcagcagatgattgaaattatttcttactactaattccccttttagtggagataagccgctttgttcagctgtaaatgaaacattagggtattaactgtggagccagaagtattggggaagctaagattttatctgcagtaagaacattttgggcaataaattgttttgttggacggaatactaaatctcttgagttacaaagaagcagagctcattaaggggaatgcttaaagcagaaaacaaggcgagacaaaagcttattacctttgttgtggggattgagggggtgtttgcaggttctcatgtatatgtagcatggaagacttatgcagtacagttattaaatagatgtgtctatagacttgcaaatgctctatgaatatgtccaagggacaaatacatttctgaaatatcaatagcaatctgcaataagttatgaattttggcgtacatatttaccctcaaagactagatttttgtttcctgcgggtgaaattttcccgtctctttgccacatccttcagattaattgactggcatggttacataaatgtttgtaatagagaagagtaagtgccagggttatccaaaatattgtcgcaaaatacacacctaaattaagataattatgtgttgggagcatctatcggcagggcttggcaaggaggggagctttctcttgatggagaggaggctctttctgggacactgaattcatgaatggtgggttctggattccccagggtgctctcagcttgtaagtgtcaggggaggggattgagggctgttcttttgccaataaccagggcggaaggaggacgagaggaagaagacagtgccttcttttccctggagttagcaaccctctgctgtgtctccaagagcaaggctgtggcagtacaactgtctacctgtctacaccggctgctccttcttgcctttggacagaagatgacactcacaaactgtggcccctgagcaacagtgtaaacgggcatacctcagttacaagcggattcaaatgtaatgagaacaatttcagagctatgcattttattcttctgtttttctccctggatgactcagggcatcttttcacagactcccaccctgaaggtttttattgccatttctgcgcttccctacacgtcctgattcataagtggatgctcaggacacagtcactcagagtagcttaatactctgcggacctcacgtgctgagttctcattctggacttaacgttactttaagctcagtttgtacctttccttggttctgtcaatggaaataaggacaacacttctcaaaacacagcaggtgggctgagagtggtgacttacacctgtaatcccagcactttgggaggctgaggtgggtggatcacttgaggtcagaagttcaagaacagccttgccaacactatgaaactgcatctctactaaaaatacaatcaattagccaggtttggtggtgtgctcctgtaatcccagctactctggaggctgaggcatgggaatcacttaaacccaggagacagaggttgcagtgagcctagaagatgccactgcactccggcctgggctatagggtgagactgtcaaaaagaaaaataaaagaaaaaaagaaacatagcaggaaggtagcagtggacaaatgaagtattggaaacacatagcctacacattcatgtgagctttaggagaacgtgaggtctaacttgcttaaagaaaacttagcacatgaaaaatgaaaactatttttttcagtgcatgagtgatcatgatctctttaattaaaagtgcactgaattgtaagatcttttaccaaaatgttaccatctttatcttctatctctggtgctgagtgtagtaacaggaagagatttcgaagtgaagactttagtaagatagaattgtgtgtattgtgtttaaatctggggtgtatttaaaatgtaattgaaatcacaagatatttaacatgctattcactttgcaagtgacttttcaggaccacttatctgcagactgtaggacaccagtctatgaacgttggcttataggagcaccaggtctccagttgagttaattcctcatacttgtcacatagggggcatactaagtcttcctgagatgagtagaaacatagatccacataaaaatgaaaagaacccactggtgacagagggtctcagagcctccagtttttttctgaactttgaaagtcagtaccaaagagtcagaactgaatggaaggacactaaaatcaatacttttcaatgtaacatcacaagcgttgggactctgaagaacttgatgacacatgattcagaagcaaagtgatatttacataggaagactgtcctcgccctctggaatgattttgacatgtgtattcactcttagttttggctcttagagtttaagtaatagatttacggtggtatgaacacaggtgttaaagagttctgggttcaagtcttgtccacgtcccaagctgtggaactctgaataaacctcttagtctattggaaccttagttttctcatctgtaaaacagatgaaactacctgattttttaggccctacttggctcttaaatttctcggctcagtgaacaatgcaagctttatgttataaaccaccaagacatctaagcttcttcccttacggccgttagtggattaagcgatatcctcagagcaactgtttggtgatttaacctcccccagttgctctatttcctgggttgttcatgagtaattgataaagaatttgcaacactaggattccacatggaagaaggaaatgcctcttttggacccatttcaaacaagcattggtaggagatgcctcagacgcttatgcttaaagcatcagtatcattgcctgacagcttatcacagtggcaggagcatagggttgaatcttatgtttttctttccctctgggtgacacttacaggatgcttaagtttgctggacctcactttcttcatctgtaagatggggacagagaactatctcagtgttacagaaaatttgaagatgaggctgaagatgtaagattttgttaatgtctacagtgttaaagaatctcaatatatggtggctatgattattgctattcttatattaacttggtgataggcatcagtggttgaattatctggagaacccagaaaacagaacagatcttgcaaattcagtcgcttacccagatgttagttgtttgatccccagtgtgacaaatgccaccttcaatctctctaacatttctaggcaagaaattattctctcaggagactgccagagaggcaattttgagcttgaaacttattgatgtgatgggctatgaccaggcaacttccgtagtcggggcatgtgctgagtctgactacagtctgactacaaatcccagctctagccccatgtggctgggggccagctattttcattgtggggttagactccctggagggaataattctgagatgacccttttaaaatgtaatccttgtactaaagtggggctagagggttccctattcattcatacggctactgtaacaaatgcccacaaacttggtagctttataacaatagaaatttactctcttccaattgggaggcaaaaagtttgatgtcaaggtgtcaacggaaatagtagacactaggaactacttggggcaagtgttgagtgactgttgggtactctgctcactttgtacctcaaacctcagcatcacgtaatatactcatgtaacaaagctgcacttgtacccccgaatccaacatgaaagttgaaattatatttttaaaaagcaatgtcgggccaggtgcggtagctcacgcctgttatcccaacattttgggaggccgaagcaggtggattacctgaggtcagtagtttgagaccagcttgaccaacacggagaaaccccatctctactaaaaatacaaaattagccaagtgcgatggcgcatgcctgtaatcgcagctacgtgggaggctgaagcaggagaattgctttaacctgggaggcagaggttgcagtgagccgggatcagactgttgcactccagcctgggtaacaagagcagaactctgtctcaaataaataaataaatgaataaataaataaaaataaaaatgcaatgtcagcagattggctccttatggagactttggatactttgagggaaaatccataccctggctctcttttagcctctggtggtgtctgtcaatacctgacatttctgggcttgtagatgcatctcgtccatttctgcctccatcttcatatggcattcccctctatgtcttctgttctgtgtgtcttctaagaatttgtcgatggatttagggctcacttaagtttaagatgaccccatatcaagatcttttaacttgattacatctgcaaagaccctcttcccaaataaggtcatagtcacaggcacgaggggttaagacttagacatacctgttgtggggacaaaattcaatctactgccattttattgtgaactatccttgcatggagaaacagttcattttaacttagaatattcaacaacacaaagctaacacttttctgtgggcgatgactatgtaccaggcattgtgctaattgataaagggcattatattttaaagttttatcttaacaattatatgaggtagggattatggccttctctgatttattgatgagaaaattgaccctcaggaggggaagaccatttttcttagtcacccaactaagaaagtggcacagttggtatcctaatccggaattttctgattctgccatttatgctttgaacaattatgctagaagttctcaaattttgtcatgcataagaatctcctggggttgttaaaattgcaccttccccaaagctcccatctctacagagattccgattctgtaggtagaggggaggggcaaggataggcattaaaaataactgcattatgcaattctgccccctctctcctcccactgaacccatctttaaggaaactgcaacctcagcacaggggctagcagacatattcagatcatctctgaagacagaaatcctcaaaagtgaaaaaacacaagaaagtccaggttgcttttttttaatttaaatttatagtgaaagctaccttggcccacagctttctccctcctggtcccttacaaatatattcctttccggattcttcaagaacacagtttgtattaccatctcccagcaagaagaaatttggaaataggtggtattgctcctaaccccttcctaaatttgagtctgctcattcttcagccatttggaggttttccacttggatgatgtccacagagctaggggaggaaaaattcttctgcaaagcacagtggatgaaccatcagtctgcagtaatccagtcaattaaaaatggatttcagttcccagcagcatggtggtgatgttaggaggagtcagtgtccacaatgctgttggtgcgcttgcccattaagtgatatttaggggatcttctgccatagcagaaaacagtgcggttgatgatctttgcaactaaagaagcaaaattgaagtctcacataccaccacggtattttatttctaatatgttaccctgccaaccttggaaccccgcatgaaactcaggaatgtgaagggacagaagtatgatatattgcccgatgcagctgattcgagagggggtatccaaaatacagtcccaagacatccaggagaatttgcctgaagagagggaacatgtaatggtattagaaaatccagaagatctaagctgcctgatgaagctattttttaaaaaatgtatcttcattgcatttatttttcatcacacagtagttggcgtaaaaccattctctctgtgaaagaagtcaaactacaaataactatgcaaaaatatatagagaaaaaggtgaagcttttcatattttaaatagcatctgaattacattgcttctttcaaggaggtaaactttgttgagtatttagcagttgttccagacttttctctgataaactttcaacttcaacataaaataatgataggtgttttgggaagccatagatgggatggctgtatggatcgatagctagatggctaaatatgttgatagaccctcaaacagattaggtaggtaaaaaatagaaaaataaaaagatagaaaaatagttaacaatgcaagcctctgggcagaagaaatttttccctatgttgtttatgctctgtgtgattctggcaataggtaaatgcattgattagcttctttgaacccacttttcattatctatcaagtagaggaaaacagtgtctttgttgcttgcctccagaattgaggatgacagtgaggtaatgaggaaatgtatttgaaaatattatggactcaacagacatattggcacaactcaggagatgtcataggcccagcttctataagatgatataacctagcacaggaggccaaaagagtttccaaattgcataaaggaaacttgattgtcctttaaaaatggctctggagaaattttatacccaggctcatgtcatctctcagtgaggttaaatctccaaaagaggaatgtcatctgttaataatacatcaagcatgcagcaggtagatgttcttttccttccctttaaaaagttatttttattttattttcatttttaatgtatattttaatgatgcagagtgtcatgttcctcagagtcagactgtatcctaaagtaatggtttggttaaaatatagaatggatttttgccaaattgaaaaatatatatattgtgttataaaactcgagctgtgatgagcaactctttgaaaatacatttaagtactcactgagtcttgtctgaagactcacctgtaagggagggtcaactaagttattcagtcccggacgttgttaactgccctgaaagtggtggctaataatttccttttgaagtgaaaagtagtaagtatgttcctgaactccattatcaatctttaataatttcagattaaggcattgtacttctatacaaaggaatatcatctttgaaaagtggtcttaaataaaatttcacaaataatagtatcccatcctcttgcatttgagaatttctgccgagagataggagaaaataaagactccttgctgctgtcaggaggtcatcgttgggaacagacttcaaagtatgtgaactttggtagtggaaagatgattattccttggtttccagatccttatgcataatttgaatatgagtggctttcaatgctaagtatatgagactcccctctgttaattatgctgtttcagatgagcctaattggacagccactggcacctaatatggtaaatatttcatataacgtgactttgagaagaagggtgcccccctccttaatcccatttgataggatggtgtaacctcaacagcagggatagcttaactctagaaagagttgttatttatctgagggcacctgtaagggggacatcacctaactcattcagtcctagacattgatgcctaaagtataaactgtggtctatagatgtaggaaggcttggaggcaattctagaaacactgcagaaaatttgcagtttctcctccaatctgatcttgaaggaggaggtgaacctggaactccccgttcacgatgcagttgtggaataaaatgaggcttgatttctcctggattatctgaccacttctttttattttcccccggctctatgggggtacaattaacaaatataaattatgtacatttaaggtataccatttgatattttgatatatgtatacattatgcagtgaccaccactctgaatccagtgaaggtatctatcagctcagagttccgttttttggtgagatcacttagaatctagtctctcagcaaacttcaagtatacaatacagtatcattaattgtagtcaccgtgctatacattagacgtctagaattcagtcatcttggataactgaaattttgtattctttgactaacatctccccattccctgctcccttcagcctctggcaaccactcttctcctgtctgtctattcctacgaatttgagtgttttagatcctgcatgtaagtgagatcttacagcgtttgtctttctgtgtctggtttattttctctagcataatgtcctccaggttcacccatattattgcaaatgagagaatccccccccccccactttttttttgcccagtctggagtgcaatggcacaatctcaggtcagggcaacctccgcctcccaagttcaagtgattctcctgcctcagcctcctgaatagctgggattacaggcacctgccactactccatgtgaattttgtatttttagtagagacagggtttcaccatgttggccaggttggtctcgaactcctgacctcaggtgaaccacacacctcagcctcccaaagtgctgggattataggcgtgagccaccatgccggggctccttgttttcttaatagatgaataatattctagtacgtacataaattttaattaaatattattcttttatatatatatataacctttttaattcattcatttgttaatgggtgcttaagttgtttttattattgtgaatatgccgcagtgaacatgggagtgcatatcctgatttcatttccttttattttattttattttattttattttattttattttattgagacggagtctcactctgtcacccaggctagagtgcagtgactcattctcggctcactgctacctccacctcccaggttcaagcgattctcctgcctcagcctcctgagtagctgtgattacacgtgtgagaccccatacttggctaagttttgtatttttagtacagacggggtttcaccatgttagtcaggctggtctctaactcctgacctcaggtgatctgcctgcctcagcctcccaaagtgctgggattccaggcataagccaccgtgcccagccgacataggaatttatttagtgtcaccttgtaggtcactgacctatcagggacaggcctccaagcttctgacatccagtgatagcttcttagaggtgaatgatgacggctcctgttaacattttctggcaggcactgcgtgaagcacttggcataaatgacctccatagataggtgctattatcatttctgcttcacagttcaaaaagtaaaggcttaaagaatgtaaataatttacacctgagtgaccagtacctacacctcagaagagaccctgtctctcagtcatgctgtgctgccagcgttggaaataggtagcaagtctgtggatattaaaagaatgctttttcagaaaaaacaaacaaacaaacaaacaaaaccgaatgcactttttaattatctgattccttgttgtcacgtctttatcaggtagaatgcacaataggttatcattcccttttcactgacgcagaaacagatgtgggctctcctggaatgtgttatgaattgggtgaggggtgccgttcaggatggcgttcctgggtcaatggattttatttccagtgagtagatatgtgggcgtaggtcctcgtttctcatgtctactccctctagtagagatgattttactccacagcaggaaagatgcctgctacaccacaaagggtattatttcggttacggtaataacgcataagggtgtgttttcaaagctgggcagtgcatgcttgccaggttgcagggtgattcttgagagctttctgggcccatcctagagaaaaatctccagtgaggctgcagttgcaatttatttcctcattctagcaagaaagctcttgacgatacagcagtgtttgttttctgcttggtaaagtagaaaggaaaacagcagaaattagcacggcgcagcgctgatgccagcccagaggcagggcctctcctggtagcccccccgctgcaaacctttgccgctggaaagccttcagctgcgatgagattagcagatgcagcagttcactccaaggcgctgtgcagttttttccctgttccaccaggtgttgccagagaacattgagcggagctgagctccgggcgaagtgtgttcccagctgctctggaacactcgggctgttctgaaggcagcaattaaatgagttatgctgaccggagcaaccctcttccttgcacgtttaaatatgcctcccgtgtgcgcctcatgcctcacatttcaaataaacacatttttgatgtgcctttggatctgctcacacattgttatattggaggaatcagagcaagcaaggctgtgcggatccaggctgcaactcaggtcccagctgcacctgtggtcagccttccctgttaccagaaagtggacagtaagcttggatgacacagagggggttctcagtgctagggtttttgcctggtaagtaaaggtagttccttctaacacctgtttcctttccactcttccatacctggagcattgagatcacagtcctaggtctgtgattctcaggcagttgtggctctgtgtccccagggtgcatttggccatgtccagagacatttttagttgtcacgactgggcagttgagggatgcaactgacatcgagtaggtagagcctgagatgctgcaattgatcctgcaacacacagagcatatcccccacaacaaagaattacctggtttgaaatattggcaatagtgaagggaaggggagaaaccccattctggaggtgaaggctttcttggcaagatacccgcattgcccaaaacacagagtacaatctttgaaactgtggtttttccagaaaacctcatctagatcatgacacctaaacatcatgcctcaccaaggtaacatccccaccaaggattaaagaagagttgccatatgccatgggcctactatgtgccaaataccttgttcatacggtttctaatccttacagaaataatgttgagtgggattactgcactgcgttatagaagagtaaaccgaggcccagagctcttgctttccttgttcagaatacctggctactacgtatgggagccttgttttcatccagtcccttccttttactgtgtcaccctgtggcccagagggtggatggatgtgggtttccaaaagaaaacctactttcgaatcttgcttttgagtggacagtaaattagagagtgatgcaaaaacatttagaaggaaaaacaattaaaaaatacaaactttccggaatccagtgttggcctgcctctaaaactctctgccttccaaagtgaccacgcacccacatggcagattgttacctgacaccttctgagtcccttttcagttactgctttggcaaattactacaaattccgtggcttacaacatcacagagtgactctcttagcgttccagaggcaaaaagactgaagtaggtcttactgtactaaacttgaggcttctgcagggctgtttcttctggaaatctaggggaaagtccatttccttgcattttctagtttctagaggccacctgctttccttggctcatggccccttcctccgtctccaatgctatcagtgtagcattttcaaatctctctctgtctctgcctctgcgtttgtatgtcctgtgatctcttaaggacccaagtgagtatgctgactaaccctaagataatcaaagataatctccccatctcgagaccctgatcttaatgttttttattttcataggtttttgggggaacgggtggtatttggttacatgagtcacctttagtggtgatttgtgcgattttggtgtgcccatcaccagagcagtatacactgaatctgatttgtagtctttgaatcacatccataaactccctcttgccaggtaaagtgaggattaggacatgagcatgtttgggagaaggatgttactctggctaccacaggtagtttagagctgccactgctagggataatgggaataaagtaaaggaaaagcatagaattttgacttcaagggatttgtatgggtgtgtgtgtgtgtgtgtgtgtgtgtgtgtgtatgtgtgtggtgcagagaagaatggcacacagcaaaaagaagccatgatactaattattctcagacaggtatgattatcatcaatcatatgcatctttgtatccccagaggctgctatgttgcctggtaagtggggtggtaggggcacagtttgtatttcctgtgttagtttttgtagggaaggtaagagcagtgttcaatagaaatacagaagaaagactgcttattatagcaaccaaaatatggcagcatacctattatcttaattgccgttaacattcaccttaatacaatgctggttgatatgcagaataataacctagagactgtgcaagtcttcacagtgccttctgtatcttcatagattcagtctattccattacactctggtgttgtacaggttttcatatttcactgggggtgggaaaactatggccctgggacctaatctggcctgcggactattttcctagacagaacattatgggaacacagccatgcccatttgtttaccaatcgtgggtggctgcttttgggccgcaatggcagaattgaataatcacaatgaatgtatggcccacagtgcctaaaatatttattccgtggctctttacagaaaaaaagaaactgataacccttgctttacacaactggatgctggcaagctcccttagggaggacagaaaggttgattaaccagaacacaacactctcacaacatgggggtcagaacatacacattctttgaattacagtatttgtgacaacctcctattgaacgtcttactgcaaataataaaagtctcaagttaagggagactgacactcaaatcatttagatttttttttctcagctatgtttagtgagataaattgtgcttcactgcagtgacttgtagatgacaatacagcagaagaacttttaatacggcgactgtattcattttgaaattttaaaaaatgttagactgtgtctgagcacagtaaaccattcaaaactgtcactgcacagagatgaatgggagaaacagtgcatctctgaaaatattccgtaaatatccttaaattataacgtctgtttgatctgctgagaagtagctaattcccgacacttttcatctctctagactgcccatcgattgtcctgagtattgcgattgctgttcctgataactgacttgataatttaatttaataagaccttatcttggtctagaggagcaatcaaggctgctatctcctacagcacgtttctccaccattgacattttaggccgaacatgtacttttttgttataggtagacatcccatgcattgtaggatattgaacagcatccctggcctcctatccactttatgccagtagcatcccctccctccttgttgtgttgttactaccgaaaatgtctccagatactgccattgtccctaaggcatgggggcaggggggtggttaacatattccccagataagaaccattgttctagaggtatggtgttggaagcgcttggcacctttcatgtaaatcattgcatgttgtcatcccaggtgaacttttcttcttttctttttgcatccccgcccgtcaattcttcccctactttctcctgggctgggcttttcttcatgtctaaatgcactgcaaagacgagattgccttgaactcctccagcttttcccgataaccctgagctgcgctgtcgctctaagccagatcagcagaatccggcctgtgatcaggttccgggagctggaggacctctccgtctcaggctgctgtgatcagagagtctggagaatgagaatctctctgatgtggtcttatcaggctgagcctaatgtcaaccctgttagaggagctttgtccgatctgcctgtagctttgttctgaaccgttcagtaacagttcactggagcagaaagagccctgtgaattgatattataaacccacatgcctgttttattcattgtggaggcaacagaatataacacaagtatttatttttagtggttggagaatggcatttctttccccgtccccattgtcacagaatgcagaaaacagcacagggctcctgaacacaattctattagaaagctgttgccagttgttcctggtttcgattattttgcactatcctaagcagtgtatgtctgtgcattgaatatgtatgtgtgcgtaatacatattacgttcgtttggatggtcttaataaggagccacataccatcagatgtaatccaatcactataggccagaccttctatccttggctattcccttaaccccatcaccaccttgatttcgttggaagttagattttctagaaaaattcatgaaacttcaacatgcttcattcattccttgctctgggcattccttgctgaaggtcaggagctgtgaaatttctctttagtcccattgctttgatatggcagaggctgggcaatgaagaaattgaagtgtggaaaaatggagttccggcaatgtcttaaatgaggggaggggtcttatcgaggaggctgtgcctgtggtctgagctgacatttctctaacagtgagaccaggaagaggaccaggggacacagctggatggctgcaataccagggtcccttcagctgcaattaaagctgcatcttacattggagtcttcagtgatgatgatgatgatgatagtagtagattgaacataggaaattgctgtcatttgacaattgttaacctacataaatgtcactttcctacagcgcaacttaataattgtacacataatagctcatctgcgctgggtgaccgctatggtccaggcacagtgctgtaggcactgcatatgtgttggctccttagaccaacacagccactgtctattacagatactgttattgctctcacttgacaaataaggatgctgagctgtgggaataatttgcccaatgacactaaatggcaaaactgggattaaaacccaggaccttaagactgcagcctcggctgagcgtgatggctcacgcctgtaatcccagcactttgggaggccaaggtgggtggattacatgaggttgggagttcgagaccagcctgaccaacatggagaaacccggtctctactaaaaatacaaaattagctgggagtggtggtgcgtgcctgtaatcccagtaaggaggctgaggcagcagaatcacttgaacccagaaggcagaggttgcagtgagccaagattgtgccattgcactccagcctggacaacaagagcaaaactctatcccaaaaacaaaacaaaacaacaaaaaaacaaactgaggtctcttctgttaacccctatcctcctctcttggttggataacagttttagactgatgctcctaattcccacagaggggcctgcattttcatcaggcttgaggatcatgagttttcacgtgtgtgtgtgtgtgtgtgtgtgtgtgtgtgtgtgtgtaaatcaccctaattgtggggagtactaataagttccatcgatctactcttcacctagtaatcaacttgaattatttatttatttatttatttttcgagacagagtctcactctgtcacccaggttggagtacagtggtgtgatcttggctcactgcaccctctgcctcttgagtttaagcaattcttgtgcctcagcgtaccgagtagctgggactacaggcgtgagccaccatgcctgaccaatttttgtatttttagtagagacggggttttgtcatgttggccaggttggtcttgaactcttgacctcaggtgatctgcccttctcagcctcccaaagtgctgggattacagccaccacacctggccaatcaactttgaattctaagaatgggtgacaaagaactttgtcttgagggttgtgtgttaagcaagagccatcaggtctcatcctcctcagtttagccacaattccacattagtttccccgacagtgtatggaatttcagttctacactcttccttctctaaatttcacccggtctttcagagaggagacagggccctaacagacttagcaaagatgttgaacacatgaaaatgggaagtactgtttaaaaatggaataactcttttcttcccccaaatctataaccccagtctaattgtaagaaaaacatcagtcaacttccagttgagggacatcgtgcaaaatatctgactgtcaaggtgatcaaagacggggaatgtcaggccaggcgtggtggctcacacctgtaatcccagcactttgggtggccaaggtgggtggatcacctgaggttgggagtttgagaccagcctgaccaacatggagaaaccccgtctctattaaaatgcaaaaattagctgggcgtggtggcgcatgcctgtaattccagctacgtgggaggctgaggcaggagaatcacttgaacccaggaagcagtggttgtggtgagccaagatcatgccattgcattccagcctggacaacaagagcaaaactcctttcaaaaaaaaaaaaaaaaaaaaaagatagggaaaatctgagaaactatcacagacaagaagaaacttcagagtcacggccgcccagatgccatgtggtgtctcagatgggatcctggagccgaaaaaggacattagatgaaaactaaagcaatcgaagtataggctgtagttaatcgtgatgtattcatagtggttccttagttgtgaacatgtaccatgctactgtaagatgttaataatagtgaaaattggctggacaccgtcgctcacggctgtaatcccagtactttggaggactacctgaggagttccagactagcctggccaacatggtgaaaccccatctctactaaaaatacaaaaattagccaggcgtggtggcgtgtgcctgtaatctcagctcctcatgaggctgaggcaggagaatcacttgaacctaggagctagaggttgcagggagccgagatcgcaccagtgcactccaggctgggcaacagagtgacattctgccaaaaaaaaaaaaaaaagttaataataggggaaattgtggagtacatggaaattctctgtacaaacttcacaacatttctgtaaatcgaaaagtatgctgcaattaaaattttatttttaaaaagggaaaataaacataagcccacacaaaaaatatggactaatcaaatactttctagatttcgtgtttatagcgtttctcacttagtaatacaaagcattctatcttagatttctcccatgtctgttagactcccaaaggcttttaccccatggtaaacagcataaacaaatttgtatggcttttttaaattcagattttcccaggctgatttaatcatggaattacgactgggcatggtggctcacgcctgtgatcccagagctctgggaggccgaggcaggcggactgcgaggtcaggagatcgagaccatcctggctaacacggtgaaaccccgtctctactacaaatataaaaaattggccaggcgccatggtgggcgcctgcagtcccagctactcgggaggctgaggcaggagaatggcgtgaacccgggaggcggagcttgcagtgagccaagatcacgccactgcactccagcccgggcgaaagagcgagactccgtctcaaaacaaaataaaaataaataaaaataaaaataaaataaaaaataaaaaaataaattatggaattattttacttgagaagcagtgatggggaaaaaaaatgtaggtcacaagcctccctgatgacaattcctttcataacaccagcttttcccaggacacaccattgagacaccttgacatcactacccagaagcattggtaacctctttgtgcctcaacactgattctcgcctgtaaaccattcctctcccctggccaccctcctgcatctgaccccctgcctcccttccccagtcttcctctgtagcaatgggtcccacacatccctgaatcacttgttaaaacctagatgtccagccttgacccccagagttcctgattcactgggtctgggatggggcccagaaactttgcatttctcacaagatccaaggtgaggtcaacactaccagcctggggaccacactttgcaagccactgagatgccctctgtctccttgtaaggctgccatccattccgccatagattccacgctttgctgccacccccctgccccctgcctgcccctttgcttgtcctcttgctattcccaggcactggttgcctgttttctaacataaatgtcaaaaaagtattcctcagcgggtgtggcattcagaaatggataggattcaaacaagcaaagggggttacttggtttaagagctcagtttaatgacaagagtattttccttgtagctttgtagagctggatcccaggtacctctcatgaagcccatgaacttggtttctaccctataaattgaggttgatgagactcatcactttggcttttgcgaggattaattggatttgcattcgttaagtgcagagcctggcacattgtaacagctcattagtaattactttccaaactccaaggagatggttctcagatgttggtgactatcatcacctcctgcagagatgtggaggtgcagagtcctgaccctgcctccaaagactcttactcatcaaatttgggagtgagataagaatctgtacatgttacaaagaaaccagaaaatcccaattcaaggggtctacagacaatccattcattcgttcttcacttagttatccaacaagtgtttcacatacacttccatgcaccaagatgggattgcaggtggtagggatacagaaatggacaaaaccgagtgctcaccttggtggagatgattggcagcctgccttacacaaggaactctatgttcactggccaggttatgggaagtggtacaaagttggagtaaaagtaaggtaagaagatagattggtggtcaaaagtctttctgagaagattacatgagaggaaagatggaataaaggaagaaaaatattgaaaaatcttcaattaaaatgtgattctttctaatgtgagccacagaatttaacacagatctgtagtagtcatcttgagtgtttttcttttgatagaaaagtgtgactttccaaccaatatagtaggaacttgttgaaggtctaccatatcccaaacacaatgtttttcaaatattgtttttattttattttatttatttatttattttgagatcaaagctcactctgtcacccaggctggagtgtggtgatgcgatctcagttcactgcaacctccgcctcccgggttcaagcgattcttgtgcctcagcctccagagtagctgggattacaggcgtgtgccaccatgactggccaatttttgtatgtttagtagagatggggttttgccatgttagccaggctggtcttgaactcctgacctcaggtgatccgtttccttcagccttctaaaatgctgggattacaggtggtgagccacggcgcccagcccttatttctaatccctgtaacagattatgcaagggaaggtgtttcatcccaacattacagatgaggggagttgtgaggagcttatatgatcacatagtgaatggccaaagatggctctttctatactctacagcctctgacatacaaagattcagacttcatttccaaagtcattagcagtaccaactgtaatcctcttaaggaactaattattttgttaccattttctgtatttattatattgccatgccccatggcttacaatcctggctgtgccttcaaatgtcccagaggcaggaactgagtgtctggggtattaaggttttctcagatgatgcatctgatatgcatccaatgacaggtaccactggctagcattataatccaagataaatccatatcttctgcctgtggaaccagatggagttctggtatcaaaatacagatctagagggtagctctgagccagtgcacttgaagtttgtggtcatgatgaacttcaagctcatgtaagagattactgaatttcccagcaatgagtaacggaccaacctatggagaaggcagacagaatggcaatgtggaataagcacaggccctggcatccaaactgggtttgaaacccacctgtccacttttctggctttgtgatttggggtgacacacaaaatttataatatacgtaatattattaagaacacagtaggttcccagcattgtattctctgttctctctcttaaaagtgccaccctctaccaagaagcactagttgaattccaagaaggcaagaaaagggctaccatttcttctctacccagcaatggttacgttaattttccagtgcaggaaagtggaagaaaataagagtatatatatatctttccaggcccttctttccaaagttatttgactctaaacttagcatcctctcccgggaagatggaactgtcctttttgtgcatttgctgtgataactttgggcccagttacgcttgctacgaagcttgggctggtagtggtttaggagaaaaaaaaatcaagtgaaacttaggactgtcttctctcttctttcccgaacttcatctttgcagagatgatctcctctttgacatgcagagtactcaggcctctttttctcttcttgtcctttctttcttattaaacctccagccccccaatctgaaacgattgctcccattttgtattccatggagctgtaatatttgcccaatgatgagctccattcagcagtttgttaactgaaatgggaagtgacagattcaataaaaggaaatctctgtgccaaggaaacagatattatttctcccctcgctctccctttctgtgtctctcagactactctgtgcccggaatccagagactctgagcttacggacaagtcaaagctttctgttgatccatgcccaactaatttgatcagaatagaggtttttattccctgtagttcttctctctcatgcttactgatatgattgagtgcctgggagtcacccccaacctctgctgattgttagagggaggaagtgatgtacaggaaagtgggtacatggtgtgctgggaggggggccttgtagacaagatggggacaattgtaaacagaagatcggggctaatgtaaaagtgcaagatcctcttctggggacagccttcttgtcttcatggatagtgcatatagaaaagcacccacgattcccagtcattgaaaaccagaggaccccagtggcaatggatacccatttaatctctgagaaaatattaatgagtaaaaggcaagcgactttagggatgtttttttttctttccacatatatgtggacactagttgtgaataataatgacaatgacgatagtgagtagatatcatgtatcaactccctactaaatgccaaggtttggtctatgcacgtaacacatattatctcattcaatccccgacaacaaccctctgaaggaggtgtccttattatccacattttatagcagaaaactggggcttagagaagtaatgtgtccaagaactcatagctggcaggtaggagccctgagattccagtgtggggctcgtaaacttacactttgcctaaattttttttaaatgattgagttcattgttcatttatatttaattttaagaaatagcacaaagagtccgggcatggtggctcacacctgtaatcccagcactttgggaggcggaggcgggtggatcatctgaggtcaggagtttgagaccatcctggccaacatggtgaaaccccatctctactaaaaatacaaaaaatactggctgggcgtggtggtgtgtgcctgtaaccacagctacttaggaaactgagacaggggaatcacttgaacctgggaggtggaggttgcagtgaggtgagattgttccactgcattccagcctgggcaacagagcgagactctgtgtcaaagaaaaaaaaaaaaaagagatgaccccatatcctgttcccccagtttccccagtggtaacatcttatataaccaaagtacaccaccaccaccaggaaactgaccttgatccaatgcatccgccttattcggatttcaccagcttcacatggtattgtgtgtgtgtgtgtgtgtgtgtgtgtgtgtgttcacttctctgcaatgtctcacccatgtagcctcctgtgatagccaccatagccaacatacatcatagctccatcacaaagatcctaggctctactctttcgtccctgcagtgacctccctccctgctccatatctcaggaaaccttaatgtgttctccatctttataattttgtcatttcaagaatgctatataaaaagtatgtgaaaggcttcatgttggtcaccctctgtgcatgtgtgtggttgcagaattagtcctcacacagagcttgattgtctacttcacttcttgacgcactttcgttcctctgtcatctcccatctcccttttcctgcagatgtattgggttgagacttctggattaggtaccctgttggccctagtatgcagcctatcacccaatcaccacaaccaccctcatcccacagatgggctccagatgtcactgtgtggaggtcctctatagattttcagatcacattcagtcactggaggccaagacactccctgtcactctctgcccaaccctccattcctaacctcacctctcccccacggccaacctaggtccattagccatgctgagcttgaggataagaggactagtttccattgctggtccatagtttccaccccagaagcctccatgccccatactggttaaaaagttattgcagaagaggtttgccagaggtaaaccaggtcttccagagtataccagaaaggactgcatgttgtctgtttgagtgggggacttcatgcccaattttcacagggcaaagcatctcctggtgtcttgtgtggcaaacagctttgatacttgcccatgtcccatggtgtccaggagacttttcattaaatgaggtgaccactgcccctttagggcgtgagccaggcatctgagatggagattacgcattctgtgtctctgcctgacacaacatttctgttttcctgatggcttatctgatgccattaaagtctctacctgtaaatagtcagtagacattgggtatgaaagacccaaacaatatttggctgaactgttcgttgccacagagtattattagattagattggatcttagatattgaagaatttttactcccttacttttgcaaacctggaaaaaaaattgatgctatctgctctctagaactaatactttatggtcttatcctcttttctcctctctctcactgtgtctgtgtctctatctctgtctttctctgtcttcctctgtctctctcacctcttttttctcttctctcctctaaaggaaggcattgactcttccagagccactaagagtcgaggtttttttttgttgttgtttctgtttgttttgttttgtttttgagaaagggtctcagtctgtcacccaggttggagtgcagtggcacaatcagagctcactgcacccttgacctcccgggctcatgctttcctcacacttcagcccctggagtagctgggactacaggtgttcgtcaccacgcccagatagttttttttgtatttttactagagacagggtttcgccatgtttcccaggctggtctggaactcctgggctcaagcagttcacccaccgtggcctcccaaagtgctgggattacaagcgtgagcaccaccaccgtcccccacccccagccaagagttgtttttatcatgtccttagtcttgttggttgctgccttgtccctttacctgttgttcctcttcaatcattgcaacagtgacactccccttagctgggcatcaaacacagacagaagcatattcaattccaggagtctccactgtctctcatctgaatttaagctggacacctcgcttgtgaatgcagaggggccagcatcccactcccgccttggcgcaatgcaaccggcacctttgagggggcagattgtattgtgccttgtcaggcccaccacggcttttgttttcctgcgcatttgaataatacatctgattaccatggcaaatgttgcggcatatgcaagcttggacctcctgcctaattagctgttgataacagggccccctgccctttcccctctccgcagccctcagggacatgacagttcttttatctttcttcaaaattgacttgctctcccgaccctccagtagttcctgttttgtctgtttacctctcctgcattttgcaagactgttaattttccgtggcacctcctatctggttgtaattaacacatcgcacactgaagaaatagttctgctttttccagatgcctaatggaggcatgtccttttttttcttttctccactaattataccactgtattttagcaacctgcattgacctaaaaggatctgttttctttctttcttcctttttttttttttttttttaattgttttggttggaagaataagtatggttttagaacccagtttgggcagaaactgggaagagaatgaaatcattagtgatatatgttgtcactgtttcttttcatagcctttaaagtaacaaatgagggtacatttgttgtcagccttcctgttcagcgtttgacaactctttgttagatgtgggtaacgtttgctttggatatatgctctctctccagtctaaatattctgccgtggtaattatacagatggggcacatgacctattccgtagagtgtggaaattctcagcagattgtaaatagcctctcgtcctattagattttaaggaagctaagcccttgcctcccaaacatgagacatggaatctgtttatcatcttatgcttaggcttaagatttaagctgtaatgaatactggttcaaagagattgaggtataagaaggaggttggtagttacagcaataaaaacaggagcaaaaagagcagcttttgtgaaggactccggctggaataatgatgatagaattgtctaaatcgatacatctcttgtcagactcatgtctgatgtttgaatcaaccaggccttttctgcaagagctttcctcaagaatattgaattatttattatttgtatctttttttttctttccctttctgatgattttttttccttctgacttagtgaaatttgtttttcatgctgccaggttgaatgttgtctactctttgataaatagcagtaattgggcatatagcaggggtcatgtacaaatgtatgacttcaattacatctagagcatttttttctttatattgatcttttttttttcttataagatctgttctctatagcctgtggtactgagtactttaaagaattattctttgtccatgtatgtcagcatgcactttcaaatctatatatcttttaaaatatatatatatatacacacatatatatacatatatatatatacacatatatatatacacacacacacacacacacacatatatatatatatgtagtcctgcgctttcctgaggctgtacagacgtgggaggcgaaattgtgacgcctccacttgatgaaccatacctgactcttttgctcatcttgcagtcttgtggcggtgtcatttctacggttggcttttcttgctacaggttgggccaaggtggagaaggcactggtattgaccaggaaagttgtatgtaatagaaattgtagagcacagtaggagaagaaaagtgaaatgaagtagacatgggaggcagaaagacaaagagagagagaacaacctatgttgtaattgaagcttaagaaaataccatccttggacactttcttgtttctgattttatctaagtatcttctggttgattcttaaactgcatgtatttatggcacatgtatttgccagtttaatggacacttttccatctaggactgtttatattcaggcacccatacgtacacatatttccaagggtaaataaacaccagcctgaatgtttggtgagattagctttggcaatagtgacatttcccaggcacagccaggttttctaaggcaggaatctgaggtctgatgatattactgctctgagcgtacctaacctacagtttgaggaaataaaaggtaggttggaagactgccgaggcccccagttggctgctgcttccagagactgcaggcttactcagtgcttactgtcccatttccactggcctggagatggcctttgccaaagggcagtcatagaaataacaactccacatcattccttgtttggttctgcgtttctgtaccatggcatcgtgctgtcgtcagcagttttctgacatgcaaaataatgatggggcactgaattatattttgtaagggcatgcaaatagagagtgttcatttcttcagcctttttgaaggagaagtgagcccttaaaagtcattttcgggtaggaagtgtacacacattattttatgtcatgcccagtccctaaagccatatctgttccatatttttcagagggagaaaatagaataaaaaccctcagaggctctgagtgataaaggaaacacagtctcagttattatgctgtaggagatgaagctgggacttaaatagacaaagagaaatggagttggctttggtcgagcctgtgattctgggccacatcgtatttctgtgtgtatgtttgtgtacgtgtgcgtgtgtgtgcgtgtgcttgtgcgagtgagaaacacttggatagaactgcctctcccaccagtaggctgttaggcacggcactcagaaacagccctattgttttagatttcctttcatatcatgtaggcgtctataccatgccacccacacaggagagcaagtgagctgtgaaatatattcattgttagagtactggggaaatggcggcaagcaatcggaggtaataatgtccgacaggcaagggaggctgccaacattacctgcattatttcggttgcctttttcattataggttcgggaaataggcagcaattcgattatggcatgatttggggtggaattgcttgcactccgtgaccccgtcactgggggatcaaatgagaagtcaaatcaaataaagttcatagtgcattaaccggatggagcagtgccttacccactcagcacgatttttcatcttccaggggtttgtgactgcagcctagatatctctgcaccttaaggcatggggaggattggctgagatgtataggagtgaggagaggcggccaatagtgtgcaaacccctcccctcccatgtgtagcgccgagtttctctgcagcttgagcaaagcagtgtgattaataacaaggaggaaacctgcttgttggattattaatttcccatcccctttgccttattttttttctttgccatattcctgatgctttttcttctgcctcttttctttttgccatttgctaaagcctctccacccctccttttccctcctgtggcccacacttttgcccatggagatatccactagtcctttacactgacacctggccacccaacctcgtgccggctggcttcacacctggggtgagtttatctcttcccttcggggattctgtctctgaaactaggagagagagaatgagggagaaagagagagagagagagagagagagagagagagagagaatatgaatatgggtccagtggtgttggagccctgctgtattttaatcatagacttggccttcttttaggagtgacccaaaaagcaagaccagttcgtggggtacctgtatccaaccccatttcagctgctgtgtggaaaagtaggatttctcatagttaactgattaggtattttctcaccagttctaaacacaaagagtgcatcttgcaaaaatataaaaagttgtggggggtgggggtgcaggcaggggagataatgactggtaattgcaagctgtcatactaaaagatatttggggtgcaagagttacttctgccagcagaatggtagaatggaggaagggggagatttggaaggctttggggtagcttgtgaggggaggtactttgcattaaaacttctgtcaccatctgtactttcgatttcacagtcctaccctcacactactggaaaggagagtttcatactgactgtgggcacaggggagtggtttgcaattgcagcttgtgctgtttatatggtgcatgtgatttggggaccttctgggttctgattcgctgacctgcccagaggaggaggctgggccactttcttttccacattatgtattgcacacctctgttctgtgtctctcctcacctgctttgaaggatttctttccctctctgcaaatctctcccctcccgtaaatcagcatgattaaatagcagaagggtggaggtggcgccatgcattatgcacatgagctgtctttaccagcctgtccatatgtctgaaggaaaccttgtgttttaatcccaagaagtcaccttttttgaagattaccttgaagcatccaaaagctaataggatggagaactaaaggcatttgacattaattgttctgtctatttatataacttaagcacaaggcagcgaaaatcttccaagctgattatttctttggtttattctgagtctcttttttaagcattcagagcttcttaagtaatgaatttttaggaaaaagagccatgcaatgataaagtgactccagtagcagatttttgtcattttttttaaaagaagtgctcaaatagggcagccatgaattttatttgtgtaatttacacttgaatatgaatatatatatatacatatatatgggggtgggggtctagctctgtcacccaggctggagtgcagtgatgcaatcttttctgactgcaacctctgcatcccaggttcaagcgatgctcctgcctcagcctcccgagtagctgggaatacagaagggcatcatcacacccagctactttttgtatttttagtagagacagggttgcgccacgttggccaggcaggtcttgaactcctggcctcatgtgatccacccacctcggcttccaaaagtgccgggattacaggtgtgaaccacctcacctggccatacgcttgaatatgttttattaaatatgagattactggtaaggacttgatgtttacatcatagctgttcacaaggtacataatgcatttattttgtttcttatgtagtgcccaggataagaaggaaatgaaagaacctatggaaggggatacaatttcagctttgacagtttgggatcatagtattatcctaaaagcaagcaaacaaacaaacaaacagtgccagctgaaacaatcacataatcacctttctagttattttttcttcaggttctgggtctccctctggaaataacaggtgttattttgactgaatgaccccctactgaggtaaaatttggagcagaatataatacaaattatattccaaaggtgataagatacttgggagtttgagcaccaagaagaatgttatcttagagatggtatgagtataatacaagttggcattattattattttgacataaaagggggaaattattgtaaatctcagtgtgttgtctgtatcaagtactcattttttaaaatatgttttttttccagggaaaggcttatactgttgggaaataatttcttttagacatttagagaaaaaaatgtgaaaattatgttttgaagtgcatttttgctgtagaatgctagaagtccattgttgtttaatgcttcatttacagcatgcggatttacaacacactgaatgagagaagtggggtttaattttttcactatgacttcttataaacccgcaaggggtctatttgatgagtaatagttgagttgacttttacctacgagttaccttctccacgtcttcattgcttcatttttccctcaaccggatcatgtaatagaaaacttcctcaaaacctgttcctacttgagaaatttcaaaggatggaaacccttctttgaaggacttaaaattacatttatatcaggatgaatcatgtttcgactttaaatatcaccttatttctggcggtctcttttgtttccaagtggcaaatgttccttctgaaattacatagtttcctcttgctcattctgtttctaaacttctctggataaatgtgtgaaaataaatgaaattgttaagccctgagaataagcttggaaaatagaagttatcctacctgggcaaaagctccaaacattctaggggggatagagacccctcctccctcttttaacaaatcctcccttgaactggggagagaaaggatcgccttccaggattttttttccctgacgtgtaacagttcttaaaatactgccttgttaatttgtttctattttacatgagcattatacaaacagtgataaacgaaatgtatcattttttccccataaagcctcctcccagattctcctcagtgtttacagaaatgtgctgtatccatgagctcagatcaattgtttatacacattggtgttcatttgttcaaggcggcatctgggcctcggatgtcgggagagacccactgaggcaaagcactattaatagaaaggcttatctcgtttaagggagtaatcattttaatatactcaggaaaaagccagcgtgcaggctcttggcccacccttgcctaggcagggtctacaccttccagaagcaaacacagccgaaaagagctcttaaagaagtgattacagagtcatgattgctctacaaattgagtcttttttctgcttgacagtgatcctggcatcgtctccccgcttaatccttactagcaatttgcctatagttgcagctaacaagaggtgattagaggggagttgccagtcaccacttaacacccagctctgggggcaccatgggcacaggctgccgaattgggcctgttttcttattaactccccacctctgaatgcattagcccagctcttagctaatgatagttttcaagcaacagcgtgagttcctgagcagcatggtgatctgactctccagcatgcagctaggaaaattaggaaggagagggagaaagcatgttgttcttcaaaccaaatagatgcgccaagggagaggatctcccccaataaaattaggcgcacgctgtgctgcgtggctgtcttggtcttggaggttgtgggttgacacaagaaggggacatgatgcgttgcatattttatctgtcctgtggaaggtcctgagaataccaacagcagtggatcttgggttagaagctagagtgaagtggtctgcagacaggagactacacctacaggggtgtaagcagagaggcaaggcaggctgtctgggggacaggtccttggttatcatacatgagggtgcatcagcattcctgcacggcttgttaaaacctctgagtctgtggcagatacacaccatggaatactatgcagccataaaaaaggatgagttcatgtcctttgtagggacatggatgaagctggaaaccatcattctcagcaaactattgaaaggacagaaaaccaaacactgcgtgttctcactcataggtgggaactgaacaatgagaacacttggacacaaggtggggaacatcgtgtgaccggggcctgtcatgcagtggggggagcggagagggatagcattaggagaaatacctaatgtaaatgacgagttaatgggtgcagcacaccaacatggcacatgtatacatatgtaacaaacctgcatgttgtgcacatgtaccctagaacttaaagtataataaaaattaataaaataaaataaaacctcgagtttctgattctgtaggatgtaggacggggccaagtaatttgcattctaacaaatttccaagagatgctgatgctgctggtctgagaacccccaagtttgagagcccctgctgaagttggacaggcttggttttgcaaaaatgcgaaacgtaccaaatgtaccctccggtgacttgcttaacaactgtgtgtagctctcccagtgcagaagaaaatccccagtctctaaccaacttctgagacattaggccatcctttcccctccaattttaccttcccttgcccaagctaatttaactctttctttcttttcttttctttttcttcttctttttatttttttttatttttatttatttattttttttgagatggagtctctctctgtttcccaggctagagtgcatggagtgcaatggctggatctcacctcactgcaaactccacctcccgggttctagtgattcttgtgcctcagcctcccgagtagctgggattacaggcatgtgctaccacgcccagttagttttcatatttttagtagagatggggtttgaacatgtttcccagcttggtctcaaacccctgacctcagatgatctgcctgccttggcctcctaaagtgctcagccaccatgcacagtcttaatttagctgtttcttgaacatactccgtgcccccatatcagatatctttttacattccaagaatgtttctccctcctatttgctcatcctaaaagttcttacctgtcttttaagttgtggctcaagtattgcctcctccaggaggccccagctgcatttgtcatttcctccaaatctgaactccttatatgctgttatgtgatggatgtatcacgttgcatgatagtgcttacgtatcttttcccctgaagtcaggaatcccttttattcatttagtttctccaacacctagcattgctattggcatatcgtcactgcagtcaactttttttgttgaataagttttgtatgagatatatttgacctatgagaattaatatctttttttttttttttttttttgagacggagttttgctctgttgctcaggctggagtgcaatggcatgatctcggttcactgcaacttttgcctcctgggttctagtgattctcctgcctcagccccctgagtagctgggattacaggcatccactaccactcctggctattttattattattattattattattattattattattattattattatttgtagttttagtagagacagggttttgccatgttggccaggctggtatcaaactcctgacctcaggtgatccacctgccttggcctcccatagtgctgggattacaggtgtgagtcactgcacctgaccagagaattaatatctaataagcgaagaccaaacattggagtcagacagcttacatttgagtgttcacacaatgatatatgtggatttttctttctttctcttttattttggctttgagggcaattcacttcccctctctgagactcagtcttactcatctttataatgggaataatgataatgataacagtagtagaagtagcagcagcagcaacagtagtagtgagtgacactactcacatctgcacatgtaggtcgtaaagtacaacacagtacaatgcctggcgctctgcaaagaaaaaaagtgtatcaacagacaggaggatttctattgttgtccttgattctactgtgagacgtccacactggtggaaaggtgacctgtcttgtggaaatgaatgtgtggaagtggagaggacccgactccagagctggtgggaaatcgagcggcataaggcttttctgacatctcctgatgtgaacactgtgaatataatcttgtgaaccagagcaagtggaggggacatctactggacagaggcacagcaacatcctctctctggtcaccccttccctgctcacccatccccggccatgctggcttcttcctcctgctgaagcactcagggatctcaaggacttggcacaagccatcctgcctctccttccctcacccccttttcattcatcagctgttgattttggtgtcaccgtcctctgagaagccttccctggctagcccatcaaaagtgatcctgcccagccaacttttattctctctgccagcacactgtacttttccttcatcacattcatagctgtctgcaatgatattaccttgaattttagtttacagtaagcttcaagagaacaggaagccacctattttgtcctctcatacacccagagcctagaatctagaggaggtgagcagaaaatagtcgtcaggtggatgaatacaggatgggaggaactgataaaaactgccatataaccatcatgggacatggcaaaggtagataatatatcttttcccttgggaatttacaatttttattgggaaaagtgcatgggtagagtatcactcagatatttctttctgtgcttccatagaccctattatttccctaacagcaaactctgcctttccattcttcattactccaactaataattattgagatatactatgtattgcacactcttctagaagctgcagaatgtatcagtaaacaaaatacacaaaaatctctgcctttgtgggacttgtgacagtgttgcattgacctacttactttctccctgcaatcattgagtttctcttggtctagggccatttgtcatcatagtttttccccagctcctaacatgattcttcacagagagtacatgctcaaaacaaattggcggaatgaattgatttttaaaaacttgttctactttcttgccactaagtctataatccaaccaaatgagcttatcattaatctagcacatttaaatatttttggataaataatgttccattggcccacagtaactattccagcctcatgtcttcactcatagccattccctatttcgaaaattatttattgttttgttgtggtggtggtttatgcaattcccaaaagcaaagctgcagcatcttactgctgataatattttgaaacaacttccttctttgaattaaaaatggtacccacctaggctgggcgcagtggctcatgcctgtaatcccagcacttcgggaggctgaggcaggcagatcacaaggtgaggaaatcaagaccatcctggctaacaaggtgaaaccccgtctttactaaaaatacaaaaaaattagccagccgtggtggcacgtgcctgtagtcccagctactcgagaggctgaggcagaagaattg[136 bp omitted]atggcatggaatagtacattggacttcaagttcagtggccagggtccacacaggaagcctggtcgtcttgctacctggatggccaagtgcaagtcacttaactttttataatctaagcatccttattcataggaagggggcttggttatcatgaatattaaataacgtgtatgatgtgactggaaaagaaccagacgtagggatatgccaaagaatgtttgtttgctagtttcttagactcagaaaaatagaagcacgtgtacttgaatctatgttgtatggtagttttgctttcacaatcatcaaacaggagtctaagcccaccctggtcctctggctttctactaaggcacaggcagcaccagcttttccataacaacaacctcaaacccaaactgactaattatctactgtgtgccatgcactgtgctagtgttttgcgtgattatctcgtttgattccttaccttaactctaacaagggatcctattttttacatgtcttttattattattgttgttgttattttgagtaggactctcactgtgttggccaggctggagggcagtggtgcaatcatagagctcactgcagcctcaagcttgtgggctcaaggaattctcctgcctcagcctcctaagtagctggggctacaggtctgcaccaacatgcgcagttaattttttaattttgtgtgtgtgtgtgtgtgtgtagatgggttcttactgtgttgcccagactggtctcaagctcctgaactcaagtgatccttccactttggcctcccaaagtgtgggattatgggcgtgagccaccgcgccactgtgcccggcttaatatgtcttttatttttaaaaaatgctggtaaaatacacgtaacataaaatgtgtcatcggtgatatttaatgcaaccgccatcactgtccagtttcagaacatttttattacttcaaaaggaaccccatatccattaagctgtccctctccattctgtcctctccttagcctctggcaattgctacagaacaaagacatggagaggttaagtggcctgctttagacccacattactgagtggcaaaactagtatttgaggctgggaagtctgctaccctagtgcagaacacttaactgttaaggtaattagctccccattagaaagacctttcccccaccatccagttcacaggaggcaggggcttgtttctagctaacacaaaagatgattttctctgaggcctcattacgggatgccaagcattcccaccagtgggcagcctgtggcacctagaaggtccgctccttccacttgctttccttacacccagcccagtgggaaggagggtgtcacttcagcagtgggggcagatgggtcttcagatcccacaggatgcccccacactgtgctggtcatccaactcattgtcaggtcagcaggggtgcctgctggcacccagagcttttgcctggggcggaaatgtggctgtctgacttttcttagttttcatccttgtcttaaaggtaggatgagtctcccaaggtgggatagaatgctgggagagaagtgaactttgggattttggtaaaattctctgcacaaataactcccagagagaagggtaatctgctaccccactcatctttactctttgaaaaatttaggatcccaatcccagaagagaagctttttgtgaattctcctaatgcaatcgttgtgcttactgaggctgcttggagagactgtcactcaggttgcattgcaccttaaagacataggatttcttgtcttaacaacaggtatgcacaaacattttttttataaaggaccagagagtaacacttttaagctttgtgggccatctggtctctgtcacaactactcagctctgccattttagtgtgaaagcagtcacagacaatacataaacacatgggggtaactgtgttctaataaaactttatttaccaaaacagatggttggctgaatctggcctatgggccatagtttgagagccctgtcctagactccagctgatggccttttctgtgatgtgtggaatctcccccaagcattctgttgattcctggaactatggctcctttgctctctctgctgcttcccagcttgtgaatttgcattcatggtcatctctgttttcaggccatcataacacagaatcaacagccttatggtgttgccccagaggattcaatgtgtcaagtggcattttcgaactgtgtagaagacttctctgcagcttctgtggagggaaacagggaaggaggtttatatcttgtagcccccagcaaatgccacgcaaaattcccgcataatcttgttttcccaggattctttctcagcagccttggaagtgggatagttggggttggtgtgcccattgaattcccccaaccaagtactcaaacttgctgatcctcccttctttccttctgggacttcttaggaggaagtctataaaatctcttgtctttaatatgcaaaaaggttttcttgcctcttctagtaaaaacacatagtgggcagagacggtgagtaagggtccagttctaattcaaaccctaagctcttagtttgcattctccacaataaaggcagtagtctctctaaaggaaattctcactgatactttttctcctccccacgtcatcatagagacatggcatggcctttgttctaaggaacttcaagtctaataggggataatgaatgttccatgtagagcagatacaaaacagtggactgagtccataatgctgtgttggagtacagacaaatgcgcggtgaaatcttgctgaaagactgcatggaggaggaggcatctgaattgagtcttaaggggttcatgtcacacaggtgaagcacactgacttcacgtgtttgaagagttgtctgggagataggttaccaatttagtttctacagtatcagagatagaaaaattcatccatcccttctaccatccttctgtccatccatctgttcatccacccatccacccaaccacccatccatctaattatccagtcatctaactatccatccagccagccagccagacagctagccagccagcctttctaaaaatacttatttaacacctgtgtgtgccatggagtaagccaaatgacagggagagaaaggtaaatgaggccatctccaaaggagttcagagaaaggtggtagataggtatgttagacaattcatttataagctgaatagttaagtgcaattttgagtatttgtgagaacgatgagagggaacagttaatactattggaaactgctcttggaggagtcaagcctgaatgatcagaaagacactaaaagatgtaaagcaggtaaaaaggaagaaagatcagggctgattttggagagcacggagtaaagtttcataaaccaggtaagagcttaggagatgacagacatgtggtggtataagagatgaaggaggggcggggcgcggtggctcacggctataatccccgcattttgggacgccaaggcaggcagatcacgacttcagaagatcgagaccatcctggctaacacggtgaaaccccgtctctactaaaaatacaaaaaaattagctgggcacagtggcgggcgccagtagtcccagctactctgaaggctgaggcaggagaatggcatcaacccgggaggcggagcttgcagtgagccgagatagcaccactgcactccagcccgggcgacagagcaagactctgtctcgttaaaataaataaataaataaaaataaaaataaaaaaaatcatcaggagatgaggagatggactgggaaataagacagaggcccaaacactaagaccaccatgacctactggactgcatcctttagaagccctaaggggatcctaaagtttagaattctaaataaacattttattttagaatacttttacatttacagaaaagttgtaaagacagtccagagagttcccatctacccagcgtctagtttgccctcttgttaacattttttttttttttctttcctgagattgagcctcgctggatcagccaggctggagtgcagtggtgtgatctctgctcactgcaacctctgcctcccagactcaagtgattctctagcctcagcctcctgggtagatgggattacagacatgcaccaccacactgggctaatttttgtatttttagtagagatggggtttcaccgtgttggtgaggccggtcttgaactgttgaccttcagtgatccgcctgccttggcctcccaaagtgctgtcttgttcacattttgcatttatcatattttacatatggtacgtttatcacaactaatgaaccaatattgatacattattgttaactaatgtctacattttattcagatttccttagtttttacctcgttcttttctgttccaggatgtcacattacaattaattgccatgtcttcttctccccttctggtctgtgactgtttcttagactctgcttgtatttaacgaccttgtcttttttggagtactaagcaggtgttttgtagtgtgtccctccactgaggagtttgtctgatggtgagactggagttatgggttacggagaggaagaccacagagacagcgtgccatttgtatcacaccatgtcagtggtacatattatgaaaatgacttatcgctgttgatgttcaccttggtcatctggctgaggcagtgcctgtctcatttttcctctctttgcatactgtgctctttggaaggaaatcactatgagcagttgacacttacgggtgaggtgtttgttaggcttcacctccttgaagcagcagcatctacatccatgaggcttttcagcaggacctgggtaaaggaccatcaggtggaaaatgcaagatgaactattgcaagccacattgaaggagaatttggctcactaccaggaacattgcctgcccccgaagctatttagctgtaggttttggccttcaggtgggcttagttgcagggctaaataattttctttaaagagcttcatcatccaggcaaacatcacagccacagtgccagatcctgtgtcaaagaaattaaaggctcattcctccatgcactaagttgtgtcataactgtaggagttggcctgctggggtatgtgtgtgtgtgttttcccatggaaatgaccaaagcaggcagcacttgttgaagtacgtcaacattactgcagcacgtcattccttttatgacatagcgacctcttttcttttctctgcgctgtgatcttcagttaatttttagggagggtggggcatgaaagctccctgaacatcgtgagaatttctttccacagatgcaaacaactctgttatggagagtgtaactcaagatagcctttttggaggacagattggaagtacatttccagttctcacattcctctcttttgaccgaggaatttatattttttcagtagaagtcattctattcttattgtttttgtttttatttttctatttgacaatgaatcgtgagcatctttcctatgggtggatgtttatgttatttccggttggttttcccatcctctttcattgtatgccaaattactgtggtaggcaaacttggacaaacgtgtttgaacacatatagtgcgtgtcatatattttgtaataactggaatttcctgttcaaaggttggggatgtgtgaaatttggacagtgtccatcagatcactgtcaaacacaggtggagacatgtgtcttcacaacccagtgcaacagcatggcgttatgcctcatccatccaacaactctagggggcaggcataagtagtcccattttaaagatgcataaactgaggctccatgaggttaaaggattggcgctgggttaactctttctttgctatcaggcatttgcggaggatcactcaggaacctttgaggatgagatgtcctgagctccagctcctggtgtctgacctcccatctcagtgaaatagctagaaaattatttggtctccttgctgagattttcttaacatattttaaaatctcagcctggtgcagtggctcatacctgcaatcccagcactttgggagaccaaggcaggcggatcatcctaagttaggagtttgagaccagcctggcaaatatggcgaagccccatcactactaaaaatacaaaaaaataaataaataaataaaaatagctggtcatggtgatacgcgcctgtaatccgagctactcaggaagctgaggtaggagaatctcttaaacccaggaggtggagattgcagtaagccaagatcacaccactgcactccagcctgggtgacagagcgagactctgtctcaaaaaatctcctgacaccagaaagccacagagcagaagcatcacagggctctctgatttgccataggatcgtttaatctgttttatgatactgtgctagtagaattttccaagttcacaatcacaaacaaacatactatcctcaactgtgctagaattaaattatctttgccccccccccctttctgttatattaaattagtatccttcttctccaaacaggcagctcccactttgagggtgggggaggagtacttgtccatcaaacatggggaaaatgactcctacttccatcgcacagtgaatcataggctctcccatgtcagattctgtggaaaggatgttaatagagacaaaaggacactgttggcgcgttattaatgttaaaaattgttgacgttccatgcagtgtgtttttctaattagagccaagctgcagagtaccatttccataatcaacatgggaacggaaactcagcaaaatttcatgtatttgcaatgaaactgctccccggcaacataaaaatggcttttataacataaaggctgtaattagaataagtcaaatcagttggaaacgattaaggccggagtaggcaaagctgccttctaaatatttgtctggagattagcctactcctgcagctctgagaagcatctttgatttacttatactgctcgacgtggcaaagataatcttgtggaaggcaaacgaatacagatttagatgtgctggtcggccccttctgcaacttgacaggaggcagtccattggaagcaaagtcagaaaaaaaaaatgaatatagggtcatattagacaaattgcttaaaaaaaaaaaaagcacaccgcgatcatcaatttaaattcttttaaaatgtgctaggtctttgaagcttttaggatgcactttagaagtccacgtggaataatccctgcatgtcagtgcgacagttgatgtgcgtctcattgtatttaaaattatagttctgagatgggacttgctccgcgatgcttgtctgacatcagctattaaaatacaagtaaatcttggcaggtgggaatttaaaaaagaaaagattatataagaaaaatcagaatggttaatgttaatttactaaccagggtacagtggctacagagagttcttcatgtcctctctctattaagatgctgatgcgagaaacaccttatgtttgccagggatggggatggagattgtaaagtggatgtgagggggtaaagagtgctactttggatgtcagtccatggtttgggtcctctggggccacggtgagcatgatggtgagacaggttcattttattaaattcagattagccgttttgccctgtcctgggagggcagaagaaggtaatcaaggagagatggcgggacaataactgctctggggatcagactggaacatccacggactccagccttcctttagaagggcgtaattcgtcctcacagactcctcactcatttgtaaacctctctgaatcccaaacttgtgtgcgtgtctgcatttagccattgaaaatataatcaggctaatgcattctcttactgaattttaaaccagcccattaaaactcctttaacgtgctaaagtcggcttcagagagggtttccatttcatctttattgagctgaggctatggttcattctccctttgcaccacagtgagcgcctgtcaataattcaatagcgtagccttgatgggcccaggcccaacctagactttcaaccacgccaagcagcttgtcaaagcctgatgctctgtcaatggctgagtgatctatactgcatgaatcccccccttcagctcttgatgtgtccctgggaataaaaagaaagccatttcagaagtcagcccagtgagaagcacctgtatgtagagaatctttaatgagggcaggtcgcgctgtggtggagcagagttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttcaccattgcaggaggccttgaactcagaaaatccagtgcaaggagcaaaacatctgaatcatatgatcatgccccagtggctcttcttcaggtgccagtgacggtgatttgaaccttcatgtccctcttttcatggaacgtcatgagtctgtactggctaaagagtgctgtgaaaggcagattaaaaaaaaaaaaaaatccagcctcacctttctttctgggtggaggaaaaggcatccattcactttaagaagaaaacaaatcatttgtattcttcttgtctggacacaatttttaacccagaattatccacctagttcctcccatctccaggccttgtaagtcgataggagatttgcaaatatctcccttaaagaaaggcaacgaggagagcatttaatccatgctttaaatgcaaaatgtcttgagtcccaacgctgctcagtttttcctgaagataaattttagctggattaaataactgttttaaaggcactattcatgcaagtgctgtctcatttgtgactgtatctgcattgctaatggatgtgtcttttcctcatgcatattctttcctgagcatctaccgccaaatttacagattgcttgcttgtcaaattgggatggggtttgaggaagaggtgacaatgatctaggtggaaaagagaagtgccagtgtgttcaaagctaatagaaaattgttgctttgtattagcagtcaaggctccaggtttcctgaaccacaaaacaaccaaatcttttctttcttttttttttttttttttttgagacagggtctcattctgtcactcaggctgcagtgcagtggtgagatcacagctcacagcagcctccatctcccgggttcaggtgatcctcccacctcagcccctcaagttgctggggttttgccgtgtcgcctaggctggtctcgaactcctgggctcaagagacctgcctgcctcagcctcccaaactgctaggattacagatgtgagacactgtgtctggccccaaatgttttatggtaacataaattcatgccactgtggcctgctggtcttcccaattaaacagcagagagtttgttatcccagccacagcatattagggtggagccaggtaggtatgtgaactaacactgtgaaaaaacaagattgtttttaaggtaagctttcgaggagggggaaaggaggtagaaaatgaatatggtgatttcagagaagaaaatctctcccaagcctatgtccctttgtatgtccacaaccccagttaatgatgggtatggcttatgaaggcactgagagcccaaggaatgtggccagcattaggcggcatttgagctgggtcagtgaatcctcaggcgtataggcaattaggacttagagatcctgttgtgattttcatacttttaatctggagagttgcttaatgaatttattaattcatttatttttagcctcacaggttttgctccaagactcaggtgaatgagtaacacagtactgataaagttgagcttttctgtttagggctggggaggagggaagaaggaaaggaaatgaaacccagggctttgcatcttcctcttcaacttcatcccttcctctctattcctcacatttagcagccctcaagggggctacaaggaatttttcagggtccagcgtggcctaatatgccaacttctgatatagtacagctcaattagcctggcatggttgtgcacaaatgtagtcctagctgctttggaggcagaggtgagaggatcagttaagcccgcccagagtttgacgttgcgctgagctaggatcatgccactgtgcttcagcatgggtgacagaggacccatttcttaaaaaccaaagaaaaaaaaaagacagctgttattttcctaagatatcctctttaaagagaaatggaacaagtgacctgccttcctctatatgaggtggggctcacaccagggttctcctgctcaccattggcccaggaaactcaggaaattaatgctgcatgcgcatgacttggcgattcgacctctgaaagctctgcaaggctaggaatttatgctttaagaacaatcagcatcaaaggccttggcagtggtggagctgttagcatattagttccatttgagatggtgaaatgccttggaaactaaaaaccctacctaataaagtttattttcaaaggattagaggtagagttttgctctgagagatgatgttgcctaagcctcccattacagaagagcagagatgggactctagggattcatggatgtgccagcgtcactgggtagtggtaaaaactaaaactggtatctgtttctctcctactataatatctttttcacgtcagggcttgtaaacctgaaatctacactttagtttcacccatatgatttgtttttgcttttttcccccctgttattagctgccaacatttagatatgtaaagattacatttaaaatcgaaatttttggcttcttgcaaaaaaatcagacgatctggcatattgagcaacatccgcacacttcacccaccagctggagctctgtagcacctgcacacctcagtgtggagatgagctttccactcccaggtcaacacagaccctcttactcaggactcaccttcgcccagcctgcttcacgatccactggctgtcacaggcatttgcctccgtagtgctctcctcccacccttccacaaataaacgtgcccagagatgctggcagcctggaagctttgcatctgcattggggctgcccgttctttgctgccatgcctgaagatttcagtagctctttgtcagcacaaatgagcttttcccctagttcatggggagaatgggatcctggcacatagcagaaaacatctggtaatgaatccattaggcaggctgttgctcagcctccaggtgcccaggggtctgagtgctgggctgaacatgatgcatgaacgggaccccagagattttaccttttggccttcgttctgccagagctccggcttggtcctaaggggtctcctgactactccaatgccaggtgttctccccagccatccccaagcgagaagctggccagccttctggattccctcctctgccttctccagcagcagtccgtctcccagcacagccttccttaggcacacaaaggagaagacagagatcatttttggcagacgtaaggagcagcatttgtcgaactctgggccctgcaactctgtgaacagacctgcatgctgtacaaaattattagaagccctgtgtctcagggctcaaggaggttgggcagggaggtgagagtgaataaaaatgaggaggccgcaaactgcttttgcccaagggctggttttaatgagcttgtccctaatgagttgtccctgcaactagcttcaggcctaaacagatgaggcagggattctgctaaatttttgataggatttgcactggttttatgagaaagcaagcagtagagagtgcaaagttgggtcatgaatcttttacgagggtggatggttgtccgtcttgtcaaccggaacgagaaagacctggttgctaatagaaaccatggcctcagacgtcgatcgtcacccaccagatcagctaatttggtcagggtggctgggtgatttgttttttttctgattcaggacctggcctatggcccctgagaaggatttatctgaaaactccatcaaggagatgatttgagccattgcctgttcctgactaatgatcttttgtggaactcaagccatattggggatttatacctttctcccatagtgcactgggaaggaaacaccatcaaacactttaattaacatcctttttactttgggcagccccattcgtatcaaaaccacaaaccttacccttcagttgcacgagaacactcttaccaaggataaaatgtgattttcgattcctatggagatgtttctaatgtttctaacacccgtcaattctaggatcgcgtggtacaggagatttcatgtactaccaccttttttttaaatattaaaagctgccaacaaatgcatttctccagtttgattcatataccaaaaggcaattttcttggtggcttagaaggttacagaaaatgcttgatcagcagcctttactgtgctgagtgaattcctaccccatccccctcctgtctcacacactctctttcacattaatcatgtaattgatttaataagctctggcttcaagagctccccctcccctctttctttgccccctccccctctcttataagatttcagttcagcgtttgactggtaggctaagaaccttgaatcctgccagatatgaacccaacaaccttgttggtgtaataagtatcctcatcttatatttctgtggctccttgaaacataatttttaagccatttcattaatagagttcaatgtaataatgtaaaaaagtgcagcgtatttctatatatgtctgtagatgtagacttctgtatatatctacttttcacaaacttgaaatcatttcacatgtgttgtcttattcaaacctctctaaaccgaaaactttgagagttgcccagaagagatccgttgctcctattttatacattacaaaaccgaagtacagacagatgaactattttaagaccttgaggctaattagggatgcacgtggcgtgaaaattttgggcgtctgaacttcctacaatagggcactactgattctgtattcctttgttgcctgaggcattcctttctctgggagaaaccaaagctgtacatatttatcttcaagagaaacttccactttgcctatgaagaaatagttagaattgttttctgtggttgcctcaagttagaggtgctaatatacatggaagttaaacaagaccacacatgtgcaaaactcttgatgaatcacgttattatactaaaccaacgttatactaaaccaacattagctagggttattagttcagattatagttatgcaggtcttccgtgttaagtctcatgtaaatatcttctggagcttacatgtgtagttatctatgttctaacctgtttcctaatgggtcatccagaaaacgtgggtgtggtctggctggaacagagtccctaggattgtgtcagagtcattgtcgtaagatatacctattcagaagttagttatctagatgttagagtctagagatggggcttcaatgagggatgtcaatggcagtatggggaaaagagaacagagttgaagactgaacagcctagggggagagcagaaagcaaaggcagctttataaataataaagatgttctgcaaaaattcctctgactgggttctgattggcttgggtagcctttttttttgagacagggttttgctgtgtctcccaagctagactgcagtggcatgatcctagctcactgcagcctcaacctcccaggctcaagtgatccttctacctttgtctcccaagtagctgtaccataggtgcacaccaccacacctggctaatttttacattatttgtagaggtgagggctccctacgttgcccaggctggtcctgaacccctgggctcaagtgatcctcccacctcagccttccaaagtgttggggttacaggcataagccaccgtgccccactgacattttactcttaatcctggcctgtatttaaagggtctgggtgaatgcagatagatagacagttactacgcgtaacagcttaccatgaattctaagtctcaacaaatccgtaatcatggtgtgtcatatgaagaacatgttctaactcttattgctgagcctgactttgaagtgtttgtttttttttttcttctttttttcttttgggaataagaaaaagcaacgttcttgactgcccggaaaaatactgtcttgtcagctggggatgcttggtgctgatgaggaatgtggtacagggtggggatagtcccttttaaagggctcagcatgtgcctgggcagttagcaaggattaaacaaaggaaagttggtaatattactgctagtatgagtatgagtaaaatgaacagtggaaagaaattaataataggaaattagtgatactatgtgtttaatatgcatagagcctctgtaatcttagcttctgaacaatagcactccccgctactcctctcttaatctggaggcccatgggtctccagtacccttatgcaccagctccatttgaggaaatgaaagtaggaatcacaatatttgccctggatctgcataactaggacaagcttttgaaagtggaagaggcccataaatgaacttctcaaaatgcacttgatacagcatcaaataggagtgacaggtccataaatcaagggattggggtcatttgattcaaatgtaaattgtcccctgcccagaaaactcattgccatgaaaccctgcacagaatccagagaacattttcttctggtctcttagaaattcaaaatacaagatctacatggtaccacagtttttgttgctgttactgttgttgttgtgtggtttttgttgttgttgtttttgttttgtcttttcacgcgggtgacgtttggagatgcccaaagactgatatcccaaaagtacctaatctacaacaacaaatatttatagaacctttatctcaatatttgctcattgaagtgggttaataaatgtctgttgaatgctctcaattggatggtgagtattttccattttagtttagctgtgaagcttcgctttccctcctatgccttttgttttcttgcctaaagaagcccatttcaagagtcggggatcttctctttctaatctcagcctgcccaacaatttgtagcatggtcttgctacagccgctttgctcccctgctactccatcttgtctgagatctgggttaactgggacttaactccttgtcaaagatgctgtgtgaaatgactaattaacaccagagaaggaaagagcattgtcattgacaaatagggcttttaataaccagcagttctcctggttattaaagttggctcttgagtctccccagacccatgcgaattgacaggaaggaggatattttagttccttctatgattgagttgcttgtcacttgagtttgtaatctcaggagtcactttatccatgttgtcccaggaatgaaaatggtgtgaatctaatttcagaagttgaggagaagtagaacaaggaggccatgattttctagtataactagacaattattttcagcaagttctccctcactgttgtggggtgagtgctcacatttgcctgccgctgagctatgttttaatgaggttggaagaagcaagaaggttgggaagattgatgttaattgcatttctaccatacactaagcagtgagcagatttaggatgactagtgtcctatagttctctttcaagatcagatcaagcttcctgaaccacatgagcctgtcttctctttacaccagcagcctcagtaactccctgttgggcaaccccatagagcaaacaccagaaaccccagaatttttctcttactaaagaagaccctccactgtcaacttaagctcacgttttcctatttctcaagccaaggtaggtctaggtattttttttttttttttttttttttttttttttgagacagtgtctcactctgtcacccaggctgcagtgcaggagtgtgatctcggctcactgcaaactccacctcctgggttcacagcattctcctgtctcagcctcccaagtagctgggactacaggtgcccgccaccacacctggctaatattttgtatttttagtagagaatgggtttcaccatgttagccaggatggtcttgatctcatgaccttgtgatctacccgccttagcctcccaaagtgctgggattacaggcgtgagccactgtcctcggcctcaaggtaggtctgggttttatgagatgtgacacttacagaatttgggagccctccgtaagaaaaacattcacactttgggaggccaaggctggcagattaattgaggtcaggagttcgagaccagcctggccaacatggggaaacccccatctctactaaaaatacaaaaattagccagctgtggtggcacacacctgttatcctagctacttgggaggctgaggcagaagaattgcttgagcctgggagacggaggttgcagtgagctgagatcatgccactgcactccaggctggccaaccgagtgagtctatctcaaaaaaaaaaaaaaaaaaaagagagattccaatgagattcaaaattactagtgcagagttgcagagttaggggtagcataaaaacacattgcctgaagtgatggtctctgaagcctaagcccagtcaccttctcattatccatttctgttcccagttgaaactttgcagtaataaagctgattttataaagtggtcaagagctgtatcccaaacttttccttgcatcttcagctcttcctgtctatgaacctctgcctctgttggcctagtctctcactatcctcttcttttattaagcaattaagtattgattaaaagccaagtctagtgagagctaaatgcatttgttgaaggttataggtcttgttatgggaaagcaggagtggaatgtagttgaattaacctagcctagaacagatttttctgtgtgttctatgaattagctgtatcagcatcaaccccctggaggggaggggccaacaggcatctgcgttaaatatgtacattcctaggtcccttccaaagtactgaatcaggatctctggggttgggatgtagggatttccactctttagaaacacccaccctcctttcttctgaagcatgtgaaagttgtaaaacaactgactaatctaagggccactgaaagctactcttaagatgcagcatttacttgagactcaaaggatgaatggcagctgccaagtgtattaatttcctaccccttccatagcaaattactgcaaacagagcggcttaaaataacagaaacttattctcttagttctggaagttggaagtcgtaaatcaaggtgtaggcaaggtggattccttctgagaactctaaggaaggatgtattagttgattctgatgctgctaataaagacatacctgaaactggaaaatttacaaagaaaaagaggttcagtggcctcacagttccacattgctggggagacctcacaatcatggtggaaggcaaaggaggtgcaaagacacgttttacatggcggcaggcaagagagtgtatgcagggcagcttcccttaataaaaccatcagctctcataagactaactgactatggtgagaacagcatggggaagacccacctctatgattcagttacctccaaccgggtccctcccatgacacatgggaattatgggagctacaatttaagacgagatttggctgggggcacagcataactgtagcaaaggatttgttctttgtttctctcctggctcctggtggctccccagcaatcctgggtgatccttagcttgtggctgcattactccaatctctgcctgcattgtcacacatacattttccttctatgtttgtctgtcttcacctaatcttcttgtaagggcaccagccattggatttagggcccactttaatccggtataatctcatcttaactaaatacatctgcaacaaataaggtcatattccagtgttcttggtagacatttttctttcccctgtttttttttttttttttttgagatggagttttgctcttgttgcccaggctggagtgcaatggcgcgatatcggctcaccacaacctccacctcccgggttcaaacgatttttctgcgtcagtctccggagtagctgggattacaggcatgcaccagcatgcccggctaactttgtatttttagtagagacggggtttctccatgttggtcaggctggtctcgaactcccgacttcaggtgatccacctgccctagcctcccaaagtgctgggattacaggcgtgagccaccatgcccagcctgacatttttcaaataaggtcatattctaaagttctaggtggacatttttaaaataatgtctcattacaaagtcctaggtggacatcttttttggcagggggacactcttcaacccaccatgccaagtgaaagtagtcagtgggggagaatggcagtgaaaatagatggatgaattcagaatgaatagaaaacttgaagaggtttggcaggagtgagccctgcttagttatcatccaggtttcactaacgcgccccttgccaacatgcagtagctctgagtcatgatctatcatattgccctgttttgtaattttgcattgtttgtttacttgtttaggaccatctctttaacctcgttagacttgaaatctctactcaattcaagcctgcacatccccagtgcctgaaaccatggctgttacatagtaggtcttggtgataatttgtcagttggataattttagctggagaaaaagaaacatgtatgtgtgtgtgtgtgtggggggggggggttgttttgttttgtttttgtttttgtttttttcacccatcctgcagaaaacactgcttctgtgacataaagagaacaccttcacagggtaaagtgttcttcccatgaggtctaagaggagtctcaaatgcgaggggcttgaagacatttgtgaagggacactatgaaacatatgagagcagtgagaagtggagagttgtctctctgactgcagtagaaggatggcgaaacatcagggagggagaagggcactccgggccagtattcaggaggagagccttgtggcagcttttctgggtgtggatttcagagcctgtcatcatagaaagaaaagaaggaactcaatctaaagtataaataaaaggagagacttggccgaatgcggtggctcatgcctgtaattccagcacttcgggagatggaggtgggtggatcacaaggtcaggggatcgagatcatcctggccaatgtggtgaaaccccatctgtaataaaaatacaaaaattagctgggcatggtgacatacgcctgtaatcccagctacttgggaggctgaggcaggagaattgcctgaaccagggagtcggaggttgcagtgagccgcaatcgcgccattgcactccagcctggcgacagagcaagactctgtctcaaaaaaaaaaaaaaaaaaaaaaggagaaacttacagaaagcaagttcaaaaaggagggactgtggatgataaattctataccactgtgaatgttaactcgtaaggatttgaagataacggcccccgactcccacttaggttacagatgaagatactatggcccagggatgctgcgtgagtgtcttaaggaggaaaagagcgttaatgtgacatctgggattccaggctcctttccagacctctcccctttttcacttttccgcctgatttaaagtgaaaagaagggtgttggcatctattaatcacctactgggcgccaggcatggatgctaatggttaggtcttcaggttgctgagtgggtgttgaggaggaggaaccagtgaccccagtagacattgaagaggctcaatgacagcaggaggattcaggggtctggtggggtggatggcatgcgacgggcccagcatcagcagtgagagggtaggagaatggtgagtttcagggcatgcatccacagcgtaggttggtaactaaaaggccagcccaggaagaggcctctgcacatgaaacatagaagtggctgcctccttcaatcactgttctgattagataagacctgggcttcgcttctgagtggtaaactcagaggcagctgggagtccctgagtgacaaggaggagactggcatgccaggtagggcaggctgagggttaaggctctggagggagaagaatcgtactcagaaaacatccagctttctgggggatgaggttgtgcagtctgggtgagggacatcggatttctatggaggctttttggatgggacctgatataatcatataatattgaattcagttctatgagcttttgctatgtacttattctgtgcaaattctgcaagggatgtcttgaacggatggttctttcttgcattgaatgcaaatagtaatttattttgattgagatagttttggaaatttcggagcagtgaaatccaagtatttcaacctggcaggttgaggcaataggtaagttaacttgggcgggctcacttttctatacattttgtgctcgggaccgtaatgcaagcccactgcaaatggcaacttcatgtatcaacttataagcagtggtggaggagatctcaaccctacactcattgctccctctggctcttagagactggcttctaaattcctggtgagttgcaaatattcttagattggactatgctaacattttgaaattaaacctacctgtctttaaatgagttgttggctgcccctccccccgccccgtattctctttgtgaagtagaggcttccagcacttttctgaaggagaaaacatttatttctcattttgtagaggcaagaccaaatttgtgtcagcttcagctgagaccactggccagccctccttctcacctcccagttccctaatctaatttatctcagtggggtttgtgggggttcatttaagcagcagaagctctgctataattgttgcatgtgccagcaacgatttgtaccatctgggtatggaatgaggtggggtaaggtggtttggaaagagaaaggaacagagagagacaaagagactagtacgaccaaagagaaagattcttattccatgaccaaagcaatatcattcaaaaatggctacaaagcaattggatactaaggaatgagaagcaatgtagttagagtaaaatgtcaaagtataatgaaacagaggaacatcactactttatgatccagccaagttacaggcaggtggcagctgtaaatacgcatataaataacaatatggatgaaatgtcagacctttcagctggcttggttaaagcactttagtaatagtctatttagggtaacaatgtagcttgacaatttccatgaaaaatacatcattggagaatgagtcagcccgcgttagcgtgtaggtgatgtgcattgtgctaagagcttagaacaacacacggtgcctggtgcatcccccacctgcctagaatggccagttgcttcatattccatgaggttacgttggttttctggcattgggttgcaaatgcttgtctttcccattacagaaagtaccttttctctcttatcagtaacacaggaaaataaataaatgatcaatgcctcagatccggggtcttacctgtggaaaggtgtggattgatatctttatttattcatgcatgaaatgtatcaggcacttgctgtggtgccaaggatctaaaaaagtgaacaaaaagatgtataggctcagacttcatgaattttaggctacactgcttaaaacctttaatgattccctattcttaggataaagtcataactcctgatcatggctgccaagaccatgtagattacttagagtctggtgaaagaagaaataactgaataaaatggtcacaaaaggtaaatgtaaaattgcagtagtgaggccaggcacagtggctcatgcccagaatcccagcattttgggaggtcgtggtgggtggatcacttgaggccaggagttagagaacagcctggccaacatggtgaaaaaccatctccactaaaaatacaaaaattagcagggcatggtggtgcatgcctgtaattgcagctactaggggggctgaggcaggagaatctcttgaacccgggaggtggaggttgcagtgagctgagatcgcaccactgcactccaggctggatgacagagagaggctttgtctcaaaaaaaaaaaaaaaaaaaattgcaatcatgatacatgctacattgtttggtagccaggatggcttcctgaaggaacaggtgctagacttgtgatcgaaggggtaggaggttaaacagagaggtatgagagtagcattccaggctgtgggattggcatgtatgaagatcctgtggtaggaaggacattagtgagtatgaggaatggaagagatcattgtcctcatagttgagctagggaggtggagagtggcccaagtcaggtggggataagtaggcaggagcctacatggtcttgccggccatgatcgggagttatgactttatcctaagaatagggattcattaaaggttttaagcattgtagccttaaaaggacgagcaggggctggtcctttagaaggcattgtgttcatagtgtatgacagtaagccaggagctctgagaaaacaaatggcactttgatgagcaggcactgtatatagtttcatacacatgttaaagcgtgtatagaggatgtgtaaaacatccacttcatgccaagcactggtcaaggtactgagggtgcctgagtgtaagacagcatccttgcctctgagcaatgcacagactaaggagatggaagtcatagaaaccactgactgaagtgttgggcaccctgatgagattatgaagcacggaggagcaccttcagccttaagatggcattcctagagttcatgtcctctaaacagagtcttcaccaaaggctagaagttgtcctcgcaaagaaggagtggaggaagtgttggtcttctggtagggggattaagaaagccatagccagctgggcacaatggctcatgcctgaaatctcagcagtttgggaggccaagacgggtggattgcctgaggtcaggagttccagaccagcctcaccaacatggtgaaaccccgtctctactaaaaatacaaaaattagctgagtgtggtggcccatgcctgtaatcccagctactcaggaggctaaggcaggagaatcgcttgaactcaggaggctgaggtcccagtgagccgaaatcatgccacggcactccagcctgggcaggagggcgagactccgtcccccaccaacccccccaaaaaaagtcatagccaatgtcttcccaggaagtcaaggaagcaaggaagatgcccaggatcggtagacagaatgctggtgaagtagatgggggtgggccctcttgaccagtgtcttgccagattttcttaaaactgtaccatatcaaaggcagattgtctcccaagttatcaagtcaaactcgtgttctagccctgcagctcaccctgttttccatcatatgtgtgttataggctattatagatatgatcaagttgagtttataaggtccagaattcccatgcatgtgagaaagtgtaaactgaagccacctgttgggttatgtcccctaccttggtgcatgaaggaaaactacacaaagatgtgtggtatcaactcatggagacaagactctatctacaggatagcaaacatttggatagaacttgagaaggaatatggtggaggaatgagtttttatctaagccaagatccaaccatctctcgatgtatacattttctaccatgaacatgtgcaattgcccatctgtgttttctttcccttttgagattcctcttgaccttctgggtcctggggaagtcctcaggacaaggatggacctaggcgagttacatcaggtaccacagtgttaaagagtgattatcacagtttgctcctcacactttatatttggccagccctgggccaaccccttttcccagccctgggccatacccttttccaataataaagcccattttttatgattttgctcatgggttcatttattgatttgttcaaacacaatagggcactacctatgtgtcaggtaccatgctaggcacaacggattcgatagcaaaccagaccattgtattttctgccatcttgaagcctcagattgcatctggaatgaatattattagaagcagctagattttgattggaaattctctcttctgaatcctttagcctaccaaatgctttggttctagctaaataagtggtggttttatttcctttgtaatacctgaatatgtattccttggatacatcaccctccctatattgagaagtttcacgtttcagcagcctcattctttctcatccttgtggaatgcatgtgcatgtatgtctctgtgcacatgcatgataggtttctatccagccttactctccatgcaagaatataacagctcccagagttgtttgcaagaaaatattaaatatttacatagatatggacattttgtggggataatataagaaatcttattcacacttggccgggcaccgtggctcatgcctgtaatcctagcacattgagaggccgaggagggcagatttctttagttcaagagttcgagaccagcctaggcaacgtggtgaaatcccatctctactgaaatacaaaaaaaaaaattagccaggcgtggttgtagtcccagctactcaggaggctgaggtgggagaattgcttgacctcaggaggtagaggttgcaatgagccgagattgtgccattgcactccagcctgggaacagaatgagactccatctcaaaaaaaaaaaaaaaagaaaaaaaagaaaaaaaaaactgattcacatttcaatcaatgatagtcactgacattgaaacttactatgagccactgtgatgtctaagattcattctctgtttttattcttacagcacccctattaggtaaatattattaatgtcccctgtttggaaatgtcaagttcaatcccttttattaagggcagggccagctttaagggcacattccctgcatggtcatgcagggccccaggctttgaagagccccgcatgtggtcttatgctatagctggaattcttaatgatttttgaacaagcgttcctacattgcccttttgcactgcccccagaaattatgtggccaatcctgattaaggggcagggcagggctctgtggagggttgatgtacccacagcatccatccctttaacagttcctccacgttaggaccctcctctcaacattgcctatcctagagggacccccccttatacaaatacagaaggtacctggttcattcttcaagctgtgtgtggattctcattgtgaagtgaatcaccttttaatgtatagtcacccaagtacatctgctatgttgatatatcacttgttttatgggccgggattaattccaaagtaaacactaagtactcagctgaaaagctgtaaacacaagacaggacgtgcctctccaactcccagcattgtttgccaaggttgcaagtccctctatgctttatcctgtttggcgtaacaaaatcttcgtgtaatttggtctcagcagtcatttcaaattgattttaagagttgcaggcaagggggtattgtggttgggagaacacaccttcacgtgcattttgcctccctttcttgcctcagcatcacccaacggtcttcctgggatgttcaccttcctgagcttgatgggtgcccgtagaatcgccacctatggctgtgctctgtgcaagcaggcctgcagtggtagcaattgcaggaggcagtctactccaagccttctattcaagccctgagccctggagcagggctgtatcagcttggaggaaagggcatattttgggtattcttccactcggaaggtgtactttttttctttttttttttgaaacggagtttcgctcttgttgcccaggctgagtgcaatggcgcgatcccggctcactgcaacctctgcctcctggatccaagcaattctgcctcagcctcccaagtagctgggattgcaggcacgcaccaccacgcccggctaattttgtatttttagtagagacggggtttctccgtgttggtcaggctggtctcgaactcctgacctcaggagatccgcctgcctcagcctcccaaagtgctaggattacaggtgtgagccaccgcgcctggccttgggtatgcatttttatcactcatacagcgggtccatgaatgcaagcagtggctccagatatccaggaggtcacacagttgactgttgtgtcatggaatagcaaacactatcttccgatctgtgtcctgggtgctgggcctcctgacattggtgacccagttctgaattccagaatgacagttttaacattagattttgttagtttgtccatcttatttttatggcattagtgttgcgtggattgaaaatcacacgtacacggacacatctatttacgtataaatatgccttgccttgcattcttctatcttctttacttaagtggtgagatgtttgggtttcttcatgcagtgactttggggaagtccctggagctctttgatgctctgttccttcttcttcaagctgtatttgattgtgaatgttccttgtgaagtgttttaaatcacaggtatcaaatcccctttgcttggtttgagggatttgcctctgttgccctcatattttcagcctaagagggccctccccattcctcccagggacatctaaaaacgtttatcttcttgtgtgcagtctggaaggttcttcttacgagcatctagcctcacaccaagcagccaaagttgtcttaaaaaaaaaatagcatctttgatatgatccacttggccacagcagcttcatcaccccctccccaatactctaatgtccagttaacgtatattctcagtccctccaacaagcatgatctttgtgccccaggacatttgcacatgctgtttcctgaaaggctacattccacagttcctaccctggtgcctgcttggttggtatattcagccttgctcagcttggacatctcctctttaaggacatacttcctgattcaccttccaaatcagaacaaagcttcctgttctttgccgtattccagtaagttgccaactcactggacattttctcatggtgtgcaccacacgtctatactgccagagccatatgcattacaaagacagggaccttgtctctctggagccctaagtgtgtccttaaggtttgcaaaggaccagcgtctaatgaccatgtgaatgcaggaattatgtgattgtgtgtctctctgccttcccctaagtctgccgtgtccctgggccagtccactttgtgcccagatgctcactttcccatgctgtcctggagcatgtgctcctcaaatctctccttgttcatgttctgagaaagaaaatagctcatgctaagctttccaagtagacagaaaatgagccatgcctctctagctgctgttttttaaaattttattttactgttgcttattttttgtcattgttaaaggaaaaaaacattgacttctctgacctacttccctagcattctttccctttcctcttggcccctttgcaagcccttgaatatcataggaatatattccccttaaggtctttttgaccactatgtcttttgtctagaatgcaatttttttcaagttcttacctagttcactccctctcctccttctcagcttagctcattaccttttcagataagacctccttgactcctccattaaaatcagaccccctcttcactcccacacaccctgtgttcctttcctagctgacttttgccatattgcttatcaccatttgacatactatgtattttatgtttcatttgtgtctgtctttctgcactagcatgtaagctccaaccgggtagatattttagcatgttttgtttgttgctatatccttgcagtgcctttcacaaagtaggtactcattgaatatttgttgaatgattaaacctatgaatggatgggtgaatggatggatgaatgatggatggatggatgaatgcaatagatggatgggtgagtggatggatggatgatgggcagatgaatggatgtaacagttgggtgggtgagtggatggatgaatgacgggtagatgtatggactgaataggtgggtgggtggatggatgggcaaaagaaagaatttggccttgggttttaacatcagtagtaatctctactttctagacattgagttttaggatggataccaacaattattatgttttgagacacactttctggagaaagtccagagatccttttaactcacttggcatgggcaattgttaccttgcacttgccattttgtacaaaagtatgtttggttccgtgccttccttccttctctggcaaattgaaaattatgatggaaataagaatttccaaaaacctgtggaggtgaaagaagacataaaaacaaagccacagattattgtacatttcctgttgccagattaaagccttgcatccactgtgtggaacaatttaaaatttcatctgttaattggaaaagttacagatattgcagccattcaccttatattgcggggggacagttctagtttaaaatattctactatgctgtgtctgtaaatcacagaaattacctagaaattgcaccattttggcatttcaaaatattgcttgcacctggaaatagcaccagaaaatctttcccagatgcagtttgatttggaaaatataataaatgtagttttgggatttaacttttattctggtccatcttcttttagatgcttacgggccaccatacatacacatttattactacttttaccctacccacttggtaaaagttttgtattttatttttttaactgacaacttgttaaagacagaaattatgttttaatagtttattggttggatacttttagcaacaagtaattgaaaatggaaataaaattagtttaaacaagagaaacaggtatgatttcacaagaatgttagcaagaattcaagggatgaggcagacttagggttagataattcagttaattcatcaattcgaaaatatcattaaggtttcaggtttttgcaatatttctcctatgctagtctgattgtatttgcttatcctcttaggctgtcattcctcctgtttctattatagctgccattgctccagacatcatgtggaaactgcaacacccagaagaagaacaaaaaatatccctgtttaattttcctttttaggaaaatctccctagccagcccacgtatctcttccacagacttctggtatttcattggccagattatatgatttgccttaatcatttagcaaaatatatatatatatatatatgtgtgtgtgtgtgtgtgtgtgtgtgtgtatatacatatgtgtgtgtatatatgtatgtgtgtatatacatatctaatatatatctaattatgtatgccttatatataatatatacatatatatatctaatatacatatatattagaggggaacaacacacagtggggtctaccagagggtggaaggtaggaggatggaaaggatcaagaaaaaataactatgggtactaggcttaatatctgagtgatgaaataatctgcacaacaaaccaccatgacacacgtttacctgtgtaacaatcctgcacatgtacccttgaacttaaaaaattttaaacaatgagatatctaaatgaatgaatgaatagataaataaataaaagctattgtgttgaagaaaaagaaattattaggttcccaaaactgcatttccagcctccctcccaaaatttctgatttgatatgtcttgggcagagtctgatattctgcaagttttacaagttccctagtgatatgaaaatggctggttcttggaccacattttgagacccatcaacatggaataatcaagattgatctccttgacattgtggagaagctcgactcccttgaaggacaaggaagccatgtagtgagtgaggtctttaggtttctgttagccagataattatcttttgtttagttagctaagaataactgatacagctgacaacttatggcaataacattatatttcacgtggttgataagaattgactgaggatgaaaaaacaaaggcaaaacaatttttttttttttgagacagtctcaccctgtccccaggctggagtgcagtggcactatctcggctcactgcaacctccacctcccaggttcaagcgattctcctgcctcagcctcccaagtagctgggattacagatatgtgccaccacacccggctaatttttgtatttttagtgaagatggggtttcaccatgttggccaggatggtgtccatctgttgacctcgtgatccgctcaccttagcctcccaaagtgctgggattacaggcatgagtcactgtgcccggccaaagtaatttttaaataaaattttatagaataattgaggatgaatgtagaatttaagtctgagttgtggttaagtgtatttcagataccctccaagaacttagaattgacattcagctctacgcagtattccaggtcatttgtgtgtctgtttttgcatttccaaaagccgtacgttttcttggaattcataacaaccccattcactgggttgagcaaatattactggaagatgatatgataatccacatccagcaggagaaagctggggctcacagaggttaagagtttcccagccctcggaggtagtgagtgttggcattagagcttacagcagcatcctctcatatctcttagcgacttctgggatgtgagggggcacaggcattttgcagtgactgtgagagccctcagtatcagaccatccttggtacccactccagagagacttctaccctcccatttgttcttgtcttttaatttttcagcctcctgtgaggtgaacggatgtcaaggaggattaaagaatgaaacatgcttattttctctccttacgtgcctgaggacaggccagtgagctgtggggacaatagaactgtgaaaatcttctcctggggttcttttcttggtatttggcctgacataccagggaagctactacctctgtgaagttgtggagggctcctgcccagccttcggagggaaacagcgggtcacaaagagagttttccatatttacatgattgcatttgttgctgttttaatggctgctgtaacaaatcaccacaaatttaacagagtaaaagaaacacccggggtcaggagttcaaaactagcctggccaatatggtgaaacctcatctctactaaaaacacaaaaatttgcctggtatgatggtgggctcctttaatcccagctactcagggggctgaggagaatcacttaaacccaggaggcagagattgcagtgagccaagatcgtgccattgcacgccagcctgggcaacacagcaaaactctgtttcaaaacaaaaacaaaacaaacaaaaaaacccgccatgtattatctcacagctctgtgggttagaagtgtaacttcggcatgactcaactgggtcctctgtttagagattcacaagacggaaaggcagaagttagcagggctttgtttcttactaggggttgtgagaatgaatccacttccaagctcactcagctttgcctggttcagtccctggcagtggtgagactgaggccctcaaagctttgctggctgtcagcagggagatagccctggccttcagaagctgcccgtattccttctcctgctgtccagcgacagctactcgagtctctttttgctttgaatctctccatgtttctcttttgccacatcactctgactctagttggagaaagttgtccaccttgaaaggctcattccatgagactgggcccacccaggtagttcagctcttctcctgatctcaagatctgtaacttgaattacatctgcaaagtccttgtcttagcctgcttgggctgccataactaaatgccaaaaactggttggcttatcaacaacagaaattcattgctcacagttctagatgctggcaagtccaagatcagggtagagtgaatgtcaggtaagggcccactttttggcttatagaagattccctcttgctatgccctcagatggtagaagggacttgcaggctctctggagtgtcttttaaaagggcatgaatctagccaggcatgctggctcacccctgtaatcccagcactttgggaggccatggtgtgtggatcacttgaagtcaggagttcaagaccagcatgggcaacatggtgtaaccacatttctactaaaaatacaaaaattagctgggtgtgattgtgggtgcctgtaatctccgatactcgggaggctgacacaggataatcacttgaacccgggacgtaggggttgcagtgagccaagattgcgtcactgcgttgcagcctgggcgacagagtgagacttggtctcaaaaaaacaaaaaaaggtacaaatccccatcaacagagtcctacccttatgatgtaatcacctccttaaggccccgtcttctaataccatcaccttggtgttaagatttcaccatatgaattaggggtgagaggacttaaacattcaaaccatagcagtcacctttgccatgtaaggtaacatatttatagattccagagattagggcatgggaatatttggggggccgttctgcctactacaatgatctcatcacaatgataaatgttagcagacattgctctgataacgacaacagctgctattttttaaatgtcactctataccagccactgagatagatacttcaaattgattggatcatttaatccccatcacagaagagcaaagtagagactattattcatctcattttacatgtatattttttaaaaagccaagacattgaatgctttggtgtcttgccctgggtgactcagaaggaaagtgtgaagctgagaccctagccaggaggtctgactccaaagccttggctgctaatctttttgcataacccatgtcttccttgtatctatgccatctttatgatctgcttacttgtacattgccactcccttctggtgctcaatggctctgatttccttaagatagggttacattattcacccattacagaccactccaagacatgtgttttgctcaatgattgtgtgtgcacctgtgcacctatgcacatgtatataatggtggacagtttagccattggagctccccagtaggagccagtgacattagtcacatccagaaacacagtaaaatgatcaccatcgcaggtgaacgctgactcttttccaaaggaatatcgcagaagctggtaaaacagtcgcatccaagatcaaacaagacatcggccactggaggatggtggtcacttctgcaaaatggatcaggaggatttagaaagtcattatggcagaatgggatttggggttgccaaggcctattggacctcttttctagtaatttcacccctttcagggacatctacaagctattgttaaaaatccctgagtgtttggctctccatttcgtcttctgttaaatgaggcaatatctacaatgtcctctctaggcttttaattggatcccccctccccgcccgaaatacttcttgtattgtctgtcttttttttttttttttttttttttttgagacagagtcttgctctgtcgcccaggctggagtgcagtcgcgtgatctcggctcacttcaagctccgcctcccaggttcacgccattctcctgcctcagcctcccgagtagctgggactgcaggcgcccgccaccacgcctggctaatttttttgtatttttagtagagacggggtttcaccgtgttagccaggatggtctccatttcttgacctcgtgatcagtccacctcggcctcccaaagtgctgcgattacagggatgagccaccgagcccagctattgtctctcttctatcccttggaattgccttaagctagcatgttacctcttccagggcatggcacgcctcctgctgtctcttacccggtgtctgctaagctcatccttagaaccccaagttattttctacgtcaggggctttgcatattttactttttccacctagaatcctccttttgacattctttacaaacctagctcaatcttgtcagcaaactctcagctcacatgtcacttccttagaggatcctctgataagcccaattgaagtacacactcattacaacttgtaattaattgattttctggcctgccttctcgtgttgggtgggatcctctacaaatctgtaggcgccataagggcggagaccttggctgcttcatttgttcttgtgtctcagtgcctcagctgtacatgtaagtgaaataggtgtttgtggaatgacttgggagcagcaccgtcatctctactttcctataaggagtcttgtgcatggcctagcacatattctgtccccaagtccatggaaagcactgcctgccaggctatttgtgtcatttcaggaaaataagacaaagttaatagtggtggtaatacttcactagcttccaagatttgtcaggaatatgctgtctgcttttctaaagcccactctttactggagtcttagagtataccctggggatcctttgcttctgggtcaataggagcactcattaaatgcagatttgtgggtccctcttcaagccgatgaatcagaatcactaatgctgaaccccaggaatatgcatttataacaggcaacccaggtaattcttgtctacaccgaagtgctggaataactgatgtcgagtgtttgatattaactgttatctgttcatacatacatttttttgccccaaagcatctcatggtgcttctctaagcaattttgttgcttaaaagaatgacagactggataactggaagcagacatctctctaacagatctcatcgttccagttttaagtagaaagtgcatcatctgtgttttctgatcctgagcttaggttggagtaaacctgctcagagactttctccaggattagctagccctggggcacaggggaaaagatgcctggttttaggcaacagtgaacaccatctgggtcagcaataggattcaactgccaaaaagctagcacagttgtaatttgcatctaataaaaggagatttatagaacaacaatccttacagctctactctgaagtattgtacgtacagttaatgtcattgctgtttatggttttaccagacctatactatttaatagagataataaaggttaagttaagtgaatgcttatttcatgccaagctagcgcttctaactgcattatctcattaaattcataccacttcccagtgaggcaggtactcatgtttccattttaaggataagaaaagaggggcttagtagctcggttttaaaaagtcaccccaggtcctagggtggttaatggagcccagatgtgaagtttgcttcaactccacgatgtcctgccttcatctgagcctccccaggaagacagggctcggaatattcaggaaatgtcattgatctggatcccagctctgcactcactagctgtgtgtccttagcaaggcatgttactttctgaatctcagtgtccacatctgtaaaatggcaacagtgacgcttacctgcatgaattattcagtgatgatgcccaggtatccacatcattcctaggtgtgtgcaatcaagggagttatttgattaaacaagctgctctgattatatacacaatgctaggttggggacaccatacttccaaaggaataaggacaaattagagcaggaagagaccaaaatggtagaatgaccaggaatggtctctatgaatttgaggattttcagccacaggagagactgatttaatcaacacatatttacagagcacccactctgctccagggccctgtgttaggcacctggaaaacagaggcgaaccaaacagatatgtctcttatctctatgtagcttcagaatatttagcaaacactgcatataaatatgtacatattttaaattgcgatatgaaggataagtaacacaagcatctaacagaggtaactgatagagtatcttctagagaggaaatcagacttctttgcatccctatgtgctaatataagaattctgagttaagcataatgacacggagaactttccaatgagtctcctaggcgacctctcaatagggaacaagtgctaaagacagacagctgctgggtatggctgttgcagggggtctcatacataccaagtcttatagacttggcagtctttaaggtcaaccagattttatctgtctgccttctagggttttcttgaagacgtgcactttgaacaaagaggacattgggatgtaacaaccacagtggttgaaaaaccccaaatgcccagagagaacattcaacccttagaatgttagagagggcagtataatataatgggtgagaacatggattttggaatgaaataaacgtgggttcaaatcccagctctgtcatttagtagctgtgggactttgggcagataattcaactgtaaaattgtggtatgataataagagtgaccttgctagggtgtctgaggattaaataagattgtatacctacagaaaagtggggatataaactcggatctgtctactgggacaccccttatcttcccatggtgcacatgcaacgtcttccccacttccacttcatctctttggaaattacttttgccctgcctgacttcagtctttacagagtccttctttgtttcctgagagctcaatctatagccaaagtaatgagcctgatctgattcagcccaagaactctggtcattgaacttgacttggtatgtccatcatttgtacattttggataacaggttattgctaagagggaaaacctttagctgaatccaatacattcactgcaagtgaagcagaaggaaaatgcctaattccgacttgttagccgctgaacttctgagaacagaatcagcttagctgcttgcaaataagcgagcatcacagaacttggttgagctggcaagaaggtaacaagctgtgtgtgaaaaccctggcattaaatctccacagtaaagttgcttggtacacaggatcaaaagagctgaaaagggtaaggagacaatgagcaagctcctttctgcatacccgcccgacctttaccattgggaacaccccaaagagtgtatgctctggcaccttatcaaaaaataagactgtgctttagattataattaaaacaataaattcttctcccctgcgtgtatcccgattagattgttgacactgtgtcaagctgttagggagataaactcacgctgctacttgcactcaacatgccgcttatttttgagtcactcggagggtgtttttttttttttttttcctggtgacaacttggaaataacccattggagtttccttccttctatttctctatgaagttattaacactgatacacatggaacttcggaaatgggacagcttccatcttggtgttgatgtaggtcccagaatgagccttttaggaatctggggaacttatgtgttggtgaaaatgccagaggacacatgcatgcataggatgctttaaagtcttctgaagataggttgtttaaactgtggcaggaggtctggggtcagcctctgagcagggatttaggagattgtctggctcctcacccttgtttctccaagcatcaagagcaaactctttcttttgggtggatgccactgatggctgaccaagagtcaagggtggggaggttgcgaggatcacagggtcccgtccaaatgacctgattcaggaatttcgggtcttgagccatggtcccagcaaggctgagtaattttttttttttgaggcagagtctcattctgtcacccaggctggagtgcagtgttgccatctcggctcgctgcaagctccaccgcccaggttcacaccattttcctgcctcagcctcctgagtagctggggctacaggtgcccagcaccatgcccggctaatttttttgaatttttagtagagacggggtttgaccgtgttagccaggatggtctcaatctcctgacctcatgatctacccgacttggcctcccaaaatgctgggattacaagcgtgagccacctaattttttttttaattcttagtagagacagggtttcaccatgtcggtcaggctggtctcgaacccctgacctcatgatctgcccgcctcggcctcccaaagtgctgggattataggcgtgagccaccgcacctggccccagcctgagtgatttttaattcctaaacctatgaggctatgtttgtctcatcttcagacctttgcctatgaggttttgtcacttgcaatgaccttacaatggcacgcttttcttgggccacctcagctcatccttcatatctcagcttgcatgtggcatcctccataaagctttttaaaataatgcatattttattttgaaatagttttagatttattgaaaagttgtgatatagccctgagttcccatgcacccacactccgtttcctctcttcttaatgtctcacatcattatggtacatttgtcacaatgaataaaccacattgaacatggaaatttccccttttaaatatttttagtgtacaattcagtagcattaagtatatttatattgttgtgcaattactaccattgatctccagaactttttcatcttgtgaaactgaaattctgtccccattaaacactaatttcatccgtcctgctcgcagcccctggctactttctactttctgtctctctgagtttgactacgctaagtacctcatataaatggaatcatacattatttgtctttttgtgactggcttatttctcttagcataacgtcttcaaggtacattgatgtgttcaaggtgctacagcatgggtcagttttttttttttttcacttttaacattgcataatattccattgtgtgtatataacacatgttatctgttcatatgtcaatggacatttaggttgtttacactttttgattagtgcaaataatgttgctcagaaagcctttcttaatctgactgtataccccaggtgcacccttgggtcatctctatcatagaacttatctcacagagtataagagctgatttctgtgtctgcctctcacactagacttccacatccttagtgcaggtgccctgccagtaagttgttcaccattgtttccctatgatgtagaagagttcctggttcatgtgacatgctcagcaaatatttgaaatgagtgattgtaggaggaatgaatggatagttggttggttggatggatggatagagggatggttggatgaatgagtgggtgggtggatgagtggatggatggatggatggatagttgaatggatggaagaatggttggatggatggagggatggttgggtagatgagtgggtggatgggtgagtggtaggcagatgaggtgatggatggatggatggatgggcggatggatggatggatggttggatggttaggtgggtgaatgagtgagtggatagacggatgagtgtacgtatgtatgtatggttagatggaagagtggatgaatatatagatggggggaaagatgaatatatccagaggatgagcccaagcagattcctcaaggagtagaatttgatttatgccattgatctcactggggtggtcatgtgatgataaacaagagttcagggcaaagaaaacacaccaggttaaagtagcattgagcatagaaagagtagatctcagggcgggatgggggagtataatttgctttactttttttttttaacctaaaaatatttttatttagtgtttcagtaaattaaatcaatgacagtcttttccatgatcctactgccaagatagattttattgaacttttaagtataaaaatagtgcacagacagataataataggagaaaataaggaataaaatgaaaatgttcttcccaaccagtctctctataaagataaccacagtaactacgtcttgtttatttgccattattcttggggggattttctatgatttgtgaatatgtgtctgccatgctcttttttaacgagtgcctgtttgttcattgcataaagttaacaccacttaactgttcctcactgagggggacatttagctttaggctatttccaacagaactgcaatctctttaaaataccttgtgagtatatccataaggtaaattatttgaaggaaaactgctgggctaattttttttaatgtacatacacttatacattttggtagatgttcccagatgcccttccccaaagtttgcaccacctgatgttaccatgactcatttttattgctgtcagtcatttagtgtgggtgaggcacccttgttaaaagacataaggttggagcacatagtccagtttacttctgaacatcagtaggacatttcaaaaaaaatgagtcctgctattccctaatttataataaattctgagacgggggtggagatggcttctttacccatgagctatgcacattagatcaaaaaatgggggagaatccagagatgttgaactcaagcgtgatttgaaattctgtccattttcttgccctcagtggatgtttttaaagtagaagagacaggaaaggttaagactttcagtctctttcccttaagagtgatgtgtgattctctactgtctgggagctccagggcctgacccacagattggctgtcactaatgctgggaagaggtgtcactagtttagcaacccttcattctatgccatttcctgcttccatgggtcaaatgtcagcaccgttcaacacgggctgaagaagctgacaaaaaaggtgcttgggactggatctttcacagagtacaaatgaggtagtagtggaacaattggtgaacacactttagtatatatttgacacaatttagctgctatgcctggcatctctccttcagcatatcctgcctggtagttatcattaaaaaatcgaagaatatataacatgtttataatttcttctttttatccatagttcaaagggagaagcatagcttctcttttaagagatagaaagatatagacatagacttagatgtatgtcattattctcctttaggataaaaggtggctagggctttataaaatttcagtgtaaatacatggagtaccatgtatttaccaaattaccaaatagtaatttggaggaggggatcttcgtcaacaacataaactttccattaacagtaataccctcttgcagtgtcacacacgagtctttataacttaactcatttggaagtcaattctttccagtgtggctgaactataagtctgaaaccagtgttatgaaacttgcaaagaaaagattaagttattctgatatgaaaatctttattttagaatgcgatatttatgcagtacacagtgcaaatatacaacatagcgtttactgtgaaacgactccttccacttctgtccccagcaattcagttcttctcctccgagactgcactgtagctatttttgagcattaatccagaggcagtcaattaataaacaagcatattcacacaaatagtagcatgtgatcatatgacaggaaaaccaagttcccagactgtggcaaaattgtttcactaaggataaaagttacagaaagtatacttgtttggcagagtttattagataatattattagataaaagtgttagcaggataggatgaattcatggaaatgtgggatttctcttatgtatgtattgctttattaagagcaaacgcaatattaatatcacaggtttagacgtctgaaaaacatacagggatttggctatgcctttcataggctgtgtgatgtcagcaagctctccattcctctcaacctcacagtccttatattcaaaaagcagaagaatgtctctgtccaagggttgatacaaacgatgaatagcattagattaaaaggatctccgctaggtgcagtggctcatgcctgtaatctcagccctttgggaggctgaggtgggtgaattgctttaagcccaggagtttgagaccagcctgggagcatggcaaaacgccatttctactaaaaacacaaaaactagctgggcatggtggcgggtgcctgtaatcccagctactcaggaggctgaggcatgagaattgcttgaactcaggaggcggaggttgtagtgagccaagatcacaccactgcactagaacctgggtgacagagagagacttggtctctcatatatacatatatatatatttatatataatgttatatatacatagtatataatatatattttatacattatgtattcaaggtcctttatacataatatatatgtatatatgtttatatatgtacatatgtattatatatataatatatataaaggaccttgactatagtagtatttagcgaaagcagtttgcttgttttcctctttacctgctacccatattatgagttacaggagcagctcctcaaacagtaatatcttgttgtgctttatatggctaaatttaatggttaaaaaagaaagagagagaatgtggtggaatcaaagagtagtttcttctgatttactagtatgctccctccccaacctccacttcttggctgtgttcatacatgaatggagtgtgtagacattcattctcatctactaattgctttcttcatagacaattctagtgattacagggacattgattctaggggatgtgccaaattacctaagtgccatccagctctcaaactttttgtaacctccctcaagcaccttttgaactctacctattaactggcaagcaatcgagacgttatttaaaaatcaatattatcttttcattaaaaacagccccccggccgggcatggtggctcacgcctgtggtcccagcactttgggaggctgaggagggcggatcacgaggtcaggagtttgagaccagtctggccaatacggtgaaactctgtctctactaaaaatacaaaaattagccaggcatggtggcgcatgcctgtagttccagctactcagggggctgaggcagcagagtcgcttgaacatgggaggcggaagttgcagtgagccgagatcgcgccattgcactccagcctgggtgacagggcgagactccatctcatgaaaaacagaaaacaaacaaacaaaaagcagccccccatctctctcagctgttatgctgctgagtaaatggcctcttctcacctttttgtgttccccagtgcacttcaccttcactgtgaaggtcatgtattcatgcttctaatgttttacaattaaggataacatctccactttggtgaatttaatgagacttggcagtgaccccagtgacctggtgaacagccaactatttaggttggtgcaaaagcaattacggtttttgcctttttatttttaaaatggcaaaattaaagtggcaggaccgcaattacttttgcaccaagctaatattaaggagcctggctctaaagtcggactggctttcatcccttattacttgtgtaactctgggtaagttacgaatatgctttccctttccagttcttaatttttcttctgtaaaatgggcataatcgtagaactggacttctagaatgtctggtgaggattagatgagtataaagcgttcaccatgagggttctaatcatttagccacagtaagcattctttgtgtgttggctgttactgtgaatgccatttagttacctgaatccattcatccacttcgtctcatatattttccaatatttatggagtgcctgtgttggtcaaagcaccaatgcagagccgccatctttccctttgatttttgaatgtcccaggatggtactctagatggttccacacaatccagctgttgataacaaagacaggttgttcaccaaatcagagagtctttgagagttcagaagagtttaaaagagacagatgggtgcctctttcatggccccgagcttttctgtagaggttgtctttcacgtggagacatctctgttccttttattttctgttgactcatagcaactcgggagggagattattgaagaacaaaagggaggagtgtgtagttctgttttcaacactccttcaaagggaggagtgtgcagctaccgattaatagatttgaaggatgggcattcttttttttttttttttttctttctagatggagtctcgctctgtcacccaggctggagtgcagtggcgcgatctcggctcactgcaacttctgcctcccgggttcaagcaattctcctgcgtcagcctcctgagtagctgggactgcaggcgcatgccaccacacctggctaactttttgtatttttagtagagacggcgtttcaccgtgttaggcatgatagtcttgatctcctgacctcgtgatcacccaccttggcctcccaaagtgctgggattacaggtgtgagccacacacccagctaggatgggcattcttgtagagagagatagctaagatcatgtttctggcatccaagctcttggttataactctgggtttgctgcttgccacatgaatggcctcggacaagttattgaacctatctgggcctcagattccccatatgagaatttgattgtgttaaagtattagggtagctaacagagcacctgaaagttattaatttgaatatatgttggtaacagattataaagttgtgaggtagcatttatttggtgcttactatgtcccaggaagtggggtaagaagttcacatcatgtctggcagtgtagtaacctgcagaagagcca[131 bp omitted]ctcccacctcagcatcctgagtagctgggaccactagcacacatcaccacacccagcaaatttttgtagtttttgtagatactagagatgctgttttgccatgttgcccaggctggtcttgaactgctgggctcaaatgatcctcccacctaggcctcccaaagtgctgaaattacaggcatgagccataacttctggcctagtcagaatatttgtttgaattcttaccctcacaattacaagctgtggccttaatccctttccttaatgctttcttgtcttcagatcctccatctggaatacgtgaagatttaatgagatgatatctatataacacgctttgaaaaatgcctgacacgtaaagatcacttaataaatgttggttattcttactgtattaaacatcccaattattagatggtataacttgcccaggttcacacaactcagaagatacaagaggaaaacttgagttggttttgtcagctcttctgcagacgtagggggctaaatgagtaacattctgaaatgaagtcttcggcatctccaagggataaggatgcctggaaatttcacctttggggcacattctataaactgtacaaaattaaatccctcacttcatttccccagaaagacccctctgaagcattgctctgtatccttgcaaatctgtaccacgagacaaggggatgtcagtaggatttggtctccccacaaaatccctgcaaagatgtatgaggctgcatataaattgcattgaatgggctaacattgcttttatgctgaatatcggcaaaaagtatgaaatggagattacattttcaattctggctttttcccccaaagctttaccaagctgccctcatcctcacccctccatcatagtgcaattgcattggtgtggagtcctagctctcctttccttgctgggaagtgtacctaacacttgctgtcaggctggaaccgtgggtaacatgttccttaacagcaagtttctttattttccttcccccacatctctgtcctttttttctcactactttttgttgttaagacctgtcacacatgagaatcacaaaaccaactacaaataaatggcattcttgtggatgctaaaatcggtatatctgtctcttgggttgttcagggtagaaataagacatcgatgcaaatatggttcatccaccggcaatgagacacaggcttattatttcttcctgaaatacatatattcatatcatctatttcagtttgtatctccaaacagccctaaatcattgtgaggacctgggctccagtttgggtctatgaaaagagggtttacccgtggggggtcggggggtggttgtgcatctggttttacatcagcattaattccgatatttcaacagccccttcctgcccacattccttgcctctcccttctgccccctgaatattattgcctggctgactccccaaagagaaaatgtactaagcgaacttgacagattccggctggctccatatggcatggcctgagtttcgtgttcctgggacccccaagctgctctcaccttattacgatggtagtaactacatgcaagtcaagtccactgcattggttttaattccttgggccctggggactagcctcagacttcaaggtggcattggatgcaacatcatccactgcaaatatgacctttcccttctcttcccataaccacacagctggggggaaggtaggtggaaaatagaccctgagtctaggaaaatcttcgaaaaatgcagagataatatcagagggctttgctagggctggcagcagagtctaacaaagacatcttaaagcatcttgttgtttattgcttgatctgaacctttgcactcccacacataattgagactttgactttgattcataagtatataatttgaattcctccttctctctacactgttttaaagccatggagaaaattaactccaaatcgaataagtgcatttcaaatggataagcacttgcaacccgatgattaaggagtgcagttgaatcccatatgtttttaaataatcagaatttgttagaatgcatctgtaaaagaaagttttttgacagcttttcacttcacccagagtatatagaaaatgttgctaccttcatgtaatgtagtcttccatattctgacagaactatcattgcgtagaatgaagagaacacaaagagggcagagagtcaccttgttcaaatagctaaaagggatagcaagaggaagatagactttactccaggtggcccaagggaaaaaaatacatctaaagggaaagattttttaagggagtgaggagtgggaggagagttagagaaatagtgtagcaatctgagctgctgaagagaaagtgctttagtgttcacagtaggggctgcagtttgcagaggctagagagggggagtccctggtaccatgtctgaagttccttctaaccctgaggtccttgatgctgggcattggcacacctcacagtgagatgatttctgacacaaactggattggtcaccattataaatgattcaacttatttcagaagccacttttgccagctttccgctatatgcaacaaaaacctcaacctctgaatatgaaaaattcaatccatttgctttccttttagctaaaaggaacccaaaactgactccgcttattgctggatttgtatgctacttgctaaataaatggatctagtctagatgccaacaataccctgaggatgtagaaaacctcctttgcttgagtcgagcgccttgaaatagctctgttgcatcttgaacggggctagtttgttaattcgatgagtaaaggggagagtaccatcatttcgtttgttcccgtgcggaccgaacacggtattagcctctctgcagatacaatctcacttagacgtaccagccactgtgagagtgtagaagagtttatcccgaatccacaaacaggaaagtggagtcataggcaggaatgcactcaggttgtggtgggaagtggatcaaaacccagttttgtttttttttttttaattttaattttagggacagggtctcggtctgttgcctaggctggagcgcagtggtgtgatctcggctcagtgcaacttctgcctcccgagttgaggcaactctcctgcctcagcctcccgagtcgctgggattacaggcatgcaccaccacactggctaatttattgtattgtatagttttgtagagatgggggtctcactttgttgcccaggctagtcttgaactcctgggctcagtgtatcctctggcttggcctcccaaagtgctgggattacaggtatgagccggggtgcctggcccaaacccaggtattttactctacaatgcttgcccttttctcagcccttccttgcttgcaggacacctgaagtcccttgagctgctgtctatgggaaaggactcaagagcctgccttttcccgggtgaaggtagctggttgggcctggggtgtgaagcatgaaacaggtactgtgcatctcaccacagctcagagatggaaggatgcagcttcttctgcttttgttccacttcaagtctagcccctcttggggctgcttctctccgaggggaagtggggcacctggagggggggcaggtgtaggtgattggagctggaatttctctagtgtgatagtggcatcagctccacattctccccagcatgtcgaatttgtaacaaagctagatgtgaagagtcttccccagaacatccctcaataatttgttttaataatagacattttcagcttaaatgtgagtttttatcggagatttcccccttcccaatttgtgtcagcaaccgttattaaattcctaggaaaaggcaaatgttggggcttggtcagaagtgaggccgacgtataggtgccagttccagcctgatgttccccaccgatgtccatgtgctgactcagtaaacaactgcctttcttctgaatggtctatgtgagctgttgattatcatgttcttaaagaaggctgaatatcttgtgcctttcttgttaagcctgtgtgtcttgggacagctacacacactctctaagttacagttttctgagctttgggtgaggggatgttcgtctttttctgcctgcagcactgggcctcgggaagcaacttagggttttggctagagcaaggacagatctgacatctagtccttcttctgtgttttctgtcaatcccagtttccctctctttcaacctgagctggtagcactatccttttactgtttagagggttaagagagataacacctagtatatagtagctgctcagaaaatttctcgtttccacaaatgagaaagtgaatgcaatagacatttgagaacagtaaatgtgtaatagaattattagttctttgttctaattgtcaccggctccgtttaaaaaaatacatatatggtatttactttgggaaagctgcaagccctgtctccatcacctccttttttcaagcgtggactcattttcatctgcggattccctcttgcctgaaggccttggtgccgcatgagcaagtgcagtgctgagagctgtgtatggagctggaagcacaggccactttctgctgccgagaaatcttctgccctccgagggcacaggcttgactgcaaggggatgtgggaagccatttgtgagaagtcgtaattaatgatctgctgggccttggcacttatggaggaagcagaaagcagctgggaattgaaacagcctcttggataaaagttgtcctcctggggctgcttccctctgaggggatgcgagggacctgggagggaggggcaggggtaggggtctctgtagtgcgaattactcaatgctactgtcttttccacagcttatagggctgctacctgccatgcatgatatccaagtgatatggccaaagaaccctagctcttgagacaaaacatcctgggcttgaattctagctcttcctattgctccttacatctggacagttgccctccatctctgagcctatttttttcatttgttcaatgaggatggtgctacatactccgcaaggctgtctggattagaaactgagtaacataaatggaacagagtaaggactcagaagtacttgggataaaatatacagcaagaaacatagagcccccgtcttcagggtgcttacggttttgtggataatagaaatcgcattatctatataatgtgtaaacttgtggatatttctgtagatattgctgtagaatgtatgcacatatgtcaggtgatattagatataaattgctgctaaattattcagatacttctcataatataaattgttcttctttggtggaatattgggatgcctctgtagtgcaaattactctcttttggtgagttagcaagaatctatcataccttaatttgatcttacttgctgctaggctgatttgaaagttaacttacccttcagatgactaagggctattaaatccctgaaggaatcttgcagataactacagcaaataacaatatcttctattgaaaacatatttggtattccttgtaccaaccttataagaatgctttgagtatgacatgaactacagatactccttgacttaggatgggatcatactgcaataaacccatcataagtagaaaacataataagtcaaaaatgcacttaacacccctcacctactcaacatcacagcttagcctagcctgccttaaaagttctcagaacacttatattagtctgtagtttggcaaaccatctaacacagaggctatcttacaataaagtgttgaatatctcatgtaataattgaatgcattactgaaagtgaaaaacagtatggttattatgagaacgcgagatacggtttctcctgaatgatttcactttcacaccattgtaaagtcgaaaagtcttgagtcggggcgatctgtattgcctacaaatcaagccgtgcagcgtccacacctagcaagggctagtgatggttatcatagcaacaagtcctcctgctctatagtcataacaataatattttgtagcatctattccattgtgttgcatgaagggttacagaatctaatatatgcagaacgctgggcacagtgcctggtgcattgcattgtaagagctcaaacagtgtcagctgcaatcatcctcattaattctatcttcgcagtaactctgtgaagtgctttagggaggcgttacagtcccactttaccggtgagaaaaatgaggctcaaagaggcttgttcagtccgcacagctgacagtgattgctgcgtcagggccagctgtagccttattcctgaatttctccttatacctcttcagcccctccttccatttcatcccagttgttgttgttgttgttgttgttgtttcttaaatcaagagtttgcatgcatcttccctttgattgcctgggattttttttttttttttttttttttttggaaagcagtcatgaagatattgcctagcctcgggtacacaaattctggatctgctttccaagagaacccaggaggaagaagatgctgtgacaggcatttcttatcagggagaggctcccctgcttgcacttcgaatccacaatgatgaaggaattttccttcctgggcgtatttgcttatgttcttggatgtgctggtaagcccctgcctacccacctctatgtaaatgagtcctcccacaagctcgggatgttctgtccccaaatcctgaacaccatgtacaggagatgggcttagatgttgcagaagcaaagactgagaggggggcagcttttggctgcaattaactccctttttgactttatcctgggttggaaaagaccttcacctggctaggagatctgaaaatgtgcctatgattgtcagctgattttcccaggtcatgaacctgggcccctcagcctggaacaccgtgggaggagagggaagccaccctcgtcactaaaaggtgctacccttttattcaccttcctcaagttagaagaactgtttctccagctgtaccaaggctgtgctggaattgggatcgcagagcagtgcagaatatttattaaccacctactatgtgactgcggaaatagactcatcaaactattttgggtccctcctggatgctgtgagagacctaaagtaaatcgttgcaatacttgggttcttgacgaagagcgttggcttcacaatctggcagacctgttgtcctatcccagatcagacttactgaacctgtgaattggggcaagttatttatctcttctagattcatttcccttacttgtgaaagatggtaataatgtgtgtcatgtaaaaatatgaggatattagataagcactttgtggtgtcttggacctaaaaagcagttagtgtgtggtggacattgtatatctttaatatccagacctttcctgggatgccaaccttgttatctacagacatactgcctgagggtggaggtttgaattgaggatacagataggacagtgttcttattggggtggctgataatagaataattgcttatttatcttataggttgggaaatattggtattttaaaggtgggttttccagagttgggtataagttcagctacccaagacaacaggttactggggctgtatggctttgcatccagagttaaaagccaggcctgggaataattaaaatacttttcatcctgggaaattctgctttaactggtttatagcagaggctgcgcatcagatgttttcaaaattaagtgatggtttatgtacaatctaattcatccgcttaagtgtacagtttgaattttgatgattatatacaatctcacagtctccactacagttccttgaccttaagtttccttacgctttattttcagtctattctgcccccccattccctaacccctggcaagtattaatcagctttctgtccctgttgttttgaatttcataataaatggaatcatactgtgcagagtcttttttgtttgagtcctttccctgagcataaagtttttgagattcagccataattgttgcacatattaacattttgttccttttcattgctgagtggtacgtcacggtaggaatataccaagatgtgtttatccattcaccagaccaattaatggacatttgtttctagtttttggctattaagaatgctgtggaatttgagtacatgtctttatgtggacacatgtcttcattttggggagataaatccttcaaagtagaaatgctgggagacatggtaagttcagatttaacattctaggataccattattgttgttatccaaagtggctgtgccattttgcttttccactggcattgtagcattgggtatttatttattttttagacagagtctcactctgtcacccaggctgtagtgcactggcacgatctcagctcactgcaacttttgcctcctgagttcaagcaattctcctacctcagcctcttgagtagctgcgactacaggcgcccactaccagagctggctaattttttgtatttttagtagagacaaggtttcaccatgttggtcaggctggtcttgaactcctggcctcaggtgatccgctcgcttcagcctcccaaagttctgggatgacaggcataagccacagtgcctggctggcattgggtatttttcgcacagctcccagatgtttatattgttatgtatctaactagcatggatatcctctgggctctgttttttctgatttaatggccacctttgggctatcagatgaataaggatattgtcagtatcaggaaagtaaagaagacatttgtcccaacccatatgccccaagttgttcaaaactattgaggaaagagatactgtctgggttttcataactcagttgcatttttatgtcttgcatatcaaaatttgtatgcagggttacgttccccaacattaatccacttttttttttttttaataacagaggacttgacttagataaagagaagtcttattccctcaggtaggaagttgtttccacctgctatagacacattagttaataatcaagggacaggtgtgttcactgacctacctgttattttgttttacaactataatgactagttctgtttatgcatgcacacacagctgcaccctcgcgtgttgcttttccctcatgtttccaggcagaccacgcagtgactatttaatgctttgccttgctatgcgctgttgcttatacatttctggaagacattttcccatcctctgcagtttaccttgtacttttattttctccttgttgaattacaaatagattaacacgctcaataggttttccttgaatccagctgaatgcttcaacctcccacatgtgctttttttagttttgtaacatgacagggaatgaggtgaatgagctgaggatgtggcctttgtcttgggctgaagcagttctcaacccccagatggcttgtccctactcccccaggcaagagcccatacctcaagattataaagagaggttttaaatagaagattgttctatctaaacatgtgcctaactgacatctattttgttattatgtgaaacacatccatatataatgtatatgtatccataatgtatgtacatatatgtatttcccaactctctcatgtctgaatattacatcccttgactatcttctgtggctctccgagtccacttggcatttggttatcagcttatacttaacagcaagtgtcggtctgcaggcccatcacctatttttgtaaataaagttttattggcacatagccacacccatttatttacatattgttcatggttgctgttttgctacaactgtgaagttgagttgtgtcaacagaaatgtatgccccatagagctgaaagtgtttcctgtctggctctttacaggaaaacacaatttctgatccttcttctgtgctaccacttggtgtgtttgcaacttcactgtgctgtctgtgggtatttgtgtgtttgtgtctttttttttttttttttttttttgagatggagtcttgctttgttggccaggctggagtgcagtggcgtgatctcagctcgctgcaacctctgactcccgggttcaagtgattctcctgcctcagcctcctgagtagctggcattacagtcctcctgagaacctgccaccacgcctggttcatttttgttttttttggtagagatgcggtttcaccatgttggccaggctggtctcgaacacctgacctcgagtgatccaccctgtcccccggcttcccaaaagtgctgggattataggtgtgagccatggtacccggccttgtgtcttttctacgtggacagttagatttgtccagttaatcttaccttgggccagtcacttaacttctctcggttttatgtctacatccataacttgggcataataacagcatctcccctgtagagtggcttgaggattcaggggaaggcgagcaaagcacctggcattcacagtgtccagttcacatgacgagctcatttaatggcacccaggcttgatagaaggtatgtgttatgatctgggtggtatctcctgccattttggagcagatgctaagaagcaagtcattcagctgaggtctaggggaatagacagagatccaggccgttactaggagacaagctatgcaatagtcagggttccaacattgcctgcctcttccagcatccgtcacctcctgtttttgttcagcctccttgccactctgcagttagttcaaacacaattctcacttcaaggcatttgtttttgtctttttgaaatggagtcttgctctgtcacccagtctggagtacagtggcacaatctcggctcactgcaacctctgcctcccgggttcaagcagttctcctgtctcagcctcccgagtagctgagcttacaggtacctgccatcatgcccagctaatttttgtaattttagtagagatgaggtttctccatgttgggcaagctgatctcgaacacctgacctcaggtgatttacccgcctcggcctccaaaagtgctgggattacacgtgtgagccactgcgccttaaccactttcaggcatttgaacttgcagttcccactgcctcaccttgtttcctccaagacatccacatggtatactccttcctcaactactttatctcaaatagcggccccatcactgtcttgctccacgccctcatactcatcacatgtatgggtcattgtacttcatatcaatgtgtttatgtgtcagtgtcctgtctcctgtactgaaaggcactccccatgcagttgagaaattcatcttgttatatgcccagcacagtgaatttcacctgcgtgaaataggggagcactaaatattagttgagtaaatgcatgaatggatgaacattccttaaagtgggaatgtctttccatgtttcagaattctcatctgccatctctcttcccatgcatgaagataagcagtagactatccactcctgcacctgttcatatacatatagaaacacgcactgagaccgagcaccacacgcacagacactcacacacacacatgcattcaaacctctccatgcagacacattctctggagcagtctggatgcagcttgtaaaagtgcctcctcattcagcacttggacaacctaagagcctcttcagtaagatcctgatagctttattggagaggtcttgggtagaaaaaaagctgcagcttaatgaaggccttttaacagtcaatctcaattccaaggaaaagcaaatctattaccagcgtccgataatttctgctcagggattcccactcttggaatggatttttttttccagggcctcttttctaattaactctggagcgtagattacaagaggccggccttgtgaatgaagggggcacctcggcggaagtaatcactggaggtgatgtttaattaaagagatgctgttagagggaaaagacctgagcaggctggagtgctaatcctcttgccgtgctagtgtgtccctgcgtgattgtgattgatgagctggtcctgctcacatcttcatctgcagcgtgctcatccctgcaggaggggcttcagctccctccacatacatgcttagcctggtgttgttctggcatggtgaaagggatggctgtgcagtttccctttctcactctgcatttttctccttttctttttctcctttattatagctagatagttggatagatacacatttagatatacaactatgtacagatatatatggacctctatatctatctactgtctgcctgtctatctgctatcattctttcgttgtttgtctatcattctatcactctgtacattcatacattcattatccatatatacattcatccattgtctacctatctactatctacctgtcattctgtctatacatacatcaatccatcatatgtttatccattctgacatcgtctatctatacgttcatccgttacacacctatctactatttacctatcactctatttgtctgtacgtacatcaatctgtccatcatctatccatctatctatacattctcacatcccttatctagctatacattcatctattatccacctatctactatctacctatcactttatttgtatatgtatacatctatctatacatatccatacattaatctatccatccatctatccatctatacattctcacatccattatctatctatacattcatcccctacttatctactgtcattttatcattatgtttgtctatacgttcatcaatccatcagtctgtatacttcacatgtccactatctatgtatacattcatccattatctatgcctctaatctctctattgctctgtcattatatctacctacctatgcatctatctctatctttataaaatcttgctgtgaatctcagcgtgtctgtctccccatgtctgtgtctggctttgtcttcatttttctcattctgtccaaatctctctgtttctctgcctctgtctgtctctgtttcactgtttgtccttttgtttctcctaggtctgccctattaggtaattttagggaacgtgtaactgatacctttttttaaattcaagagtattaatggttgagtaatgtaaaagcaagtttttggttaagcatttactaaatgacaggaactgcctgaggtaccttttggcaagtatttcataattgttcttaaaatagcaaatattaatctcttaatatgtgccaggtcctaatgccaagtactttatgtattaatcccatttaatcttcaaaatagtcttatgttgtagcttcttttgctgttcctattttggagattaaaaaactgaggcttggagagagaattattattattattttttttttgagatagagtcttgctctgtcactctgctgcccaggctggaatgcggtggtaccatcatagctcactgcagcctcgaactcccggactcaagaaatcctccaacgtcagtctcccgagtagctgggattacaggcacacaccactatgcccagaaaattgttttttattttttgtagagaccgttttttttttttatgttgttccggctgatcttcaactcctggcctcaagtgatcctcccaactcagccttccagagcactgggattacaggtgtgagccaccacgcccagctaagttatgcatattatctttaatccacactttcgcacaccaagataacattttatttccaccttttaatgatgcatgtacaatggttttaaaagttaaggtgaattttccttggtcagagtttttaaagaatgtcattctagggatcttacttcagatgtgtctctctccaaaatgctccttttgaatggacagaaaggtagacctgtgtctccccatgtttctctgtgattgctccccctttaaatctgtgtcccagctacatttagtgaacatctttgccatgtggcttctgaatggaggaggctgcagaacttccttcagtcttctgagccataataaattggcagaaatgtctgatttgacgttttcccccccttgttcaaggcagatgcttttctcattactgagaaaagaatgacactttgtctctccaagagctcaggcgttcataatagataagtgtgcagtttctgatcttggagctgctagctctgctagactaggggaggctcagctctatcagggctctatccctggcgagattaggtttgcagaatctctactggagcttgtagctactcactagagtggattggtctatgattctagtttcactgtttatagttcaaaattttccagccagccaggctgtcttcttaattagaggggttgagtctgacatggaaggagtggataatgtacctttactccccattttcatctatcaatggaaaagaattaaaataaattcaactgtgacttgtttaactcccacattaacttgggttagcaaattctactttgtggaaggaaccatgaggaagaaaacagattgtaactatggtctgtgctagttcataagtccaagttcaactctggttgaggtgggggtgttgatagctttcactaaacctcaaattgttcattatcttctagtcttggtgaaacaagctttcccatgtctcaaaaagacccacctaataaatataatcaagtcccatcttacccagaaacagcacctgctgttactctctgattctcattgttttgctctgacattagggtgtctttatcagcctaaggatacatagattcttagacagtttcaatctcttatcttctttaggtggcctaaaatctaacactggagatctcttcatcatagcacccttggaaaactctgaaagctgtcataggtctagaaatccatcaactccagattctaaagagacaaccaaatggctcacacttcttaccgtacctgcacccacaaatctggctcttaaataaagtcatcagccctctaattatactaagatattcaaatcatgagattcgctctgaagccaattcttcaaccacccacttacccatctttgctttccgggcattgccacatccctttttcttggggtttcctccgcaggaacactccttatctgcgactttggttgactgtaaatcttgtactgttgctttgctatttaatgcaacttgtcatcttgtttttggccttgatttgatatcctagtaagggactcttcttgggttttgctttaagattcagtctgctgaagggctgtgactccattgtgagcagaagcagcctgggaaggcaggactagacacaccaaacatcagccagacaggtgatgtgatccctctgattttcagaattcctttgagagatcacttggcccttccctgctgatctttgggctggagtcaaggcaatcttttgaattagttctgtctctctctaaattatttgctttatgtaataggaacatgcctcatttgggctctttattttatctattttatttgaaacagggtcttgctctgtcacccaggctggagtgcaagtacatgattgtggctcacagcagcctcaaactcctgggctcaagcaatcctcctgcttcagccccctgagtagctaggaccgcaggcacatgccaccatgcccagctaattaatatatatatatttaaaaacatgtccttgtatttaacagaattttaaggaagaatttgatttttagtaatttacaacttctctggccaatcttccaaatctggctaattttcattgtaccactccgtgtgttccttttttgtcattctgaatattgatgattatagtctatgttcctaacgcctaggctgataacactctactcagcctactttgttcacatttccagcatcagaatcctgtgttccatgcttgtatgttgtggaacgagctcaattttcagcattaaatttaccatgccaaaaggtggaaaaagactctgcaataaacagactacttagcatgattttgtctgccttctgcatttggaattcccaacataacctaagcaggcataaaattcagttctttaagattcgtttaccaataagaatgttgtaaaaattcaaataaaaggaatgcagattagcagagagaatgctaagcaagttttttgtttctgtccttggtgctgaaaaaaatgggggtcaacttttctaccttagtgaatttaatgatgtggtgattgtatttaaatgactatgtgacaagggatcagatacttccctataatcattctttagtttcctagaactgtagaagcttggtggcataatgagagctgcctgtcacctaccctagaactgtcctgtctcatatgacagccactagccacatgtagctacttaaaacgacactaaataaaattaaaattcagtttcttagtgatatcatttagatattgtcccatctaaatctcatgtcaaattgtaatccccagtgttggacttagggcctggtgggaggtgattggaccatgaaggcagatttttttatgagtggtttagtgccatacccttggtggtagtggcatgatagtgaattgttgtgaaagctgactgtttaaaagcggttggcatcttccccttcactctctcttgccccgactctcaccatgtgacatgcctgcttctgcttcaccttccaccgtgagtaaaagctccctgagacctccccagaagccaaactgatgctggcaccaaccatgagctaattaagcctctcttttttgagacgtcccccaggctggagtgcagtggtgcgatctcagctcactgcaacctccgcctcccaggttcaagcgattctcctgcctcagcctgccgagtagctgggattacaggtgcctgccaccacacccggctaatctttgtagttttagtagagatggggtttcactatgttggtcaggctggtctcaaactcctgaccttaggggattcgcccgcctctgcctcccaaagtgctgggattacaggcgtgaagccactgtgcgcagccttaagccccttttctttgtaaaatacccattctcagggatttcaagaacagactaacacactcagtcagactgtctacctttcaggcgctcaacagccacacgtggctagagtttcctgtgttagacagtacagatatggaatatttctgtcatctcagcaagttttattggacagtcttcccctagaatcattgcaatagactcagtaacgcccacaaatctgtccacatcataatcactggaacctgcgagtgttactgtatatggaaaaaggacctatgcagacagatttaagtaaggagaattatttcttttgaattggagagattattctatagtatccagatgagtccagtgtaatcacaacagtacttacaagggggaacacagaggtgtagagtcagagtcagagaggaagaaaatgtaataacagaatcagaaactggagtaatgcattttgaagttggagaaagagaccacaaggtaaggaattaaggtggtcattagaagctcaaaaatggcaaagaaaccgatgatcctctcagagcctccagagccctggtgacaccttgactttacgtcagttgagaaatcagaactaaaagagaatatgtttgcattgtgtgaagccacaatgtttctggtaatttgttataacaacaatagaacgctgataaaatcatcattatcattgtcatcatcattatcgtcatctcagtaggtgcttggttttagtttgggttcttataattttgcattctcaaatagaaagtcaaaacaatttcttagttatttgaagaaccacactgataagcaatggcaccttttattttttgagattttcttattggcttgtgaatgatttcttctccgagagtggttatggaggcttaaacagtatgtcatgagttagcaatgtctagtgggggagctataatagataaaggtgagaagagataattcacatggccccactttctgatttttttggactgggatgtttgtcaattgcaattctcgttttgagcatggtggtcagatgagattggccttgctgaagcacaggcaagcatcccattaaatgcttttaggtgattcagaaccaaagctcaattcagtattttaaaggcgccctttggggagaccatctctggccttcctaccattggcggctagtgtgttattttccaagcccgctgtgtgatgatgggtgtgatgtgtcacactccttctctgctccctcaacatgctcctttcctcccaggctgggtttgatggattattttttctggaaaattttcctaaccccctgcacactgccatccaagtcacttcgcttaaataacaataacagcaataatagcacagagatgttcagcatagtgataagaaatttactttcatgacctaatttattgtagaaataatcctatgaagggtatgcagtttttatctctcttatgacagagaggagccaacactcaaaaaggtcatgatacttactcaaagccatatacctggtaagaggcaaagccagcatttgaacaacaggccttctgagtctggaagtggctttcattccgaaactcagcagaagtttctccttcccaaatgcttgagctccttaatatcaggaactgtgttacctactttttttttttttttttttgcactataaaatcttcattctttattttagatacaggaggtacatgtgtaggattgttacatgggtatattggaccaaggtaatgagcatagaagccaacaggtagttttttactccattccttcctgccattttagtagtcccccgtgtctgttgttcccttatttatgaccgtgtgtgcttgatgtttagctcccacttataaatgaaaacatgtgatactcgttttctgttcctgcattaattcagttaagataattgcctccagctgcatccatgttgctgcaaagacatgatttcattctgttttatggctgcatagtattccatggtgtagatataccacattttctttatccagtccaccgctgatacacacctaggctaattccatgtctctgctgttgtgaatattacagtgattaacatacttgtgcaggtgtctttctgagataacaatttcttttcctttgggtatttccccagtcatgggattgctggattgaagagtagctctgttttaagttctttgagaaatactcaaacagctttccacagtggctgaactaattttacacacccaccaaaagtgtatcagccatcctttttctctgcagcctcaccagcatctattgttttttgactttttactaataggcattttgactggtgcgagatggtatctcactgtggtttagatgggcacatatttccctgatgatgattataagcattttttcgtatgtttgttgactgtgtttatatcttcttttgagaaatgtctgtttgtgacctttgtccatttttttgcatgtgcagaatttattcaagttttaatataattccatctttaagtctcagaaacctttttacatttattttaagactacacattgggtacagtacacactgcttgggtaacgggtgcaccaaaatctcagaaatccgcactagagaacttattcatgtaagcaaacatcacctgttccccaaaaaccaattgaaataaaaaataaattactttttttcttctccattcaaagatactagactattttttttgaaaatcagcagaatttcattgaagttcctcatttaaatttatgtttgaatcctgtagattcttaataagtacttccatacagagaagaagctaataagaacgttccagagagatcctacagaacgtggtgtggtgggaagatactaggctgggtccacattctgtctctatcagcagtgagtcagtgcacacatcctaccttctgggcatcagtttcctcacctttttattttattttgttttacttttgaagtagggtcttgctctgtctcccaggttggagtacagtggcatgatctcagctcactgcaacctccatctcccagttcaagtgattctcttgcctcagcctcccaagtagctggaattacaggcatgtgccaccacatctgtctaatttttgtatttttagtagggatggggtttcatcatgttgaccaggctggtcttgaactcttgacctcaagtgatccacctgccttggcctcccaaagtgttgggattagaggggtgagccactgtgcctggccaagtttccttatctttcaaatggggatagtgatatctaactcagagcccttatggggatgtaatgaggtaatagatgtcagtcacttagggtgtatacatgagtttaatcatcatcatcatcatcattaataccatttctgtacccccaaagtgtgtgttcaagtacttgtccacattcagtggtcatagcaaggcctcagtttacttgaatgtatttacattccaacaatgtaaaccttaacaaagactttttttttttaaatttgaccactgcagtgttctcatagaaaagactacagaacagaaaaaaaaaaaacagtttgcattgtgtaattgctccaaattgtattttcttttagaaaataaaaaataaatcactagaatcctatttaaatacaagtttaaaaattaattattttgcactagacacagaatggactgaaaaaattaggattagagtcattggtacccatacagatgtgaagaagttgtcctgagagtgagcctctggtttcatctgtgcttctctgtctccacttggctttgtcacgtctcccataaatgaccacagtcattttattgcctctctccatgtccccaccttttcctgtctccagcctaccagccatttagtggccagcgtggtctttctaagacaaacctgaccatgtgaatcccatgcctggaactcttcaatggcctcccgttacttaaaggatcaaatacaaactactttatgtgtcattttctgattctcttcctatgcccacaaccttattttctagccccagttcctgctaaatcttcaccacacctatactccagccatattatcctgttttctgtgttcttttatgccctgatgctgagtgtgtgcttttcctcttccttgaatttgcacctaactcactccatcatctcctcaagattcctctcaactgctacatcctttaagaagcatttgatacctcctgtctctgaattgagagctttcttctttgccccctataataatttatacttataaaatccatgacacttgctttgatcatcgattttttggtatctctctttatccagatcttaatctgcatgagagcaggactattttcttatctctgaatgtattttatattaatgcaaaaacaaatgcttattgtgaacctactggggaccagacacagtggataaaggtacctctagtgcatttctaaacatagtcaaaaactacatttcgaatgaattaatgaatgcaagatatccttccatgtgtcactgagacttttaaaaagaactagtttctttctgatcaaattcaatggataaccttgcagagcaagatctaactcagaatgtctacggatgccttaagcattctgcatactggagcgttttcaagagcccttctctgacctcacacacagcgaatgtctgagctctgtaggctatttgtagagagtttatttcatctttgcagaaagctgcccagtataaatattagtcagttgatttcacacagagtaaaaacaagcttttaaaagcttttacctctcctgtccccaaataggtgctttagacagattctctgagccttgggagctttgttggatttggtaaagtgaaagttatgttctgttccgaagcagccttctgtgaaggctgtcttggggttgatgctgtaattgtgcagaaaggtaaaatgaagaataacaaaggtggcgtgtggggtgggatggagatcaagcttccctgttctggatatatctccataagtccatttcaaaaaatgttcacgtttggtgccaaggtggtcacttggtattgtaaaggagtggtggcttcaaatttaaatagtctaagttcaatcttagctctattaatgaactagctaatggtgtacatgggtctcactcagcctctatgacacctgaaccaatgagtatagctagcattgtccaacagaaatataaccatggtcacaaatatgaatcacatatgtagtgggtttttttttatactttctggtagccatattaaggcaaaacaaaatgcgtgattttaatttcaatattttattcaagcagatatatcccaatatataaccaagcataattttatttacccagtatatccaaagtgttaccattcaacatgtaatcaaactgacactactaaagagatatgttgcattctttctcttgtatgacgtctctgaaatctggcgtgcagttgccatgtacagtacgcgtcatttcagaccagccacatttcaacacccaatgaccacacatggctagtggctaccatgttaggacagcaaggtgaaactacaatgcttaagctgatctagcaagctcttaaagctctctgactaggattacaatatctgcttcacagagagcaaatgagatcgcatgaaaattgtcatgcgccccaactttctcctctgaagtgttagtgtataagcaacagattaagaggataaggtgtcacaacatccttagctgtttacctaattgttgcatttctatcactggacctcaaactccatgaagtagacagtgacatcactcaatactaggtcttccgtgactagcacgtaatagatgtattaatttcccagggctacgaaaacaaagaaccacaaactgggtgacttgaaatagaaatttactggctcacagttctggaggcctgaagtctgagacaaaggtgtggataggactggttccttctgagtgctgggaggacaatctgccccatgctgctctcctatcttctggaagtttactgacaatctttggcatcccttgagttgtagaagcatcacccattcatcttcagatggtatgcatatctgtgtccacactttcccattttataagacacagtcatatggattcagaagcccaccctgctcgctactcaggcatgacctcatcttaactaattacatctgcagtgaccccattcccagattaggttacattctgagatactgggagctgggactttagtattggaatttgaaaataagacaattcaaccaataacagtatgtgttcaataaattcaagtcagatatatgaaaaaataaaaattgagtataaagataatttttggctacattgactggattccaagaatcttccattctgtctaaagaagatagacacgttaaaaatcaaacgagaaaaaacagtaagtgaagaggatgaatgcagccagtgggtagttagactatgcaaaaacaagtgcgccagaatcacaactcaacatatattaaggctttcatttggtggtgttttgaattagaaatatttaatgtcgatcagcctcagtttccttagcattatctacttcgcagttgttgagacaattaactacaatatcctaagttgcacacaattattgggccagacttctacactgtgagtatctgcaaaaaaaagaaaaaaaaaaaacattgttcactgctgtgcttcttccctctgatttaccaataagggaaacatcttccatatttccaaaaacccctggttttccttgagtacaccttgacatcatgcaaaacctcttcttcctcaagtcagccaggccctgctgtactctaagctgcaacccactgggctcagcattcaatcaggcagacgtccttaaaagatcacacattcttagctacggaagaataatatttatgcactgcttaatcatgtgaagaagcacagactctccagtctcaagtggagacattgggtgatgtataggcttagagatcctcatattgggaaagagtcagttactgatcttggctcttcacttgccaagatggaactgtttggtttcaattctgtgaacatacttacaaagtagtaggaacttcaatactgtgtgcttctgcttagttgggttgtactgaatttgtaagtccagtgaggttgtattttccctttgttctgatgagaggtctagccactttgtgtttcaactgttataatgtccatattcagttttcttattcccccataaaagttcatgagatagaaatggaggaaacgtagatatgcatcatgcatctaagcctattgttgtagctagacttgtcgggtcatatggatgaaaatatcttagggaacagtttgatgcattggaaatacctctagggttcatatcactagatatgatttgggcatttcactgagttacctggctctcagcttcttccactaaatagatgtgaatgatacccattctgactttctttcaatattgtatgtaaggcttaaaacgattatgtttaaatgctcccaataacctttacaacctatcccatgatatggtttgtcagtgtccccactcaaatctcatcttgaactctagttcccataatccccatgtctcgtgagagggacccggtgggaggtaattgaatgatggggacagttacctccatgctgttcttgtaatagtgagtgacttctcatgagatctgatgggtttatatgaggctttccccctgctttgctcggcccttgtccttcctgctgccatgtgaagaaggacatatttgcttccccttccaccatgattgtaagtttcctgaggcctctccagccaggctgaactgtgagtcaacctctttcctttataaattacccagcctcagatatgtctttacttgcagtgtgagaacagactaatataacccagctgagatattttgatgatggtgatggagaagagaatgatcatttgtcctatttacctaaagtgactacttgtttcctctgcttatttcttctatttcaagcactagagttacttccattgagaaggtaatgtcaaaatgtagcttaaattatcagctctctctctgttcttacccttcctctttccttccattcataagacaaaggaatgcataagacagctttatcttggcatgtatcattgttgcatttactctttgatttaatcaaatcgtgtttgatcattcactctgtgcttgccattccaatagtgctggggatatgctgtcctataagacagacataggtctctgcttttgagagctttacaatccagtagcctccaggtcttcagcccagctctatattttataggtcctatgtctctgtgaaaatgtcctcattgctttgttctactttgttttctttgattctgccactcagactatcagatattctgtcctaacatttagcattacaattggcctttctacatattgttttgtcagtctgtatcctaccacctggctgcttcctgctcttcaagaacatcaggttagacatcagttcttctggaaaaccttacctgataaatcattttgtttcttaaatttatcttctctgggcacataccctattgcactgtaaatctctaggctattctatgactcctgccagcctgtagctatagaggtacctgggctatgtctaccttattcaccactgtagcccccaaacatagcacagtccctgacatccaacagatactcaatacctaactcctgaaacaattgcgtgagtatcatgctcttgcccatttggacagttcattgcccttgctttctggcaatctctcctaatttcatttcttccaagtccgactatcattcattttatgacagccttttttttttcagctggcaaactatgagaggctaaaacttatgcaacacacaatgaaagacaaggtcatattttatcgtctttgcctgttgcagtaaccagattagacatctttctacaagtgaggcgaatgcaagccaaccgatatctatcatgtcaaacacctgattactatgtgcggaagaaaaagagggaaccattaaagatacatggacaagcacctgcccttaaggagcttacaacattgtgggaggtctctggtttcatgtaagaaaatcgaataattaaaaatacaggcagatgcttggctttgtgcattctttataaacaatgtaggggtggcaggtggttgctaagttttcaccatatcatgcctccacaaagccattgggttgtttagactatgtttacgtacccagctttgaaaaggggctgaagaagaaatagaagatatgttgattcatggtagtgaggcataaacttttttgtttgtttgtttgttttgtttttttaattatactttaagttttagggtacatgtgcacattgtgcaggttagttacatacgtatacatgtggtgaggcataaacttttatgatgggtagaaaactttataatgtgttataagaagaaatgattctgaattggctgggagtactggctcatgcctgtaatcccagaactttgaaaggccaagatgggcagatcatctgaggtcagggtttgagaccagcctggccaacatggtgaaactccctgtctactaaaaatacaaaaattagccaagtgtggtggcaggtgcctgtaatcctagctactcgggagcctgaggcaggagagtcgcttgaatctgggacactgaggttgcagtgagctgaggtcacaccactgcactccagcctgggtgacagagcaagactctgtctcaaaaaaaataaataaattattctaaatttatccatgtccaagattatggcgtccactccttgcactactttttatctagaatgtttatttttctcttcactagaacattctgtcatctgtaacctaatcccattggggagagtatttgattatcctttcgttagtgtgacttaatgctgccaattttccaaatctagcaagagatccttggtgacattcttagtgggataccgtagtcagcaacgttcacggcagagttgctgtctctctaagcgatttggttttctttgtatgtataaggacttcctctcttacaaagaaagttgtgtcacattcgatcgatcaatttcctcctttagaagcaggcagagaatactctggacagctatgatggaataagtcacacagcgatattatctcaaattatatctgtagggtaactgcaagtcaggtatttaaggggacagaatccatccttctccccttgtggatttggttaaatgtagtagtattagcaatggcacaagtcatctaaatttatcttgaatgtgaatttgacactgatgttactctggtggtagtagcaagaacttttccccctttagaaaaagtgggctggtgaaaggagatggattatgaaagtctgttcaggattgaggcttcccgcatacccaggaggtggagaatccctattgaattaaaattcaaaatgcatctgtctgttctttcccttacaaaaattcacttttgccaatgtttatttgcatggtttgattttctgcttgtccatatgcccttctgtccatacaagtatatctgtgacagtgatgggcagccccatctgtcactcaggaatggatggcagtggtgatggttggttggtattgatagccaagtacttactacagctgagctttctggtcttgactgtgtattatagttatgcaagaggttatcacggggaaaaatggatgaacggtgcccaagatcaccttctacattttttgaaactttctgtataattatatctctatgattatttgaaaataaaaaattaacaataatggcagtcataggctaggctctgggttcagaattgggttggtacaaatttcttcatggaaccatcatgacctgagataattttcttagcgtctcagagcctattatttatgaaatgaagataaagtcggtgcccgtatcatcgggctgtgggttgcattgatggaagttctatttatagaacatttagggcagtggcaagcatgtggtttaagcccttctaattgtattattgttattatcaagaatgttataagtaacactatcatcattaacgtgattaatctacctgggttctggatcttagggtggcaggaacatggtcttgtgcctttttgacaacctctaattttgcctaggatactaaaagactttgtcagaatgtctcaaaaatattttatggtgaattgttccaccataactctcacaaatatcacctcttatctcagcccacaaaaaaaggtcaattatagataaaggaaaggacctcattgttgccgaaagacttagatatgaggtctggatttgcacttattcacttcaagactttatgtttccttatctgtgaagtgggtgtgctgaaaatgagtttattactctagctcctgtggagatgaagtgagattatatatatatatatatatatatatatatatatatatatatatatttatatatatatatatttatatatatatatatttatatatatatatatttatatatatatatatagtgactaacattgtctgatacttagaaggtgctggaagaataccagctgttctggctgttagtttgtattaataacaggcaataatacggcatttgaagcaatttcgcaaacagacaggtgaagccctacgcagcatgcctttccagcgcgaaatgcttcagtgcaatgttaggatattctaatggggaaacttttttcagtaatgcagggcaacggtggatggttttgaccttgctctcagtgccccgaggtgctgagtgagtcagaacatgtctcagtactactaaaaatgaagagactagcttgggattcattttttattcaacaaaacattttgaatgcttttgtacatgtgtgtgtgtgctcgcatgtgtgtgcacctcagacactctttgagatgattgaggcaacagtgatggaccaaaaaaaaaaaaaaaaggaaaccagacaaggttcctatactcatagagttcacagtccagttggagatggacaccaaaatgtgtatataatgtcatactttgacagaggttttcagtggcaagacagggtcctctgagaccctggaaaagtgagaaactccatcttcctaagtgcttgatgccgttggttgggaacttcacttgttctggatgtcgctcattttttaagggctaagcacatatttccctttggaattatcacctcagaagtggccatatccaggtctctgacttgtacagagtaccataaatattttattgtcagtgacttttaaagagttgagaaaaacagcctctccattgccttctgtaactccaaatggaaaatcaggatggaacattttgcaaacatgacacctcctcactgcaagtcgaccgcccactcggttggcttgtgtttctgaggctggtgtttgtcagccatggcaagatggcttccatcctctctctgtgcttccctactgagccggagaagtgaaatgagacaagtagctttgctggaatctgtaacatggattctgtcatctttgttgtttgttggattttatgaattatggcttcagcacaactttagagttctttgttcaagagataattttctggccaggtgcagtggctcatgcctgtaatccgagcactttgggaggctgaggtgagtggatcacaaggtcaggaggttgagaccatcctgtctaacatggtgaaacaccatctctgctaaaaatacaaaaagatagccgggcatggtgacgggtacctgtagtcccagctacttgggaggctgaggcaggagaactgcttgaacccaggaggcggagtttgcagtgagcagagatcgccccactgcactccagcctgggtgacagagcaagactctgtctcaaaaaaaaaaaaaaaaaaaaaaaaaaaaaaaaatttctgtaagctggcatagttaccagaacaaaagtttatatgtttatctaaatgaggtcagatctgaattcatctccaagtatttaagaatatacaatgtaggattctgacagatttgggtacctggcactaacaagttgtgtgagcatgagcaagtaatcccacctagcttgaaaaagaagataaaaatatgcggtgtgttggattcttgttaaatgaggtaatgtaggcaaagctactttattgaattttgtatgcttggtgcttagaacaataatcagttcataattggtgtgcaagaaaagatttcttttcctcgttaccagacatcgtcatcaccatcaccattattaccatcaccttcatcatcatcatcatcatcatcatcaccaccaccaccatctttgcttttatcttcttatggattcagtaacaagaattcttcaataagactcataataagattgtgttaaaattcgggttctttcccttactaatgtacgagatccatgtgttggaaagtgttttccatttgtttagcacctcagttttcttatctgccaaaggtaccataatgaggtatgtgatctgccaaaggtaccataatgagtttagtattcactgaagtaggttagagtccaacacacatcccttcttcctgggttctccagaggaagaacttcactggactggaaggaggatcagttttatccccacagtgggacatatgtgcatacaggactttctagattataaaatacattccagtagatttttccctctaaagcatcgtaagagtctcactgtgaagaataatatatattactatttatattttatgaataaggaaactgggtcacataaaggttgaatgacttgccaatagtttcaccattatgctcttgatgcctcaatatttgactttgatttcatagtcacagcattaaaaggttagatagtaacactagaaattacctggcctatcatagtgtttttccatttatttatttttaccccaattcataaaagattttacactctgaacccattcctccacataaagttttcatgaaacaatataaactcttaactattttattcttctctcatgtgtgtagattatttcatttaaagaatgttggtatgatgatcccctacatgggtcttacagcctaagagatcagactgacagaataaaaaacacagaacatttttctccaggattgtgtatcagaactatctggggcaacttttgacagtgcccatccctggatcccaccctcagagattctgaggcagtaggtctggtgtgaaggccttggaacgtgattttttttttctttctttcttttttttttttttttgagacggagtcttgctgtgtcacccaggctggagtgcagtggcgcgatcttggctcgctgcaagctccgcctcccgggttcacgccattcttctgcctcaacctcccaagtagctgggactacaggcgcccaccaccacgcctggctaattgttggtaattttagtagagacgcggtttcaccgtgttagccaggacggtctcgatgtcctgacgtcgtgatccgcccgcctcggtcttccaaagtgctgggattacaggcatgagccacggcgcccggccggaatctgttatttttaaaagaatacataaggagctcatgctccactgactaaggacccatgttctgttgcatctatctgattgtttccagctgaaactctttaactctttgtctatttaagtttttttttcttttctttttgagatggagtctcaccctatcacccaggctggagtgcagtgatgcaatcttggatcactgcacactccacctcccgggttcaagcgattctcgtgcctcagcctccaaagtagctgggattacaggcacctgccacaatgcctggataatttttgtatttttcgtagagatggagttttagcaggttggcctcaaagtcctgacctcaagcgatccgcacgcctcggccttcctaagtgctgggattacaagcgtgagccaccgcgcccggccagttgttttgttgttgtttgtttttgagtattttctgcgttattccctaggacattaatgctttcaccagggaattgtccgtcttggtcttgtctctctttccaaggttgaaggacagaagttggcctctcagttgaggacaagagcttatggtttgtgcgaatggctgctgtcctcgcatactgagctggagtcttgtgagacagggcctcttgtcctctgtgtttatgtggttagagaggggagctgacacatccttttaaagaaactgaaagggctgcttgttttaactctcactctgtgatgcattgcagagatccccaaggtatgattggaaatggaaacgtaaggacgggcacaaatactatgtatccagattttctttccaaccttgtagagctgggaattaaaaagaaaaacctcgcccaggggccacctgaactagaacctgcaaaacagacaagcagaaaggttgaattcttccaggcggtctcttccaccctcacctcctcctctgttatacaatttaattacaactttattcacttcagaaaccccatccattccttccagtaggggaagatctctctttccatagcaaggagccttggtgataagcagctatctgtaggaacggtgcatgggactctcaaaacctctcccttgacaagcaagaaagacatgagcaaataataactgaaattattttgacatttcactctggttgttgtagttttcataataaaggaagaacaaagtacttgcagctttaaataaagaggctgcctttggcattgatgtgggatttcactggggaattttttgtatgagttcttgtttttgctcactgggagagaaaagaaaacgataagccatgaaaagacaaaagtccaaggaaaggagaaagcaagacccctgtactttttcttgatagcatttgtcacccctggaatattgcggtcatcttagtatttattttttgtttcttgaagtctgctgctgcacttgactgtaaggtctatagggacaaagatggttttggattttgcttaccgttgcattaaatgtgaatgaatgaattcgtttacataatgtgtactaggagccaagccctgtgtgtgtgtgtgtgtgtgtgtgtgtgtgtgtgtgtgtgtctgtgtctgtgtctgtgtgtggtttttggtgatgtgatttttaattagatccttacaataatatggtgaagctactcatcattggtcccattaaacagaagcaaaaactagtgcttggagtatcacaataacttgtctaagattacacagccagtctgcaaaagagctggatttcaaaatcttccaagtcatcatcagttatggtatttttaagatcgatttgcagttaaccacacagctttattacaaattcatgctctcttgatgtactcacagtatttttcaaaatttacctattgctatctctctatctctttaaacttttttcatccatcctctgtctcttcccttttatccctgaatgtttgccctcccctcttaagaaaaaataagatagtagcaagctccctgctggattttataactttgcataccatatatttagtttagtaatgaaaaattccagctccaggcgatgcatagaatcgcatttctaatgttttttaaacagctattaatgtggtcgagcagtgggttttttttttttttcccttcctcctctatataatcatctgctcagtggtgcgctgtgaaactgagagtaggagccagaggaggagcaagctgtgattgatgggccaggccttcctggcagaaaaagtgccatctgggttggttttgggagcagtcagatgttgagggggaggtcagccaggcggcctcagccccccaccttcctcaacaccccgatcatccacacattgcacagcgcgcacaccctcgctcgtaattgaggcgtgcttggggcagatgctttgtggtgtgggacaagaacagctgctaagtttatggaggagaaaggaagcaggatggtgcagcaggtatttttgtttttttttccatttaatctttcactcaaaattgcgatttgaatgaagctgaaagcttttcttgtgttaagtccgtgctgtcggtgacacgtagcttgctgcttgaatcatgcccggggaaaggagaggagttttggtgaagagagtgtgtgtgtgtatgtgtgtctgtgtgtgtgtgtgtgtgtgtgtgggcgcgcgcgcacgcgcgcacgcgcgctttctgcttgatgtgtggaactgagctgatcttagaaccagcaggttaatggtgtccttttgcatttttcttctttgtttgaatgcccctagggcatgatgcagtttagctcaattcacttctgcacaagagggtttctctgaatatgcgcgatttcttgccagagaagtggtgtagaccatgctcctaaactaaagtaaaacaaactgtcagcaagactgaaaactgcaagcaaccatcaagaatggatagttttcctccagtgagtccatgctggtggggggtcccactgcaggagccgctgctttcctgggctgtgtgggcatatgtgatcagctggcttattaggttttgacaattcctgtgcatgtcttcattataagggttgagttaaggccagaggaggttctccacagcaggaaataaactggggacaagtaaattccagatgcagaaagggagggtgtgctcaagaagtttgactataaaggtggggaaatacaggtgtgtgagtgtgcacacacacatacccacacaggaaaatgcttgcctattttaaagtccacctggacggctacgaaagctggtactttgccttctcagtgaaagtcaggtagttacatggaaaagaatagacccatttcctgttcggccacttaaagattctttttcagttgaaatacggtttaccttcaattttgagccaaaaggttttgcaaaccctgactggctaccactcttgtttctcttgttagtttctcaaaactactttattaaaccactcagggcaacgaatgggagaagggcaatgtcttggggaaaaaacaacgacaacaacaaaactctctcatcttattttctctctgactctgtctcctgagtccacttcagagagaaaattcagggttcaggatatttcagggaccaaagaaattctctgagcatcagaagagtggccctcttattgcatgcatacaagagtcaacacactatgctaatagtcagattacagtgtttgtcttaaaatagcaatgatagccaggctatttcatgcttcagtaaaatatttaaattgaaatgacttttttttttgcttttatgaatcagacttggttgcattttaataatccttttgctcttggtaactggagtgaaagctacacgttggggtgtcttaagtaatgacaggtttccatcatcctgctgtcgttgagttgctctcgttgactgagaggtttggtgactgaggacaaggaagtttcttctctgtttatcctaataaatgttgtttatttcaagcttctagtcagttgtgcagcagcaatagtgggtcttaaagcgtgagatcttggccttctttcatcctccttttgtgtattgagcaacaactcaagaaagtccaggcactgaaattaaacgttaagtttgcaaaagctcctgaagcatttgcttgatgatgtggggaacacttgtgaggcagatcatcctgctcatcaactaggaacacccacaagcaccctgactctgcagatatcagaagctctctctgatcattccacttatttagggaaaggtgggggtttggcattggagtagaagaaagaaggcagcttctgcaaatgagggaatgtctagccagaatgctccaaataattttgcctgtcactgtcccctacatgaagttggcttcagcttccaacccaggagcctgttcgcgtgcctaggatttgctgtgacctggagtggaaaaggtgcccttaatgtcagtgtatttttccagaaaatacatttcagccaagctaagaatccaggaatgtcactagggaggaaacaaagacatctctggagccatttgaaggtgaaaaataattccataggaagtacaatggtcttaattaaatattagctgtaattagcctaaagtgcaaatgttgggaatattaattagggtctctctggaacggctgtcagtgttaataagtaactgtagggggtcccaccaacatctgtttgagaactccaggtacaggatgaaatctggagtcccatgttcctggatgctaactgcaggctccttggctaccatggactcagtccctagagcatggtgctctgtgtttgccagaattgcacaactcatggtagaggtgggtggcttgctttggcaccagtggtgcccccagctggcccttgcctttcctcggatagcctcaaggcatttcaaagtcaggcgtcaggcttgaggtagtgcagaagtttcccaggctgctgccccactcctttcgaatggtcacccacccaacctggccattggaattgctggcatatttgaatcaaataccctagtccctggcttcctcacagggagtaacacaccaacagctaaacacaggtccatggtgtgtgtgatagagagggaactgcttatttaaaaatgggaagtggacaggcgcggtggctcatgtctgtaatcccagcactttgggaggacaaggcagatggatcacttgaggccagcagttcgggaccagcctggccaacagtaaaacgccgtctctactaaaaatacaaaaaattagccagtcatcatggcgggtgcctgtaatcctagctactcaggaggctgaggcaggagaatcacttgaacctcggaggcggaggttgcagtgagccgagagcctaccattgcactccagcttgggtaacaggagcaaaactctgtgtcaaaaaaataaaaataaaaataatgaatgaatgaatgaatgaatgaagtgaactccccaccaggtgattctcttgctagatgagaaatgccttggtttaactcttggcttccctaacaactacctgtgactgtggcctcgaataattatttcccagctttggtctgcagcatctttgatgacaaggtaaattgagattagagatgcattgcatgaaaagtagggattctggaccttggcactattaacatttggggcgggacagtcttttgtggttcaaggtagtcgtatactctgtaagatgtttagcagcattcctggcctccacccactagatggcagtagcacatcctccctcatttgtgacaaaactgtctccagtcattgcctaatgtcctgtggggagcaatcacacctctgtaagaactaccggtatgaggcgcccagcacagtgcctgccacctattaggttttcttctgaggaccagtgaggagaaggggctgcttttcatggaagtctgaggccatcatgaaccttctgctcataagcccacttatgcagatttaaagcctgtgtgcctgtgagtttacaggtcaaagatctgcggatggaaagtaaattccccaaaagattctgacccactgtttttgcaccattttcaatattgccagtctccaagtctagctatcacccctctttggtttggagagtatacaggccctttctctctctttctacttcactgcctgctttatttcctgcccaaactacttatgcaataatggcttcttaactggtgatcccatatctaatgacattctgccacagctattagaaaacattttccacaaaggaccagatgatagatcattcagtcttggtgggctgggcagtctctgtcacagctatccaactctgcctttgtagtacaaaagcggctacagacagtaaacaaatgagcatgggtgtgttccaataaaactttatttacaaaaacaaaatttgggccaggtttgcctcatgagtcgtttgctaggtcctctcttcatccccctaccctatctcctgctgccagactaggctttacagagcccagaggtcatttttccagcacatattcacttggcaaacatttataaatgtccactttgcagctagtatgctgttggaccatggagatgggacagggaatgtggcacagtgtcctgttttcagggagctcacagacaaataatcaggctgtggcagtgcttggtgctgtgtgagctgtggccaccagctgcagtggagcagaggggatgggcaactgaccaggtttcagcatcaaggaaagcctgctggaggagggactcttgatgcggactgaaggaagagtaaggactagttgggcaagggggtaggtgaggctttccaagctgaggggcagtaaatgtgaagacttgatggggttgagaggatggagctcttctcccttaactgaccataagcttctggaaggcatgacccttctctcttcaatacagagatagctcgaagtctacaaggagccttagctcttttgcaagaactagtaggaatgggccacttttcctgagcttgctctgcactgatgaaaagccccagggttatatatgttcctggtgaaagtatattctgctggaggtggaggagggaaacctttgtcttcatatgatcattgtctgtaccactgcttatgtggttattctgtgcttccctgtaagagtttacacaagtctacctttcacttcagagatgggccaggtagaaggttggggaggcagaaacagatctttgagcagaagctgcctctggcacagtgaatttctcatcagatgattcccaagatcccaacatttctggggcttttcatcacccatagagaagtggcatcgctatgaaatttctgtacagaaggatatgttccttgaacagcccagaaaaagaaaagatgctagtttagttataaaacagcagaagtttttttttttttttaattagtcaagacccttttggttgtaagtaacagaaaaagtagcttaaaaaatgagacaaagggtacaaagtgtcagttttgcaagacagatacattctggagatttaagtacagcatggaaacaagagttaaaaatactgtattatatactggaagtgtgctaagaggatagatcttaaattaaatctctccacacacacatacacacacacacacacacacacacaaatggagatcatgtagaagtgatggatatgctaattacctggaatgtggtcacttcacaatgtatacatatgtcaaaacatcaagttatacaccttacatgtataatttttatgttaatggtatcttagtaaagctgttaaaatatgggacatttactgacttgtgtaactacaacaaacagggatggtgctgactgcgggtaaagctggattcaacacttcaaatgacgtcactgggactcagtagaaacctctctgttcctcagtttcttctcttcattttcctctaggttggcctcacgtgtagggaggtccccttcaagtggcagttcgttgttgttgttgttgttgttgttgttgagacggaatcttgctctgtggcccaggctggagtgcagtggtgcactctcagctcactgcaacttccacctcccacattcaagtggttctcctgcctcagtctccggagtagctaagattacaggcatgtgccaccatgcccggctaatttttgtatttttagtagaggcagggtttcaccatgttgcccagtctggtctcgaactcctgacctcaagtgatccacccaccttggcctcccaaagtgctggaattacaggcatgaggcaacatgcccaccctaagtgtcagttcttggcagctccaggcttatgatgtttttacagctgcccatcaccgtggaaagagaacttcttccccaaaactacagcaaaatcccagggtgactgggactcagtggtgtgactagggcttaacgcactaacggactcactagatagatgtgcatgaacgcaaatccatgggactatctcagtgggaccatctgattggccaggctgatgtcctatggctcatctcgtagcgactgggagctgggttcaactgtatctgcaccatacaggctgaaagtgggactgtcccccaaaaggaaactggggctttgttgaagaaacaggagtggagacagaccagcagtatcactgcatgtcttctttggcttcccaaggatggacaaggttaactgctcatggatagcaactcagcctcaacataggcacaccctccatggccccagtgctatgggaaaatgttagaaagagaaagaaatgctcgtgcccttttgtttccagtggcacagacatttggcgaaatttgtctggaggagggaagagcctgatgggaatgatttacttgtaaaatgtttaaacttatcctaagcttagttctcttccaagtgtcatctttaacattctaattaaggtcccttctaaacaaatgcaccagctccgtgtgctgctctgagaacaaactttttttttttcctctcttctttctgtcatcatgtttttgctgcactcaaattgctttagagaaagaggatttcggatgttggtggcaagtactgaagagataaggagaaattctgatatttttgccctagtatcattatatgagggccaaagtcacatctaattgaccacagacaataggagaggcagctatttggtgtgcctaattgctaagtttttttcctcgctctgtctttctgactgtgtgatcccatctcctgagaccatggaaagtttagacctttgggttacaatttcttatgccgtgtgtgtgtgtgtgtgtgtgtgtgtgtgtgtgtgtgtgtgtgtgtgtgttgtggtagaactgtggaggaggaggtaaagagagagagctgtttcctgaaatggaagcatttgtattcaggtttttgttgtgtgtgtttttaaaattcttctgagttggctgtaattgtcacactgcctgttttgcctagatctgaagaatgaattgttatataatactctgtgctcataaaaaaataaggcagggagggagaggcattgactaatgagactgagagttaaatccaatatttttcagaaatgcttaaaatggggatgtcagagaggacagtctttgtccaaattaggccctgaatttgtatcagctgcttcattttggcactggggacatcatacacgcatacacacacacagacacacacacacacacacacacaacataacacacaaccacacagacactgggaccattaaaaggatactccctattcccattatgtgagccaagtcacataaaactttgattaaattcaaatgcttacataaattgtctctcctctcaagaacacacacgttcaatttagtctctcttggcactttaagtatcaaatcaaggttctgctgtcactgcagacaactaaatgctcacagcttccaaaatgggaatgaaataaaaaggatctgccaaaaaaaaaaaaaaatcaatctagtaaagccacagaccctcatgtctttgaatattaggctgggtggcttggaaaaagcgactttatctttatctttccaagcctcggtttctgcatctgtaaaatggggagaagtgatggttactgtttccttatagggtctggtgaagatgacctgagattggtccatctcaggctggtggcaccatggtgacccctagaaagtacgcggggcacgatcgtcctgggatctgggaggaaggtttctgcatggtggctcctcatgacgttctctccctctctgcacctttttgatttttcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacagtaagtggacgtgtttgctacgggtgggaggttatggggaggcgcccccagccctggtaatggcagcgggggtgcacccccatctacccagggactctgggaaacagatcagtccctaagcccaccctcatcataccagcttcctgaagtttacctcatttccatgcattcattcttagcgttcatttaaatcaacggattattaattaatttcatttatttgtaaaggggcacatttatcaattttctattcctatagttttgcctttctagaatgtcatcccaatgaaatctcatttttttggaaaaaaaaaatttgatgtaagataatttttcttcaagtcttacggaggctgggtgtggtggctcatgcctgtgatcccagcactttgggaggccgagatgggagagtcgtttgaagacaggagttcgagaatagcctgggcaacaaagtgagacctcatctctacaagaaatttaaaatttagctgagtgtcatggtgcatgcctgtagtcccagctacttgggagactgaggtgggaggatggcttggggccaggagtttgaggctgcagtgagctaagattgctccactgaactccagcctaggtcacagagtgaaactctgtctctaaataaacaaaaataaagtctttgtggaattataatttacataccttaaaattagtatatttttaggtgtacagttcactgatttttagcatatttacggagttgtgcgatgattgccggatgcatctaatttcggaacatttccatcagcctaaatacaaatcttgtgcccctttgcagccactcctcattcatacctcagagctctgaacctcgcttctttaccttagcctaatacatttgagattcatccaggttgcggtgtttgtccctggtttcttcatttttattgctggaccaaagggcaggggctagaaagaggcagggtgagagaattttgatgaataagggaactgtcctgtatcttaatggtgacggttacatgactttatacgccataaagagtaaattttattgcgtacaaatgatgaaatggattagaaacaggcatgtaaacagaaacattttatcatcactgtaaatgaaaactggtgttttgatcattaatcaaatataactctaaatgaaaatatttatcataaaattaaataatgttcatttgtgtgccacctaaagtaatcatgcataccacaaaacctgtatggaacatgcatttgggaacctttttctgcagaattctttagaagcttgggaaccccaatcctgtcgtctggaacattttttgagtgtaaggcaattctgcctcttcgtcctgtcccaagacctcaggaaagcaagtatttgtgaaggagtttatggctttgaagcatgatacatttcctgtgataaaagaaaacactgactaactttgctacttgccacctcattcatttggaggctagttttgacgttttgtttttgtttttgtttttgtttttttgagatggggtctcactctgttgcccaggctggagtgcggtggcgcgatctcggctcactgcaagctccacctcccaggttcacgccattctcctgcctcagtctcccgagtagctgggactacaggcacccgccaccatgtccggctaattttttgtatttttggtagagacgggatttcactgtgttatccaggatgatctcaatctcctgacctcgcgatctgcctgtctcggcctcccaaagtgctgggattacaggcgtgagccaccgcgcccggcctagttttgaagattttttaaaaaaatggtatacattctgaaatttttagttgccttcctccctttttaatttattgtggtaaaatacatataacataaaacttaaccattttaatcctgtacacatttcaatagcattcagtgtattcacaatgtagtgcaaaaccaccaccattatctagtttgagaatgttcctagcaccccaaaaggaaaccccatacccactaagcagacactccccattctccctctccccggcccctggcaaccaccaatctgccttggagatagctttttgtgtctggcttctttctcttaacacgatgttgtctaggttcattcatgtggagtaccccactgtatggatagaccgtgtttatttattcattagtccattgatggatatttgggttgtctccacattctggttcttctgaacactcctgctgccgacttttttgtatttagttgctgtgccttaggcatgggccttttaaatgagtttgctggttcagcaggtgtttgttgcttttgcgctgactaccaggtagtagtgatggggatgttgtttactgtttgttggctattttgtgacaattaatagtagtaatgcctggataggttattttcagattttgaaaaaagatccaatcagacattatttattaagctaactgctgtggaaattttacgtattcatttatttattcacaaatatttattaagcttctattagggccaggattcatactagctgccatggttgaacaaaacaaaatgatctttacctcttgtaacttagtatgagaggcagaaactgagcatgtggcaaatagcatgtgtgatagatgtcttaaggaaaatatgggtaccgtaggaaaattaaaaaagaacagaggtgctacctgcaaacgtgtagtctgagagcatttcttcaaggagatgatgcttaaggtggtaagacaaagcagcccaggcagagggaataccacagtcagaggtcttaaagttggaaagatctgggctcactcaaagtcctaagaagaggccagtatgttttgggcatgatgaaggggatttggaggtgatgtggcaaaagatgaaccgggaggaattagcagggatttgacatcctacagacctggtgggtccaataaggagttgaaattccacgttataagcaatgggaaaccattaaaaagagtttaagccagaagagttatgaaatgagacataaaaagaaagggttagtgatgcctagcttaaaggaaatttaatctagttggggagctgagatgctccacatctttgccctgcaaaaagaacactttagagatcaacacaattgaatttaaatagcgtgttgggtgtccacagtgccccaggcactgcagcaagataatctgatgtgcagacaagctctctttccttggagagccttaggagaatataggatttgttttctgttaattatgataacgtgccaaattctagcatatagattttcacaggttttatctatcataatgacagtaggagaaaacattttcaaaatcatagtcagagggttatacctttcagagacttctggttacaggaaagagaaaactcagtaggaagcatgttggcccatacaataaaaagtccaggcggagggtggacacagcctggtttttggaacgtgtccatcagcttctaatgggaaaccatcctgagttggcttcctcgtcctcacctcagctctctggctctgtcctgcaagttcaggctccagtcaccacctgtgaaaagctcttggattcatcccatataagccctctcgtgggaatcaatctccattcctggcttgtgtggtgttatcttcattcagtggctgaggctggtactgagtgtcccagccctggggtcactgaggagcttcatatccaaatacatggaatgaagaccatttcatcagagttcatgatgagatgccttcagaataaatcattaaagaaacgaagtagacagaatcttgtccgagctaaaggtagcatggtgaaccttttgtacaaagaagcttgaattggtgttaatcaagagtagggagtgaagagaaagacaaggacagaacattggagagctcacggggtggggtttgaaggaagaggaactattgagtaagacatcaatgggatgttcagattgggcattcaaccagttgaatgttgggctatacagcctggagggtataaactgagaagacattattgaagtgacagtttggatgtctttaaagacctagaagacaatagttttgctagagtagtggagagagatgcagaagggacaagagttgaggaataactgtgatatgttggagtgggtgggcattgcccgttataaatatttggagtgatgaggagaaagaagagattgcatctgagaagcaaagaagtcagagaaagcagttggtaggatagttgatttagattcaactaatttatgccaacaaggtccctacgtggggcacaaaagacaggaagcaagagatagggaataatggtgcaggaaagaaagtgatgaagtgttttataggcgataagaaggaataggatcaagagtattcagaaatagtaggtagtctaggaaaaaagaaaccactttttaacagctttgttgacatacaataaactgtatatatttaaagtatacactttgatacatttttacaaatgtacctgcatgcacaaccattactgctatccagataatgaatctgtccattatctcaaagtcttttcttgctcttttttgatcctcccctcctcctccttgcctcatccccagggaaccagtgggtctgcttcttttgctatagcttaatttgcagtttctagaattttatatcagtaacctcaaacattatgtgctctctttgtctggcttcttttactcagtatcattatttttagattcatccatattgttgcatgtggttgtagctccttccttttcattgctgagtactgtttctgcatggatatgccacagtttatttctccatttacctacacatgggcatttgggttgtttttcattttgggtaatggagaaataaatctgctgacatttggaagtacttcaattttgaaacagaagagaaggaagggtgaatgtgtgaggatgcagagaaattttcaagtcaagagataatgtgaggagttccatctacattgccttcattttttccatgaatggaggcagcatcatcaaaggaaggattcctgaacttgggcaaacatgtcagaaatctgccttagataattcctagagtatttgaatggcaatggatgcccgaatttggagaatgtaaatgtatggtggaccggttagctgtctactctgtcttctccagcaatgtttggatggtacacactcttagaggtaggattttaaaggaaagacagccattaggggctgaagcaggtgggctttggggctgatcctgaaggaagttttaagacttatattctgaactggtattgggtaagtgcgggaatcataaaggggctgtctcgttttttgttacaaacaattacatctgtatactcatctctctttggccaaaaaggagatgtgacttttcagttatcctttcctgatctacaccagcagaacgtggtctatgacaagtttacttcaaattgtctctgcctcctcctacatttatggggtgtaccttgtcttcactccaggttctgaatttcctgtggaacgaatttaacctcaaagtgggtcagaactatggttctccccaccctatatccatgaccctgtatttgcacaaaaagttactattgtgagatacctaggtcattccccataggatagtgctgtacctggaatagctctaactcttctttgacatatgtatccacgatgcttaatatcattctaaggacatcgtagaggccattatttctttgagaaactaagtacttttgggtaagagaaaccagccatccatctggtggcctccaagaacatctaatatatgcacatgatttaacacaaagtgcagaatctgtaaaagggaaggaggatgcacccagagctcccaaccagagctcagtaaaatgcagacagaaaagacttaccaggtcatccttttagttccccacaggctgagatgagtccctgcaggcctttttttctgctgaatttctatttcatgtaggcctccaaacatatcacggatcacattgctgacagagccaatactgtattatgttagatactgttcctgacaaggtattttactcttgacatattatcattagagatttgcaagtggtgaattctccatgtatctccaacagcaacttaacttctatttttaacgcttctgcagtctgttgaaacggctcccaccactttcccactagctctaggccctgattggagaaggaatgtgggtgccccagctaggttcctgagctggaggctctactgacagggaaaagaactatttagagagccaggttcttctttggcctcagccgcttcccactgaagtgttaactgcgcctccaaatttccttaatacttttaggaagataaggtattggttggtgatggtgtcctgttcttaaccctttccatgccagttctgattttgaagctgatggaatcactaaggtataggaaaaacttgttcagggcattccttttgactaactagctattattattatcatcatcaaagcaattcaggcttggggtttaaaaagccagacattggaaaaggatataaaatgaaaactaacatgtcctaatacccacaacccaaattcttagtctctgtgccagaaatgagttactaataccttatatttccttccagaagtgttttatgcaaatgcaagcatatgcctgcttgtcctctatctctatctttatctccctctatctctatcatctgtctctaattcaatctttatatcttataagtactcactatttccattctcaaaattacagaattgaaatctaaacacctactttggcacctgctttatatctcagagattattctgtatcatatttaggggttcagtcattattttgtgtgtgtgtgtgtgtgcatttttatgtacagaagtatcctaatgatggaatttaggttgtctctgggtttaatcttgcactgttgatatttaccatcaggctacagtacagagctaggtacaaagattgctctccatctctgtttgcctctgggtgtgaatggctaaaaggtacatggacttaagatgtggacattgatcaattaccctacagagagcttgcaccgatttgcaccctcatggacagaacctaagaaggcctgacacccacacccttgcccaacccaatgtgctagccaactcttggctcatgtccctgcggactctgtgtgtttgggtgtggctttccccctctctgacaaaagaaagtacttttagaattgttgggtgtcctggagaagaaaaattgaggtgtgctgccattgcttgaggcctcctgtggtccaaagatcatgctaggccctcttttggtcgccatcttgttttgttacatcaaccttttgaatgctgttagaatcccaccaataaagggagaaagaggttgaagatgttttgagttgggaatggtgcagttgaggtcgtcacccacatcttgtctgcctgatgttaaagtccaggctgtttccccagtctccagctgtcttctaaaataggggtacccaactcccaggccacagatcagtactggtctgtagcctgttgggaactgagctgcacagcaaaaggtgagtggtggatgagtgagcattaccactttagctctgcctcctgtcagatcaacaatggcattagattctcagagaagcgtgaaccctattgtgaactgtacatgcgagggatctagattgtgtgctccttatgagaatctaatgcttgattatctgaggtgcaaccatttcatcctgaaaccatcctccctgccccactgtgtccatggaaaaattgtcttccacaaaactggtaccaaaaattttggggactgctgccctagaggatctcttgaccaatggcttagaattctcatgaagattggtttcttcgtggctgccctctagcttagacaaacaggtcagttaaggcctggcctctggacttgacaagatttgaccctccattctgcttacaagcggaaggagctcaagctgaccattgaacctctctgctcttattttttctataactcccttcctcagctgtgacccttctccagatctcctcccttttttcttctaaacaactatcagacgatggattacagaacaacagagttcttttcctttgaggagggtttacgcctcatgtacttacattgaaagtttggcaaaataattgaaggttgccgtctaaaaatagggtgaatagttacatcgaaatgagaatcaggaaaaagtctcaaaaatcataacttttgctcattgactgtcagactatattttaagcactttccatgcacaatctcaactaatcttggccctccccaccacgtatgaagtgttatcgtcccatgttacagaagcagaatctaaggcaaatcacttactgaaggtcactgtggctgagaagcaggagtcagagctcaaaaacaggcatgtcagaccaaaattcttaagggctggaagcccagaaggcatcccccaggcatgcccagccacactggcctcttttctaaataggttgctgttgcagaaaggaattactcatttcaccctggggagggccccagcagacccaagcctgtgcaacattacagacttcgagtgtgctcttgtttgagacctgcgccttgagcaaactccaataacatgtttcggtggcttcaaaattgtcttttcggatgacagtgtgactgagctgttttgtcaataccagttctattttcctaaaattcacatttaatttgaagacatgggtactgtctcttgtttccttaggagcctgagcactatgcttctcactcccatgtattctctgcaatacatggcccttggctttcaggataaactaaagacctttattacccaatactgtgcctgttttattattttaaagaccctggtcatcaaaaactgtctagtcctggagagccaaaatgaatgatttatcccaacttaggataacttggccaggaacaggatatctctgagcatcaaagacccatgtgtttgacgttcttttttggactggggtttcagcctcggattttggcagaattggaggttgttatgacaggtgaaaaaaaatggcgttggttaaatatctttagatattatcgggagaagcagagtagaatctaggtacagagcttgacattttcattcccattctgtctgacccagagtgggaccataggcacgttacataacttctctgagcctgttcttttttatatgtgaggcttagagttgttgtgaaatcctaatacagtaatgtctatgaaggtcttagcacaatgacaaacacatagtaaacattctaccagatcgaccatcctaattatgaaataattacagtacccataatgagaaatcagagcggtctccttggttccgagttcttcattaaaaatgttttatccaggagaatacattcatcataagaattgtgaaatttcccgtttcaagtgccaaactaaaactccaattccgagatttattttaaaggtaattttgtatttaatgatttatagacaaatggttttcaatcactcatgttttagtacaaactatcagtacaagctgttcttggtctaagtctaggtcgtgggcaaacaaagtgagattcattagagaaggaaatgactgaagttttgtttttaagacccaaggacatcttgcttttgctaaatgaggaatgctcaggcatattctaagggtttgatttaatgtttccttagggggcttcactggcttatttccattgcaaatattagagccatctgacaagtttcatcgtgactttgtcctcatttggtgctttgtgcttattcacacctgtatttattgtcatcagtttacccactcaggatgactaagcagtctctatctttatttttggttaggtccttcaaacacccaaatccatcctttctgtagctcatagagactgctagacaaaggactgatgtaagtgtttgaaggacctaattccctctgcatagctgattgccccattaagcaattttattttatttatttatttatgtgagagaggggtctcactccatcacccaggctggagtgctatggcaccatcttagttcactgcagcctgaaactcctggggctccagtgatcctcctgcctcaatagcagggtactgagctcagtagctcagtactgcctcctgagtagctgggactacaggtgttttccagtgaacttagaaataggcattaatctattttgtgggcagtatttgggtcatgcattagtcaacagtcattttatgcccttaattcatggtcatatagtctttaggtgcatagtaagttcctatgaattccatgcaatttttgaattcaaggctggaaaaagaagttggctattctctgttgacagaagtttcaggaatggctcagccagaaccttgcaatgctagagctgggagagccaaagagttcatctacgctatcttctcgttgcacatatttaaaaagatcacataagttatgggttggaaacggaaggccaggcacagtggctcacatctgtaatcccagcactttgggaggccaaagcagatggatcacttgaggccagtgattcaagaccagcctggtcaacatggtgaaaccctgtctcgacacaaaaagtacaaaaattagccaggcgtggtggcgggcacttgtcatccccactgctcgggaggctgaggcagaagaattgcttgaacctgggaggcggagcttacagtgagctgagatcatgccaccacactccaccctgagtgacagaatcagactctgtctcaaaaacaacaacaacaagaagaaaaagaaaactcaaatactttcacatccaggcaagtaacatccatgcttagagagattaacttatgttggagacattggcaaaataaatttttagttttctccattaaggtaggcattacaaaattacaagcgtgatggtatgcaaccctttggtggggaccctgtagtaatttagcaaacaaatttcctgtccacaggatgtggtccctatccatccatccaatcattgctattttggattgttaaaccactattataatttcattgacatatttccactgcaaatgtttagatttctttcttcttaagaatagcagcaatttttatttttctgggttctcctgttcactactattttattcatttttgttatctgtccagcctctgaagatactgaatttacaacttctgacttaatcttggaaactcaagaggtgaatttaggctgggcatggtagctcacgcatgtaatcccagcactttgggaggctgagacgggcagatcacttgaggtcaggagttcgagaccagcctagtcaacctagtgaaaccccgtctctcctaaaaatacaaaaattagccaggcatggtggcgggcacctgtaatcccagctacttgggaggcggaggcaggagaatcacttgaatgcaggaggcggaggttgcagtgagctgagatcatgccactgcactctagcctggaaaacagagtcagactccatctcaaaaaaaaaaaaaaaagtgaatttaggaacctgaaccctttaagggagactgtatttcaggttcataaaagagacagcttggatgcttcagtgtgacagtgcagagattcatagaatgttagagcttgagatgactatcttatcttcctgcttcatttacgaatgatgctcaggttcagagacagaaagtgacctgcctgagtcacacagtgagtatcacagcagaacccaatgtaaggatgtcctaagagaaaactcccactgtaccatgcccttcctctgtccatctcctggattctacagccatttttaaaatacacatacccggggttatctctgcattgaaatagacaaagtcccaatgacactgcctttagaagcacgctgagctgtacactgtaagtctctgtttctctttgctatcctattttggttcctagccagaggtttcagccacaagtgggccttattctcacaaagacttccagacttcttaaaaaaaaaaaaaaagtcttcattttatctagttctctcctgctgctcctggtggttgtatcaatgggtctgtgtgaattcagcaatgtcatgcgttcctgccagctccagtcccaatcattacttctgggtcaggacactaaccagggggtctgggtttcttcctttgtatccccgaagaatgtggagcctgccaaattgtcaaattatagcatttgatgtagagctaggtccaagtgactgtacaatctctgcaggagttcagaagctggcttctgcccctggtagaaacataaccagactctcaagagacagtaagccagacagtctggagatccagggagatgctcatgggttctctggcttctgggccatggggagaaagtcatcaccacccagaaaataagccttcaccctgacagcagcagcagaatgtacctgggcttgaggacctgacttgcatgccatctcagtgtccttaggacagaagttccacgggcaagttctttcagcagtaaaccaaggttttcagcctgtaccactcaaaacaaaccagaccatcaggaccagttaatgtgaaggcttaaatgttgcagatttgttttgaaagtgaaaaggcaattttcttgtaaaaataaaaaaaaatatgtagagttgcaaatcatacaatccaaacaatatgggctgccctgatcttttaaaagggagaaatgtaaatgcccattctgattgtcagatgaggaacatcaaatagaaacttcttgggctgaaaggaagttacaaaagaggaagcagcgatcatttatggataacgtatggtaatgatcactagcatttagtgagctcatactgggtacccagtggaaatggtactaccagctttctgtggacaatcagattgaatttttacagcatccagaagaggcagggactataattaaccccttatggcctagatgagaaaaccagaacatagagaaatcaaggatgttgcccaaggtcacaaggctgataagggcagagatgggattcaaaggcagccacggtccactgtcttacccagtccatgctggggtcttccatgagccatgcactatgttgtgtatttcattgacataactcatcaagaaataggtgtgatcataccacgattacggatgagggaactgaggcacaggtatgaagcaaatgtaaacataggcctggcagattccaaaacccattttgtgtgattaccccgttagtagtttattttacctaaatgacattccctgctaactatttcaattatgataatatcattacaggcaaatatcttaacaatcctgcaagtctgtagagctctcaactccctcaatttatacaactaaacccacacacatccttcccatccctaacccatccccttccccagtggcatccagtggccccatagagtgaaagaggccttcataccatttggcaagctcacaagaggaagcctggatttcccagagaaacttgctacaaggaaattgctataattataacccaaattgtatttgacttctgcatttttgctttatattgttacactataatttaaatagattgttctctggccttttttagggggagaaactagctaccttttttttttttttcactaagaaaagcaacggtaggtgtagcattccaatgacaggaggtgggtttcgtcccccctcttccctctaattggcttgcaagtgggagttgggttagcagttatgccgggagttgcctggggttccaggcggtgacattcatctggtggctccacaaaaggggaagagacaacagtgggtggcgccagcttcggggagatgagccccagagagtttctgtgactccagaaggcagatgttggggacgaggggagatagggtatattaatcattggatttgggaatttttcctcttttgagacattgaagctcttgacagagaagaccagaggggacctaggaaaagggaggacgtgagttggatgcgcaccctggaatacagggcgttggccatctttctccttgcctagtctagctgtggatggggcccagagccccttagcagctcttccttttctctcttctctccagccttctccaggcttttaacatcagcagaagtagcaaggctaggagttggcaaactgtagctcgtgggccgattcctgcctgcgatgtttttgtcaataaagttttattggaacacagtcacactaactggttcacatattgcctatggctgcttttgcatgatgacagcaactttgagtaattgtgacagagctcgatggcccacagagccaaaattatgcttattgtttgaccctcaacagaaaaagtttggcaacccccgatctaggccaaagtgtacatattgttggcctgctggctgcattcaggcatcgggccattttattggactcacattaattaattgcctgcattgtaaaatggaagttttcacaaaataagctggctttgattaaaaaatggaaaaatctaacaaaacatggcagctaatgttggggatgtgtcatccgtcccctctgactatttgtcatagtcgccagcactgcctgtagggttttaccaagtgtacccttttacctgcatggactggtcctcataggcacttgagtatgatactctttcaggtcgtctgggttgtttttaataaaagatttggtatttcttactggactgatgaattacattttaaaaattctttccatcaaactggacttccctgtggaactccagaaagaaaatgaaaaatgtgtttgtgtaatgccagaatttagtgactgccagagttgttatatcagaaatacaacattttcttccaccttgaaacacccatacacatacacacagccctgcattttttaaaaaaaaaatcctttaaaattgagacctatgtcactgcagatgcttcttgacttatgatggggctatgtcccaataaatccatcacaagttgaaaatgcatttaatacacttcccctactgaacatcatcacttagcctagcacaacttaaagatacacagaacacttgtatgagcctacagatgggcaaaatcatctaacacaaagcctcttttatactgaagtgtcaaatatctcatgcactttattatgtactgtactgaaaggaaaaacagaatggttgtatgggcactcaaagcatgatttctactgaatgtgtattgtttccacatcattaagttgaaatatcgtaagttaggaatcatctgtactgaccttgatttaaacaaaagcaggattagtaaatactacattcttcttcagtcaaagaatgagtttctcagttgttattattaatagagcaagtaataatggtgttgggcaatatattaatgatttaagtcaattaattctaaaaccaatggtgggcgatgttacctcattttaaagataaggaaaagagactctaaacggttgtgtaaattgttccaaatagtggcaccaggaagtgatagacatggaactcagatccagccctgattcatgtcaaaggtcccaacgttttttttcttttttttttttttttggacatgcagtttcactcttgttgcccaggctggagtgcagtggctcgatctcggctcactgcagcctccacctcccaggttcaggcgattctcctgcctcagcctcctgaatagctgggattacaggcacccatcaccacacccagttaatttttttttttgtatttttagtagagatggggtttcaccatgttagccaggctggtctcgaactcctggcctcaggtgatccgcccgtctcagcctaccaaagtgctgggattacaggcatgaaccacagtgcacggccaccacagcaactctttaaacactgaggacacacaatagagccaatgattaactaaaataggcaactgatgcctttctctgaagcttacgtgtagaatacggtaagccccaggataacttcccctgtagctagaataactgatcccaggaagagcccctggaagcccgattcgatccactgaaagtcagttttgggtaaagtcgttagtgcgtcttctgttgttctcagcaaatcttcagacaattttttcaccaggctcagcagagggagaactaagtctaatgtatttagccgggggaatgacaggtttccttttcacagtaagggttcctaggataggagactatccactcgtagcagaagaaaatcctaatgagcaggatccaggttttagggggcccttaattctaacacacagttcaccctgggctgctcaaacgtcttgacttgccccgctatgtgtgtgtgtggctttaggaagccctgcgattttccttctttagctcgaatgtcaagcgctgcaggctttctgagaattcagtgtcctgacactggggctgagcccttggtaatgacactgtagacacgaggtaattacagctctgttaactcccaagtcaggctaagtggacctctgattattattctgagtataataggagcataactaacattgaagggaaattgtacttctctcttttattaaccgcttttatattcccttgtgcatggctatgatgctatgaaatctccttaaatgtgatattcctcaatataatacaataataatgcacacaccgtaatgtattggattactttgcaaacagcccttatgaaattgcatttcccatcatttccctgggccagctcagggctgctgggcttacgggccctttctgtagctgggagcctggaatctgccttcacggtcacttagggtttcatggatgtgagcaattggtccacaccatttttattcacagcgaggatgttggccaaccaagtttccagacatctcgctggacattgcgactcagagatgcaaacagtgtttgatacctcagcatagtttgaaaataaactgggctagatggtgtcaggaaggaagctagatacagggaagggaggccttccatgctggaattaaattgtgaagtcttttccactgactttgctggagagtctatcagatctttgttcctttgtaaactctttcctgacaccacctcaaaactagagttggttcttcctttgtatgttttatatgttttgaaaatccacccttagtttggcatcccaaaatacttactgaactcctactatgtatcacacatacattaatctactaaatacacatgaacaattttacaaccacttaaaatttaatatttggcataaagctataaactttttgagggtaccactgtgccttattcatcacttttattctcagtgttaggcaaagtgcctggaacaaagtagatactcaataattgtgtattgttcatttattcctgaatatttcttgggttcttactatttgagaggcgcagaactgggccttggagatacaagagtgaataagacagacatagcttctccttcaaggaatgtacagtctaccgtaacacagaatacacacacacgtcactcacacagttgaatgcagccagccatctgtatccaccaggttcgacatcccatggaaataagaaaacactgtttcttccatctgcaattggttgaatctgtggatgtggatctcgtggaaaggagagctgactgtaattacatttgcaaaaacttctgtgaaggaaaggtagagggtgatgtgcaaacaagcaacagggagacataaatcaaagcggagatgcattcaagacttccttaaagaagtgacttttaacatgaaaattagaggctgggcgcggtggctcatgcctgtattcccagtactttgggaggccaaggtgggtggatctcttgaggcaaggagttcaagaccagcctggccaaaatggtaaaaccctgtgtctactaaaaatacaaaaattagccaggtgtggtgctgcacacctgtaatctcagctactcaggaggctgagacaagagaatcgcttgaactcaggaggcggaggttgcagtgagccaagatggcaccactgcactccagcctgggcaacacagtgagacttcgtctcaaaaaaataataataattaataaataaaagaaagacatgcagagaaaggtgggtggatgtcctgggtaggacagacagcagatgtggaaacaagatgcaggggcgtgtggaagccagctcttaatggcctgtgattgtcgattgtatatgtctctttccaacaggacagggatgccatggtagtagcttgttacctccagggtgagagtatttacactatgggcattggcaatgctacagatgagggcttttctgtctgcttttctggagagctggttgttgatcagttaccagcactccagtgacagaaaggaagttggcatattcctgtgacaggatgaatatcagtgtagctgtgtggacgggcagggggatggtggcccaagttgaggataaacaggtgagcaagaaacactcatacagagccctgctggcctcatctgggggctttgtaccatgggaggccattgaaggattttaagcagaaagaatcccatcattaggtttgattttgggaatgatctgaccaccatgtggacagtggattggagaaaagcaataatggtgttgggaagtggcagaaaggactgccagtaagctcttgccatgggctggatgagagatgttgataggaactagaatggtctggaacatgggttggagtcaatatcaaatgaccaaataatctgccagagctctctgtaatatacagtattcacacctgtggacttttgtgacaatttgggacggtatagtcccttgtaatttaattctgagagtgaccattgaggatgtgatgatgctctctttacagtgaggaaactgaggcgtggtcagttgatgtgactcagtgtgttccctgaggtcatagctgaacaagtctgacttagtaatatgtctgactctagacctacacttataaccacaacttcacactctttttgctgccaccttcttctaaggggctggaagaatggagatgccactgagctgggggtgaagacatcgtaaaaagatctacctggttctatgagatgcatccatcctgaccttgccaagggaagtaggaatcaggaaatggtggcttctaacgtgatttcatccaggcccttatgcttgggtccatctcaggaatagtgtttggaattaacgcaggagccagagactaagcaaaccccgcctccaccccagtgcagatttcagttgaatgcagactagagcctttgaaaattatgcattggaaaacaattctggataaattaatttccatcatacataatgcatgaggggaaatccgtggtatttttaaacaatggaaatgagagaatctgccttttgggcattgatcccaattaaatttatttcagcaaacatttatcaacacctactgtgtgccaggttcttactggaaaacagagatgagtcagacattgtctgtgcccggaaagagtgagaaatcaatggaggtacccgcagagtgatcagctctgggttagaccttgagactgggagacaaagagttgtgagtattgccctggagggacatacatcctagtagaggagaacgaggacctgccagaagatctgagagtgagagtttgttgaggaaggctatctcgtgcctgggcttcacttgaatggttttctttcatgagtccttccgccatcaataagatccttatttaaagcctcctattgtccagcaatggtatgtgctgtccatctgccccattagcccatagctgctactattatgctacttttcctatggtgtccactgttattactgccacaactacctcaacttactgttgaggaaaatgtaattctcctcaacttctattactattatagtgttgctgttattttatttaatgatagatcatacattcgaaattatttgttgagtgcttactgtgtaactggcaccgaagattgaggaacagataaaaaatagctatggtttcttcgtttagaatgttatcttgtaggagagagagatggaaacaaataaacaatgtaactaaataattacaaattgtaatgtttgcttcagttatgcattgctgcctaacaaactaccccaaacaaacattttatttacttacaattctatgcttcaggtatttgggtgaagtttagctgtagagatcagcttggtacatataccacttggaactggggagtaagttccaaggtttcccacagatgtctggaacttggtgattgtctgtacaacacatctcctcccccgcacccccacccccaccccgccactcaatctctccacaagactagcttgagcttcctcacagcatggagttctatggtcaatgagactttcatatgggcatcatcttggcatgtacacacttcagtggtggctgaattcgaaaaaggtgtgtctcaagaaatgagagtagaagctgcatatctgataaagctcagccttggcatttgctatgtgctatgtctgcctcagtctgttgattaaaataaggtcatctcagattcaaggagaggggaaaagactccacctttgactaggagatatgacaaagaatgtgaaaccgtcttgagtccaccatgatactttttgaagaaaacacatattaggttgaaaaagagaagattaaggagggagggacatgagatcagggaagccttctctgaggaagggtcggttaagctgtgttctgaaggatgggagagtccagcaagagaagacagtgggagcagcattccaggaagagtgaagagtatgtgcaaagccaggtgtccctcatctctctctattcccagtgcagcttcctcaccactccccaaccaaataggagtctcttcttgtaggtggaacacgggataatataaagagcgtatttttgcacatctgagaagcccaggtgacatattgtccatgatctgaagcaacagataatgtgtttcctcatgtatttcccaatgggatcacccaaagtaacatgcttaaatggatgagttgtaatcttctacatagaggtgatgccaccaggcattggtgatccagataaatgaaatgcaggaataaggataccgagactgtttctggccacaaaggaccaggcagagtagtctattgcttggcgaccaagtgcatgatagcactgggcttcctgcttctgccctccccagtgaacttcagatgaggcttgggagatgaaagacgagagaggagtcattatcagaatggtaagaatatagcatccagatagatgagaagagacaaaaagataactccgtccccatactggcttatttctcctttatggagaaggcagccccttggaggtaggcatttcctgggttcaaatcccaacgttgccctttattcactgcatgactttgggaaagctattgaacctcactaagccctaaagcatagaaggtgccctataaattgtagctgccactacttctattattatcatgtatgtcattattgctactgctttgcagaaagacatgtgcctcattggtggtgggattcttctaacccccgtctcctcctttcaaaggctcactctgctactttagagttatcttttatagtgtactcccaagcttgcgatgttgcttccctgcctgtaccattttgttttctccagatctcgctgtttccctcgctggaaactccttggtctctgactgtagcaatatgtttaataactcaaggtacctgaaaataatgcaatatggcaccatgtcggcaatgtggctgagagagtggctcctgtacagattgcctgacttcacatccaggctccctcaggtgttacccatgcaagacttggcaagtaacacaactactctgtgttatttatcatcagttatacaattaggataattaaagtgtttgtcacagagggtagttatgaagacaacacatgtcaatgattgcagagttcttagcctggtgccaggtttatacaacacatctgatgatcactgactgctctgtctctgctgtctctatggttgttgtcatggacataaaagatgtccgtaaacctgctcatgatagtcatgacctcttcaggcttaaccgttagtacttctggttgtctcttcttgaatgagaaataaggagatcaataattaaacacctatgagattcttcaccgaagggagttcatgttgtcatcccagcactcatgctaggcttgtaggaatgtttctgttttgcagatttaagaaacctaaggctcagagaagtcttatcactttccttaaaccctaaactcctcatgtggccaaggctggattcatcccaacaccatttaccactaaaacctgtgtcttctagggaccttagtttgatgaccctggttaattcagtgcattgaaggtttagctctctcagaggttcaagtgagagacacattagatacctccctgcccaagacccagaatgtttccttttagaagcacccctaaccacacacctggaaatccaaggcttgtgcagtttatagacgctgcttttcgcccctgactgctgtatgtaccttgagcagcaagataattcactctaattactcagaatacatatttaaggacaagcacaaagaactcttagtgaggcttaaaaataagccattcagcaaaattgcacaaggtgcattccctcagaaggaagagtttattgcttctaaaagtgagtgtctaccctttgttggctgcaaatgtgaggcaaaggaccagctccacgtgaagcagcattttcctctttcagatttacctccagaaggagctccactgataggagattgctcctttctgctatgacatcttctgcgtcaaaggatctcattagtgtttgtttttatcaggtttttttttttcccgacttttatctcactcagagtgaattcagtgttcactgtcatttacaggataggaaatatatgtccgtttgcattgaaaatcctgcttattccatctagactgtcccagataccactgtattcatgtaggtttggtgttttgtctttcatctatttctgaaatcaaaattttgttaaaaatgtttcgggaaagctcaaaagaattggcccattggaatggagtgaatgcaggctttctccatgcaagcagccatgctttcctagtcattaaccacctgggccttgggcctgtcatgttttttgagtctctgtttcttcctctggcaaatgattttgatgggtgtcatgaggatgaagtgggatgatgtgaaggacttggggtgcttaagaaatctcccaggccattcacaagccacatgcctgcaaagaagtcttgggtgagcagatgccaagtttcccagcaaagagatttctaaggtgcagtgcttcagcttgacattagagagatggccttggccggcagctgaggttttccttctcttttgacctgagctgggaagaagtgtgggtactggcagctttcgtgggggtacctctaaaatagagcagcagttccctgttaggaatggcagatgagattgtgatgaatgcaacaagggctggagcacagaacattctgaacggactattactccctcaaccctatgggctacctgggccagagagatatacacagagaagactggtcaaaggggaaagaaaataattccttttaaatatctaggcaagcagccaacctcctctgatacagggacctgtgacaaagacagacttggagcatgtaacttgtgtttgaaagcatacgccagacccgtaacttcctcttgactttccaccccacctcttctggattacccgggtctgcaggtgaaattccagttgatttacccaaacgggtgcaagtgcagaggaaggagaacatggggaaagaggcaaaataaattttaaaaacagagagatagaaagaaagagaagacatgaagggcgaaggaaggggaaagagaaacagaaaaaggagatagaaatagagggatggggccgggtgcagtggctcacacctgtaatcccagcactttgggaggccaaggcgggtggatcacttgaagccaggagtttgagactagcctggccaacatggtgaaaccctgtctctactaaaaatgaaaaaaaaaaaaaaaaaaaaagccaggcatggtggcacgcacctgtaatcccagctactcgggtggctgaggcatgagaatcaattgaacctgggaggcaagactgtctgaggaaaaaaaaaatagaggaacagaggggagagagaaggagagggagaaagagggaaagggaaggatctagctaggcacacataattgttgtcttcctaaaaacaccaccaccaccccacacatacaaacaagaaaggcaagtgacattacaactataggtactgacatttgaggctgtgtggccctgtccaccgctctaggttgcatctcagtgaatgttccaggttctgaacaatcctataggtgggggaaagaggttaggtggaccaagcatggtactgtggcagcacctccttctcctactgtttctgcaccccgccatgcatttaaatcactcagggttggtgtttaacagacacaactcctgagctactgaatcaaagccttagggaatggccaatgggaatatggttttaacaagtattttaggcaagtcttacaaatctggcctgacacatgacttcacataaaggtttgagaactgagagtctcaccactcacatagaatgaagggtgtcagattctgggagatatttgagatctgatagaaattacaagacttttttacaggcctggtaatgatcatggagatgccagcagctatcactgccaaggactgggtgggttctaggcacctgtcccttgtaacacctgaattggaaaactcctggataaaggtgactttcccattttcagaggagacaatggaatctcagagaagttgaaatgtgtgtgtacccctgtggtgacacaactgattgaatccagtcttaggcatattaaaattgagaaccattgcttaaggatttcttaacagctgtattttattgagagtctgcaccatgctgggcagtatctgtgtgtgtgtgtgtgtgtgtgtgtgtgtgtgtgtgtgtgtgtgtgtgtgtgtttattttttatatatttatttttttcaaatggactctgttgtcaggctggagtgcagtggcacgatcttggctcactgcaacctctacctccttggttcaagtgattctcctgcctcactctcccgagtagctgggattataggcacgcaccaccacgcccagctaatttttgtatttttagtagagacagagtttcaccatgttggccaggatggtctcgatctcctaacttcatgacccacctgccttggtttcccaaagtgctgggattataggcgtaagccaccactcccagccatgtctgtgtattctaaggtgtttatttccatttgtcttcccaatgactttataaagtgagagagaatcctcattctatggagagggggaataagaccaggaaagcctgaattgaaaccaacgcttactcctaaagactgggctttgagttgctacattatatttcacacctctgtcctttggaggtgaaagttacttgatggtgatgtctttagggaaattatgacaaaggagaagtgaacgttggagtcaggtcattgtgtgtctgattacttactggctatgtcacctggtttataaaatgggcttgatttaatgtactgagtgaattagtgtccccccaaatttatgtccacttggaaccttaggaggagatctcatttgaaagtagagcctttgtagatataattaaattagatgaggttatactggattagggtgggccctgaattcaatgagtgttgtccttgtaagaaaaccatgtcaagacgcacaaaggtaagaagtccaaggggcatcaaagacagattggactaataccagggacaccaaggattgccaggagctaccaggatctaggaaagaagcaaggacggactctccttgagagccttcagatggagcatggtttaggcaacaccttgattttgaacttctggcctctggaactgtgagagattacctttcttttattttagtcacctagctggtcataatatgttatggcagtcctaggaaagtaatagcacatgagatattttttcttgtttgttgttgttgtttttgtttttgttttttcctttatagcacttattgtaactagtaattttctttgtttgcttaccaattctggacatactggaatgtcagcaccatactgcattttgttcatcatccccgtatctgtgatgcttcactccaatagcagctcagttacgatgtgtgaacggaatgtatgaatgaatgaatgagtgaacagagctgttgtgaggactaagccgagcagtacagtgaaattgcatcaaacagtgtctactaagagcaagcatgcagaataaaagctatcatgattatcattcgaggcaggaattatctttttttcctagggtccctctgccttgctgagcatcaaggtgaacttgagtagttactagttacgtggactgggagaacacggttaaagtaaaggttgtttttgtggagattgacaggcaagagcccctgcctttcctttcctgaaacagcagttttcctttgagacacgaagcccaccactgagagaggcagggtgcgggtcatgggggtggaggtggcggcattgtttgcaatcctcttggccccttgctcacagccaggcctctgcctttatattcttcggggggctttgatctcacctccctgtccaacagatgcacattagtcagtaattctaggagacatcaaaaccccagccctggcaccccccgaccttccctgcagccttcacaagccgctagctgtgttaataggcgccagacaggactgtgctatttcttagagcttaggtagaatgctactgcggctgttttactgaaccccagctcagtctccacttctttccacctctgacccagtacgtttagaattagagccaaatgctctgagtgaagagttgcccgacacggtgacttgatttacctaaggctgctatattctttccgaatgttctttccagacagaggtggagggcaaggaactgggtcccaggagctagaaaacgtggtcttgggtctcagctctgccattctgacactgaataaccatcatcaagtcacagacatcctcagagcctctgtctctgcatcgggggagcagaaccaggaatgctggtcctgcctacctgacagaactgttttgagagtcacgtgcaaaatcagatgtgagcatgccttagaaattggaaagtgtcgtaaaactagaagcacttattactattattctgtgactctgagcttataaaaaaaaaaaaaaaagaaaaagaaaatcaggccaggcacagtggctcatgtcagtaatcccagcactttgggggacagaggcaggtggatcacctgaggtcaggagttcgagaccagcctggccaacatggtgaaaccctgtctctactaaaaatataaaaatcagccaggcatggtggcacgggccagtaatcccaggtacttaggagcctgaggtgggagaatcgtttgaacccggagggtggaggttgcagtgagctgagatcacaccactgcactctagcctgggcaaaagggtaaaactccacctcaaaaaataaaataaaataaaataaaataaaataaaataaaataaaataaaataataaaataaaattggttacttaccttgtgtcagctgttgcagatcaagaaactaatacaacgcaatcccttatggtgtgcttaaacccatattcaatatagaaaatatagtatatccagataaataataataagcatagttatttcatcacctcgttgaccacctggttgtttatcttttgagaggctttgcaatgtttgacaaaaaattagaaaatagataaaaatgcaaagatgatacctgctatactgttttgtggatttctctttaacttaaaataccatacatacaattccgagtcattattcaatgactattcagattttaactttttgttttctctgatggcttctttgtgtctcattgcctgggatcatttggattggacatagtttatttagccaatcccttgtagttggacacttaaattttttcccatttttcactgtgacaaatatcaccttgatgaatttctttctgcaaatctctgcacactaccgtgattgtttctgtaggataaattcccacaagtagaacttctgggtcaaagagtaaaaatgcacattttttaaggcttttgatagtcagataaaactaaaacaaaatcaccctctagaaagatcataccaatttaaactcccaccaagactgcacggcagtgtcctgtctcctgcactcacaccagtatcaagcattatctcagagtgatttaaaatgcctgaagaaaggagtgataatggtttctaaacagcactggctaacgcacagccctgcatattggctttcagcttgataaatactttcttataaggccataaatattggtggtaccaaaggttaacgtagtgtgcaatgctgtaaaatccagcaggcaacctgctagctcataatgatgcattagcacctttcgatatgaagtgtgatgacttacaaagtctgtttgtaagtggccactaactcaacaagtgtataattgtgtcagttggcaccacagtttctgcaaacataatttattaagtgagcaccttgccttctgttatatgccaaaaatgagaagaaaagacaagagaaggggaaagaagaaaatgatcatctgactggggcatttagtcccttctgcaagctagggttacttaaaagaccaacatactttattgaagaaaaaacaaagcaaataatcctttccatattttaatagtcagttgaccacactgctggcagtgttagaatcaggattgaggcaggcatgacaaatagctgcaccattaaaaggcatgtgcatttgcaaattagacttttaaatattttattttcgtgtttttaagtttgcaactcaggcaccttgctcctaccattttatttttgcaggtggaaacagttgtatagttctttgctattgttctgggatgggctagcatgaaggtgaaacctgttttgtgattaatgaacatggaggttgtgtgtatttaacagcagaagagtaatctatcctgataggagacaaaacagaatggataccaccagccgtgttcccgtttggctttgctccttggtaatggaggaaatccaggtattaaggatagactttagtaggcccatctcagcatttgcccgtgtgtagtgcctgttttggattgctgtaaagaggacactctgtaaacagaaaataagctagacaggcacattttgagctacttattctgttcattttcagtgactgttcaccctgtgcaatattttgaaacaaaccgaggagttattcacgtcatattctttcttactcgtttttcatattttatttttacttttgagacagagagtcccatctgtcacccaggctggagtacagtggtgtgatcttggctcactgcaatctctgactcctgggttcacgtgcctcctgaatagctggaactacaggtgcctgccactatgtccggctaatttttgtagttttagtagagacagggtttcaccatattggctaggctggtcttgaactcccaacctcaggtgatccaccggctgcgccacccaaagtgctgggattacaggtatgagccactgcgcctggcctcgtattagttgttctttaaacatttacatttgacactgagcactgggaatacagaggtgaatggcacctactccatccctcaaggaactcatcctagtctagagctgtgaaccaatgcaaggggcaaatgcacacacatgcggttgcacggatgagcaggatgctctggggcaggagcgggggggcagtcaaacaagtccaaagcttctcgcctccagccagtttcggctgctgttcacccatatctcccatcgcctgggagcaaagacagctttgctcagagttttcttctccacttgaggccgccatgtttgcctctgtctggagttgtcagcctggctactgactggtagaaatcagagaggaaattccaggcatgatggcatgttcctgcctattagttagggacccacttcattatgaatgacatagtcactatgaagacctgacctctctggcttctggaagaatgttgaacatgcagaccaaggaaaagccaccatcccagagctcacattccagggatccgaagaaacacatcagagtaatggctagcccagatggtgataggagagaaacagagaagagggtggacaggaaggactttctgaagaggcgacatttaagccgatgactaagtatgaggaggatccagtctggtaaacagtggaaggcagaggttccagagagaagagctggcatatgccaaggccttgaggtgggaaacaccctcgaaatatttacagagtggaagtagctcccaatgcctatgacttcactagcccccaatttggaacaaccattatggctgctgaatgctgtaggactgtgaataagcaaagaagtgtttgaaatgaggttataaaggtaggtagggccatgcaaaccaggtgaggagtttaggtgtaattctaggtgcaagaggaagccactagaaagttttgaagcatgaagagtacctgtattacggttctctaaagggacagaactaataggatagatgtatatataagggggagtttataaaggagaattgactcacgtgattacaataggtcgtctgcaagctgaagagcaaggaagccagtccgagtcctagagcctcaaaagtagggaagctgacagtgaaaccttcagtctgtggttgaaggtccaagagtccaaaagctgaagaacctggagtctgttgttcaagggcaggaagcatgcagcatgggagaaagatgtaagccggaagactgggccagtttagtctttccaccttcttctgcctgcctttattctggccacgctgaccactgattagatttgtgtccactcagattgtacgtgggtctgcctttcccagtccactgactcaatgataatcttcttcggaaacaccctcacggacacacgcaggagcagtactttgcctccttcagtccaatcacgttgacaatattaaccatcatcatatccttctctttttctttttcttttatttttttagagacagggttttactctgtcacttaggcaggagtgcagtggtgtgatcatagctcactgcagccttgtcctcctgggctcaagcgattgtcccacctcagcctccctagtagctgggaacacaggcacacaacaccatgcctggctaattttttaattttttatagagatggaggtctttctatgttgcccaggctggtctcaaacttctggcctcaggcaattctccctcctcggcctcccgaagcactggaatgccactatgcccagcctacccttctcctgagtgagttcctccagagtcttttttttttttggctgggctgggaaatacccttgagttccggagaagggaagtggtttctggaatcctctgcccgtgaaggttaatttggcaatatgcatatctgctctggggctatagaggcagctgtgacgatgcccagagggggacctttatgatctgagagcccgtggaatgtttgtagcagcagagccgtgttgtcccattgaatgtctcttccatttttaatgaggagcctgggggcactgtatcaataaaacgaccaaattattaaattatcactctacagggcatcttatattagtcctaattaaatgatgcttttcatattaacaaacagtgctcaaaaaggattctcatttttaattcggacctcattgaaataggaagccttagaaatttctagaataggtactatgcctctggacgaatatgcaccatgtctctggactcactggagggcacctacagtgagttttcagacactgccctgaattttaaaaatcctcagtatccacaatgactacctgtcttcacccagactcagaaatgctaatgggggtcaggtgcagtgactcactcccataatccgaacgctttgagaggccgaggcaggcggatcacttgaggtcaggagtttcagaccagcctggccaacatggtgaaaccccagttctactaaaaatacaaaaattagccgggcatggtggcgggtacctgtaatcccagctactcaggaggctgaggcgggaaaatcacttgaacccaggaggcggaggttgcagtgagctgagattgtgccatcacactccagcctgggcaacaagagcgagactcaaaaaaaaaaaaaaaaagaaaaaaaaagaatatttacaggacttctgctttcgccacgatagagtaacagggactggtgtgcaccgctgccttaaagaacttttaaaaaggtcagtctcagaaattgccactaaagaattttttccatgcaaccaaccaccacttgtcccccagaaacaactaaagtttagaaaaaagtcaccatacaagcaacagtgatttcagacgttagacagcatgaggcatccacagaggggaagcagatgagatgtaccctccaggggccccagctcactgccttgagagggtctctaagccataggacaaggggtgggggcccaaataaggaatatttggggcgcacttgctgggtgaaagccatgagacactggagagacagtagtgatccagtcagccaatagctctgtgctactgagctgacattgttttgagggaaatggtcaataagtgagcaaataaatgggggtggtttcagaatgtgagaaatgttacaaagaactaaaaagggtaatgcagtggaatactgtgacctggaggagcaggtaggagttactctagctggttcagtggcatgcaggaagctgctggaataggctgccaagggccaattatgagcattactagccaaatctgtgttccatgagatcccactggtagcttgaaataggccatgatgtcaatatttacaccacagacattggcggtgtttttcttttttctttttccaacatactacggatggtatggccaagataggtttcataaagaagtgcacatttctgtatgacattaggataaagaacagcccatcatttatgtgacaaaccctaggaggaatattccagcagaagaaatagcatgtgcaaaggccgtgtgtccacatcctccatttcttcattctctatgatgttcagggcaggtatttttacccctccccacaattgtataaggagattttcattgtcacgtgtgtcagtcattttatctcattctctccaccacccgtttttaattcccatgttggtacagtagagaatatctttatccagttatccttccttcatccttagattttgtttcctgatttctctttccttgtacttcttttttcatagaattttacaacttgttttcaggtatgcttctttatttccatgtctatgagagctttgatcagcagctatagtttcttatgtaatccatagactccatcaatttcttttatagtgagaggcgacaggatactcattttacatctagaggcaaagtacttcagcactggaaggtgaaaagacttcagaagaccttttctggaagccttttctttagcagcagggtgtcttcagagaagttgcagagttgagtctaatggaacggcctgaatgaccactgggtcaatgttaattgataatgatgctttctaaggcgagatctgaactgaacctcaactcaattcttaatatgtgcggcagaagcaaaaacaagaaatccatagttcatgaccctataagatttatgtctaaagcatttccgacacccattctttgttgtgaacgactaatttgccactcttgtttttctttctttttttgcaatggagtgttactctgttgctcaggccgaagtgcaatggcgtgatctcagctcactgcaacctctgcctcccaggctcaagagattctcctgcctcagactctcgagtagctgggattacagtttcctgccacaacccccggctaatttttgtgtttttagtagagatggggtttcaccatattggccaggctggtctcaaactgccgacctcaggtgatctgcccgcctcggactcccaaagcactgggattacaggtgtgagccactgagaccggcctaatttgacactcttaagcataccttctctttcctctcagtaagcaagtcagatatttcaggagaaacaaggtatgtgctccttccttctttcattccttccctccttccttttttccccttcctttttaaaaaattttccagtttccacattttaaaattttatttctttctctttttagagacagggtctttctctgtctcccagactggagtgcagtggtgcaatcatagctcacttcagcctcaacctcctgggctcaaattatcttcccaggtcagcctctagagtagctggggctacaggtgcccaccaccacaccccctaatttttaaaattttctgtagagatgggatctcccagtgttgctcaggctggtctcaaactcctggccccaagtgatcctctagcattggtcttccaaagcactgggattacaggcatgaggtgccacacccagcccagtatctacaattttaaaagtggtatacatagcctaagatcttccataacaattaaaaatgagtgtcagacatgcaggactatcaggcactactgaacattgctgaatactcacaagagaagggggatacatatggcaaaatttcaaactcaaatgaagatctgcaagtggccagtgcacttgaaaggtgcacaactcatttcagaaggcactgctcagcattaccaagatgcagctgtgtcctaacccccagctacaagggagtgtttactgtaggttagagttagctgactcagtccatatgttagggtaatcacaacccaattttgatgaactcataaaccaaggaggctgttgctggagctaagaagagacaagatttttagtagatagtgacatttaacctcagctaagtctaggctgtcagcctggcaggtctttttgaagagctaagttctgcttaaaagccattagtgtatgtcaggctctatacattaggattaaagaatgtaagaaggccaggcccagtggctcacacttgtaacccaagcactttgggaggctgcagtgaggggatcgcttgagcccaggaggtcgaggctgcagcgaactatgatcggaacactgcactccagcctgggtgaaagagcaagatcctgtctcaaaaaagaagacaatgacccagatcctattctctcagagcccaaagcttagttgggctgatgggaaaactaacagtttcaatttaatgtgtgtattctaggatcgagctaggggaacaaagagtagcaggcaaaggaatgcacagaaatatttagtcatagcaggaaccgttcttcaactatcttccaaggactgtgctaaatactttccatgcattattttatccttacagcaatcctgtgttttatatacttttaggtaaaagtccattttagtcattagcaacctgagcacagagaggtcagttaacatactcaaggttgcactgcatgtggtaaagagctgaacagagaaaaccaaattcccaagttcagcctgagtcgtgtagactaagtgttagttggagtaaacagacttagcttctctagatctgcttcctatcagaaatgtggagatgttcaaagtcagctgcttacctttagaattgccatgaagtgaacaccagtgaattcagattagttgagcactttgagcctctaacctttttttttttaatttttttatttttaagcaccctacacctataacttaactattcccaatttggaaaaaaattttatgagtgctgtgcactctttttttcttcttcttctacaaagccaagtgcacgacatcaaacctgtaatcttggccacattatcaccatgttctaaccaagcaagcttattagttcagacaattaagaaaatagaagttgaaaatacttagctattagggagaacggagtaacataaatccaaggtgttgggacaattagcattcgtagtaataaaagccaagtagaacactaaggaaatgaatattatgtttattatttagcatttaggtagtattgcatatttataaaatacctggtaattgtttttggtcatttctttcagaataaatcggataaagggtatttgctattgttgtgagtagggtaagggggggtttttagtagaagcccattaaattacaatgcatctccccaccctcttaccctcaactcagatttaagtacagaaagaaaacattcagaaatcttgctgaaacagaaatcatttcacttttctcctttgttaaaagccttctgatgactcccccatttctgttgcagcaaaaggcaaaatcctgtaaatgcaacttgatgtcctagaatggattctggaacagaaaaaggacataagtagaaaggctgtggaaatttcagtaaaatccatggtttagttaatagacaccagtgttaccttcctcgttctgataaatgcacgtagttgggtaagatgttagtgttagaggaagcggggaaaaggatataagaggaccctgtgtactatctttgcaacttttttgtaaatctaaagttattcaaaaagttaaaaaagattttttgtttaaagctaaagttcttagagcagactacaaagacctgcgtgacctgtttctgtgccctcgtcaggtctctgacgtcatctccttttctcttccccttgaacgttctgtaccagcctcacgcttcatcactttctcaccgcaggacctttgcactggctgtgtctgggactgggctattattgcctgagctctccctgtggcccactcttctttgtcaaattgtgattcaaatgtcaccttcataaaagccatccattgaaaatgtcaagcctacctccacggtcccttcctcctgctcagtatttatctcatggtgcctatgcttccaacatgctctgcaatgctctgattgattaggttatgcttcatcttcctcctgctctcctaaaacttacgttccttgagaggagggattttttcctgttttctccacgatgcatttccaacacctggaattgcatacttagtgcttaatggatattagttgaacctaaatattaaattttatactacaagaaagtaaccctaactctgaatgctttgataaccaaggcattgtggtaaacactctaaattttctagatcttgtggcatcttcatgatagcttaaaatttgagtatcatgaccaccatttataaggccctgagaagtcttaagttttgcacaacatgacgcagctcttcggtcaaatctgagagcccagattcgaacttgcatctcccaacactacagctagttctgtttcttgtacaccagattgtctgctagatttgcatgcttcccctccatttcattaaaccacggcacatgaagaaatagcattactcatcaagtcagtagttgtttgagtaactcagatccctttcttagatgatggtacccaagataaatgtatggaacatattatttcccatgatggccacaggtaactctggaatattataaggtttatttgtataagcaactcagtatgaaacttttaccttgaatttccccttcatgggcctatctttgttttcattttcaacattctcttttggatacagagtttcattcacctaagaaagcttcatgacattagtggaaaggcactggttcagttctaagaccttagttctaggacccactctcctatctgctagctatatggaccccttcttaggctttaatttcctcatctataaaatgggcataattttaccaccaacttcatagaggtatcatggggataaatggtataacccatgtgcaatggtatgcactgctgttattgtttgaaaataattctttgttgaatcagatataaaggttgttattgttgttttctgaaaccgacttagtttaaaattactaagtcattttaatatctatcaaccatttccatagtttctaaggatttctcccaaatgcctctgttaacaacaacgacatcctcctcctcatcatatggatatcatgaaacaccaattatatcaattattgaacagttatttggagtcaggcttgatacagtctttgtaatgttgttttattttttgctgtgagtccacagagcgagtattataaacccattttacagatgagggaactgaggtaccatggaggtgaagtaatttgcctactgtcacgtgctactcatggggccgggtctcgaacccaggtgtttcttcctatagctgagggcttcatcagtacttagcacagctttattgccaaagagaattgtaaagcaactggaaaaatgaccaaaatacaatacctccaatgactatttttaaaaaaacaaaaaacagccgggtgtggtggctttcacctgtaatcccagcactttgggaggccaacgtgggcggatcacttgagatcaagaattccagaccagcctgaccaacatgttgaaaccccgactttactaaaaatataaaaattagccaggcatggtggtgggtgcctgtaatcccacctactcgagaggctgaggcaggagagtcacttgaacctgggaggcagaggtttcagtgagccaagactgtaccactgcactccagcctgggagacaaagttagactctgtctcaaaaaaaaaaaaaaaaaaaaaaagaaaaagaaaaaaaaaaagcattttcttaaactgtggcccagaaagcacttttatattagaattacctgatgcgcttgttacaaacacatattgctggctgtaatcagtgaagtgctagtaaatgcttaacaactagcttggtgggggaaggagcgggagagggctccagagactgatctgaagcatttgccaatttccatggtgcaaatactcccatcatggccattgcaagataccaatgcctcgtcactgaacacagagttaggaaaaaatatgcagaagtggaccatcacgcagtatttccaccatccagatactctaaacaaacaaacaaaaaacctcaagagcacagataatattcaagtatggtaaaataatttaatattcaaaactcattatttcttattaatttttaatatactttattgaggccaggcatggtagctcacgcctgtaattccagcactttggggggccgaggtggtagatcactggaacccaggagttcaagatcaccctgggaaacatggcaaaactccatatccactaaaaatacaaaaattagctgggtatgttggtgcacacctgtagtcctaggtactcgagaggctgaggtgggaggatcacttgagcctgggaggtcgcggctgcagtgagccatgattgtgccattgcactctagcctttgtgacaaagtgaggctctgtctcaaaataagacatacatatatatatacacgcgcacacactcacacacatatatatttatgctatatatgtataattatactgtatgtatatatcaatatgaatatatacatgtatagtacataaatacatgtgtacacatattttcgtatatgtatatacatatacaacatatattaatatgtatatacatatactttcttactatatatgctttaattatgggcttatgtcatttcattttttattaaaggttgtgtttaacaacagagtcacagaattcctgacaagttagcaactggctttcagaaatcagtatcaacaaacttcaacagtccaccagctaccccaggctgacaaaatcagcaccgaaaaggctggagccctggaatgtgcatttctaaagagcatccaactgcttctggtgcacactcaaagtattgagccaatgccataagcctttctgagagcacttgtgaaataagtatatgaaaatactatataatgtggtaagcatctgaaaaatgtagatgggattcatattcctagcaaatgctagtgggcatttatgctaaatgaaccccactgttactcttttgaagatttttttccctacttttaaaatggcataaaattattttatagttttattttattttacccatcaatgaagagtgcctggtctctgttaaaggagaaggtagtaatcctatttcccttgcagccagcataggagaaaggttcagaggcctttcctgaaaggtttaggcaaagataacaaaatgtcagagaaagctgcagggcagggctgaatggaaaagtaggtttgtaatctcaaattcaatataaaagatcgaaagtatcaaatagtcagtggtgagcctctccatcagaatgttatatctgccatgaaattctgctttatgattgtattacgttatatacattatacatctctttctctcagtctctctctttctcacctagtctctctttctccctctcttcctttatatattctcatagaaactagggcacatctgagatccataaggaagtcttgcttgactccagtcagagaaaccattggaaacatcacctgcctccaaccccaaccccatctgccttaaaaatataaaagtctttctttttaggtggaggttttgattcagggaaaacacaggccttgcaaattaagagcagcccaagaattgtgtgcaaaccctgatacacgagacacccaatccaaggcttgcactctgtcctctaaacagtgattgtgctttccaaggtggatatggagggtaattaagaatgaattttcatgacttgtgtctactgtgtgcccacacagtgccagaagccagagtaagaactttgcgggcctttcgcttttcatctaccctccttagtctttggttcttatccaggcacttaggagtttctcaatcagtattctttgaatgaatgaattcacaaatccccattttaaggctgtgggaagaaaggcctttagggatgaagtaacatgtccaaggtcaaatagttgtctttggtcaactgttggtcaaatgctacacaattacaggattgcctccctaaggtatagacagtggctgttaaaagaatggatcctatttgtcacctgtgaaggttattttaaaagatttatcttgagtgcataggagtatgaatgggtcactctgggatggggcccagaaatctgggtgttccacacccttacccaggtgacttagagacattcagcaggctgtacctggagaaagaccagtgcgattcatgtaaatctctctacatctccaaccagaggcaaacctgtcaacttttctggctgcaaaatctgcaccttgctaaaggctgtcaagaaccccctatggggggtggacttcttggcttacccaccctccctacatctctgatccttgcatttttagacgtgacaggtgcctgcaaggccaccaaatttcatgtcttcagtttattcagctgcaaaaaatttcatttcagaaacatgacacaatgagaaactgacaaaaggtgggcttgaattcaagtctcctaaatgaaagtacccccagtgactaaaagtcttgttgctgctccggatttcacattgtcatcctgcggtgggaacatatcttgcatttttatgtagagtatcaaaaaaaaaaaaaagcaaaaattgttttttggaacagccaaagcgtgtcctggagcataatctaatttgtttctctatggcccaagaaaagagggggcgagtgtcatccttcctttttcataaattgagattcagaaagggcgagtgactttctcagtcacacagcatcatgtctaccacccaagtctcacccgcttctcattggagccacaaatgacataattagatgagagatgatcccaagactagcggatgtttccctttcttcattttaagagtttggacttttttaggggacctaaacatttgctcctgagctctgctaatgtgtgactgctgagtttttctggatgaataagacttttttcaagaaatttcacatattcccgtctggccgaattatgtatccaaatgtttttccatcagagaactcatccgttgtcctgtgactgtgtggtttattcatttctcctccacaaagctaggagctccctactggttcaggttatgtcttcttcatccttcagtccccatatgtagcaaatgttctttatacaagcagatcttaaaatggtagctgagttgaacagtgtagacacagagtatttgtccctctaagaaccaacatgggaatccatggagctcagaccaaatccagcccactgtctctgcttttacaaataaagttttatcaaaacacagccacattcatggttcatttgtttacatattaccccatggatgcttttatgtacagcatggcttatgatgcccaactattcactctatggccctttaaagaaaaagcatgctatccccatctagatgaagagacaagtagaaaggagatgcaggcatttctattttcagagtatatttcttagcatttccatttccgaacatatatttactctccttcccacctgccaatgcaggagaaattagcctactgagaaactccgaaatatcctgactagtgtcaatttgcagaaattgtgcagtttatgtgacaggattctttcactgtcaaatttttgttcagagacatatcggtgttcacaaagaatgatatctccatgtctcagcatatcctggaaaaaccccagtagtcctagaacaaaactcttggagtgcttgtctctttgtttgaagcatttatattaatacaaagaaagaagtaattagccaggaaaacccagggatgttcagggagatcagtgccatcttaaattcatcacccattttctgcaactgaattgtgctttcagcagttttcttaggtctgggaaattagcataacgtatagaattgccatttggttcatttaaatcttgcataatatattaggggggaaatctttgagctaagtggaatttaggatttagtaccaaatacgaacttttgtgttaaattgatgtataggttggccttgatttctgagtgggacaggtaattaaagaaaaccaggaggttaagaggagatgaggaaaaaaaaaatactgcaggaggaaaaggttggaggcgtcagccagaaagggaggctgctggaagattgctaagctagagaacaatgcagctcatttttatgagaccattaacacagaagacagtggcaacaatcttgggagtatttgacatgttcccaaaattagttgggtgcgggatgtcatggcacagagctgtgtacctgctttttatctggggatttataaaagtggagccttgctggtgtcgtccaaaacagcaggatgggaaagagctgttggtgagaatgcattagggtacctgccgcctgttccctgtagttcctctggctcttgaaagagcctgaagttacagaagagggcaggagttctaagggtgtccaggaggccaaatgctgaaggagaggaccctcatctgaaaggagagttggaagcaatgaccattggcaacagccttgaagacacgagaccctgggcaactatggagaatgacagaggatggctgatcagtgccccaagtaacctaggaatgtggactccacagccccaccacatccatggaagccaccagtggcacctgagccccagcagaatgagatgggaggcaaaaagaggcacttctcatcaccaggatgcatttgatttcattagctgccttctgcctcctaggttccttctcttcagcccccagtcttgaaagaagcttcttccccagtgggggaaggaggaggaaggtcccagaggttgcacctcatcccactgatcctacaaactgctggagagtttggagccaacaggcaagaaacactctatgcccactgtaggtatactggaccacagatgtgtagcaagaggaagagagttttaatctcattgattttggaagctttaaagtggactggcctgagttttaacaaccaagtgccccgagagctgttgcatcttctttagatgccattaagggacttgacccaggggattgcaatgccagggctctaagccactgtgccacactgcctcccatgtagggactaaacatcccaaagaagctctgaggccctctgaacctcaatttctttgccgtaagatgggcacaatattagaatcctcttgtctgagtcatcagacaatgtgaagagattaatagaatgctaatcactcaaccaggatttattaaatggcaatgaagtattaatcagccactcttctcgatgctggttattataataatcatggtccatcctaagcacttacaggtgttgactcatttggggtagatgccaatagtattcctattttctagataaaggtaatgagacagagaggttaagtaacctgctgcagttcacacagataggaagcagtgaagctggaattcaaatctagataattgtgtttcgaagtctataaatgtgtcttgttgttattgctattgttatatatatacatgtttttttcttttcttgcttcaaacaaagtcttacactgttgcccaggctggagtgcaatggcacgatctctgctcactgcaacctctgcctcccgggttcaggcaattctcctgcctcagcctccatagcagctgggactacaggcacacaccaccacacttggctaattttttgtacttttagtagagacgggggtttcactatgttggccagactggtctccaactcctgacctcgtgatccacccacctcggcctcccaaagtgctgggattacagggctgagccaccgcacccactctattatatattttaactacctatcctggaaccaaaagccaaatctttgcaacaagaagaggagaagaaagagtgctttttgtagtcttgtcattccactttctgataagcagacaccaacctccaaccctgcccactgtaccaccggggcctgatgtatagtaggtgctcagtaaatatattttgaatgattggataactgagcacctgatttcaagcccccaggacaaacaatgcttctttaagtgcaggtgtttgtaggcgctgcctcagtaacacagctgtggactgaattgtgtcccctactccaggtcatatgttgaagctgtaaccaccaaagggatggtgtttggaaatggggactttggaaggtaattaggttaatttaaggccacgagagtagagcccgatgagacagtatccatacaggaggcagagatatcagagcttccctccctcttccatctgagaacacagaaaaaaggcactcaagccgggcgtggtggctcacccctgtaatcccagcactttgggacgcagaggtgggtagatcgcgaggtcaggagttcaagaccagagtggccaacatgttgaaacctcctctctactaaaaatacaaaaattagctgggcgtggtggcaccagacacctgtaatctcaagtactcaggaggctgaggcaggggaattgcttgatcctgggaggcggagcttgcactcagccgagattgcacctctgcactccagcctggctgacagagcaagactccatctcaaaaaaaaaaaaaaaaaaaaaaaaaaaaggcactcatctgcaagccaggaagagggcccttcccaggagctgagttggctggcactttgatcctgcactaccagcctccagaactgtaagaaataaatgtctgttgtttaaaccacccagcctgtggtattttgttataacagcctgagaagactaatacagacacctagacaaggctgtctcctttactgatgtgttaaacacctggccccttgtacattcatcctatttttttcccaaggaataaaaatagcaaaggaattcggagtcagcccttctctgtcctccagcccttctcctttcagaggaatttcatcactggagcagagcattgaattcattcgagttgcagggaaatgtgatgtatttcttaaatctgtgtcacctggccgtggaatcagcccagccaggctcgaaatgaggcattaactacatccaaagctgtgtgattaacttatttgtttgccgacggagctcaaatgaaaaagcaggaagctgggaggatctgcacgagccccgttttgaagtaggattgtgagaagacccgaagtgtgggttttagttcacattccctgggcttaccattattattacttttaatggaaaataacttttcacaatcttgcttcgttttaaatggagaatgtgcaatattgtctaatttagggtgtggagttgatctggtatgcatgatttttcttcccccgcccgccaccatccttggattctttgtacacattcaatatagttacatttttgcttagaacatatatattttcccccgaacttttctcgattgcttttttatcaggtttacaaatcaaatcaaataggtatattgcagagctctgcgatattattttctgagcttacagtacaatgtattgaattatgccagcccatgctctgccctgctattctctgcagactgagagagggggaccgtggaccctgtaaattcactcggcgcccagcattactggctaaatcaagaccgctcttcagtctgcaagaagagacagagcaagtgttcgttacacaaatcaatttggtccaaagtacttcgcagtgggtactcaaccatcgctcacataatattgtcaacttaatcaaataatgcctcgaagacactcagaagcttttctctctgagaaataacttgattggtggaggatggagcagcagctggctcttcaaagtacactttttatttatcactgtgaagagttttgtgcatggaggggaggaagcctgtaggaaaggaaagaggctgaatagtcagtaggctgactgtggggagaatcatgcagcattcatgtcgtgtcttgggtgctgggtttctacaccgtgatggtgaatttggggatgctcgtggatgaagcagcagctgggcccaaatcattagtttcctggaatgattcaggaaagacttgccgagcgcctactatgtgtcatggtaaggggcttttgatatagtgcatctgatacagtgtttatccacgggacgctcatattctaggaagcatttgatatggtgtttagtcatggggtgctcatattctcgtaagcatttgatagagtgtttatccataggatgcttattctaataagaaaacctgtcagtgagggcttaacagaggtcaacccaggactctagtagttcaaaccacacagctgaagcagcctgcttttgattgctttttaattggttggatgagctagggcctcattcacccacctcactgctctgtttccagcccagacctagaacataggcagttagggtttctgtgaatctttactcctgtctatatgtactttgcagctgctctacgtgcctgctcttagactttccagagcattttcaccttgaccttgaaaggccattcaggagcgaaaagagtttaggatacggaattagatatcctaagttcaaaccttccatctcctggctgtgtgacttcggacagatcgcctaacctctctgagcctcagttttcctagttgttatggcgactcggtaaaataaggcatggaaaacaccagtgagatgcttagctcatggtgggacctcagcacagttttcttttccatcctgtatcccagaccatttagccagtttcacattttgcttataaactacgagtggcattcagcatcagtgatagccggaatcctttgtcttaactcaggataggggagaagcaaaagccttcctcagtgatccttttccacatccaagggtgtctatgtatcctccagggagcttgtgaactttctgaaatcgtatgcaaaatttaggtgtatgtgtattttccccccaaaaggtggtccacagttttcataaaaccttcagtgtatccatgaacaaagaaatcgattaagaaacatgtatttacagagtaaagggaaataccacccaaaaataatggtatcaacaaaagtcacagctgacagctactgctaatggaactgactgcctgagcgacccactctataattaaagctggatatatatatatctccctatatatgtatatccatatatatctccctatatatgtatatccatatatatccctatatatatatccatatatatatccctatataaatatccatatatatatccctatataaatatccatatatatatccctatatatatatccatatatccctatatatatatatccctatatatatatccctatatatccttatatatggccctatatatatatatatatatctccctatatatggccctatatatatatccctatatatggccctatatatatatccctatgtatggccctatatatatatatccctatatatatatccctatgtatggccctatatatatatatccctatgtatggccctatatatatatccctatgtatggccctatatgtatatccctatgtatggccctatatatatatccctatgtatggccctatatgtatatccctatatatggccctatatatatatatccctatatatggccctatatatatatccctttatatggccctatatatatatatatatccctatatatggccctatatatatatatccctatatatggccctatatagatatatatccctatatataatccctatatatatatatccctatatataatccctatatatatccatataaccctatatatatccctctctatatatatccatatgtatacctatatatatccccatatatatacctatatatatccccatatatatacctatatatatccatatatatacctctctatatatgcatatgtatacctatgtatatatatatatccatatatatgtatggatacctaaaattaaagctggatattttttacagtattgcccaagaaaaaacattaaaatgccaaatttatttcatttaaaaatagatgtatttgaaacttagttgactcaataatattcctcatttcaaaggattctattgctactggaaaggggtcctgatccagacaccaagaaagggttctaggatctcacacaaaaagaattcgaggtgaatccatcaagtgaagtaaaaataagtttattagagaagtaaagaaacaaaagaatggctactccataggtagagcagccctgagggctgctggttgcctgtttttatgattatttcttgattatgtattaaacaaggggtggattattcatgagttttctgggaaagggttgggcaattcccagaacttagggttcctccctcttttagaccacatagggtaacctcctgacattgccatggcatttggaaactgttgtggtactggtgggagtgtctcttagcaggctaatgcattgtgattagtgtataatgaacagtgaggatgaccagaggtcactttcgttgccatcttggtttcggtgggatttggctggcttctttacctgttttatcagcaatgtgtttattacctgtatcttgtgctgacctcttatctcatcctgtgacttagattgccttaactggctgggcgcggtggctcatgcctgtaatcccagcactgtgggaggccgaggcaggtggatcatgaggtcaggagatcgagaccatcctggctaacatggtgaaaccccgactctactaaaaatacaaaaaaaattagccgggcatggtggcgggcacttgtagtgccagctacttgggaggctgaggcaggagaatggcgtgaacccgggaggcggagcttacagtgagctgagatcacgccactgcactccagcctgggtgatagagactctgtctcaaaaaaaaaaaaaaaaaaaaaaaagaatcacttaaaactgtctgggaatgcagcccagtaggtctcagcctcattttatccagcccctattcaagatggagttgctttcattctcctgcctctgacaattacggtcattgtcctagggaagactttctttctctactttcctcccttttaaacccattatccgttatcgctttttcttcccccagcacaccatggctctaaaacaggaccgtcccattgacagtgatgaaaatgttctatacctgtgctttctgatgagcgtgcaatagttttcttttgctgtcagatgaccatacacctagtaacttccacaacacaagtatattaggttacagttctggagatcagaagtgtagcatgggaatcaccaggtttacaaggattgtagctggcaggatgatatttctataggctcataatttgatctttccccatgcctttcctggcccctgaaggccactgtcattcttgggctcatggcccctttccccatcttcaaaatcagtaatggtgggttgagtttttctcacggggtgttcactctgacattgggggttctcttccatgccactggcctctgtttcacttctcaggaccctggtgattatacagggcccacacaggtaatccaggataatctattttatggtcatgtgattagcaaccttaattctccattgccatgtaaagtatcctattcaagattccaggtattagaaccttaacatctttaaggggtcattatgttgttttccacagaaagccaccaaccacaggtgtctgttgagcacctgaaatacagctagtgaggccaggtgtggtggctcatgcctgtaatcccaacattttggagaccaaggcagaaggatatcttgagcctaggaagttgggattgcagtgagccttgatcattccagtcttgggaatgggagtgagcgcctctgtctccaaaaaaaacaaaacaaaacaatacagctagtgaacttgatttaacttcaatttgaatgtaagtactgatacttgattgttattagtttgtttgggggatccttcacatgtcattttttcaaaggctaaatataaatcaagtatttccaatgacaattcagtttccatatggagatgtgtaaaatacaagatttcaaagacatcctccaaaaagaaaagaatataaaatatcttttacatgatagcatgttgaaataatatccttaataaattgggttaaaatgaacgttcttaaaattttactttttttttttttttaaaaagtgacttctaagaattctaaaatgacgtatatcacttacattttattttacaagacaggcttctctaaagtccttcaccagcatccttgagctatatctaatgctgtgtgatgagtgcatgtatttttcatttccatcaaatagaatttgctacagttcttattttatttctaattatcccctctcccctactgagcacagaacttcaacatctctaatttctgtctgtattctgatttctactgacaacttcatggtggtatcatctaccacattttactcaaccgaaactggatgagtaaggactgccaccagtaccctggacccacagacaaccctgagatagaagtcatttatctacgcttgcagctaggctcagaaggatgtacatagctggactagtgatgaaactagagttttattgcagagctacctagccataaatattccttccctgaatgtacattagctcaaccattgtggaaaacagtgtggtgattcctcaaatacctggaaccagaaataccattttacctggcaatccaatttctgggtatataccaaaggaatataaatcattctgttacagacacacatacacatgtatgttcactgcagcactattcacaatagcaaagacatggaatcaactcaaatgcccatcaatgatagattaaagaaaatgtggtacatatacaccgtgaaatactatgtagccatgaaagggaagaagattatgttctttgcaaggacagtggatggagctggaagctttatactcagcaaactgatgcaggaacagaaaaccgaacactgcatgttctcactcataagtgggagcaggacagtgagaacacatggacacagggaggggaacaacacacactgggggaaggggcgaagggagagcatcaggataaatagctaatgcatgcggggcttattacttaggtgatgggtgcagcaaatcaccatggcacacgtttacttatgtaacaaacctgcacatgtactccagaacttaaggaagaaaaaaaaatccttccctgtgcttctgtacccacttacctggtcatcactagaagatgccacgcaggtggcctcagtcttgtctccctagggtcagacagaggaaaccccaggagggggacagaatccaaaaggcatgtatctctacacgactatgcattttctctccaacagtcatccctggattggtcgatatcaaaatccaatttcaccaggattagtctcgggttgctcagagctattcattgaattaggaacgattatagcagagggagccccgtggttctttattaaggtctttgtggaagcactaagtgatcttcaggagattaaagtgccagtggtgttttcttaacatttataacctgcgccgatacctggggagtttgtgtattaagaaaaattctgccgcacagatcccgcctcctaataaggccttcacactgggcccgggtagaagctggcattgtggtcctaatgagcttatcagggaagctctgccaagtgccgcctggaaacccacctcttggggttaatggacttcccatctgtgtagggtcctgcagcctttcctgtttgatggggaggctgcgtctcagagttgtgcatggcctgagaaataaaacaaaagctaggcccggcgccgtggctcaggcctgtaatcccagcactttgggaggccaaggcaggtggatcacctgaggtcaggagtttgagaccagcctggccaacatgatgaaaccctgtctctattcaatctaaaaattagctgggcttggtggcacatgcctgtagtcccagctactggggaggctgaggcaggaga[145 bp omitted]tctttatacaagggacttaaccattcacaaagacttggatgtaatttcactctaaagcatccaggacaagtatacatttatcattttatgtatatgcaaatggagatccagagacatgaagtgagcagacttgcaggtcgctcatggtaaggcttagtcatttacgctgcagatatttactgagaacttaccacggactccaggtcagcagtttcaagtggtacagttttgcctcccaggagacatttgaatcccaggagatattttttgttccaactcacgggtaggcgactggcatgtggtgggtggaggccagtgatgctgttgaacattctgcagtgcacaggatgatccacccatcaaaaataataataggctgggcgcggtggctcacgcctgtaatcccagcactttgggaggctgaggcgggcggatcacgaggtcaggagatcgagaccatcctggctaacgcggtgaaaccctgtctctactaaaaatacaaaaaattagctgggcgtagtggctggcgcctgtagtcacagctactcgggaggctgaggcaggagaatggcgtgaacccaggaggcagagcttgcagtgagccaagatggagccactgcactccagcctgggcaacagagtgagagtctctctcaaatgaataaataaataaataaataaaatgaaccagccccaaatgtcaatggtactgacattgaggaaccgtactatagtggtagagggtttcagtgaacagaaaagccacagtctctgctctcctcgagttacatcctggtagaaaagataggcaatatacaaaatcacagaataaaataataaaaaggcaagaagagatgtatgctgtgaagaaatcagtggtcaaggggagagagagtgctggtgcagagttgctgtagatcatagggccagtgaaggtttctccaatgggtgacacctgggcagagattgtatcggcaagagggcaagctacaggtggtgtcccagggaaagagtcttccaggcaaagggcagaatgaatgcaaagaccaaagatggggtcaggaaaagcaaagaggccaacaagcgacaatgggagacaggcagcaggcaaagtgggaggcagtcacagccgagaacactgaaccttatagacctagagagccaatgacgatccaggttggagaccactgagaagggggtgtccctggccactttcccgtccacctctaacatccttactttactgactgccctcaatttcctccattctctgaattttctgcatggctatgtcctaccttctgatctcccaaatatggtaatgtccattcaggtaggtctcactttagagccaaacataacttttatggccaggcacagtggctcaagcctgtaatcccagcactttgggaggccaaggcaggccgatcacttgaggttaggagtttgaggccagcctggccaacattgtgaaaccctgtctctagtaaaaatacaaaaatgagccaggcacagtggcacacacctataaatcccagctactcgggaggttgaggcaggaaaattgcttgaacccgggaggcagaggttgcagtgaggtaagattgtgccactagactccagcctgggcaacagaacaagactctgtctcaaaaaaaaaaagaggtcaaataaatcaggagttctctcagagattacttcccactaagctttgatgtgctacagctttaggaactataactatgaattccgtagccactgcccttcaggaatgtgcattctagatggtttgtcctattagcaagtttcctagctttttcacattttcttttccttaggaattacacactatgcttttgtcataacgttcagcaagcttctcagggatgctataatgacttctcaagttgaatgaggcacactagtaggtactgggaacatacaggcagcatgtctgtccttgagtgttgatggcctttcaagaggctgatgaaaggctttccagccaggcgtcattgcatccagggccatgatcgaaggccactggggagagtgggctggagagaggaagacttaagtgttctctttggagagtctcattgaagtgacacctgtatcagggttctctagagggaaagaactaataaaatagatgtttatgtaaaggggaatttattaaggagtattgactcacacgatcacaaggtgaagtcccacaataggccctctgtaagctgaggagcaaggaagtcaggctgggtcccaaaacctcaaaagtagggaagccaacagtacagccttcagtctgtggtcgaaggtccaagagtccaaaagctgaagaacttggagtcccatgttcgagggcaggaagcatccagcatgggggagagttgtaggctggaagactcagccagtctagtctttgcatgttcctttgcctacttttatcctaggcgtgttggcaggtgatcagatggggcccacccagattgagggtgggttggccagtccactgacttgaatgtttatctcctttggcagcacactaacagacacacccaggaccaatactttgcatccttcaatccaatcaagttgacactcagtgttaaccgtcacaactcctattgacagatgacagcctgacaggaacattcattcctccttctcctagacctgctttgaggccactcatcttgagaacttcgtgctgcctgaagtggtggaggacgcattgcctcctggataacagctgcttgtttgtactgcatacacctttgctttatatgtttggtggagagatgtagtagagggaatggtgacctccaaaaaatatgtccttgtcttccataaatgtgatcttatttggggggggctgtgggggaggaggtctttgcagatgtaactaaggatca[143 bp omitted]ctcctgcctcaccctcccaagtagctgggattacaggtgcgcgctaccccacctggctaatttttgcacttttagtagagacggggtttcaccatgttggtcaggctggtcttgaactccttacctcatgatctgccccgctcagcctcccaaagtgctgggattataggtgtaagccaccgcacccgaccctagtatcgttttaagaagaaaaaggaagagggaaattggagtttcacccccgcagagggaagtagggactgtggacattgaagcagaggatggaaggatgcagacccaagccaaggaacacctgcagccaacaaaagctaaatgaggcaaggcatgattcctccctagagcctctagaggaagtgtggccctcctggcaccttgattttagatttctgtcctctacaactacaggagaatgaagtccagtggctttaagccgccagctttatggtcctctttcaggaaacgaatatagagacataaaacgctggctggttctaaatatgttttccccggaaggtcccagaaaaaagagaaagaaaagagatcacactcagtggagggctttgtgatgatctctaaccccaacatgcgttaggctctgaggtagctgctctgtcatctcctgctgcatttcatccttcccactatcctgtgagcttagtaccattagtgtcctttttgtttttgttttagaggcagagtcttgctccattgcccaggctggagtgcagtggcatgatcttccctcactgcagccttgatctcctgggctccagccatctcccacctcggtctcccaagtagctgggatggcaggcacatggccatgatcagctattttttttttttttaatttatttagtggagacagggtctcactatgttgcaggctggtgtcaaatgatcctcccaccttagcctgccaaagtgctgggattacaggcatgagccactgcacctagccccattaccccattaatgtcctttgatggaaaagtaaagtgaaggtcagagaagaaaagtgacctgcctaagattagcaaataacagggatggtctgtgtgattccaaaaccctggttcattgtgctgcatcccaccatataaaaggcatgcaggctgaaagagatttcctttttctgttgttttattcactcctcaacctctacttcctaacactcttctttttccctttccatacacccacaatgacctgaaacacttttggcttacttttttattttgcatgctttaaggattctttttaatacacaggtatttctccataacagtttatacgcatttgtatataagcatacactacaaaatgattaattgagcgttgtatgtttttatcaaaggaaacaatgcaaagatttctccaaagtgctgtttgactagagatgattaattttaattttcacatgagcggtataatgctattaatcatttaatatgtttaatcataatctctgtaattcctaattaggttcattaaactgaaacatccagcagttatacacaaatccaaatctatgtttccttctcaggataagaaggagctcattttgtttttgcattgaaacgggaacttctaacaggatggaagagaatggactggaagcttagggtttcagctacagcatctgtaaactccgagtctgggtgtagagtactaaaaccccttaacttctgaaaagtgacagttgcaggattcgagctcatttctgtgtcatggacgtggcaccaaacctcgtattctcagcggagaaaacgcaaattctgctctgtttgggtttcagtgttacagtgttgctcttcgactatcacatgaaggcggcgacattgattgtacacttcttcatgcatttgtttattcgtgtactaataattcattcggtcagtgagtgagccaactgttaaacagacatttatcatttgtgttacaagctggtcataccacactcctgctgtgacccttaggtggctccttattgctcttaggatgaagctcagactcttgctttgcacagtgtcctttgatctagccccttgactatctttgaaacctgtcctcctgccttcccttcatacatgcctcatctgaccagtggtgctggagtccacacatactctcctgaatccaagacatcatttcacatctctgcacatctgcacatgcactgccctgtcttggaatagcctcagtccttttcacctcttctcttagacatctcccacttaacgtttaacctccagaattggcaagcctggctgaacctccagcagtgtcatatgaccttgatttaaggttactcagccctttgtgattgcctcttatcccaacatttaccagtctctggggatggtggctcacgcctgtagtcccagtgctttgggaggcagaggcagaggcaggaggatcacttgaggccagaggttcaagaccagcctgggcaacttagtgtgacccaggctctgcaaataaaaattagctgggtataatggctcatgcctgtaatcctagctacttggaaggctgatgtggcaagattgagcccaggatttcaaggcttcagtgagccgtgattgtgccatggcattccagcctgagtgacagagcaagacccaactccaagaaaacaacaacaaaagacaatgacaaaatgattctatttatgattgtttttctctattggtgtcatgcactaaagttggaattgcatgtgacaaggagggctgatttatgtgtccaacacaaagcagttgctcagtaaagatgtgtaaacactttaaaaataagcaaatgaaaacctttccttcgtgtttctcaaaggaggtttatttctctttttggtatttaaaaaacttgccatcattctaaacatttcgtcactttccatttattgaatacataccaggaacttggccaagttagcacacattaatcaatcacaaagcctcaaaaggtatgaactcattattctttatttaccagttaagaaaatgaccactgtactgcttcctattcaatccaacagtataggcaaaatgactaaatacattgtctaaatacatgacttgcacttaaaagctgaagtcaactggtaggtcttttgataccagagcatcttggaagaatggtttgccagctaacaagatgtctttatttcaaaatgcgattcagggtgtgttaggaaggaaaatgcaaatgaaaccttccagtacataccagggctgatgagaaacttgctaattatgcccatgttatctgagtgtttgttttgtatttcactttgtaagattgtcttctctcggtcgttattattttacacctggctgcctacattgatagttttgtcccaattatgtacttctagattgcttataaacaggtcaggatgattcctcactcataaatttgataggcttctgtgtaagctttctatcatagtttcaaagttggtatctgatgtggatggcatttactgccagctggaggcaatagttgctaattgcagagaagtatcaaatgctaaatgtctgaaatgttaaaactctagaaccgagagtatggcagtggctataatgatacctaatgtgactgtgacttttcccctcgttcctgccaaatatgtgggtgtcaatgtaacgtcatgttatacagccttatttggaagacaggggaggtgaaacaatcagttatgctgatgatgttacatggtctaggcaaacagagcacaacagcactttctgcagagatggaaacgttctgtatttgcattattcagtatggaagcaataactacatgtggttcttgagcgcttgaaatgcagctaatgcaaacaaagttaaatatcttgttttaattcagttaaatgtaaattgtcacatgtggtcaactgtagtggacagcaaaagtttgtacaattagaacctcaaaagaataagtcaatcagctggttatttgaactccagaatgccaactagtcttttcacattttttacatttaattatgttttatctgcacaattacctgaacaattatgtaggcatatcttcagattctgaacagcgtcggttaagaaatacacactgtcctgcctttaaagattattacccccttcttgatgaggttctcgctccccacctcccaaccccagcagctcccagtccccttcctttgctttttctagcctatagtgcttttctctgtctgccaacactctatctatggatttattgtctgtgttgccctcatgagaatgatgctccctgagggcagggatttttgtctgcttttcccactgcctaatcccagattcataatgagcacccagtggacgctcagaaaacacttgctgaatgaatgcatgcatgcatgcgtcagcattttcttcccttctcagattgcttagttctgatcttttcctgccactcatggcaagcaaaagagcatcggaagagagcactgtggtccactgagaacctcttcggtttcttcttgttcttttagcagacagatgacgcagcaccgacggatggccagccccagacacaaccttctgaaaacacggaaaacaagtctcagcccaagcggctgcatgtctccaatatccccttcaggttccgggatccggacctcagacaaatgtttggtgtaagtatcacctttcttcccagcagtgcccgctctgggggttccagagacctccctgtctcatgtaagtttggggtatttacaatactaaggttagatgtttgtatggggagaaacaatttagagcctagtctgcaggtatattgtggctagaatctctttatggttttagcatgtatttctgtacatatgctcaccatgtatctactttaccaagtggctttcttctaagaagtaacttgtaggccaaatggaacacaaattcctagatgacccactgttgaaggaagcctattgatggtcctaaatccaatggcccaggacatcatactgcagcaaaaatacacatcgagtcctcttggttttgctttcttttacagttgtcaaatgatccagagggtgactcttagtgtatccctgcattgcctagtctttcccaggcactgtgcatttagatttcagatgcatcagcagagaacaactacttctgcataaagctgattttagcaaacaaaacaaaaccaccaccaccgacaccaaatgagctaccagtttctaagtccatgttgattcctgaagtctacgttcttctgaaatcagtgaaaaggattcagaggtacttactgtggtgctatatgccatgaagtgtagccttgcccaggcaccatggtgaaacacagagcaggccacaagtcaccactgacccaggagaaaataatagcattgctttttttataggtcatcttgcccctgattatttttttctcgaagatatcttcactatccactttgggaagacatgagtttgccatttctttgaccagtgttccaccaaaggacaaagctgtgacagggcttggatatcattcatgtttgcagatgtagccaatttgcccatgacatcccagcaatgatagcaggtgcctctggattcaatgaaaagaactacatccttaacatttgacttagagcaatggtgggcttctcagagactcttcctctaagagttaataaatggatgcaaatatcacaaaaggaacaagaagatgcccaacttgaatgcctcattcctagccaagttggtggtgtctccatataaaatgggaggctcttgttcactactcaaaggcactgtgtgttggggattagcttgcaccttttacttcttatacacacgtgatgcttatcaagtatgcatctgacacaaaagcagagcgagcatcctaatattgaagatacccagctttgaatgctgacatttcagaggaaaaggtcagctcttgcacttttatctctctcatttggtaataaccttgagttgagccttccaactcctgcagaacagagataccctcgggcactttcaggtcaaagatgactttgaaaagtgcagagcattcaaagtgagagtcgaggttaagtgtgtgtgaggcagtaagaccaggtgtgaatgatgggcggtaagaggagttatattctctttgccgtgtcaggttaggaagacatcttgctatgcagtctatttttttctcatcaagtgtcactgtgatgttggctttcaatgtgatccccttaatgaccgtcctgacactctttcatggtgtcactcagttatcgtgaaagttactgcaggctacaatgctaagtcatagaggtattcaaaatattcacaggaatcagagaagggatcctgagtctctctagtcttacagaggtagggtagacggcaaggagcaagatcttgccaaaaaattgtactaccggtcatcagaccttgatccaaatctactagtttcagggctcttgtttttaaaaagacaagttctcactctgctacccaggctagagtgcagtggtgtgatcacggctcactgcaaattcttgggctcaagggatcctcccacctcagcctcccaagtagctgggactacaggcacaagccaccatgcttggctaatttttaagtatttttttttaatagagatggggtctcaatttgttgtccaggctgctcacaaattcctggcctcaagcaaccctcccgccttggcctcccaatgtgctgggattacagcataagatgtgagctattgcacccatccagcacccccccccccccttttttttgtgacaaagtcttagtctgtcacccagactgcagtgaagtggcatgatctcggctcattgcaacctttctcctgggttcaagcgattcttgtgcctcagcttcctgactagctgggactacatgcattcaccacttcactttaaagtcaagattttcaagcaactgacaagatgtcaatttggcaagatgatagatacacttaatacctgtcaattaagagaacacaccatgcatttagtgcacaaactcaaccttgttcatcacaaatagcatctgtgtccctttttttaaaagtatgcaagatttatttgtttctgtaaattttgtctataaaagtgccaggaacatacagattcatagacccccttgcaatgactttcaagcctccttagtttacaaccactattctaaagaaatgcagttttatgcactaaaaatctgttctttcctgccaaacaccggtggtcatggagccgttcttgttataggatacatttagtggcaggaatcacattgtgaagcatctgtaaacattctcattggctccctgcactggagcttagggaatttaggagggtttcctcttttgggtcatagttactgcaagaaactacagtttaactccaattcggtacttctcacgttatttggacatgagacatcttctttccttttggtgctctatcctgtctttgtcttcccactttgacaggggtttacagtgaggacaattacagagaaaaacagtcacaaagatctttgtgcttttccccccctttgtctcttgttaaatataggcatgggatttcaaagtcaaaagcaaaacaagacaaaaaagcaacctccttcttcaaactgcctaaaacttggcagtgatcattacaacgtctgtaaccactaataattcgaccataccatctgcaaccgttacatgcctaatggttactgcagatgactcattttatttctaatttgtatcttcagcacatcatgaagattggaatcctgattaccttttccaccttgtgcttcatattctttactttctactcattggaagcatttgttcccatgtttggcattaaatcttctagctcatctttttttttttttttttctcatttgagatggaacattccttgggcaagatatatggctacagtatacaaagcagaagccatcgtcttttaaaaataccggttgaggttcaagggaatggatctgttctgtgcagtggcattgatattaaatggttcattggaagggatgttagttttataggtggctactttttccttgagctttgtcttcacgttaggtatcatgcatgagcatgcattttctttacagataaatgtttgatgatcccaaaagaggaatatatggatttctaacaaattaattgcgatatattgcaccctaaatagaatgtttaacttaatatttaacatttaaacattctgggtttgaagtgagacaagtggattgtgatatatccagacttctgctacaacagatggatggatgttctggatgccttcacggaattgtcagaaacagttgctcaatgactacagttctcaaatttacacaacacccttgttgattccacagccttactttaggggtcaaaatacagaccctcttggccaggcatgatggtggcttatacctgtaatcccagcactttgggaggccgaggtgggagggttgcttgagttcaagaattttagaccagcctgcgcaacatagggagacccagtttctacaacaataaaatcaaaaaaaaccacaccaaaacaaaatataggtcctctgggcaggaaaatggtccactaaacctctctttattgtcacaaaaaaacagatcacatgactttcagcacatgcaaaggaagatttcaagatcactttttagtcacgagacgggcttgcctgtacttatgacgttaatggaaagttccatctaccatgatgttgtgagtgaagtcattatggggagacagggcatggtaccttctacttctgcattctgaacaggaagctgacactaagaaaaactgggatgatgcctttctttggccttcacgcacaatctttgaactaacctttacttttacgttttatgctgtatccattgaacatccctcacagtttttcagagaaatattgtttgatctgagaacatctaaaaatgcttggtaggtatttgccaaagtgtgtgtgcctgtaagcttctagatcttgtttgttttgttttttaagatagagtctcgctctgtcacccaggctggagtgcaatggcacaatcttggttcactgcaacctccacctcccaggttcaagtgattctcctgcctcagcatcccaagtaactgggattacaggctcctaccaccatgactgggtaatttttacatttttagtagagacagggtttcaccaagttggccatcctggtcccaaactccccaccttgtgatctgcccgcctcagcctcccacagtgctgggattacaggcatgagccaccatgcctggcctggatcctgctcttgatacagctattgagaaactttgtgtggatttgaggcgttgttgaatgcagctgaacattgatgttgagcaaacaaatgctagttatgtctgcgaatgagtcgtgtctatttaaattgaaaatgtgccagctgtgtttacatcattagtagcgaacttcccaattaaactgttgatactataaatatagtacacaactgtcttggaaatggggcttacatcagcattcttctttgggcttgtttcaccggctttgagaaccgtcaacctaacagcaactgccacagaagcaaactttgagaccacttcagggcagctgatgtcattgtttcatttagggaatgacacctgccaagattgctgtttgattggttctgtctcaatcagatcttattttaaaggaaatgtttttgggttgactgcctagagaatgttccatagatgacagttgcatcgcggttttggaagaagtccttttcaagcttctctttctgtaaatatatgtgcttctaggctcttatgcctgaaataaatatgatagcgtctgtggagactgaatattcaagggtggttggtatcaaaattactgcttgaggagttcacaaaactggaggtttctttactatgaaattcagctcacgtttgaatggcaaatccttcatttccccaatctgaatgttttcttctatttccagtgatttttctctgcctaaaactagggcactgaaaatgctctgtaaaggaatattctcttgaccaaaagatctaagtccacagattgcaggatgagtaagctgcacgtttgttggcgtttccattgtgcatgcaagcaatgtgacccctttccatgttctcttctgagtattttctctttggtttcttcctatcctttgcttctctgaacagaagtgctggtagttctttgtttcacaacttgaaatatgtgcgtctgtgattcccccggctgtatagtgtatgggtcctgaggaacgggcacatttctatggcacagaatgacaaacttttggttactttgtcccatagtcagaactatttttatttcaagattgggctgtctgtattcaagtggcatatacatttgtttctactgtttctgggagggtggatttctttgtccattccagaggatagctatctgtatgttctaaataatttgtttcttgaatgttagtaggaccctcttgacattcactctctgtgtctctggatactctatgactgaaacacatagtcaggcaaacctcccctgcttcttgtgtggtctttttgtttgttccttttttatcctgccccacccctcaccccagtcgctctgtccgctgccacacagaagcacgcgtaatgctctccactcaagggagagatggaatacaaaacctctgggggtcataaaggatgcaattaaaatccagaatgcagaagtgaatggaatgataggaaagctcaaaacaaaacaaaaaaagaggatggaaatatttatgttgccctgtttaatttttaatcactcaaagagcatttgctctcattctgcatggagataaaattcccattttatttttccctgggccacagtacatgattttacattaccctctctctcagttgctcgtacttatgcaggttaggctactgtactcaagaaatggccacaatacttcatgtgatctcagaaaactgaaaaaattccaaggttgggggaaaggatttcagatgatccgatgcccctagttctagagcccatacttcctgttttgaaacgtgatcaagaattgcttgatgtacatttctcactgggacttccagatttcacaaatttaaaaaatatgtaagacacagtcgttgaatttgaagttcaaataaaccacaagtattaagtataagtatgtcccaaatgttgtgtgtgacatatcctgaaaaatctgaaatttaaatttaaccaagtgtctgcattttatttgtctctatttataatctgagtctctgtttctggacttttcatagagcctattcatgctagttgtctaaaatctatttgtttaacaatgtggagaattatcttgagagaatttcagcccaagcactgatcacaactgctgataccatcatgatgatagtgcctagatagtggagtttgcttctgtgtttgtactttcttgctcatatgatagagctgctcctagattttatgtgagctaggagccaaccccagtcacatcacattctcactggacattgattatcaaaatcacatttcatcaagggtgtttctcccagtgtttagtgggatagaccagaaggatcattgtatgtacatactagccacttttaatctttgctgctcagtgcctgggaaagcagacatgcacacaggaaaaaaagaaaaatagaattaacctcttgattaatattttgtatcaagccttgccggtatattccataataaggagaaaatatgggtggttttattttctcttgtttcaagcacattaaccataaaacataaaatgtgtatccttggtattaaaagagaaaaaaatggacgtgggaaacaattactactgtacatagtaatgtctactgcatttctcttcttgcttataagatatttctatttctttgcagcaatttggtaaaatcttagatgttgaaattatttttaatgagcgaggctcaaaggtaagcaacttaattcactttagaattgtttagtttatttttaaatgtttgttatgaataaggggaaacaactgcactgtcttaatcagctcattgtgaaaatacacttcagtgggaattcctttagagaccaccttccgttttcaaaatggtgggaaagacatcgggttcagtttaaaatgtataaggggataattttaaattgctgttttatatatatatcaagtttccagaggaaaattatacatgcttaaaaaaataatgatgttgctacatttttgtttttcagtgataattatgttctttatattaaaaagtgagttgatagtctcatgagcaggtaaatatgtgattattctgtattaataaagtgcagttattttcctgggttgtaggggagaaaaatctcatatacaccaaccttttgaatgtaattttattctttagtatgtttaccgatccacatttagcaatttgccattgctttgagtttgttttttcaaggaaaccaatttttaaatagattccctagtgctaataaaagtcaggggctctatggagaggtttgggttcaggagaggttctgtttcaaaacagaaatatgggctgggtgcagtggctcacgcctgtaatcccagcactttgaggtgggtggatcacctgaggtcaggagctcaagagcaacctgggcaacatggtggaacctcgtctttactaaaaatacaaaaattagctgggtgtggtggcatgtgcctgtaattccagctactcgggaggctgaggcaggagaatcgcttgcacccaggaggtagtagttgcagtgagctgagattgcaccactgcaccacagcctcggtgaacagagcaagatcctatctcaaaaataagcaaataaacaaaagaaatatgttgggagaagagaaaaacagaaacatttctaaaacctcctctctatcagtggctaaccaagggtggtcccagaccaggaatatcagcatcacctaggaactgattagaaatgcaagttctcaggctccagccctgatctgttgaattcaaaactcccaagttagggctcagcaacctgtgttttagctccactgaggaaaacaacacatgaggcctataagcagacacagggggttaacagggagaatgatggagaacaaagatgtggatcttggtaaccagaaagtgaatgctttcaatagctctgacgggtctcctggctgccagtccccaggctattaggaattttaagttcccttctccttgcatcctcagactatgaatgcaaatgttgagagatagtgatttcagcccattgactctccttacacaggcgatttgaggcaagtcggtatcacggagggtcagtaagcggtgctggttttatttgaagtgtcacaggccacattgccagctcttttggatgtgtataaccatctttcccccataaaacaaacctttgatttttttttctttattccttggacagccttcctccctcctaagtaaatttagtactaattaactaggatgatgttgatcatatcaaggaaagaaaaccccagtattttctcctccatggccagagtgatgttgtaatctgtcagatgagcaaaaacaaaagcaaaacagaatcccttacactttgtgataatactccttcagggaccttgtcatttttccatagctccagatattttacaatcgttctcgaacttaagtctcttcctgcttcttgtaggaaagttattacggggactattgctatacctgcaaagcaaagtgcattgagagaaaaatgtgcccagcctaattctgttcactcgagccttctgtattcttggcgaaattgtagatgacccgaatgttgaccaacttcgttctgaccctaggtctgtctatagcagcactgccttcaaagatgtgttgttgttgttgttttttaatatgtttaatttatattttgttttgtaacttttgccagttacaatgaagaaagctgtttaattccttctgagagctgttttgggacattagaagaatatcatttgccattttgaaagtacaatggtgatactgtttttaagacatcttccgtcattcccatgattagcctgtctctgggggcttcaggaaaaagaccatttaagtttgctgcatccagagcctgactttgtgaagctgcctttttttggtctttattcttttggtttaggaaacatccaaaatagcctctctcggtgggtatgcgccctctgaaagagcttgtcttgcaggtgttggagctgactgtttaggtactgctggaatggcactgagacagtccagttgggactgctaaatgggggcagcagctcacacagggatatttttcatagttgacattatcctttatgggaaagggccttatttagaggagcatttccattttaatggttcagaaacctgaactgttgctatggcctcattttcatcgtttggtgctggacagacagccaggaaatgagtgggcccttacgagccaggaactcaccttcttgcctttcattctctagagcagttcttcaggcaggccactcaatgctgaaggctgtgtgtgctgggtgtgtgtgtgtgtgtgtgtgtgtgtgtgtgtgtgtgtgtatgcggacatataaacccatatgtacttaagggatggacgcagtgtctcatacctaacattctagccctttaggaagctgaggtgggagtattgtatgaagccaggagttcaagaccagcctggacaacagtgagaccccatctccacaaaataataatttaaaattagctgggcatggtgatatacacctgtagtccaagctacttgggaggctgaggcaggaggattgcttgatcccaggaggtcaaggctttactgagctatgattgcaccactgcattccagcttgggtgacagagtgagtccttatctcagaacaagtatctatattactttggaatatagatccagtatctatattccaggtagtatctatattattttggaaatgtatataactcaagtatttaatgtatgggtgaatagcaagaatgcagaaaatccacattttaaagagatgtcagagagaaaatgagaattcgtaagcatttaggggcgaatgatcctgtaatttatttttcctttttacgagatttacccaaccatctcgtttacctctgatatggtctatttaagggctgtatgcagatatagctactccctacgtatatacttaagatatctggccgtgtgcggtggctcactcttgtaatcccagcactttgggaggccgaggcaggcggatcacctgaggtcaggagttcgagaccagcctgaccaacatggagaaaccttgtcttgactaaaaatacaaaattagcagggtgtggtggtgcatgcctgtaatcccagctactcgggaggctgaggcaggagaatcacttgaacccggggggtggagattgcagtgagccgagatcaagacattgcattccagcctgggcaagaagagggaagttctgtctctaagaaaaaaaaaaaaaaaaaaaaagctacactttgatctttgattcagtagatatcagtaagtatttgctgcatttcatgagagccaaccatgagtaagacagaagtacttcctgtcctcctgggctttcctgagtagcaggagagatggactaggaagatgagtgactgcagtagcctgtgctgttctgcggtgatgggagaggccactgagagtccggacaggcaggctgatattgtgagaaggcttctggaaagaaggaacatttaagctgagagtgagagttgcgtaagaatttcccagggaggggaaagagggatgtgtctcaggcaggagaagttgcatgtgcaaagatcactggagtaaaagtgagatgagagggctcatagtcccatcggaaaatgaatcttcagatgctcatcaacagctcccctcttctaaatatgaattctctgcaccagaaactagaggactggatttttcatctaggatgaaaaatcagtaccttcatccatccagggtgctttatttaagtctttaacatataaaatggtgtatttgcatgaatgcaaaaaaggaagatatcacctaaaaatacaaaagatgaaaaaagaacaataactaggatacaagaggatcagaatgtatgatttgcgaaaatattttaaagtaagcaagtcacgttggtctggcaatcctcttaaggtccccgttatctgccctactgattatacctgctcatgacagggcacaggccaccaatctcttttcttcagtagcattaaaggtaaactctgggaaggtgtgtctctgactccccttctctgtaccccttcttgcggtcttgattttttaagcagttacacatcagcatcacacccagccctttgccgagcaagccaagctcagaatgtgcttgttttgttctcctttttaaggcagaggtaaaaatattcatcatctttttaaaaactgcaaattgctgcttccctgagttagaattccgaccatgaggcgggtcagaaaaaacaaccttagcacccgctctcaaggttgcctggcacctgtgcatcgtggcaaaggttccctgctcatagagaggaccaggtgaggtctttctggttacattgcaaccctcaggtgagaattttgataacctgataacccagggaggccatgccacttcttgtctgggtgggaggtagaattgcccaacggaacaggtaggaaagtctgtctggcattttgaggaccgtctggagcacattctttctgcaccgaactttgtcaaatctcaactctaaatgaggaataccaagtagctgacaagcaaagagagaaagaagtttcgcagaaaaacaatgagaataataaaaaagaatgtattctctttgcttaaaaagtgagaacttgagaatagatgaggctatttcctttttagttcatgccccttccttgggattcaaaatgtatttctctttccacctttgtctttcctaaacatacttaatgctgatttcggggcagtaggtttgccttgggttcagacatgaagcatgagagcaaggttctggagtataatgttggacaggagggtgagtgttcagtctcacctggctgtgttcttcccagtgctgtggtaataatgactgctagttccaaagggcagaaatgataccacctggccctccagctataccagtggggctatggattttcttttcttgccgggagagaatataaatccaaagccctcgtttctctgattctttttggaatatgtggcatggctatggttgctaggaagttaggcccatcagggaggaagagaacgttgccaagaagcctgggacatgtgcttttggctgtacctctacatgtaagctccaagtaactgagtcaaaatctatagccaaaaatctatagatatcagcaatataaaattctatttattacaaaggatgaaaacctctttttcagatagggtgtcacccaggctggagtacaggggtacaatcacagctcactgtagcctcaacctcctgggctcaagcaatgaatgctcccacctcagcctcccaagtagcagagacaataggtacaggctgtcacacctggctttttttttttttttggtagaggtgaggttttgccatgttactcagcctggtctcaaactcctgggctcaagtgatcctcctgccttggcctcccaaactgcttgcattacaggtgtgagccaccatgcctggcccaaaaccttcttttgatggtttcgatcacacgtagtgaaatgagaggtcatggaaatcaaatcactgggccacacattttaagcaaacacatttctggactccagtctgggattctaatccagtggatacaaagcaaggctcaggaatcttaatgtttaatgtcctcccaagttccttctgatatgcggctaagtttgagatatactggccaagagttagaactgtcaaatagagcaaaatccccctaaattctctcttttttccctttgaagaacaatcatttccaaactatacagttggcgagtgtatttgcatacccaatatgggcatactttgtgcacaagactaagcaagacccttctgttatggagcaaataatcttaaatgaatcagataattcaggcttatcctaatcacagagcctcactatgggaaagattatggaaggtaatttggttcaatcccctaaagtaaagaaacgttatttttctcgatacagttcacccttgaacaacacaggtttgaactgtgcaggtccacttacatgtgaattttttttttttccaaccaaaggcagtattcccaggatgtgtggcctgtatatatagagggctgattttcttctatactcacattccacggggtgactgtgggacttggaaatgcaaggatttgggtatcaggggtggggatgtcttggaactaatctgtagtggattctgaggtacagctgtctatagaatcccgacaaataatcatctaccctcacttgaatacatccacatcccctgtcttctgtggctgatgagcctattccgactgttgaaaagttccgttagccagcccattgcacaatactttttttgttgttttattatactttaagttctagggtacaggtgcacactgtgcaggtttgttacataggtatacgtgtgccatattggtttgctgcacccatcaactagtcatttacattaggtatttctcctaacgctatccctcccccagccccccaccccgtgacaggccctggtgtgtgatgttccccgccctgtggtcaatacctctttagccttaaatttggaggtgattatagagaactaatgtaggactgggagttatcaccagttggttataactaccatgtatttgtaattattgtgcatttctttagtaaaactaagtattatactgtcccaactcaacttggagccaacaaggattatttgatgctaagaggagccccaacatattgcatgatttcacccagtttacagtgaaaaatctgaaagagctgggtaaatttatgtggaaattgttcgaaaggttggtgtatatttctgaacaagatgtacaaatatttttaggggctttaaaaataatgtgtcgtattttctgtacttaggaacaatgtcagtgaagacaaaatacggattttgacaatatagtttagtggggttgatttttgaggctgaaatattaaaagccaatgtacctgtggtaaattaaaaggtatatatgttatctatcagtaaaagaggaagtggccagaatattattacaaattacattctattaacaaagtttctttgctacctgttgatatgaaaaataaatattgacctaatgccagaactttacaatatgggtacacctttccctttctggttaacaaagtaggatggaaggttgtcaaattcaaaagcgtgtatgcaatttgaagagtggggaaagtatgagcacaaacattgaattgtttgtattattaatcaactgaagtttatttctgttcatttcatgtgacttttttgtttattagaccaaagagtttaagatttattataaaaaaggtctttccttttttaggcttttaagttttatttttgagaagtaaaggctgtagaactgacaaatttgaataaccctaaaactgcatgaagaagagatgttcttaaaaccacacggcatgactctgtaggcaatgttagaggattttggcattcattgttgaatttcgtgcacacgttttattttattttatttttaatttgcatgtcaaaaaagtggttcccttttcttttcctcattatttcattttattctctgtgaagacactgtaaatttattttgatctcattttcttttcgttagatttattttcttctgtagtgacatttagaaaggtatttttggtatccttctttgaatacttcaggggttacagctaactggtgacagaaaaaaatatcttgttcacatttgtcgcttaattattgcacatctcagtactcttataatttctctaatttgcatgttacagaactgaagccaggacaagaaatagaaattaaagcgagagaacattaccaagtggtcgttgactgaaataataatctgcatgttgttttcccttctccctcctgcatgcagggatttggtttcgtaactttcgaaaatagtgccgatgcggacagggcgagggagaaattacacggcaccgtggtagagggccgtaaaatcgaggtgcatgttcaaaatattttccttttcatcttttttataaatgtctgcttcacgctcattcgttgttccagatgcatcattggcgtcttgtatgtgaccctattccccctcattgtttatatatatatatatatttttatatataaaaaggaaaactggccttacttttttttttaattttactttattatgttactcttataccgctgaaaggtggatggcaaacgtgagacaaaagaaaggttaatcggaaagtgtttttttgttgttattttccatgttttataatcaatgggtgcagtaggttccaaagaatagacagtattgcaaaccaaacaaaatacagaacagtttctttttctttttctttccacttcagggttgaagagggatccacagtggttggcaaattaaaccaaattgggaaagcaaaaaagattgtttttttgtttgtttttttttgtttgtttgtttgttttttgtggaaaaaaaaacaaaaaaaaaaacgagaggtttttactaaacctctcgtttttttttttttaagaagccagtttgaatttctgtattcttttgataacaaagtgaataaccaaacaggatttcctgttcaatatctggcccctgttcactgaaagcataaataccaaaatactgacattcagagtctgctatttgtcccactgggatctcccgcaacatagccacagggtcatatttgttaattttttttttaataccagttacaaatgctttagtctttggagtaagatgttgcatattttgcctttcattttccccttcgacgataacgcttaggcccctcaccaaactctcagtaaccatggtaactgtatacaaacccatgctggcgatggtggtgaatggtaagtggtgaagtccatctgccgtttcacgtatttagtgctgatatatctatatacatatatatatataccacgtgaatttttttgacttgtcgtattaagttttcttgatgctctatttttttggatattggtacgcctgtaattgagtgtacgttctaagctagcctgggaggcactgactggattgagttatgaccggtgcacatcttactcagattgttaaccccatattgtgttaaacaatgcaccctctcttttatccttttgttagctgtgacgttaaagcttgaatgattttgttaattcttgcgatgtaaaaggctcttgttccaagtgttgaatgctagatgttgctttcctgatggttctttcctcctaaagtgttgcacacggctaagacttgtttgtccctttttttgacatttatgttcccttgtaccttgtctcttctctcttctccactgcatgctccttcatatgaattttattttatgtttaaaaaatatttcttgtttctgtgttaccatggagtacacgcatgcttttaaatcttcaattatgcagaatcttttaatttgcttttactgtccctttattaaacactcttaatgatatgacattgctttattgaaatgatttgtaagttaaacggttatgaagtaaatgtaattttaaaaatgtatgattttgttatgcacctactgccttttataaattaaaatgcattttactttttagttttcttttttaataagtaatcacggtcataatgcatgcaactaattgaattgggagctggccctagaatatgtgcttacttgagttttctatgtacataggtaaataatgccacagcacgtgtaatgacaaataaaaagaccgtcaacccttatacaaatggtaagtagagattggccttttacaagaaattctctctacttctgactctttaagtaatttaaccagagattctattacaacaagctgtgtttgcctgggcattgacactgtgtttttactactgacctgctacagtgaaccacctacatcaataagatcattttcacaacaaaggcaaatggagtgttcaggttaagtgtgcctgcccttcttcccttctttctagaataactctgtttgggattgagatgcactaattatttggaaattagtttgctaatttcattggttattacagtaagttgaggggagaattggaggtttagtttgtttgcttttcaataccatctgctcgttgattactaatcattcctggacgtgcagtcacgtaatttattctgtctttgagtcttctccagagagattagtcatttgaagtggtttagagtatacctcatgtctgaattccacagggttagcagaatgtgtgagtgggttatttgttcttctctgggctgctcagtgttattttgggctagttgagaatgttgctttgtattacagaccccatcaggacaatgcaatttctgtttttatcaataaaacttctgaaaactcctcctaaaaagcattcacatatgagttattaaaaatgtttgaacattttgattctttaattcctctcaaaataagtatctcttaagatatatggggaagaaacctgccactgtgttaatcacatacttaattgtaccaaaaattaaagcaatgcagtaagttaaagtatatacacatggtagaatattatacccattaaaatgagcaggataaggatcataaagggtctcataattaaaaaattgacataaatgtttgtcgcataactttagataaatgatgataatatgccagaatgctaatggttgtgctgaattgtgagactggcaaacattttttctttgattcaggttcataaaaataatataactttattacatcaaaaggagatatatggaattttatacttctaaaattttaattgcacatggagatacggattttttaaagtaaaaaaaaaattaaaagaaacgttaaagacaagtctaaaatatattttaaataaccccattgccaccctggtttcctacctcccccctcacaggaagccgctattacagattgttgtctatagttttattttgcgtattcatgcctatatatgtagtaggtgttcatttatagtattcatagtgttgtatacatttttatgtgaatgatataaggatacacctggcatttttaattgggttttttaataaatctatatagagttcctttaatttaatatatacagattagactaattcatttcagtggttatgtaatattacacaaaacagataaataggttcagtcagaactaaatactgattgtttatcacaataaaagaaaacaatgatctagcaatgtattatcatttggtagttttgattttcctgtttcttttgccagtgactaccaatttgacagtcagtttgctcttaattttaaaaggggcatcattcaacagggacataccgtctatataatagggctctaagttgaaagaccagaagaattacctattctgctatttttctcagctttgtcaaccaagacatgcccttaaatggtatagactattttcacaccagactttaaatgcccagtgctgaactgaagcaaacctctgatttatatgtcatacagcctttccagttgggtaaaagtaatgactctgaaacttgccagatttcatatatggtgacatcaacctgacggttgggcatagtctttaattatgaagttgcactggtgcccaggcacatgtgtgcttgtctacatatgactagctgctcatgtgtgctgagtgagaaactggagcgagaaaagccaaatatttcataagccatgtgcatgtatatttattttaaaagagttattgatcaattttatgaccagggactgaaaactagacctgtaggattttttaacacaattcaaagcccatttataaataactagcctttctggaatatgaggtatgcattatgtgaggcattttaagtgcactggacacaaatgaagtcctataaagaggacatcattatccctattttagaggtgcaacattgaggctagagaagatgaagaaattaataaagacttttttttttttcttttttttttttgagacagggtctcactttttcacccaggctggagggcagtggcatgctattggctcattgcaccctctgcctcccaggctcaagcaatcctccctggtagctgggactacagccacatgccacaatgcctggctagtttttttttttattttttgtagagacggagtttcaccaagttgcccaggctggtctcgaactcctgagctcaagtgatgtgcctgtcttggcctccaaaaatgctaagattacaggcatgagccaccacttctggcctagccttttctttttgttatgaagtaacaaaatcttgtgaccatgcctgtgtgtatcaggcatcgctttccctttgtcttcttgtagaaatgcactcaagtggcaaccaactacaataacaaaaaaattattaaatgtgcaacctcgtgttcctgccagattttggcatgcacatcccatgtcccattccaggtagccatgcactcagtttccaggaataagtcagtcatatgggtctgtcatccacgtacctgcaaaagggaactcagagaattgttcctgtcacacatactgtgtatggcacctaaggggttgatggatagacacagtagaatttatttaaaacacaaatgtcaattctaattatataaagactttggcttctgtagtggagattatggagaactttggtgttcaaagaaaagtagttctccaagctatcccaagtttcaactcaggagtatcaccactacagataaattcccttaagtggcaatacaatataactgaaaaaatatagggccctttcatatccttaataagcaagacgatagagttatggcaaaagagggtaagtcgggaccaataaagtcacattgaaatgagaaaattaagccatcggtgaggttcactcattagctacataattcattctcacaaagcatagaaattgtacttcagcaaaattataaattactggagctatcaaagtttcaggtcatctccaggtgatgaaatatagttatcaatgccagcatcaccttcatgcattacttcaatcatgtatccagaaaaacttttagcagctgcaaagtttccagtgataaataagactgaattctaaatgtgatgagatacctgtccattatagagggttacagttaataacatggagggtgtagatactattctcaggatatttaaacaatgacataatgaaaagctgtagaatgagccgtaggcttctggacattctattaaaaagttccacaaagaggggattggactatttctctattgctatttctctgaaggacacctacccacacggaggagttggggtttgctgtgttctttggggatcaaatgttggatctgcaatacaagattgagagctgaattcacaaggatttcctggatgctggggaagcatgggtgctagacatggctttttcattttcttagagatgttaggaaggatgaaaatggggcaaacatattcagcgctccagagagaggcatactttgttgcccggatcagttcttccattcactggctcttgaattgtaggaagttgtttaaactctccatgtgccagctctctagtgggaactgtacaaatgatgggaactacatcacagttctttgtgataattatgagagaaagtgctcaacacaatgctaggtatgcaaagtggcctaaaagattatttttactactatttatagcgcagtagtatttgattacacatagtttcaatattaagtcatcatattattcctttattgtcatgggtagttgaattccctgagagatactagtttaaggatcaattcttcagatgctaaaaggggctgaacaggtaaaatcagcaaacagacagtctttgaaaaactcagtcttttgggactagctattgttttcttactgaagtaaagcaaaatatttatctacgaggaaaaatcaacaccaccaccaccaccaccacgaattaacaataaaagatctcaaacatttaatctccctatcagtctcacaatggggagcagtggtaaatgtgactaagtggggagttgaatgcagtagcccttgaccacctctaataagtctgtctgtgaggcattctcaacttaaagttaccatttctaccgatgtttcaagagaaatagaaatcctgtattttagacggaatttaaattttggcaataaatacacgccgttaaagaatattcagtgaacccaaacaaaacacctttgtacccagtgcgaacctcacttctttttgtttggtatttgagagttgccacctgtaccatgtcagctgccaggtctctgacatccttagtatatgtctttagaaagcattgacaggcagtttttgtaattcctgtagcgtacataagggtgctctctggaatgcgtttctttgatatgtaacccagcaaagccttaagagaaagcctgtgctgatgttttttgtgtacacattcagacttggccttttaacacccaatgcagtcatagttaacactggaggtcttaaccagcatattttagaaatactgacacttgacctttgacaagctaaatttggggaggggagtgcaaattcagatgtggccccttgagtcctggccacggaggggtctaaactgcttgcgtatctgatacagagccagaccccaagacgtctgttctctggctccattgccttgttgtggggctgggggggccctgggaggctgggaccagtgggccttatcagccattctccttttgttgtaagcctcattgttcagtttaatgtccttgatcaaaatctctgaatttgcaaggcctggggacatacacaaactgcctaagaaattaaaaaggggatcattttgttcatcttcctgacagtgcaggctcttatctccagcagggttatcccaagggtctctttcaggtacgaggaggagtcacagggaatgtgggttcatttgcatgtgatttgcatatatttacataagcccgcatgagctctgtaagtctgagtggaggcgattttcaagggctggattctagaccaaatggacataacagacatttacagaataccttttccaacagctgcagaatacatcatctactcatcaacacacggaacattgtccaggataagccacatgtcaggccaccaaacaagtctcaacaaatttttaaaaaatctaaactatatcaagtattttcttagaccataatagaataaaactagaaatgaatagcaagaggaacttcagaaactgtacaaatacatggaaattcaacagtgtgctcctgaatgtccattgggtcagtgaaggaattttaaaaattcttgacataaattaaaatggaaacacggcatgccaaagtctatgggatacagcaaaagcagtgctaatcaaaaagtgtatagtaataaacgcctacatcaaaaaagtaatttcaactaagcaaccgggacaacagtcatccctaacacgattcttctttatttaatgtagagtctatggaaggaagcaggtccttgaagattggaaggagacataatcagagccaaaaaaaaatttgtctattaggaaaaactatattcctttagtttctttagagaaaaaccaagtaaatatttatggaatgcttactttgccaaacaacattttaggtgctggagattcatgttggacagcagtcttgcctgcttgactgttaattttaatgagggagaatggttataaaagacaagagcaagcaaagaaagaaagaagctaaatccagatagcattaacggcaatgcagaaaataaaactgggaatggaatcatggaatccaagagtaactctaagaggaggtgggaaagtgacattaactggcatgttctgaaaagactccagagccctaaataacatgaagtcgactttgtgaaaagctagagagttctccaagaagaaggagaagtggatacaaagagactttgatatacggtggtcttggggggttttataaagatgaaaatggccagtgtcactgtagctgggagagacggggaaagggaaaaagggaagtggtaccaaagaggtaccaaatagtttggttaatggttagtgtgtgctgattgactaaggtaagacatgtgtgcttatctcaaattgggaagaagctattgaattctgagtatcaggatgacaaagctgatgttttttttaaaaaaattgctttggtcaccatgaccagaatggacagggggaaggaggaggaagaggagacagtgagaattagggcatttctgctgttgaacttgtccaggcagagataggaatgccttggtctgcagtggtggcaatggagaagaagggaaggacttttcaagttttaaccaacaggattttctaatggatcacacatggggtatgagggtaagagaagaatcaaggaagtgttgatgaattttattttgagcaaccaagtagatagatatgccatttgctaaagggagaaggacttgctgagtaacaggtttcatgagtggggggagaagagggagactagaaattgggttttcattcccatcgcagagttcagaaaggtctttggtctccaacagtgggagtggagtagccttgtttagaagggatcaaggatgggaagaaggttgacacctgcactcatgttcccatgatgacccaagcatttcattttgcagcacacagattcccagctggtttcttgtagaggagactttatcaattacctttctcacgattaatacttgcaaacatgagatagcacagatctcctgatgaaggagagtatcatttattttctttatttttttatgaagagattgccatgtgcagacttggcaaactcataacttgcagaaagatggggaaataaacagcagattatagggggatagacagattatagatacgtttatagatagatcagtagatagatggataggtgggtaggcagatgagataaacatgatttctaggtagcctcaaatgcctctgagagatctggaattttttgctttgttcttagaaaatgagagatcattggcaaatttataatctttaagagctacaccaaaattcactgataagtataccttcagtgaaaaggaaaaggaagtcttatatgcaaaagaaagtatttaaggtagtaaggatattcaagaaacaagacctgagatgcacagtatgggaaagacaccatctccactaccaataagaggtaggagcatcagtagagtatgagatgggtaacagtggaaagatgaagagtgatcacttaataattattcatttaatatgaccccatatagagtttacaaattctaggtttctgtgaaaaactagaaagaaagaacattaaatatgtctgcagctttattttcaactagttttttgtactttttcttagactccaagttgaaatgtagatattaattcccatatcctcaggaattagacttttttttaaaaaaaggaagcagtggaatttcagttgatcaaattgaagtcatttccatactcataaaacacattctgaaatgtctgaactaatatttatttttacgtcactatagaaattcttataaggcaagatgtgattaatacaagagaagagggtgtcagtatgaaatttcagaaaccgctagggcagtaggtctcagaatttcatgtttctttctgtcactctaaaaagggggcccaggaattaaatatgcctcccaggtaatagaagtataacactttgagaatctctattctgagatcatcccgggggctgtaaaccacctagcttcttcaggttggaactgaaagttcttagaaaacattcttatcaagttttagaaagttctggatttcgatagacatactggcctgtctgttgagttagtgagcctctgttttccttagtggatgttaagaacacctctgggctattcttagttcgggcagaaaatcacacctctctcttctcggcaaacctcagaaagttcttactgtcaaaaataccttccttcacattcaaactttaatcattgccttctctcaaaaacatttattaaaggacctttggtatttggccttctgctcaaggactcagagcaaaggactacacaccttaccctcctctgtctttcaaggttttttttacttcttgagacagagtctcactctgtcacctaggctggagtacagtggcaccatcttggctcactgcaacctctgactcccagcttcaagcgattctcatgcctcagcctgattagttgttactactttgtatttttagtagagtcaaggtttcgccatgctggacaggctgctctctggaaactcccaacctcaagtaacctgcctgccttggcctctcaaagtggtaggattacaggcatgagccacggtgcccgacctgcatggattttttttttttttttttttcccgagagagtctcacactgtcacctgggctggagtgcaatggcgtgatctcagctcactgcaacctctgcctcccaggttcaggtgattctcctgcctcggactcccaagtagctgggattacaggtgcccactatgatgcctggctaattttttgtatttttagtagagatggggtttcactatgttggccaggctggtctcaaactcctgacctcgtgatctccctgccttggcctcccaaagtgttgggactacaggcatgagccacttcacccagcccgcacggatgcttttatgaagacttagccagcaggagcaggaaacaataacaaaaccctaaaacgtgatcagtctctggaaattgttcccctaaataatgcccagcatatatgtaatgtgctttccaatttgagaatattcttgtatgctctttttttgtgagtaaagatttctaaagggtcaggattcattttacaaaaaactctccatccagaacatttggaaaattacaggattccattaatcatatatacagattatttgaaagttaccttagatatcatacattgattaagaattttttacagttcctgaatgcatcaaaatgtaggccacagtaaatctctaggggataaaatatcattttctttggtttttatgaagcactttggaattctctagtatctcgaggttataatttggaatgacaattgttagaatatattgctgccaagaattttgtttatgcaagctttctaatttttgtgaacttaatgcagaggggtgtgatggattatctagcagtgatatataaaataagaaaaaattaaaattattatagtagttctaaaaaatattgatggagtagaaaattaattaccatgtcattttcaaagggttcacttgtggctggtcagtagtttccattccattaacttgcactggcagaaaatcaaagaagggcataaatatattttcttatgtgtggtttttaagtatttttatgcatgcccaaacgacacctcctttacattttaaaatacaaaatgagatactttaacccatttgatttgtgattcatttgcaattatataagatgttgaatcaaatgtgataataatgtttttgtgtatttgttttaaggctggaaattgaatccagttgtgggtgcagtctacagtcccgaattctatgcaggtacagagtttctctttgcacgaagtcttctcagtcttttctaaatgtgctttgcctgccaagaatgaatgagttttgtaaaataacctgaagcaagtgaattcctatcctaacaagttctgaatgatttctttgggcaaaatcaagagtgcttaaaacagtttaaaaattacaagggaatcgtctaagtttcatggttgggggatcagcgtggagccactgctccttaggacaattcacattgattttgccctaaaaaaagcattgtgactttgttcaatagtgtattgaacaaatggagagctgctcacacccattgtatttcaatgtgcctgaatgtgtgttttagccatacatttccatttggggttggcattttctttttcctggcaaagcagagagtcgagttggcttaattattccaataatgtgggagtgatttagaattgccaagggaaggcctttttcgataactaaaaagttgtccgtcttcgttcattaatcaaattcccttagcaattccttttctctctactttgccttccagaatatgtctctctcctcaccccttccctgcctaagcaccaattacctctcagctgggaaatccattctcttagaaattttgggagagcataacccagaagcagtagtggctgagatttcatgtctcgatgtcctcggcttggcccgtcactactgcctgtatgtctccttgctcttgaacaaggctgcattgaatacctaggaccttagtaggtttgccacatggctatttaaaagaagtctttctttgatgtggctcttgctttttaataaggagaaataaataatccgttgacctagagccactcccttagtaacctcttgacggtaagtcataccccttgctttgtttcttcctgggctgcctaacttttgtcattttcctaatactgaacactgacccttgtagatgagaaaggaacacagaaaacttagctactctggcacaacaaccagtctgacaaaatttaagttaaaaatctggtaaatctggaaaggctcaacaggataactgattcctggattttacgtaggcgatgtttggagttgttcttcatgtatgagttttaccgggagcctgggttaagtccagggattctaacactgcaaaatagctgtgttcactcttgtgggggaagagacttagccgtcaggctttccatgatcatattgcaaaccctaccacctgagaagacacctctgctgagtaaggaacatggaaaccatgcctacacagctcgggttcaaattctgcctcccctactcaccagcagtgtgactctgggcaagttacttaacctctctgtgcctcagtttcctcatctattaaatggagatgatagtaacaaactcatagtaatttattagaattaaatgggttaatatatgaagagtggtgtgtagccagcaccgtgtaaacatttagtaaacaaaaatgaatatgttaatctctttaccaggaaggcaaagttagctgcatattctgctgaattttgagtatgctatgagacaaagagattctttccttcattgatgagagtactagtccttcagttctcagtgtgttcatttagggggtgttaatttctgggatcgggggcatggcagtttattcaggggacacacagaacatggcatgtattgctgggatgcatctttgtgcaaagctgcaaggaaatcaaatactccaaatggttgaaaagtcagacaacagcttccatgtgtccgcagcaggcactgcccatgaatggagtagttagactaaagaaatgtcagtttctcctatatgcacatatctgagtgcatattttcagcctaaaatagtccagtgaagaacaagaagccttcttgtggggaggaagggtatggatgtgagtgttgtggtggagagggcaaaatgcatttttacatttttctggtcctgtgcgatggagttgccagtcacccttgggtctattaagcaggaaaatacctaatatccccgttacttgtgctttcgtagccacagacatatctgtgggtgttgaggaggacattaagatgagagaaacagttaagactgatttgtaactataagaataaattcatctgcatgacttctagaacattagagcagctattcagattagcccagggcccaggttcagaagttagatcattaagttagaggaaaagaaaatgttataatgtaagttaatatttactggatactttctatgggccagcactgttctaagcactgtacataagtttaatgtatttaatgctcatggcgattttccaaatgaggataccaaaatgcaaaaagttggtattactgctctgagatttcagctggtcaggaggaggccagattttgaaatcaggctttgatcatctcagaaatcgtgttctttacaaccagttgatactggtggggttttgtttgtttgtttgtttgtttgtttgttttgagatggagttttgctctgtctcccaggctggagtgcagtggcgcggtctcagttcactgcaagctctgcctcccgggttcaagtgattctcctgcctcagcctcctgagtagctgggactacaggtatccgccaccatgcccggctaatttttgtatttttagtggagatggggtttcaccctgttagccaggatggtctccatctcctgacctcatgatccgccctcctcggcctcctgaagtgctgggattacaggtgtgagccactgcgcccggccccctttttttttttttttttttttgaggcagttttgctctgttgcccaggctggagtgcagtggcatgatctcgactctctgcaacctccgcctcccgggttcatgcaattcttctgccttagcctctcgagtagatgggattacaggcgtccaccaccatgcccggatcatttttgtatttttttgtagagacagggttttgccgtgttggctaggctggtcttgaacttctgacctcaagtgatgcgcccagcctgtttatttatttttttttttaatattaaaggtcatgattccaatcgactgtctcctatgatcatgctactgctctgtgtgcaaaccagtgaaataaaagaagagaggtaacataatcattctgtatgattccagctgccaccaccaccaccatattcacaagtgttacatgacaaatctgagtatctgtgtttcatgctgccactatccggattatccggaaaatccacatgctttcctcttttcagctgtacgtttgtatgtaggtagacagagctcataatattcagaaatgtggggacatgtagctgtaattttaacactgcagagcaattcctttgaaatatttgaagacctgcaaacactgaaagtctggctggcttaaatctgaagtttcaggcacctgcatctatggaatggacctatgcaaagcgatagatgcagagtgcattcatttccatatccaggtataattattactgtcacgcatctacagatccatgactaagaatttatggggcatttaaaatttccccagctataaaaatagtctgaatttatcttgcaattctgagtgtgcctcaaagctgaaatgaagaccccttgtcattgatttgctttgtatttttagtaggctggctctgtatctgcttaagatagaaagccagacttattagtcatttctctatataaggttgtgtgttaatgacatgttttataatattctcatagtgtaattatttgattttctgaagcttatgcagaattaacaacccagcctcccgttgtctctcagaatgaggcatgaaaagttcacatattttgtaaattaaaatcaatattttcaatctctcctaaaggtaattttcttagtttagtagacttgtccctaacatttattttctcttttaattataaaatggcaagttattgaccaggcgtggtggctcacgcctttaatcccagtactttgagaggccgaggagggtggtctcaggagttggagaccagcctggccaacatggtgaaatcctgtttctactaaaaatacaaaagatctagctgggcatagtggtgtgcccctgtaataccagctacctgggaggctgaggcagaagaatcacttgaacctgggaggcagaggttgcagtgagccaagattgcaccattgcactgcagcctgggtgacaagagcaaaactctgtctcaaaaaaaaaaaaaaaggcaagttattgatttttgtatgtaatgttttgactccccgagtatgtttttattgcaaacttgggtggggtgggggcgaggcaggaagagccattgcacttaatgaggacctttaattactatttgcattgataaattatgacattccttctccctcacacgtgccttccagaggaagcattgagaacgttctaatgtattttggatggtttttcttttctgaattctcatcaagtcatacttataaaaatctttctaaatgcttattccgtgccagtcttcagagcagatacacatacatcagcacatcccatgacatatattaatataaaccttctcccaggagagatgggtagttttctataaagcaaaaacagcattgataatttcttctaaaatctaatcatctccagagtccttgaggcttattcaagacaaatgatttgccgggcgcggtggctcacgcctgtaatcccagcactttgggaggccgaggcaggtggatcacgaggtcaggggattgagaccatcctggctaacacgatgaaaccccgtctctactaaaaatacaaaaaattagccgggcgtggtggtgggcgcctgtagtcccagctacttgggaggcagaggcaggagaatggcatgaacccgggaggcggagcttgcagtgagcccagatcgcgccactgcactccagcctgggtaacagagcgagactccatctcaaaaaaaaaaaaaaaaaaaaaaaaaaaaagacaaatgattgtaagtccccacacacaaatccaggtgagtcatgaagtctttggccaatgtgtatggcccttctttagagtttaagtaaaatcaaggcagtaaggagaagtagactcagaatatctctacccagtagcaggcctcatgttatctagtgtagttaaaaatagtgtttccaagaatgtggaggaataggcctcagaggggattcttacactttctctgtcattgtgagaatttcccttgtcttctaataaaaaaatatatatatatatttttaaaagcagtatcttctagagataatcacgatatccagccaatgaaactgttgatttacggcacctttaatcttcatgaataagtaaagcaaaatcaaaataaataacagaaggttacacaaagttgtcagcacggggctgtcaaatggtaaatttatctgtttctcaattgccagtaaaatacacactgcaaagctcacccacgttgtatatcatatctgccaactcatttctgtgattaaatattccatcagcgggactataaggcagcaaagcttaacaagattcataagatgcaccacttgaacacacataactcacttccgtggatggagagcaccccgcctgcaaagggaaattggaattgagttaaattactccatgagacgtgatcaatagggaaaggcaaagatcttctaacggaaatgcagatctaagatatagttaggtcccagagatgagatacatacaattaaagtaaaaataaggagatgcagagtagatcaacttgaaaaccttgaagaaaacaaaaaccacccctagggatatttattattagtggaatttggggggaataaagagattctgaatggatactcctgaaaagaacaatttgtggttttgagagggaaaagaaaatgacaggaactaaaaatgcgccatgcctgactgcaaagtcacatttgaaaggtggtcaggtcttgaaacaagctcaccctagggttacaggggcgatcagataatatgagcatcagagaacatcacagactgtaaaatagaaatagaagagattcatgtgatcaccaaagtcacctcgactgattatatccatttcagaaagaacctggccacggatcacatgacttgatgctgggctaggtgatgggaaagtggatttggatctcagtatgaagtttaaaaatgaagagggtggttataacactctttgattgcttatctcaaaagggcaactgtatttgacctcggatttacccataccaaaggtattggttttctgtgggctagagtgaaccatgattcatctcagaattgggtcaaaagaaggtctatgaaggctccctcacattttttcctcccacttccaccaccaagagtctattaccgttaagagaatgacttttagtcatacttttagctgtacctcttttcaattcccttcctacaatttggatacaatagcatctgagaaaagttaagattgtctagaacccacctttgatcactgtggtccctgacacaagtttgctctattttattcagattggcattgggctcagggtgatttggctataaaaagtcctaggtataaagcatgccctgtttgggatgaaagagcacagtgtgggtttacaaggtaactgttaccatccaagcccttcaaagcagcaaatattcaggtgcccctcttggctccaacactttctcatacccaccaggaggactagactcgaatcaatggccatagggagcagttcctcatgaaccattgacctttggctctgggatgttttgcatagtttacgcatctgccaaattcaaatgcagtgcacttcagtgaactggaacaggagagtccagatttaagtccccgagcaaaggattttcagcctggaaatgttccacttcaaagagtttatcttgcacatctgtttacctttgcctccccttttagttgtaattcacttcgcttctctcctctcctcccctcttctgtcttatcagattttattccagccctgcccatatttggccttaatttttatctgcgtccttctagatcccacagagggaatgcaactcatctttgatgaagcctgtggggttttttgatcttcagataagatcagtacttgcttatgtgctaaaaactgcatttttgaagtaaattggttctttttcttgtgtgtgggaagtctgtcaagaactgctccccccaaaagcagggggtgtcaaggtagtccttgtacaagaagcttcacatccaggctatgggaagcgaatgaggtttggatatccgactctggaaaaatttcacaggggaagttttaagttaccattgtccacatagtgagaaactcaaaccatcaacaacagcaagccacttgcaggtacttgctctgtgctgaacaccttgtttctcctcaaatccttatgaaaatgctatcccattattttcatgatcaaattatgaagtcaaggtttctgggaaagcttacctcattcgccaaatcacagaactaccatgtgaaaaattctggttattatataaaggtcttttttcctaagtttcaaccccatgttttttcactgctttgctacgcagcatcctcaggaggtgtagatgagggcatgtcctcagtgtcttctattcatgaggtcacagaatataataatgaatgaaggccgggtgcggtggctcacgcctgtaatcccagcactttgggaggccaaggcgggtggatcacgaggtcaggagattgagaccatcctggctaatacggtgaaaccccatctctactaaaaatacaaaaaagtatctgggcgtggtggcgggcacctgtagtcccagctactggggaggctgaggcaggagaatggcgtgaacctgggaggcggagcttgcagtgagctgagatcgtgccactgcactccagcctgggcaatagagcaagactccatctcaaaataataataataataataataatgaatgaaaacacatttgcatttaatattgtctgccacatgccagagttcatgttgagaactttacatatatgtacgtaaattagaagttttcaggagaagtattgttaccttcgatttgcaggtaaattagatccagtgaagttatgatgccagtgggtgctgactctgaaagttaaggagtagggccaaagctgttatctttgtgactccaaagctcattttctacctacaagctgcctcccaccaatgctttagttaacccaagtcctagattagtgattcttaatatggagtgacctttctcttaggggaatttggcaatttctggaaacatttgtttcattgttacatcttgggtggtggtgggggcggggattggggagtgttgttcactgctgacatctagtgggtggaggccaaggacgcttcaaaacaccctgcaatgcacaagacattccttgaccacaaatcgttatctggcccaaaatgtcaatagtgctgggtttgagaaattctgtcctcattgacgctattcgagatgccacatattcacggaataccttaacaactctcatgccccactggttgctaccactaataatgtatgaacagctgcagtcatcaatggcagtcaaagaatttgaagactttcatgtaaatgtttcatctttggagcattgtattgtgattatttactccagaagggaaaagcataaactttgatttgataccacacagctgtgttgggagtccccaagaccactctcaggctccatgattgattagaaggactcagagttcaaaaaggctgttacactcacagttagtttattataacaaaaggatacagatgaaaaattagcaaagaggaaaagtacatgcagtgaagtttagaagaaacctagcaaaagcttccaggtgtcctctcaccgtgcagtcacacagatgtgcttaatttttccagaaatggcatgtgacagcacaggcatagtgttatcagtgaagctcacctgagccttagtgtccagcgtttttgttagtggttactcacataggcaagctgcacctgcatgactgaccaactctcaaacctcagcccatgctatggaggtgtgaggaacaggaattcaccataaatagttaccataaacaattggatcaaacctatatggtgtggtccaaggcctcaggcatacaaaaacaattttgtttttgtttttgggatggagtctctcactctgtcacctaggctggagtgcaggggcgttatcttgtttcactgcaacctctgcctcccaggtagctgggattactggtgcccgccaccacacccagctaacttttgtatttttagtagagatgggctttcatcacgttagccaggctggtcttgaactcctgacctcaagcaaccctcccacctcggtattccaaagtgctgggattacaagtatgagccaccatggctggcgcaaaaatagttttatcaggcagataatattctaaggcctgatattttatctcccaggagctggccaaagtccaatcctaaggacaagctgttgtggaaaatgtgcaaggtttgagatagcccaggcctgctagaatccacccttccctgcacaaccattaaaaaaaaaaaaaagtaaacttgcaatttatagtgacatctgtaatgatggtagtagtgaggatgatgatggcataagaaacatgataccactgggtagcttgactgtaagaaaaccaagccaaatttagttatgaaagagaaaagaatgtacagcttgttagcttaaagcaggggtcttcaaacaacttatcactgtaggcacagatagtgtttttgactttgtaatccctatgatccctgtttcaactactgagttctgccattgccgtgtaaaagtagccatagacaatgtgtaaataaatgggcatgattgttttccagtaaaactaaggacgtggaaatttagattttatacaattttcatgtgtcacaaaatagttgttttttttcaaacatccaaaaacgtgaaagccattcttagtttatggcccgtacaaaaacattgtccctactttgctgagcttggcttgaagagctcagcggtaataaagccaccagtttaagcccttgagagtttttcttttggttttttaaattgcacagctttagcggttatatactacatgaacccatgaccttagctggatggcactcagttgtttgatgttcatcagggaagggccaaagagacagaccgtgtattaacacttaatccttgtttccatgaattcaccttttattgcagaattatagtatcgggcgctagacactgtgctaggtgccgaggtaccaaaacagacccaggctttccctctagaagtcaacagggtagtagaaggatgcaaaacaaactgtcaatgcgggtatagtacacagtgatacctgctagagccaaaagaataacaaggctctctgcatgaggagtcaagggggtggtgtaaattgagtcttaaagggtaagagttcacctggtaagaaagtgggtaaagatcattgcaggagggaatatggaggtggttggtagggtcccaagctgtttctcaacctttatctttagaatccattgagaaaacttaaaaaaaaaatacacatgcttgatcttcacctgatacctactgatgggaatttctgagccaagttgacgttttttccaaaggctaaggtatattgatctgttgagattagagagtaccttctagagaaaggttgcataagaccttaaaattttacataatgaaatctgaattttggaatttatcctttcagtggtaggcagccattgaaagctctattaaaaataacaattataattaaaaataaataaggaagacacctgttggtgagttagtacttgtatctatattcacactgagtaacagtcttataattaagacttgtattattactaatatgtgcgtgaagccctgtggtgctgggagacttaggagcagattatcaactgttcagcaaccctgcagattgggttcttaattactaatctagtgcctaggacaaaggctattgtgaaacttatttcgtggttttctctaaatcttttaagaaagtaaattaccagcgatttcaaacgcaaggtgacatgtttttttttaatgttttaacttgttatcattagattataaactctttagtttgaaagactttttgcttcccactttcattgttcttttcaaaatttattgttcttatttccccaacaaattaagttggtgtataaatagaaataaattcacccaatagtgtttaataccctttctgttaattacatgtagatactcattctctacatataaaacagagctgtcctgttgtcttttgaaaatgtagttttgaagaaccaactgacaaatggcaaaaccctactttgagtaacttcatcagtgacagttaatgcatttctagaacttccatggaattgttataacacattacagtcgacatattggtttatgaaaaattaataaagccagtggaaaatggaattccgcatctgcattagctatttacaccaaaagaatcagccagaattaattatgccgtatgctacgttctaatgagtttttcattaaactgtataccattatggaaactaaacaaggattattcaaagaataatgccaacggctgttattttgttgagagattaaattagttaatgggttatacatttaaatctgatgcaaaggttaatcgatgcacacttattgtattaaacccagtatcattttaaaacacaaacaccccaatatcactgatatttcctctggagaaaaaaaaaactatttgtatgattctagtgtttggttgatgtgcatgtgatattgtaaagattgaaatccaccctattctctttcatttttgaaaatgattttcactagctgaaatattatgtttgtttttagccatagcaggggaaggggcagtgtgtgcgagtatgtgtgtgtatgttgtggcaggcatagacaacttcatccaatcactctttgagagattgaaaggtgacgtgtattttctactctcaccaaaaaagtcaggttaaaattttaagcctaatctgagaaggcttagaaggcaattcaagatgaaggatctcatcctcattccacaaatagagtccctcctaaatagttctgtaatagtacttgaaatatgaaagaagtgacaatagagaagcctgtctagacagctttttaggctcttacagcatcttagaggctcttattcccaagaagataagaagagagtatagaaggccttctaggttctttgcacagacttgtaaattccactgttttcagttgaatgacagtttctaattttttttttcctaatcagagattgcaaactaaaatgtttttaggaacaagctatgacataaataagtgaaatgtgccaaattggaggagctgtgtctcaattatagcaagtagtggcttctcacctttgcctacagtggctctgccggacaggaatcctagcccagacacctatggtctgtcccctgacttcccactagaagctagacatatcttatcacattaaaactcctaagtttaagtgcttgcaattcatttaatactaaaatatttgccattaactattatgtttagcattatgtttagtggccaaacacaatagttcaatagctataaatttgctatttcctttctgaaaaccaaagtaagtcctcagagcatcattgttttagatacccaataataattgctatttccatgattatgattgattcacttactgattactatttgccaaacactttcatgccatagttgtaatcctcacagcaatattcgatcaagtacacatttttatctctatttgacagatgtaaccactgaggctcagagaagtacagagttttacccaaagtcaactcaacttccagtcagcaagatcaggaaacaaaacaaagttaaaagtttcaaagcctacactttttcagtgacactatagaaatctcagacgttcattatttctcctctgcatttgcctcctctatgtcttatttcaatcttgcaagtaggatttttcttatctgtagaagatacattctgcccaaaggcttccttggttggatttaaaaccctatcacagattcttaaacatgatcaggaggttctagctaacatctttagccaggaagagtcaggtgtttcctgccagatggcagcttcggaattcttagatgtggctttgttgtaatgggggtaatggatattgatcattctcatgctgaaggatatgtttttatcaactcaggaccaagtatcaccattgataaacaggtgtagctttgagagagagtgtctgagctttggagtcacacaaaactgacttatagttcagttttattatactttttctctgagctttcatttcctcttgggtttgataagaaaaagacgtgcatgtggagtacatcttgtatagcacctgaaacctagggccaccttaatgggcactgtcaatattagctgtacatgaggttcctatgtaatccctagcaatttactgttgtcagcaccatctgcatcccctggaagcctatgagaaatgcagagtctcaggccccaccccagaccccctagataagaatctgcatttagaagagtcccaggggattcagagcatagtagagtttgagaagcaaggccctagtagtcttatcatctatatattgacacctataactttgaaggacaaacatcttgcaagatagaacttattttcattgtttttgttgtggctgaattgatagacctccacaaatactctatggaataactttttgaatttttttttttcttttttgagatggagtctccatcacccaggctggagtgcagtggtgcaagctcagttcattgcaacctctgcctcgcgggttcaagcaattcttgtgcctcagccgcccaagtagctggggttacaggcatatgccaccacgcctggctaattattgtatttttttgttagagacgggttttgccatgttctccaggctggtcttgaactcctggcctcaagtgatcctcctgccttggctttccaaagtgctgggattacaggcagggtcaccacacctggcctaattgttttattgttttgaaaaacaatccaaaagaaattttgagcaaatatttttaaaagcctgtgtttgaaaaaagtttgttttgaacaaaaatgaaataaaattaattttttggcaagtattgatcaaatgatagcctctgaaatacttagtgccagctcccttgggaagggctaatggtgtactgagagacagttactgttagtatttttgcaagcagtaaagggatcttagaacactgatcagcaaactttgtctgtaaagggccagacagtaaacactttagcctctgcaggccataaggtctctgtgcaattactcagccctgtcattttagcagaaaagcagccatacacaaaaatgaatagatgtagctgtcttccaatgaaactttacttattagatactgaaacttgagtttcatgcaattttcactagtcaaatgttactgtgatttttgtcaaccatttaaaatcgtaaaaagcattcctagctcacagaccatacaaaaataggtgggggctcgggggaggggagcagttggatttggccaaaagtctgtagttggtcagcacttgatttagaagatgattgttagaaccatgggtccaggaatctggttggtatgacttgcagtttcagcatcacgagatctgtgtcacctcaggcaaggaaaaagagttctctatgcttcaatatcctcatctattaaatgggtataaaaatagtgtctgtcctacagggtcattaagagtaaatgatgatctaagttaaagttgagcaggatacccagtgattctcaggtattcagtaaaacactttgggaactcttattgttaggtttatcatattaagttaaatatttcctgtcaatgccactattagcctacattttggctgcaggagattaagtgaacagttggagtgagtcattaaaattttcaaacaataaatagtcaaggaacaaattcttctttgtattattcttgtgacttttccaaaaagtctcaagttatgtcaaaataaaaagcaaaaagaaaacaaacaagaagtggtgtattttttttttgaatattatgaaaaccaaagcttatgaaaataaattggagtgagggattatttacactatagacagatgcgcttcagggcccctttaaatatggaaatcccttggtacaattaaaacatgatttgatttataagaagtaaacatacagagcaacattttttctgcaacatctgtgcccaaatggaaatatccctatacttaaaactctaccataacccttcagagaagctcatctttcaggctggtgtaaaagcattagggattaactgtgaaaatattcttacatggattagctcaatgctagtcttgcgttcaaaaatgcatgactgtaaaagtatccaccgtccattcgggctttgggtaaattttggaaaaatctgtcaattgaaagcagtcacctccattgctaggtaccttatggcaacctctttggcttctaagtccaagagaagtttgaggcttatgggtcactttgtaggggactctcattataaggtaggaaggtgtagtagttggctagtgctgccatagcaaagtatcacagactggatggcttaacaagcagttcccaaccattttggcacccgggttgggttttgtggaaggcagtttttccacgggtcgggtagcagggatggtttcaggatgattccagtgcatttcttgtgtaccttatttctattattattacattgtaatatataatgaattaattatacaacttgccataatgtagaatcagtgggagccctgggcttcttttcttgtaactagacagtcctgtctgggagcgatgggaggcagtgacggatcaggcattagattctcataaggaacacacaaccaagatccctagctcagttcacaataagattcacacttttatgaaaatccaatgcttccacttatctgacaggaggtggagctcaggtggtaacatgaagtaacatgaacaatgaggagcggctgtcaatacacatgaagctttgctcgctcacctgcagctcacctcctgctgtgtggcccagtagggtccgtggcccaggggttggggaaccctggcttaaacaacagaaatttattttctcataattctggatgctggaagtctgagatcatggtgttggcagggttggtttcttctgaggcctctctccttggcttgcagatgaccatcttttctctgtcttcacctgggtttccctgtgtgtcctcatctcctcttcttgtaagatctgtcagattaaggcccacccatatgacctcattttaacttaattacagctttaaagatctctctgcaagtaaagtcacattctgaagtactcagagttatagcatttaaaaatgattctacaacagtggactgaaggaaggactcgatgaaatgagtgacagtgtaggaacccaaatagcttgtttttcatctaaaatttacctctggttggtaaggtttttggtaaaggacttagttgttctgtgccacctttgtaatgccagtaaaggaggactaatggcatcagacgcctactatggagggacaaatgcaaagtaaatattctttggcaaatattgaaaaaagctttttctttatgtagaatcaaaacatttctagcattgattcctattactactaaactttcagttatgatagaattatatagcagaaatagagaattttggccaaagccataatagttatatctaataaaaattgttctcgaataattatacttatcttagtgagcagtgtgactaattatgtaggctaaggtttggtttgatattcagaatcattcttttgttccttttcatgtatacatttgttactgaacctatgagcactaaacgtgataacatgtcatcctctggaaaagcacatggagttcaacagatgtaccccaaagcccagcacagtgcctggcacatagacgagtagatgccaataagtaccagccaaatgaatgataatactcactacatcatagttgcctagctgagcactagaggcagagggactaataagcacttgtgctactcagacattgccctgcagggttctagggttctcctcttagccttcttccctgagtaagctcctttcctcggctgagtgacattaggaaagccagacatcagtggagagttctatttttgtgtgactctgcaccaccacacagtagaggtttgttgaggtgatacggttctgatgactggagaaatgccaaggttgttggttttgcgccgattggattaacaatgtgaacacacgtggagtggttttaaggagcgaaaagtgtaataggcaagaaaggaggaagaaagaaaagaacagcttccccatacagagaccggagagtggggcctggaacagagaaaccttgtgtgtggcagataagtggtagattataggggaggcttgaggaggcggtgtctgatttgcatacagcccaggggattgctttggccaggtgtgtcatttatgcagcctgcaaaaaacctggctctcccaccttagtcctttaatgtgtaaatgcgggtcgccatgatgttctgaacacatggtgttatctggaggtggccattaaactgggcacaggtggtgacaaggagaagacagcaggaatcgccacattgagtgaaccctgttcctaatggcgggtatttgcatatcaaagcttgcccacccagcccttcgagcagtcttttctgttataaaagagatggtttgggggtggtttcttattacaggaaaatttccacctagaacctttacccttactatctgcctaaaataatttcttaataactcctgtattagaggtacagacagtgcatgacatatacagaaacttcctgcatgggggccccagaatactcattccatcttaggtatttcataaagtctagctgttgttctttgtgtcttcaagagcatcctccagatttcctaacccattttaatcttcgagctcttgaagctaattggccactcccagttgccaggcagttgagatgttccgttcacattttttgtttaaattcagaaattatgtaggaaaagttctagttattcaccatgtactgacttggaactgtgcccatttgatactaaaagggaacgggcagacattgccaaacagcctttcttttcttccttcccatcctccattttaattttatttcttggaagtgtagcatggctgcctatcagaaacctttggattctcacttcatttgctccctgcctcttagtctaggttcctggactcatgaggataggaagataaacacatgattcctgatctctttgaattagtagcatcaatgggggaagacactcattaaatagattacacaacacaattttaaaaagaagagaaaggaagctgaactctgccagacaaaggtacatagatagggtttctaggagaagccagagctgagtccagaaaggagttacctagagcaaggaaaagatttcctggaaaaagacaaagcctctgcaaaggcatggaggtgtgaaactgcactgctgttccggtttgagtccagttttcctcacttagggggttggcagcagagtaaacagttttcgacacttcctccttcctgtctgtgatgggaaacatcccttctaggcttgtgcctgccccttcaggggccaggaatgatcccctgcatgccgtatggagactactgctcagcagaaagggttccgatgccccatctgagaccttggcactggcttactcccttcctcactggaggattcaaaatcctgctggagagtggctgtgggacatcttgccaggttgtggggatgccgatgatcccggcactcagagtgggcgaacgtgacaggctttggaacgggctctgattattctgagattgaggtctgtcccatggagccaaatgtctgccaggtgctgatacagtcatcgacagtccaggctgcgcaggtttcttgttagagtgggtgagccaactttataagaaccaggaaagaagagaaaacacgtgaagtagattgaagctatttcaatctgtaaaagttatttacatgtagtgtgtaaatctatttgaacttcaggcatgcaaatttcctgccatgaacaggcggaagaaagattggttgaaaaaaaacactatttttagcaaagagggtagaagtggagacttgtttttaaaaatgtattataattcaatcatatgcattaatccttctgaggatcaggtattttcctaggtgttggggatgaaaagatgagtatgatttggctctaccgcaggtggattttgtagttcagacgaccaatgtctaagtagaaaattgtagtagaggaccacgaaggatctatcagggaggtttaaaaatgcaagataagagcatagtgtaggtaataactaattcacccctgaggacaagggagagaagaggtcacttttaaactatgttggaggaggacaggggaagcccctccgcctcctttttttttttttttcttttaagttgaaccacatgaacttggcaacattcaattctatttgacaaaaaaaaaaaaaaagtcaatttgaaatggtttaatctaactctaagagcaggaacagcatgaaggtttcatccacttcaccaactctaatcaaatgggaatcattgcctactggctgtgttgagaatgattgtgaggattccaggccaataggaaaggataatattgaaattgattaattccgttctggctaaagaatgggtaggtagtggtataaattgaccccatttgccatccctagattataaggaatttgataaaagcacagaagtctgagaagtacaggatgtcatcatgtgatacaaatgaaggttcctggcatttggcagtagaaggtttatgttgaaggctagggacagatagaagatccagctcagtggactcaatgaagagctatgttgaagctatattgagaagtgctttgaatgaccttgtaggccctctccatactgctgcttgtaccttattacctatttgacttactttttaaaacaaacacacttacctttccctgcccaaaaaaatgcatggaggttgcagtgttctctgctgctttggttttgtcgaattcaaagcgtccttttaagaaaaggtcacaaagcactaagggaacatacagtaagtactttccaaattaaattggaggatgcttttagataaaacaaaaaccaagtcctgtgaaggcatagattttgttttacaaaaggtcaaaatcattgcataaagattttttttttttttaactacgaagaaagtatccaaagaaaatatttcagtccaggttctcagaatccacagcattaaaaaaaattaggaatgcttcattatgccgtgccagaggttagctttccaggcaaaaatctgtgctgtgtcccagtggaattctataaattgcatcgaggatattgaaaattgacccaagggttttaaccatacaatactgaaatgtccttctgtgtatgtttgtgttacagttatacatttttcttttgaaatttagcaccccaagaaacttcatagctgattttaagtgtttttttaaaccaggcgtgcacaggagagaaggttgaggagcattccctaaatccacttgctaggatcctatcgtagatgattccgacctgataactctctgtatatcctatagaaacacattcatttatttctaagatttctagcagtgagcagaagcacatagataaccgctgcagagtcacacaggagtactcattgataaacaccactgactgtagaggggactaactgtctttcctggtaggtagcttgcctccccttgcttggtttcatatcccaatctccattctttggagtttggtttgtttgctgttaatccccagtgacctgctaaaactggaaatacctgaggcgaggttaaaccatggaaagtatcatctcatacgttgtgataaacttttttttttgagatggagttttgctcttgtcacccaggctggagtgtaatggcgtgatctcggcttactgcaacctccacctcctgggttcaagtgattctcctgcctcagtctcctgagtagctggaattacaggcgcctgccaccacacccagctaatttttgtgtttttagtagagacaggatttcaccatgttggccaggctggtctcgaactcctaacctcaggtgatctacctgccttggcctcccaaagtactggaatgacaggcatgagccactacacctggccgataaactgtttttaaatgaagaagaaagaactattagtttagcacaggtgaatcatactgacactccgccagactcttgatatatttactacccagagaaggttagttaatttcgagttaatttcactgttgtgtgaagggctattttgcgggtgggggtggctgttctccagctataagcatgggaaaccagatcgaaaaagaccatgggacattccttcaggtagaacctctggccctgggctgcttctccctgggaaaaagtggatggagttgtcagaccggtaacaggggaagagtgagatgggttagaaagaattgtgtctggtttactgtcccttgatgacatcaccgtgcagtccctctgtgtggcaggaccccacacgctttggaagttttaactacatttttgttgatcatagggaagatacagaaggagcatagaaccattccctagggcaagtctccaaggatatagaaaagttccctgttctgcgggtgcacttgtaaggttggcttcttatcatgggagattgctttcccgttgcggtcctgacaggggaatccaaatcaaactggggcggttgaccttccccagtcaaggaagtgaccagaaaccacagggaggtatttccatcaccagtaatggccttaaaactcctcagaattctaattattttcaaagtcttggagtttgagctttgcagcagtgggaaagtagcactgataccctgacaattcctgaccccagtcatccctggagtgggtggttgttcaaaatctgtcatagattgaggaggtatctcaggattccaccattatttgccgctgtaaaattccaccttgcaaggatgaacccagtgcccttcgctttaaatcaggaggaggcaagtcattgctgcaatgcagccgcagtttgcaggatgagctaggcagcctttctggctggaaggcagagagctttagggaagaaagcgggaatacagaagccgaagattctctcatccagtgtccagtgtgggtccagggtgggtcccagggatggcaaaaagttgcaatttttctttctccgccttacttctgttcttcctctgaagaactgattcggaaagactgacatttgaaggaagttaccgttttctctaaacctatcaacatgtatgcttactattgattgagtgattattacatgccagcccctgccctgggtacgtctccagtcatatgatgcacagccattctcggaggtaggtatatttacccctgttttccagatggaaacactgaggcacagagaggtacagtgacttgccaagatcacacagtgaagaggtgtctgagtcaggcttactatctagctccctccaatatttctcaagttcccttttcagtatgccacgctgcttccattcctgatctgaacctgggccctggggcaaccagagtccgctacacaaccccgtgtgaaaagtcatgacgtgtgcttggtgggccgggttgtggtgggtgggggggcttccattgattccctttggctaaggcagggggctttgttgggtacccttgtcctgcgctctgggatgtggctatgttttcatttctctgcatttctcggttgcattgccgtgatctctcaggtgtagtgtaccgattcccaaaccagataccatctctctctctctttcgtaggcacggtcctgttgtgccaggccaaccaggagggatcttccatgtacagtgcccccagttcacttgtatatacttctgcaagtaagcccactgtcgtggctctttttgttttgtgacataaatctgagtccaatcaccttccctgccatgtaagttctctccccctccctctgccccaccctctcttgtggctctctctgaggtgaagttaattttcataagcatgtctgtctcccatgccacttcccagatgtcctggacattctctgttagatccgtcaggattgggtccaatggttgggaatgtgggcatggggttggtggggaggggcatgggagggtgggaagctttagctcattgcctgccttctatcatagctttgcaaattaatataaaaataatttaaatagcatatacaggccaccccaaaggcacccttgcctagtaaaagatgcttaaccaggattcttgtacacagttgtctcacgatggaaaataccactagcctgcagctagtcacttgtttgcaaggctgttctgtcctttgctatgtaattccaatgaggaggaggaggaggaggaggagcagagagagaaatgtggttcccccctcatttaatcaagtgcaggggcagcaacattaaataactgtcttttaaaaaatcggggcacttttaaacgtagataagtatacccatccagtgcgggagggaagagacccaaaataaatacaggaagtagatcacaacattgacatggaagaaccgaagatttctctgcctcggatggatgctctgggttcaaggatgccctatcctcaccccaattcccagagcaggtagaagaattaaagccgccactgactctaccatgttctcccagagggtataccccttcttaaagaatctcccagccacagctgaaactttaacatctgttttatacaatgtgtgtaaatcctgtggagttgccgtaactgcagaatgagtcgtctttagggtcagtgcttaaaagtgagtctgggtgcctggagtgggggtggggctgtttctcagagtagttgtaaaaggcagggatggggaggagagcaggagtaccaggctcaagggataagagacgtaggagaatcctcaccatcgtgccaaaaccaaacatcttcgtttcctaaattgtgaagctgaggaaaaccaacctcctcactgttggggcagcacctccctgttaccagcagtcacagggaatcaaaaatataatgtgacacacccaagggtctgaagtcttcaggaggtctgacagccagttgtttctcacagttagaggttttgagacaaagtctcactctgttacccaggctggagtgcagtggtgccatctcagctcactgcaacctccgcctcctgggctcaagcaattctcatgactcagcctcccaagtagccgggattataggtatgtaccaccactcccactgatttttgtatttttagcagagatgaggtttccccatcttggccaggctggtctcaaagtcctgacctcagatgatccatccacctcagcctcccaaagtactggaattacaggcgtgagccactgcccctggcccagactataatctttaatggcaattttggcattaattaaatgcaagacatttttctgtgcctcccaagaagcccaaatctaatcatattggcaagaagtggttctttctgaatttgtgacaacaaattcagaagggcctccttggggccagtgtaaatgtgtgtgcatgtatctcctgaaattgtaatgttactacacattttcacatgtccagccttgtgtattcctctcaaaaccagcaccaggtaggtatcacaatgtttgctttacaactgaggaaatggagggcaatcccagagccagtgtgtaatagatttgtcttctgaacctgggaacattattcaaccttcagctacctttctgagtccatttgactaaatctgatcgctgtaccatttacctagccttcctcgtctatattattttctgaaagagagttggtgtgccaaaacttaccatagggctgggtcctagagtattatttttttctctaacattgcggtcctatagaagtgtctgggataaaatctttatgctatccagcatagtgctgatggaactgagacactcatttttatgttatattaattagccatataggggctaatggttaccatattggacagtatggctctatatgatgatatgacatatctatatttcaattttctttacagaagtgaacaaaacaatcaactccaaaagtgtgctagtttgaattggtatagctattctaaagtgaattggggaagcatctctcacatcacatgaaaatatttcccaaattctccataataaaatagctgaagcatagagagaaaatgaaaccatctaaagcgagggccacccaagccagcccatggcctgtgttacaaggcttatgaatgaagaatgatgtttagattttccaaggattgaaaaaaacaaaacaaaaacaaagaatgtgccagagaccaaggtggcctgcaaagcctaacgttttaacagtccggctctttacagaagaagtgtactgatctccaatttaaagggtcgattttagtattaaaaatacaaagtggcaatatcactgcactgtgtgtagctgtacctttttctatgtttaaagtaaaaattaacaattatgaaattgtataatgtgcatccaacatccttcatttctaaattgtatcagtcgtattacctgcacattatatgccatgtgctttttataaaaatatgttaatgaacccatagtattgtttcattatattatattttaatctattcccccattcttgagaacttaggttcatagcaattttttttcaaaaatattaaacaaaataaacacccttcaatagagcagttttaaagaaaatagctaattttaccaccccattaaaaagcaaaatgaaaactagtttcttacattaagaatcttcacttgtcgaggcttaagcaagggcattcagatggtcaatctcgattagtattttgtaatggtgaccaactctgagacccctccctctccaattgggtaggcagaggggccttcagttatttctgtttgcaggctgtgcattggtgttgaatgttaagtttatccgcaaatccctaagacacattgctgcggtttcctttctcttttatggctttttggtctaggctgtttgtggattgctggcttggcaacattcacttaggtttttctcttccagattaggtgcatattctactacaaaaccattccccatttcctgcaacaggtcagctggcacataaagggttatttttacatgcaggcctgtgcgcacacacacacacgagttatattcatggtcatccaggatttttcttctcccaacagtttcgatttgcacagggctgagagtcacatattttatctttgctctctgatgggtgcagactttttctctaggaatccaaccattgccctcaaagctgaggctaccatacttttcagcaattgtgtaggatgctcttgttttttaacttgaaaatgcatatgttcctcatttctgtttaacagctgtgctcctgaaggaaggtgtgtgtaaattacacttttgtatgttggatcctatgtgtctacagacttgcaagataactctggagcttcgtttttgtttttttgcgtttttttcctccatggatctttaactggcctttgatgtttgtttttttttttcgagacttaaattgtacctcttcctagtcaaatagctaatcatctgtaaataacatccttaaatgcagtaggggagatggtttttaaaggaaccctgctgaattagtctgtaatgaaaataattcctactgaagttatctgcttttgatatgcatttttgcataacagtgaggttttctcccccattaagtgaatcatcctaacaatgtgacccaggactcataaaagtattaagagaaagattttcactgataactttgtgtccatacaactaattccgtagactcttccatcggaccccaaatgactccagtttttctccgtcacccctgaacttcatgcaggtttaaaaccctagttcaaattgtgtcacaggtcatcatgcatcctcttacacgtcctaataaactactctcatccagagtgtaaaatgggcctgctttctatgaaacttaaatgaagaaagaacaaaactctagagaattaggcaacatcacctagtgtcaaatggaaaacatttgcaattaatatttttcaataggctttcaatagaaacaattcaaccccttaacagaaaggtttagtgaaatgggcagggctgcttggtatgtggactgttcattccattccgaaggccagtggtcagcctgctcctcttgttgaggggaaaggtactaggtgtattattgccagcgctgttttgcatatggcgaatgctcaacatcaaaattggcaccaggcagaaataggaaggtaaagaacataccacatctcttccaaattaatacatgagtttcattttcattagttgaagtatctaaaggtaaatcattggttccatgaatgaaaaagttcacttctgattcagattagcaaagccagctaccgcagatccttatttacatatgaagtagatgtttccagaagcacgtaaatgtttattttgttttcttcaggattttatgaatatgttttaaattacaatagtaacaggtgctcattgcaatcaatgtgaagtgtgcaaataaacatacacaccattgtaataatgtgggaataatatccccactttatccagtaacataaacccttaaaagtgtgtggacgcccagtatctttctacattttctccgtggttattcaggaaaggacatacacacatgcaatggtgggggcgggggacggtgtgttattagtttgactttacagaggagagtatacacagatgttacatggacattacatatatcaatcatatttagtttcacataatacattgtgaccgtctccctttaagccttttagatattttcatccagtttgtttaatgacataaatggttgacagtcaattcaaccattctctatccatagtcattcaagccacttctttttactttttattttatttatttatttttttattttttgagatggagtcttgctctgtcacccaggctgcagtgcagtagcgcagtcccggctcactgcaaactccacctcctgggttcacaccattctcctgtctcagcctcccaagtagctgggactacaggcgcccgccaccatgcccggctaatttctttgtatttttagtagagacggagtttcacgtgttagccaggatgatctcaatctcctgacctcgtgatccacccgccttggccgcccacagtggtgggattgcaggcatgagccactgcgcccagcccaagctacctctttttctattccctccacaaggagatagtaaaaatatttgcaaatacccttacgtgcaactacatccattctacacttaacattgccaaacatggaactgttggttcccttccagcatgcttgccagcactgccatgttttgctctattttgcaaattgcatagtgaaaaataacatctcaatttgttttagtttgtctctgcctttctcctattaatgatcaccgtctttcacatttttcatttagactttacctctttgaatttccagtatacatcttcctgtttgagatttttcttattttattatcagttcacacgtgagtgacacttgtttactaggataacctatgaatggttcagatgttacacgtgtatttcctgttttgacgattgatgttgctcagattccaccatacatttttaattacataggcaaatgtatctgtcttttctgatcattttagacgtcattttggattacaaaatccctgtcaagagcaagttttgttttgcactgtatcagtcagtttgggctgctataacaaaataccgtagactgggaggcttaagccacagacattcattttctcaaagttctggaggctggaagtccaagatcagggtgccaagaaagttaggttccggtgagggctttcttcttggcttacagatggccaccttctcccatgttttcacaagagagagacagagacagagagaaacagagagagagagaggaatagagcaatctctggtgtctcttcatataagggcatgaatcttatgaagggcccaccctcaggacctcatctaaacctaattacctctcaaaaggccccatttccacaaagcatcacattgggggttacggcttccacatatgaatttgagtggagaggacataatttagtccgtagcaagccccttgatacagggatgtcagttttatttgtcaagggctagaaaagcattttctggaagaaatttctttattgttccgtatgcttatcaatgccaatgagcgcgttttccacagttccatgaaagccagagttgaacagtagatccccatcaggataaatcctaaagttaatagaagattaattatcgtttcccctgaaattttcaccctgatacccttccctcctcaaaaaaaaaaaaagaaggaaaaaaaagatatcatgggcaaatgcttgggaacctgaatgttatcaaaatgcaaaatcaattcctcatttattgacttctatgaaactcaagggcaggtggtaggggcatagtttcaactgatatattgattgcagattttaaggaagtaattgtgtggaattcataaaacgatgatttaagtggcagaaacatacataaatcaggcctgtactattttacttttaggtaattgatagaacttccatgggtttctgtaattaaagtaaggacctaaattaatttacggcttcctttttcttctgcacaatacagaaaatgtcagtgggctggactcagttactagaaaggacacatacaggtcattttgttactgacacattggtgtaaagaattgtgtcttctttttccctcacttgccagtgtctgacagcttcttgctttcctcctagatatttttctactattttatggagggggtgcttaacaataactagctccgggactagggtaagcaagtgacgtgctcacttcaaagattaaaggggtatccaaatacctcataaatagcattttaatgcaatatttttaaaaatctaaagtaacagaaaaagatccatgattaacagaatatcaagacagaataagttttattcctttttccttttggagccttaagatcccatatggcttaatccagcactatttcaattttgatagtctgctcatcgtggatttaaaaaataatttgggtgttaaaagattgcattaaaacatgatctatctccattacagagttttttggtgtttcctcccttccaccccccacttaagttctgcaacgacagtgaacgcctgttaacctagttgcagccctgaaatcatgatgatatccataatcataagtagtggttattgggcactcactatatgtcaggcattgtgctaagcccttctcattagctttcttaagaaggaactataggacaggtatgattaattatgctaccttttctcaggaggaaatttaggcttgggggcgttaagaagcttgtccgagatcacccagctagatcagctttgaaccaagcctgtttaaatcccaagccgccttcttcactactctctcaacttaccccagaggctggaaacaggatggactccaagaaatggctgagcagggagtggtcacggggaacctctcagcagctgtccagcaactctatttgggccaaggctgtgctgtctcctccccatcccatcatgtttggagaggcagttttcccctctttgagatgtctggccagggcttagcaaaattattctgtaaaaggctggatgttattaatattttcagctttacaggccatctagcctctgttgcagcgactcaactcttgttatagcttgaaagtagccatagactactgtacatatagccatagacttctaggttgaaacatgaatgaataggcgtgactgtgttccaataaaactttatttacaaaaatggtctgtaggccagattgggcccaagcgccatagtttacccatctctttgtcaggccgtaattcttacttaaaaggacagaacatggtggctggctgcttgggggtggaaataaggaaaattcttttaagtgtgcaccctcatgtattttttgcattttgtaccattttatcacattttaaatgacgtgaagtagtacataaagataggtacccttctcctggtacctattaagatcaagatacaaattgatcttgatttaaatgatacaaaatgatcttgacttaaatttgatcaagatacaggaattgggtggttagttttgcttgcacaatgatcaaatctggtttcagaggcttaattctactgacattagtctaagacctgccccagtttccttgggcaaaatgtgaagactccattgtcttacccaggatcttctgtctgaactgtttccatttctatccccacactttcaacaatgctggctctaaaagatcctctgggctggacccttcccatcagggaatcagacactccttcttctcttttgctatggttcagcattacggtggcagcctacctgtgtcctctttgtcattttctcagagataattccttctagtttttagtcctttgatcggagagggggttgaaaggtgttacttcattcaaccaatctttattgaagttttttctatatgccaggtgcaattctacatcctgaaaatatgctgtgaagatactctcaagttggcttctattatacctatattcttggggggacacataacagacaaatatatataatgctaaggtttcagaatttcaaacgcagtgctcctaggggatatttgggaagtaacacccaacaggagacttattcactgttagcactgccattggggtgcctctcagtaggtgaattaagtgtccctattttcaccattcttcaacactgtagacaggtgccctttgctactgagaccctatttgcttcaccaaacccatggattgaggtgttttcagacacctactaggtgccatgctctccctgccacctcaatcatagcacttatctatttatgaacaatagttgcccacagcattgcagaattatccagctaccccccacccaccaatggtgaactccagagattattctttctccatcactgaagcaccatctctgcttttctccatctgctcaacttttcccatgtcccagcacatttgattaacagatgatttctaagaggcttttactagctctgatattaacttagttattccacctggatcacagtcctcagaataggttcatttgtatttttaatccctgcaaccactacccccaacttcttcatccgtgtgttgtttctttggctgtcataatcataacccactttgttgtttgtcctttttaaccaattccaagaaagaattaaaaccactagtagaacctctcacccccagttgtttaaagggaaagttctgcaaagaggcagccacatttcaggcagctgccatgcagctctctgtcattgctttcgttattaatctcaatgcagaatggtgattttcattttttcagatgggtgtctggctgcaaaaggccgccagttgcaaaaactaccatcccatggtgtgcccccaaacatcttatttgtcttgatatttctttcacagaaatacatatgacagataaggagtcactagaggatgcttttgctttgtgtcagacagatattaaaacaataaactatgttgccctgggattccaatgcatacacagccagagaacaaggccgagatgagatgtttcagaaaggcagtgaggcaattattctgggggaattccctggaaaccccaagtcctgtgatagcattgacagaaagtgttttttaatgctcacattttcttaagaggatcaactggctagtgcagctcctgcatttaactccttgacaaaactcaccctcatccggcctcatcagagtcaagagaaatccttcaatagtttgagaggcttattttgagagtttattttttaagcacttatctgccctttatttgcttccccaaactaatgtggatttacattaaaaaaaaaaaaaggaatccattttacattcagagctctgagcaggtaagttgcaggggccaacggcaagatcttgcttggttcttggaatgtaaaagaggacagtttgatgcaatggagcaggtgcacattcccaagggccccagctttataagttgagtcaagctctctctgggtctacagagctgggaaggaacagcttaggaagggagaggctgaatccaagggcactcataattcaagagctggagcaatcattctttcatcaaataccagtcttcttggatagaaatgtgtccaaccatagaggtggctgctgcttcttcccttgccttatttcttttctaaaataaatctcagtgcaaagaccatgaggagcagctcaggttgcctctcatccaagggaaaaagagcctggtgtagttcatataaacccagtaatgtaaacacgtgcttcaaacaccattttcttaaatcatgtttttatataaaagaactgtcatgccaaaagctatttatccctaatggagaacttcggagcactgttaagaaaatgcagtttcagaaccaaacaccacaccacatgttttagatttatctccttgagttttgtttgtatgcaacataggctcttgatgcctaatacttttcatatgaaagcaaacagaaaggcacaaccatctatgggtatttattatccctacccttactatttgctacaggagtctcaaacatttccagaagatcatttttcctttctctggcaagtcctaattcccactagtggttttacagcatttttcttgagctacagcgtgacttagtgaaaagagctggattcaggaaagtctgggagtaaactgtcacggtagactagtgctgtgaccttggccaagtctcctcgccatgtaaatagccatgactacctacctacccatgagcactaaatgagattgttgtgcagcgtcctccaggctgcttgaggcgttacagctcctcaaatgctactctttctttttctggctcagaagccaccttctccaggattttttaaagtccaccaaaccagatgtgatggtgtacttttatagtcctagctactggaagggctgaggtgggaggatgacttgagcccaggagtttgagattgcagtgatccatgaccacgccactgcactctagcctgggggagaccctgtctcaaaaaataaagttcaccaaagaagcgggtttggatggtttatattagtccagtgactggactggtggaccactcctggatggtagttccttagtctattctatatgggtgttttggaggctctggctcagatatcaggcagatgatccctaggctcagacagtacctgtcctccaggttggctttgggcattgatcaaaggatcaggactcttttttttaagtctgaaagctgatgctcaaaatcagatggcctcagcactgacacacagatcagctatccccacagctatggctgggactgaaatgaacaatgcatgtgcgtcgcgtacccatcttgtgagccaccgtcagacccctctgaaggcttcatgttcaggagctgcgtcagcccaagagaaccttgggaaatccagcccagcataaggaagctaatttatctcacttgccctgtttcctacctggagaggcaattcaccgagcttgctgtttcagccagctgttagatagaacatgaatgatttaacaattgaaacttcagtatgtatatgcactggataaagtaattatataaattatttgggttttttttttccgtggtttcccgggaaacaacaacatggttatcagtacagattttgttaaactaatagatgatgacgaactgctgcatccaaattaaaataaatctcagctcttcagggctttgtcttctccttcaaaggacagaaagcacctttgcaaatgccttttgcagttctgccaagttaaacactccaagactgagactcattctcattttgccgaatgttacaaaaatcctgcccggcgggggaaattgtcgatacctgtgagtaggcaaatcacaaatacctcttctgcatagtaaaaacatatcactacacatttagcagccatgacatttgccacttgtctgttggattaatctagccatttataacctgtgaggaaagatacaacagctaactttgggaggtaagcaggaacagcacgccaattagttaccaccaattctactgccttcgctcagagacacaaggaccttacatgatcaaagaatattcatgtgtgtgaatggtgtgtgtgtcttttgctgttgctttaatttgttaagttaggggaactttctcctttgggaacaccagactcgttgctcagagtaaatcccagtgtgctcattacatgtaattttattttcctagatgactatttttatttccacaaaaagaagacttatttcaaaaacccaagttgtaatgtgatatttgataacatattaaaaaagcaattatatatagaaaaacgtgcaatagcccaaaatgttatgaaggtttcttatgcagatcttccaaggctttgaaataagtttctcattccagtcttccaaattagaaatttctagctgaatttagttgtaaggagctcatcattgtgacagtaatcaggtttgtgttcatctgcagcctttactcacactgtactagtacaaacctgctcactaactctacagaatctgcattcccaatatttttgggttgaacacaacctccccctcacatcgagatgtagaggtaaaccctagtggcaaagggaaacagcctgcctttgaactcttaccaggaacataaatcagtggtgatccctatggccggcatccaattagcagaaaaggaacagggcctttccaggtgtcttgaaatctcagaacttaagtatctaacagaagaaatggcgggcacacacacagaccctctaatgtctcccctatcccccaacaagaagcatattgagatctctgggaggactgtcaacagattcccctgcaaattaacccagtctatgatgaattggggctggctctgtctcagatgtggtatggatatagggagatgatgtagcagcttgtacaggcaataggagggaatccaaactgagagtctctaagaagcagagagagagtagaagtagaaagcttttcccggagcctgactggggttgcctttatgttgcatgatggataaaatcataggctttggtgtcaggctgccttggttcaaaccgctgggtgagtatctgagccactctatacctccatctccaccccaggaaagtgaagatagcaacaatcatggttcatatggttttgtgaggcgttagtgggttaatctccgggtctggcaattagcaagtgctagtaaatcctagctgttatcatcatgcaattgaattttctccacctgataatggagcctcagaggttggaattttgccaactgcaatcacatcgttccttgaattactccagttatcactgcctgggtttttagacaagggaggtccaggatcccttatcactaactccatcaccccagagtttctgtgggaatatgcatccctcacaggccgctccttagcaactctcacccgtttgaggattgccacccattttctttcgtaactgtaggactatggcattccgagttcatcacacaccgtagtcaatacacatatcagtgatcaccttgtgctcggtcatcttctagatgttggagacacagtagggaccaacatagagtcctcaggacatccctatagagagatgtataaggaagttgaaatcaactcaggtgataagaaactaatgggaaggaaaaagaaaacaacagggtaatatgatggtaactggtaacagttgtgggtgtcaggagatgtgaaattagataaagaggtaaagcctttggagggagcgatgtttgaactgagaactgaatttgggagtcaagttcactgttagagcctggacaaaggagagagaatctgccaaaagccactgaaatacagccaagtgaggctggagaaaaaagagacattttagcctcttacaatcttattcccgaagtctagctgaagtcgagatttagatcaatatattcagcttggacaatcaggccagcacgttgtcaccatcttttttttccctttcaaaaatgtgcatttctctccaagttcacattcttgccaattccttcgatgcatcccaatcagacctataacagcctagaaacttctggctaatttggatttgactaaaacttttctaccatgacgttatgtaaagagattcaattatggtgcgcagtgttttgtgagtaactaccacccataaaaagttaattaatcagggctgtgtcaatttcctcgtgccatgtcaatttgctgcaaggtaattaatcactaatcacccaccaagcagcaggctgagggacaatccctgagtcatttattgtctttccccaaataaatggcacacgcagccaggaagaaacacatcttgcctttcataatatttttatcgacacttttgcatgttgtaatagactgcagcaacaagcagctgcagttcaatggaatatgaatattaaagaaacaaatgagcagagatttataggacattgcgtttctgtaatgtcagtgttgagattaaaccaagcaaatgaacagtgaaaaattactcttccatgtggagcatggtgattagacttgtacattaattagaaatttttgttttcctattcaatgcatttcaaatgagaatgtcctagaagaaactgtttgtccaaaatgtagatttattcacttctaaacagcagtatttaatatcaacatgcatttcatactgaaacaagggtcaatcccaaatgtgtgtttcagggataaatgtatgtgtatatgagaactggagattcgacaaattaagtggccgttttggtctttctatcagtgaccgaaaggatggaagctttctcccccacccaccacccacccaccttttttttttttctgcgaaactctgaaattactggatttttttaaaaaaagaaaaacctttccatttttgtttggagctagaacttaataagtgccatcatgttaaaattttaatttaaggccatttaaagagagtgacctagttgtctgtaaaatcctatgttataaaccaatttgatgtacttttgagattcgttctgaaaaaggagaaaacatattttgccatttggaaaaaatcaggttttttgattcttcattgtgatgttcattgcacgatgccctgcctcggaaattgctgctctatgagctatggctggtggtttatttcgcctcagtatgttacctattatgccacttcttaatttatggtccagcacatggaatgggagttcccccaaggggaatcctgcaaaaccatcaacccgctgttgaaagcacatctgcacccccagaattgtgtaagtgaatatttcctaccataaattacccacagaacaatttcaccccaaatttgcatgaatctctctccatcttaaaaccttccaaggctggggaaatgtgtcattatggagcaaagggagaggaggagcaggacaaagagagcccccctcatccattcggatgcccaccttttccagggcatctggcagtctcatgcaaattcaaaccagtgcacaaatgcaaagaataattgcccattaaagcggttgtatatttttatggctttggtgcagaatccgcccccctgtcgggttttgcatctgctactcttccatctcccccagagctctaaaactttaatatgcagtttataaccctcaagtattttccactggttttgtgttttttctcttgggatttcctggctggtgagatgatctcatttgtgtttattttcgaaggtaagcaccatgttcgtaaaagagggagagaagacacactcatcactgtaaatacattgagtgcagggctcattggaggtgggaggtgggggctttgtttttgagggggagacaggcagttagcagttgacactttagtaaatggcccatttggctggtggatacacccacacatcttccgttctaaaatgttgatttgccgtgatacttgagcaccaccacagcgtgcctcttgttacatccctaaagcttccatttcatcgagttccatgggacagaacttcttattcccaagaactgagatggttactctactaacctcccccagaatatgctctgtatataaatctagctgaagggtgagagtgggtgggctggaaattctcatgtgtcaacaagatgctcaattggtattttctctgaaagctcttgcctgttttgagagaaattcatttttagcttatgagctgaatccaatttgtgttgtagtgataccagatttttctctttgattcatgctggataaggcttcagaaggaatctcttcagtataatgaacctatgggttttcttgtttccctcatgccaaaaactaaggatttatactatatccacaaatcaacctgcgtcctttccattgttccttattgatggtctgcttacatgtgagttaacttgaaattgaactaggaaaaaaaaaaaaaaagcaaacttgcagtgctggggtttagaaatgaccattgtttggtgtctttttcccctaacattgttttttaattaacaaagaggcatttacaaatactggatagggtgatgtttgacttttaacattgatttaaatattttatttcatattctagaaatggagagaacattgtgagtttccactgggcattttgcattggctttattaaatagtcattcattgcccacttactggatctagacttctaagccagggtatttggcatgtctggatccagacatctaaactaggatagatgacataactctcactcaacaaaatataagtgccatacctcaaagtaaacatgtaagaggttctctttctatgtggtcaaaaaacagttttagtcttgtttaatttgtgtctgaatcatctgtccaggtaatcatctcaaatatacattttaccatgttccagaatcctacagaccaccacacctgtaggcaaataataaaagcatccattcttccacactgtgctgggttttttaaaggaagtgtggcaaacagttgtgtgtgtgcatgtgtgtattttgcccttgaaatggattattcgtgttagtggcatgcgaagaagccatgttgtccctaaaccaacaattgaggaaaaaattatttatttatttattttttttgagactgagtcttggtctgtcacccaggctggagtgcattggcgcgatttctgctcactgcaacctcctctacctctcctgggttcaagcgattctcctgcctcagcctcccaagtagctgggactacagatgcataccaccacacccagctaatttttgtatttttagtagagacggggttacatcatgtttcccaggatgatcttgatctcttgaccttgtgatctgcccaccttggcctcccaaagtgttgggattacaggtgtgagacactgtgcctgaccaggaaaattcttctaataaagatgggaagaaacacagaaggcacagtcataagtcagaagagtttggaattatcaagattgttattttctattgttcctggttgcacataattattttattcagggactgttgttgctgggttgtcagagagcatggtctggggctatatggaagggtgagatgtgatgaagaccctttaataggtgttacctgtctggggccaaaactggagtcccgcttttcccctgaacaagaaacaattttaaatcctgatagtgtgctgccatcgaggagaatttaaatgaattgagggctctgacaattccaagtgcaacaaacttggtccaagcagcctccccttgcttgattgaaatcatactctttcaaaatctggttactttttccgagacagtgaaaaacgtacaagggtagaagtggaaattatctttctagggattgtgactaagtttcagttgtgttacaggaaaagggttcctatccagaccctaagagaggattcttggatcttgtgcaaaaaaagaattcggggccagtccacagtgcaaagcaaaaggaagcttataaagaaagtaaaatggggaaagtacagctactccatagacagtaggatgttcccaaaagtaagaggaggagcatgtccaccccttggtataatacttgtttatataggataaaaaaaaataagatcatggggaaatgtgctctgctacaagggtttgtgataaaggattaattttcttaattactatattttgcaagaatcaatattatctttaaagcaaatttaggaatgcttctgttcacaagatattgggatatcaggacactcctaaagtctgggtctgtttagtaaacataatcaatctgtttccttaaccacaaacatctagaggccaggaatacctaactttctggaaatgtagtccagcatgtcttggcctcatttttcctagccttcacttacgatggagtcgctgtggttcgaacacctctaatggttgtgttgcttgcatgctgtttatctgcaaattctgagcaggtcactttgtacacaggacagtgttatagaaggtggacagtgaagaggtggtggctgtactctcccagaaggaagacaaacattggttaaccactgacagggtgtccaggcacagtattaggtacctgatacctgcttggtaccagttactcatcctaactgatgagcagaacgtggagatcaccacccttacgcagcttgcatgcacgcaccagtaagcgtccttctccttcatttctgtgactcaagctaatgatttttacatgaaccaggggaggaacagggcagccctctttagaaaaaaaattccaaagtgactgaaaggaaggattgtaatgaaggcaggaattaataaagaaatgaagggagaggagaggaagaagagggagaggaagaagagcgaggggagaaaggaaaaggaggagggaagacaaaaggaagaaagagggagggaaggacaggagggagggaagacaaaaggaaggaagaaaaagggaggggagaaggaataaaaaaggagcaagtataagaaggaaggaaggaatgtaagaaagaaaggaatgtgatcgatgagcatttttctaactagagatttcacgaaagggccccttggccagccctagattaacaagaaagagaccactgaaaataccaaccacccaggacacttgaatcctccagccctttctccatgaagcctctggcccaaagcatgacctgtggaactctcttttttttttttttttggccaagggtacctagccttccaggaaggcactatttaagccaggaattgattttcagtccttcctgtgttcttttcacaaaataagaagtcccccaatgtgccctgcttgggagagcccaaagaacctcctaggaagccttgtaaatatcctgcctcaggaaatccattttctccctgtaatgaagagggtacaaaatggaatcctggctccacgctcttaacagcacgtgctcccctctctctctcttgccaagcttctgtttcatgttatatctcaacatctaaatcctccaagaattattgtaaaagctgcttgtggctgagagggagcttgtctggctcactcggctccatagccagtgacaatgaatgggtcagcataattaccgtgtttcctcacacaggcagccagctgctctgccagattgtgaatttttcattttctttatttcaaaatccagggtgttcctctgaaaacttaatagttgaactgtggcaagacagatttggagtcaaggccattcccactcattttctccccagtcctgaagcaagcgtctcatctctcattacttatgggcttttatgatattaggatttactcgtgttccccattaagaccccacacgtctctgcggtttcaagcataccagttgccacgtgatccaagaaactcaggtgctaggagctggcaaaaaaagttaaataaaatggcatgatctatctttagcaagaataaaaaaagttaaaaataacctttatggtcttctcagatacaaatagaaagacggaatcattctgggttctacaatcctcgtattttacccgcattgtgatagaaagatgcggtagaatccatagaacaggacggctgtgggacctttaagaacacacagaattccagataatagccatttggtcttcactttggtcgggttcgggggttttatttgggcccttaaaattgcaagagtaatttggaatggctgctgtggcaaaccccacccgctcccttcacccaccatgtaagtacaaacataccctatctatgggtgtaggtgtaattcttggagttctaagtgcactacatggtcaccccgtccaacctccttggtcgcagccagggcctccagtgaggcttctcatgcacattttttccttccaattcttttgccttttgctccttctgcaaccctcacctgggtccatgcatcagtgtatgtggaaaggactctgaataatggggagacataaggtggaacgcttctactcctgaagctgatagcgggaagggaagaagctcttcttggcagtttggatagagggtggagacaactttaacatgaaatgaactacaacccctgccccttgagaggtttgctcttctgcagaaagcctggaaaaggagttggttgtgctgggttaactaagagcatttccttcatggtgggccttttgagcctttgctgtggctctcctgggacagggacttaccaaatgcattttttcagaaaagcattctctgtggacacagtttgggaaacaatacctgctgcttagtgagatgggacaagcgtagtgagtatggtgagagcactgggagggttagagaagcgaactgagcttgaaggaaaagtggtttgctgactctgtgggccctgatgagttaggatttgcatgagaagggaggaagggcatcccaggtagaggaaacagtgttggttatcaggggacaggggtaaccggggtaaccatcaggcatcctctgcggacacagtttgggaaacattgcctgctacttagtgagatgggacaagtgtggtcattatgctcagagcactgggagagtcagagaagccaactgaacttaaaggcaaaagtggtttcctggccccatgggccctgatgagttagttaggatttgcatgaaatgggaggaagggaatcccagatagaggaaacagcagtagttatcagggggctggggtaatcatcaggcttaattccccttcctaactcctcctcacctcctcatcttgctcagagaattttacccaagggaagatatccccgcccacattcttcttcttatttgagaaaaagtcttgctgtgtcactcaggctggaatgcagtggtgccatctcgactcactgcaacctccacctcccaggttcaagcaattctcctgcctcagcctcccaagtagcgggaattataggcatgcgccaccacgcctgaccaatttttgtatttttagtagagatggggtttcaccgtattggccaggctggtctcgaactcctgacctcatgatccacctgcctcagcctcccaaagtgctgggattacaggcatgagccaccgcgcccagcccccacattctctttttaagggtcggggtcccagacttatcgcgtatttgtaatcatgctggttgcctttgcctttaaatgctgcacaggagttcagcagacttatcagatgttggtaataagctgtttctcatggcatgtgtggtttgtgcactcataccacatacatgtgtcagtgggaatacttcaattagaagttttaagaagtgatatctgtacatgaaggaaactggaaaaataggatgggggaaagttatgaataaaaaccactcatgcagttcggccccagagattgctagcatgtggaaagttgtgtgtatgtgtatacaaatatgttcatatcagcatatgtacatatatgtatatatacatgcacacattcatacacatgtacacatgcatatacacatatgtgtattttgcatgcaaatacacctgtacatatatacataggtatatgattgataagacatgacacatcttgcaatctgcccttttaaaaatatgtttgtgggttgggcgtggttggtccataactgtaatctcagcactttgggaggtggagacaggaggactgcttgaacccaggacttcaagaccagccggggcaacaaagggagatccccatctctacaaaacatgaaaaaattagccaggtgtggtagcacacttctatctatggtcccagctacttgggaggctgaggtaggaggatcacttgagccctggaagtcgagggtgcagtgagccgtgattgcaccactgcactccagcctgggtgacagagccagtccctgtctcaaataaactcattaattaaatactcatgcagtgagcttttctcccgttatatagaattatttgcaaatgtttgtcagtcaccacattctcctgggcaaagggcccactgtgttaactactcatcctctctggagtcccaccctggccaccgtgctgctctctgctttttaacctcttgattccgggaagcgggcgggggtcctgctgggaccctgtgcagggacaagggttcccggggcagttccctccacagcagggtgtgcatctgacagcctgtgctctctctctctctctcctcttgccccgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcgggtaagtggggcagcctcctgggtgggcctccctgcaccagccctccctccccagaggcacggagctgtttgcgagcgcatgatggtcttgactccccctccgccacccccagaaccgcccccagcatgcagcccggccgcgcacctgcagtggagcaccttgctaagagtattgaaaaatgagtgtaatttgtcctgtcatggttggtgcctttaagcattctacatgtcacatgttgttatgtaaattctctttgagactgaatgctggagaacagagaaatggttacagccaaagatgtatttctgatgattgcaaacatctggttattaaggaggttggaccacatttgccccttgaattcctccacagaaagaagtgaggttttcatacataaaaatcactggggtcgtcttgctcgcctccccagggatatcttggcttcaagggtcacgaacctttgcctgcaaagagaaaattaggtgttgagtcacatgcaaacatacaagaattaatgaaattggagttaagatgcgttgcagttgcgttttccaaaatggcatttgccttcctttctcctctgtgggaacaatgcagattagtttgtttcccattgccaatttggtccttctctgcacagactttgatattgccaggcgaatgtcaaggaatggtgtgaatgctcagtaaaagaaaaaaaaaaatgatactggtgtgtttggtggcagtcttgaaatgctagtctgtccctcttttaaggctcctgctagaatattcttgcacctctgcagccagggagaaagggatacctccaaggcagtggccctagaccaggggacatttgcaaggtctagagacatttttggttgtcacaacaggaatggagagatgctatgtcctctattgggtagagtctagggatgttgtttgacagcccccaacaagaaagaattatcagactcaaagtcagtcatgctgcagctgagaaaccctgctctatgttaaattcagcgatccccagaaagcctggcactaggcttccctggccagtgactggctttctggtgtgtagaagaaaatatggctgcatttaagactgtgtgaaaagggttaaatgcccttttcatagctctgttgcttgtaaatctttcagaaaatctacattagcctagatcatctattatactcatgacaaaaagaaacactttttttcattacatattcattctaaaccagagcatttgaaatgtttgtttcaaaaataaatgcaataaagttaatggtaaaaagaaatgagagtaggtaaaaccatcagagaagggaaagttaaggaaaagtagtaagacaaagtccatcaaatttcttgtgtagtcatttgaattgggtcaactttgagcttcttggacaaaacaagagctctctctatgcatacacatattttaactgaaaagacggtggatagtaacaaaccaagaatgaactggctataaattctccctaatgcctgtcaaatgtatttgtatgtcttaagccttttatgtgaccatgcaatataaggagttgtcgatagtataatttttatctctggtatcacagcaatgagcccattttatggatccagaaatgtaaaaataaagatttgttattcccaagatcatgtaatgagttatgaaggaaaaagaaaatcccaagttacctttgggctcatgtaattactaaagcaagatttgtatgctataaatccaaaattgcacttataccacattcgtttgaaaattgttctcagtacatgggagttgaagggttttagtatatctaccatcagtatctcactactatattgaagagcaaaagaaacaatagaggaaaattatatggtttatcctcacatgaccaatttataaacatctcagaatgacacacctgctgtaaaatcaaaattaaattagctaacttataatgaacatgctctttgctgggaataaccatgcataactaattaatgccatgtttcaccagggagagacacaggcatttccaaatgatgaaacaatgtgtttgtaactacttgggatgaaaattaattttaatattccagcaatatctgtgatcagtttggttatagtggtggattgtacctccttgctgataatagtatggctggcattctaaagccatacttggaagcaagatcaaattctcagcagagaagcaggagccccagcaggactaagattgcaagcattcatgtctgcaataacctattagagcaaggtactggtcaaaaagaaggaaattcgtcttgttgcctgggtgtttcactggattacagactcctgggaatgaattggcacggaatgaaaaactttgaggccaccatcttagaggtttccttttcctctggaataaacagattaggttgcaggagatggcaaggggatggctcctcttggaaaggaagagagcagagtgggacccagggcaggagctggctggaagagcaagaacccctatcttgtgttcagggagagcaagaacccctatgttgtgttcagggaaagcaagtagcatagaggttagaaatacttgttttcagaaagtaacatcatcaggattcaggtggtccagagagcagatttcctgtagccttttatctctaaattcctttggaggaaaactaagatttgactgacgtctttaccccagcccagtgcagctcaccctatgactcacacctattgtgttttaggcactgttgtgtgctgaagagacaaatggcaccttgagaggtatttcttctggttggggcagggggtgacatacaagccaacaatttcaataaatgtgataagtgatacaagaggatattgtgtgaacactagggaaaggtccttagcccagcttgggtgtttacagaaggcatcccagaagagaagaaatatggggtatatataagtccaaacatttcctaaattgccacagtgaaatcttatcctgtgacccctcctccacccacacccccagcaatctccatcttttctaagatgtcacctaacaaactacatttaagaatttgtttccactgtcaccaattgaaggcatatctgccaacctaaatctgttcttcctgaagtatccaatatgaatctatattgttactaaaataccagtcaaaaaggtgtcctaggtccatgcatggcttccacattttcttcctcctgggagattgaagaaaatatcctttaggatctccatggctacctttatggaagcttgggtaacccttggagatatccaacataaagatagtcacaccagtagagtccctaaggatgccctacattcatccatttccttttaaaaaaaattttttttgagacggagtcttactctgtcacccaggcttgagtgcaatggcacgatctcgactcactgcaacctccacctcctgggttcaagtgattctcccacctcagcctcctaagtagctgggattacaggtgcccgccaccacacctggctaatttttgcatttttaatagagatggggtttcaccattttggccaggctggtcttgaactcctgacctcaggtgatccgcccatctgggcctcccaaagtgctgggattataggcgtgggccactgcgcacagacattcatcaatttccttttattgatttgccttttccttccatgtcttgatattttctgaagcccttccatgcagctgaagaacatcggttatgaagaggcccttttttgtctcacatgcctaaatagaaacctcttgggacattaacacatgatcattcctccaggggtagggaaagttgtggaccatggtgggatcataggtacaagtggaaaaccctgtaccaaaccaaccaactcccaattgattgccaacatcaattgaatgagactgaagagttagaaagtaatgtctacatagcctatggaattttatagtcctaggaagacactggatttaaggtaaataagactgggccccaatattctacccatactggcttggatagcttacttaacgtctatagacacagtttgcttaagcgagagtgggggatatatctgcccccatagagtcgatagagggtgaagcagggaaatccatgtaaggtgacaacttggtccatcttatgacatgcattcagtgaactgtacctactgttctccaggttgatgaacttagcgactttattaaccacccacagtcttctttctcaacatcccccttttgcttgtggttgagtacaaaagaagatcccatgtctctccctctatgcattatttatctttgctagggggcacttgcagtttcacagacctccatttccttcaagccacagaaatggttgaggcacttgcattgcttatggaatatgtagattgaaaatacaatattgagtagggaacagtcacagagcagagtagagttttccttatttctccttgcatttgatcctggactcaatttgactgagaagccacaatgcccagtctagcttcctatgactcacatttgggaggaattacccatcaggtaattgctgttcagggagctcacaagctgattatctgtgcatcaagacagcaagtggaggctttggagacaaaccctgtagacttagtatctttgatgttagaaaacagcagctaaatcccaatcccctccctcaaagaggaactcgatgagtacctattaggtaccgtgcatatttcatgtgagtacaatggggtgctctaatggagcatcacatgagttatttttgagatggagtcttgctctgtcacccaggctgaaatgcagtggtacaatctctgctcactgcaacctcctcctcctgggttcaagcaattctcctgtcttcagcttcccaggtagctgggattataggcacatgccaccacacccagctaattttgtatttttagtagagacagggtttcaccatattggccaggctgctctcaaactcctgacctcaagtgatctgcccacctcagcctcccaaagtgctgggattacaggcatgtgccaccgccccctggccatgtttttattattattctaagcctaagcatctagtgtcagctgtaggcttttggtcttgttctctaggtatctctgagtaagattttctgccctttctcaggtaattgtcatacatctgtgtaaacttcccagagttaccttgagaagtatttgagaagactctatattatttggggtataggaaagatagagcagtatcccaggagaaaacttaaagctggtcagtggaagaacaaatagatcctttggaaatgttttcacgttaagtcctaaaaaagtctccaacaacagtctctgggactatgggcatatctttctgtgtacagatcagccatgctttctggttttatcttctaaatatctaaatccgcaacctgtagtatctgatgcttaggaactgtatttagtataaatactaggaacaaaagtcatcattacccattctcagaatactttagacacaggggcgtccaatcttttggtttccctgggacacactgaaagaattgacttggaccacacataaagtacacatacactaactacagctgatgagcaaaaaaagaaaaaagaaaaaaaagaatctcataatgttttaagaaagttaatggatttgtgttggggctgcattcaaagttgtcctgggccacatgcagcatatgggctgcggtttggacaagctgcctttgcagaattctttttataaagtgtgacttcttatttgctagttttaaaatgtaatccaaacagcctctgaatagcatgaacttatagacaaacatgatgaataagtggtctttaaagcctttttttggaggggagaatgtgaaaagacattttcacagatgcctttaataatctgattaaaaattctctaggaaaatacgtacaaacagcacacacacacacccaaattctatacacatgccagctagtttctgatccccccaatatccattaaaaaatagcggtatttgaacaccttaaaaagtttattttctagttggaaggggcctcagggtagaacaattgtaaacagccttttctataagaatatacttgtggctggtatatatcatattacacgagcagattgtatagtttgggcattttatactttttttttaaagtaaactaattttctgtagtgcagtcactccctgctcgcattcattcaaatatttaactactggtattacttttctaagaaaataagatgtgcatttgcattatgtccttgcaaaagcacattgagtcccgatgtgattgacaaacaatacaagtacctttgcatggctagacggaccatctctgcattgaaatatgactgcgcctgtttagtgcgcaatggtaactcccttctctcctaactgttccgtggttaatttatctatagctgcaccgcagacatggatccctgtgcctctttccctgcatatcttatattttaagtgcagctgtttgatgaggctttacaaattatttggatacatttttggaaactagcatgaggctttgtgatgagaactttcccgtaaccagctcctccattagaatataacctaggaggctgaccttcagttttgtctcaaatgtaaagtaaaataacacttggaggatggtgttgcatagagctatgattctcatattcctgggaccaatagcatccgcatcatctgttaacttgttagaaatgtaagctcttagatgctgtcatccggatctattcaatcagaacctgttggctgggcatggggcccagccatctgtgtttcaaaagtcctccaggtgattctgctacacattcaagtttgaccaccactgcctgccatagtacttaagagtttgcactgtggagccggaccccctgggctcaaatcccagttcagacaatacccaactctctttcagtttctacatgtctaaagaggcaatgatcatattgtccatctcatgggggtattctaaggactgagtgggatcatgagcacagaaaggctagactagggactgatccatggtaagtgttctgcaaatgtgagtagtgggagtaatggtgctcgtgctgttactattagggagaaaaacaatgttttggtaaaattggcttcccattacatggctttatttcacactgccggtgaggatggctacattgcttccacattttttagagttatcctaaagatagatcactcgtcctttccatttctctccaatacatgtgcactttgaaaacaagtaatcccttcatgatggggtttataatggcagctacaatcatctttttgctgtgaagccaccatatttagaccctaatgcttatacgtttccccccagccctccaagaagccagagcgtgggtcttccagccataggtcttgccttgcagtaccctcaccccaccaccctttgccttgacagcacttcactcctctctaccgagccaaggctttgaggtttctgtgccatttgcttagcctctctcgtctctgctgctggccctgcctccttccgttccacattcagggcacctctgttgctgtctcctgcagtatctatctcagctgtgattctacagttttatgcataatttgtgactgtgtgtcccacttcctgtacactctgggagggcagggttactgagggggctttcttcttcggtcttcatgccttcgcatagtagttggggtacaggaaagctttcagtcacagagaaatagtatgtatttggcttgtttgagcttttcacaatgagaaagctacactagttcttctttggttcagtgtttcatcaatgtaggatgtcagcaacacccaagtaactttccatagcccacagtggaggacaaagcatggcaatcaggttaccctactgagcagagactcctaagagcaaacatcccggcatgttctttcctcacctctgggcaatgttggtacaaataggcttgacatggaggcacaaaactggccatggtgcataacaacttgtcttaatgaaagaagggatcagtttcttggccagagctcagcctcagccatatcaaagaaccccaactcttggcccacacccatgccatgtgccccgttggaacagcctccaaggcctgggatcaattcttctctccgtcatttacagaagatcagagacagatgaggttccaccattgagatctttagaagtcattatttcccatatttaaaagtatgtttcatatctcatgaaaaatacattgtttacttctagactgctgtctagtctcttgccctggtctcctaattcaggttcgagtctgttaatcgtatttctcctccattgacaacagccactgatactgaatagccaaatcagagacaaacctcagactcctcccgacccattattgaattctacctggagttggtaaagcaatgactcaatctccttctgacgccttctcatgcccacccttccctctaaaatatgaaccctattcacccagttattgtccatcttctaggtaacaagcagtgtgtcaggaactgagaatagaatgttagttaagccacagggtgtagcttttaaggtgcaacgagtcacatgcacacagacctttaatgtgaggcagaaattgacgagtggctctgataagagtctgaaaaatgatgctggtgttcataatgggaaaagtcacccagctgcaggtgggcaccgggtctcaaacatggtgacctcgttagagctacagtgttaagcatgatgccacccatccctttgcaagcattatcttacgaaaccctttcttgaggtaggcacttacctattttccctttttaacagatgagtaagtgaggttcagatgtctcaagtaatatgtgcaaaggcactgcactgttgattgaggatgctgcagtctgattcaaatgcccatgtgcttcccatctaacttggctcttgaatggtcatgtcactgcttttggatgaggatactagaataaagggcattgccagcacaaggcattgcacgtgcaagggcatggcagcatgaaagaatgggatggagcggttttgatatggctaagtgatcagtcctgtggtttgggacccaaactaaatatctgttgctccctctctttcatcagaccttggcagagggtggctctgccttctgaccccccaaccgacattctctatgttggaaaagttgaaaaagaattcaaagcatagctcaggacgatgcacacctcagcatcttggattagggctttatgccacttcacaagcgctcttgtgaactgtagccctcccggatcaaatatgaacaacagctgaaagctattcctaccaacctccttagtgtgtgaaatccctgccacatttttaaggacaatggtacttggagtttagtcaatcaactctgaaatactctaagcagcacactagagtgttctccagcaaaccagtgtcacagctgcgtgtgtgtgtcagtacagcgtgtgtgtgtgtgtgtgtgtgtgtgtgttgtaaaatgccttcccttggctcaatatgctttgcttacatgtgggttcattctgctacagaaacctgctggaatcctttggtattaaagttgtgtttctattagaacctcagcttcattcaatggtggggctcattggtcctttgccagaatcataagtcatctagaaacatcatgggaaggtatcggggaagattgtaaataactatgatccttttaaaaataggcatttagaaacagcttcatatgcaagatgccttgtgatccttacaaaaacctgtgaaggctacatatgattctcgttaaactcgttttcatgcttaggaaatacaaatcagtttctcacgaccacgtagctaagagcttcttttcctggttgttttactcaaagcataccaaaaagcttctggggaatcattccctaacccctgtccccagccctctgaagtctcttctttctgggatggtcactacatgggtggcaatcagagagctgctatcagattgggcttgttcaatcaaggtgtgggtctttgtttagtctagatataatttacgtgaacatgcagatattcacatgtatacacccttgtacatataagtacacaaatacatataaataagtatacacatgcatatatacatgtttacatacgtgtatacactatagacaaatacatgcattcctgcacttgtccatattaacacacacaaatatgcacacaatgcacttgtacacatgaagacatgtctgcacagaaaacacattcttgcacatgtacccatgctcacccacatactattagagatattctccattaaccataaaataatgcacgtgcaattaccaaatataatacaatgtgaaagaatatagaagaaaatttttgaaaccatatgtgttgtccacctcacctaaggccattcagctctagcccatactgagaatgctgcaatctgtgtgtcgacctttacaatccgatttttaaatagatgttttgggtttttattctgtggggtagggggctatgtggtttgattgccaactctgacctgttaagatgctcatgtctgtctgggccacttaaatctcagtcctctttgcatttcaaagtcgtgcctttctgtacccactcctgagagagtgggaagtttgggacctagcacaccgccaccaccacatcctaattctgggccaacaccaaagcccggcctaattttctcggtttgctcaactgccgttgtctccaacctccttaatccaatgtgaaaacgatcctcggttcctgtgttttggatcttgtgaccagactaacctcgccagtgcaggggttggtgtgtctgcatgggaaatgcactaatatggatgtttctctttgtgtgtgcacccttgcagtgttgtttaccaggatggattttatggtgcagacatttatgtaagtattcattcacgtgcatgccatccccgtttcctcctggagtcattctttttacaagtttgctgtgaatttctctacttggcgtagttgagtttctctccttggtctgtaggaaataattccgtggtttgtcttgcaggacagaaagccttctgctcttgaacttgtggcagacatcactggctgtttagtggggtggaattaacccctcgatcaacttcagaacgaatgcaattcccccaaaaaggtggcatttctttcatgccaactaaagaccccacttcacccacaaagaaattgtctctcaagttctcgatatgttcttcgttttcagtataatatttaggataacagctgtagtcaccagctgcagagggttaaaagatattttcatggctgctatttttgatgttttccctaaaatatcacagtagccttaggaacactctttctctctctagacatggacaagtttagccctaaacatctcctgattctcttaatatgtatgtcaaattgaacattgagcccccattttctttaaccttttattccatttcccccaattacctgacttaaaattgcttgctaaatagtaacactttaagtttatttttagaaaagagtaggctatttctcattatgagaacaagaatttaactatgttcatctagaggtagttattctccgacattatgatatgagcattgacgatatgaaaatgacttggagtaaacacaattttgaataagtaggcagtgttgggagatattccctaaatcacaatttttattacaaaagacctcagtcaatgggattatatttgttttacagactagatagcaaaaaaatcatatttctgatgaaattggtatcatgtactagaagatgaataaggcactgattattgtattccttttgaatttcaaatcattacaattttgagatatagtatgtatctccatcaataatagacttagttgagttctactattgcatcaagtatacttactataatctgtgggttagtattttttcccccgtaataaaatgagtgaacaacccatatgtcctaattcactcagtgatcaattttcttcttttttgtggaacttaagcttttctgtctcatgtcctcttttttcagactttcagattttaaattatgaggcaggctggggctgagcagtctgaagcccattcatttcctcaggcacctgctaaacccaatcaccagtcctggctctcgactccatgcagcccatgggtagattattgcagatgggaggagccagaatggtagttggcatcgcagaatttagggctttagaaatgaaagggaatagacaagggatagagaaatggttttttaaaaaatccaccaaaatggaaactatctccagcaacacctacccaagaaaaaaaaaatgcagattttcctgagtttagttaaaagtatttcacaatcatttagtgagtgtccacctcttcacgcctcagtttcttcaaactgacaataatttattgaatcattaatgtgtggtgtcttatgcagatatcaaattggtgtcttcttggcctcagattcttgagtagcaggaaggagaggctgcctgaaggcagggtctgtggagctcccacaaataaggaaaaagaagggactcatttaagtgagtgcgagtgtgtgtctgtatcgattggggcatatcgctgcatcagagaatccacagagcaatgcaaatagagaaaaaacaaagttagaagaaggaaatatgccaaccacttgactagagaggaaaaagaaaatttattcagggaagaaagccacagaagtgtccctttgtgcttttctagttcctttaggagattttgtctctcacacattcatcatgtttgggccaagcccactgggtgcagcggtgcagctcgggaagcatcagggtgagcttcaaggacagagtttcttccagtcctaagttgtctgatatgtttgttcataaaactgccctttctctgacttttcaggccacgacccccagccagaaattatcgttttccccactctttatattataatgacaataagatttttcagtgggggagcatcacatatgcaatcaggtggcagaaaaagttcctgcaatatgaatttagagatttgattacccagcacatgtttctgtcctgtctctaacagtctctggaatctggtagaccttcctgaatattttgctttgtctgatgatgactttaacatattgctgctggtgtgcatccgtgtgtatactggacagcaggaaactagcctgtgccactgcccagctcagcagcagaacaagaggtctttgatgaccataagtttaagaaatataaatatgttctgcaccacagaatatacagaacaagattcatcctagctagaaatatatcataatcttgaatgtgctttttaaagccactaccctacctcccttgagataccagcatgttctgatgagtggaaatatccccaagcttcgtttttaaaagagatgatggttaaacagactcttagaaagtcatgtgagcttctactttaaagaaagattttggcttactccttcaagctcgttaaaagtagtacacaataaataggtttagggcaattgtcaacggccccgggatatatgttagacacatcagatacctcgaatagatttaaacctctttttgttattattatattttttgagacagactcactgtgtcgcccaggctggagtgcggtgcaatgtcatctgtctgcaacctctgccccctggaagcaattctcctgcctcagcttcctgagtagctgggattacaggcgcctaccaccacccctggctaatttttgtatttttagtaaagacaggatttcaccatgttggccagggtggtctggaactcctgacctcaagtgatccatccgcctcggtctcccaaagtgctacgattacagacgtgagccactgcaccaagccataaacctcttctttttaagtttattgggtagtcagtttctagcttcggtcactgctaaggaagacaaaggaggatactgtcagattcttcctgctcaaaatgttctccatcctggcagtatatcagagcaggtcaacaactcaacagcttgcatctcagaactactgggcttttctaggtgccctgctctctcccctcccccgtcctttgttcttcaaggtctttccatgcctaccacctgaggttggagccctcgggcattttttagttctgccaaagcacatagtcattgaaagacctgcgtgatccctgtaactggcaagccacaacctcttctctcaaatgacctccttctgaaagttttcagaggaaagaggattgaacagagagggacagatgatcacagatatcttgaaattgccaaagggagtagacttgttatgaaatgctgtgagccagacacgaagggaaaaaaccaggacagctcatttgggcagagagcaaagacaaagccttcaatcctattcaggagctgagccctgcaggaaacccactgcctctagccacagtggagaggtgcaggcacagtgtggttggctactcatcggaggtgatgcgggggttgtctgagaatggagggtaggaatgatctttatctgagtcccttctacctgagaacagaacagaacacacacacacacacacacttttgtataaaaagatagataggaatttaattttcataatgaaacatatcaaatcttttgatatgttcactattattgcttagtggtgcacctttaaatacattcattttaattaaaaagtggatcaagttaagcaaactaaatggtagagtttatacaaacagagttgcaatgcaaggactaaggttcttagatctacagagtctctcatacttggaagtgaagctatagatgttttttgaggtggaatctcgctctgtcgcccaggctggagcacagtagcacgatctcagctcacttgcaacctccgcttccagggttcaagggactcttcaacctcagcctcctgagtaactgggattacaggcactcgccaccatgcccagctaatccatgtattttagtagagatggggtttcgccatgttggccaggctggtctcaaactcctgacttcaagagatccacctgccttggcctcccaaagtgctgggattacaggtgtgacccaccatgactgacccctgaagctataggttttatgaggctagaagttgaccaaggagtggaaaacaagcattgcttaactgaaccaagacatctgttggttgaccttctcagaaagagaccaaaaagtatagcatttgatcaaaagataactattaatattacaaatgaaaagagggagagaaagaaattataatgaactgttaaaaagaattgacaaacggatagaaactggaataacatagtgaggtgtgacaatggtaagagcagagagaaagagtgagaggatatagagtataaatgttaaccttgttcctttttattaagaacatcctaagcgtcctaacattagacgcaaccatgagggccgcctagcaaatatgtcttgagattccagtgcatttttataccattcctaaattctgtataacaagtttctggttaacaccatggctaaacacaattatttctgaattcctgtcactctgccacccatatgttttaaaacaaagaggtatcctcatttcactgatgtttaaactcaggaatgagatgtgtcagtagctttgggaacatgtaaagctggaaagtaggaattctttaaataaaaactcctagtctttcttcctgagaccttgctttcagtgtgaggtggctgaggattggcatttgacttgccgtccgcagtcaccatagtggagacctcagtccaccaagaaatcaggcgaatgctgtgtttgcaatgggagagacaagatgttgagtgttttacctgtattacgtcatctctcctcaccacagcccttgaaacaaggaatcttacctctatttttctgttgttccagaagagaaacttttttgggagacatagcctccctgtatcacccagggtggagtgcagtggcatgatctcagctcactgcaacctctgcctcccaggttcaagcaattctcctgccttagcctcccagatagctgagactacatgcatgcaccacgacgcctggctaatttttggatccttagtagagacggggtttcaccatgttggccaggctggtctcgaacttccgacctcaagtgatccagctgccttggcctcccaaagtgctaggattacaggtgtcagccaccacgtgtggccaacaggaaacttttttttccagaaaaaaagaaaataatttgtccaaaaatcttcagacactgggccttgagcccacatgatttgactactgagtttaatgctgaagccctgagcccacaaactcaagtcattgcgctagttgagcaatatttgaaaagtacggtgaaagatgggaaaggaagagggagagaagtaaaagcataacggggtggttagaccactgagaataatatttgtactggaaatattcaagtaagcagtgaactaggagcgaaaggaggagagagaggaacaagaatgttatcaggcatcgctccgtaagcttagacttttaacataaggaagcaaatttaaactggaaaggcaggctatgtaggaaaaagtatacacaagcctttatagggtacgtccctcagtctcttcaagtgttcagccatctcagtgtctgccctagaattggagaattttatttcaaactgtgaccactcacatggaagattaatcttgaccatgaatgactcttatgtcaaaaaactgcatcctagtccgcacaaggattctacagagaccttccttgccagtgctagatttgtatgaaatgatagcattttgatatgtatattaacactagtttacacacacgcacacacactcatatatactcacagttctctagtctgaaagtattaaaaggagccatcgtagcttcagtgtaattcatgaattcatgaactgcaattttgctgttagttgaaattaatttaacaagtaaaggcatttatgcagttatggttgctactgtgctgttttcttaactacttcaataataaggcattcatcttaaatccttagatattccagaaaattccaatcatgagataaagagatgaatgtgaaatagttaatttggactgttggaatatgctttaagaggcaagaagccatgaaattatctttttcttctttagaaataaacacaagttataacacaaagtggtttgatccccatctccaccttgatactctccattgcagagatttgcaactaaaaatgtttgtcgatgcccagtgcccctttcagcttggtgggccagtcccaaggcttggtgaagtaagagagaagcaaacttgtaaatgaattgctctggaatttgtctgacttatgcattctcttttatttatttcatttttgcattgaaaacattacatttctgtttccttatagagtagtgtatcaagagcctgtgtatggcaataaattgctgcaggtatgaaatcccgactggtggagaaactcatcactatgattgtgggtttgctgtgaaatccttactaacaagataattctggggaggggaacagttctctaacataggaggaaagacttaactgaattttccagttttaatatgaaatctcctagaatagaggtgaggtggctatccctgtatctatcagtatatccactgtgttgtggcagtttcttccaaatatgggtgctgtttccatgactgagtgctgttagctggcctcagccatgagctttgttagatcctgagtgtgtcaaatggtggtctagcttggctgttaattttttagtttaaaagctatctggactcaatcagtataaatccaatgaaaataattcaaggttctaattgaaccaattgtctggataattttttagtaggttcccagagtgaaccggaatggggttaaatcaagaatctcatgtgcaacattaagggccagcatacctgacatctaacataaccctccctggtcttagtagagctgatcagaaatttatttcaagcctgttgttatagcttttaaacctatttctcactgctaaagcaaccaccaactgaacaaatttgtaggaagaaaaaaagtcaacatattcattggaatgtggctggcctagagtctccaaatttggtctattacccacattgaaaccgtcaaataagatgaatgtcaaactgaggatgatcagtgagagttgtaggacattactttccctatctctgcaattcccttttttcttcagtattatgagtgaattacgaaagtactttttgtaaaccatgagaattgactgagttttaattaaaacctgaatgtgagaaagaggtactttgacctagtaaagagcaatatggttaaaattcctgagatgaactttcactgtcacatttcaagagaactggacctccaactgccacccttcaaaaatagatggatgtggccaggtgtggtggctcacacctgtaatccccgtacttcgggagacctaaggcaggcagattgcttgaggccaggggttcaagacggggccagccaggcctatgtatcaaaaccgcatctctactaaaaatacaagttagccaggcgtggtggcacatgcctgcagtcccagctactcgggaggctgaggcaggagaatcggttgaacctgggagacacagattgcagtgagccgagattgcgccattgtactccagcctgggtgacagagaagactccatctcaaaaaaaaaaaaaaaaaaaaaaagaacatatagataaattagggagataaatttttcattttaaaatgttcttataagtattatatagtaaataagatttaagttgtatgtgtatataccagcacacctgttttgcaccaagtgagacttgacccttgcatattttcatcataaagggagcctttacccctagttaagctgatttactttcctatgcactccagctgaaggaagcatgcgtaacacgtacatgttacagtcctaccgacgcccacgtctccctagcacacacaggtttcccctcccctatttcactgtttggccggtagaacatttattttcaaaagtgatctaaagtgaaaactttgatttaagcctcaaattctctgagatgccttggaggtccctcagtgttcatgaatattgtcccaaggagttccacaaacagagtaaccagtttaatttaactgagcatctgccaaaccagtttggttgtggaaattttcctttccttgccaccattaataccccacaagcataattttgaaactgctttattagctaggcacagtggcttacacctgtaatcccagcactttgggaggctgaattgggaggatcgcttgatcccaggagtttgacagcagcctaggcaacatagtgagaccccatctctagtagtaataagagaacaaaatgctttattggagcatcatttgaggtgcttaatgggtaactacctcaaaggacctctagaggttttgctaacaaaggaaacttctcagtccacatgagtggatcactttggtggcctcactcatttggtggtggtggcaacaagatgcacaatgacaatttgaaatttttatataaggttacatttatattttgctgcccatcctgtgaagaaataaatgtttcatgaatgggagcgtagaactattttgtgtttgtcatgcctcgttcctttggtttggtggtgggaaaaatttaattgtcaatgacacatttttgtcaaatgatctcggaagaccaggttcaacatgaacatggtctggtgacagcaattgaaagtgagtgttccttttacagacatcactgtggaaccttgaagaagttctggatatgctcagtgagctgcaaaatacagagcgataaaattgattcaagtcacctgttaggaaaattaaagcaatttgtatttttgtatgtaaagcaatttatattttacagtgtatgtacacatacactgagttaatacacaactcttatttccctagtatgaattgcatacagaagaaaaatagcaaaggaagaccatgcagtaaagatagaggagagataaaaccaccctaatccctttttccctaattattacatgtttcagggatcatttaggctggtattgtccaatcctttggccaccagtccccatgtggctatttacatttaaattcaaattaactgaaaagtaaatttaaaaatcagttcattgcactagttacctttcaagagttcaatagtcatttactagaagtagctactctgttggacagcacagatatagaacattcatctccaagtggtctactgcacagcaatgagaccactgatcaaggtttaaaatctctccgctggctctggagagttaaggaaattgtgatcttaaccctggaatcaggaatgctcacaagcaaatttctagataataaagtcataaataatatcagaatattgacgacttgtgcccgtcttgtctggaaacacacattttctgtaactggccaagtcatatgcaaacagagtagaggtcattttgagaccttcatagatgaccacatttgctgtgcagcggaatcccaggtgtacacacctgcatttgatgtttctactatacataacctactagtcagtgtggttcatttagttgtttgcaccgcagcaattcttcccatttatcggactcgctgccttcttccattgactgaaactaaggcagaaggtggaggatatgcaaagttcaaaccaagaggcttgcaaataggatgttgctagacatctttggtgggaccaaattcagtcaccaaatcatgattcacatggcatctgattgctgcaaatactttttcttgttccagagagaaacacattcataccacacacattctctccactcaaaactttaagcctgttgcagctaatgtcttctggaaatcagctagccagttctagcccctccctacctcattaagtttaatgtatgtacctgcacacctgtatctttctgtgaactttatgaaagccaagaagatgaacaagctatatagaaaaatggctccataaacctggtgacccaatttctctttagtccgtcactctgttgaactcagtgctgttataactgctttggttttataactcctcagcacatttaatgagttccccattcctaattggagaacatagtatttggaacaccaggtggcatctggctaagacctctttttgttgtggttaacttccattacctctttaagggaaacaaaaaaaaaaaaaactggttctaaattattggtgattatgtggcaggatgttttggatgtgtcttctccaggactgatccaaagaataaactttaaaagataaactcgtttctttgaattgctgtgcaaatgatagcatatttactctgaaagttaactgtgcaggaaagaggcagaaagaaattgagacccgtgtacctacatcttgaaagaggctttttgtagcttccctgcttcatctatgtcttatcgtatttagtttcatgaagccaaatgccatgaacctacctttccctctcatgattctgctgttgtataccttctcacacactactttgtcctgagttgcccctttatggtgatggtgaggacacttacctcagaggattatgggactgtgtgttctaattagaacctgaatggtcctgtgttatcagcggacactggatcctgtttaactgtgctgagttcattgtacactggttgatgtatcattgtggtccactgagcaagaagctctgttatattcacagtttgatcatcaacgctccactgaacacaattccttttgaatatgcctatttgctcgtcctctttgcttaattgaacaattgcaattactggtacatacaactaaatgttaattattttttcttttcagattttttctgttaatgattttatttacaaattagaagactatcatattttccacaccaaacaaattctccgtctgaagcagcatgatacataaccatgtgatatctttggccaaaaagaaatgttcagtcatttttgtaataattgtgtaacatttagacagctacagacattcttcaataacattagtggtttaacaaccagataggtaagagattactaataaactttcaatcaaagggtgatttaataaatataaaagacaggaaagcattcactttataagaaaataagaactgtttgaataaaatttaagttaatatctgataaaggtaaagcagaaacaattttgaaaatctggaaagttcagcaaagtataaagagtatttaaataattccccataatcctctccaccccaagacaatcgccattaacatttaggtacattttcttccaagggcctctaggctcttcttttgggatgtgcttatgaccgctaacctttaacatccagctggggttggtattccaccccttgtttctccagggtgtttttgtattttcgctttgatactaagctttcattaacctcaactttagctcagtagatttgggtaacagctgctctggtgtggtcttgccactgggcatccctgcattgggctccgctacattcctgagtcacatttctccttgtgttttagggtggttatgctgcataccgctacgcccagcctacccctgccactgccgctgcctacagtgacaggtaagggtcatccttcttgtgcttgacaactacttgtaaattaacttagttgatgggagaggagattcttgtatggtcttggtgaaactgcatgactgctgggggaggtagcaccccaaaagttaggtcccatggtgaacgtgaactcaagtccccatagagagagggcaaatgcttcagccaattctaaactactctctctgctgagacacaaagaaaatgatagccttggtccttgtgtagtttttcacatctcttaatttctgtgacaacgcaccttgctcacatacacatacacacacacacacacacacacacacaccgtacaaccttcttatggtcttccacataagaccacggtttcatctaactcataggaagaaaaacagaccatgatcctacaaggtttacttcaatttcaagcccctttcctttttacaaggtcttatacccaataaatcattccctccattgcattattacaattctaaataaaggagagggagagtgtccctggcattcataaggagattgattctttctagcaatgcccagtgtccaatcctacaaacataagccagcttttatttgtaatgtacaccacatgttaaggcaggcagtggaaggaacacagtgtgtttgaggaatgcagaagtcagaatggatgggcaggttgcgggggtggggtggaaatcaggggtttctatcacccaggctgaacagatgagttggttcctgaaacagcaagccgtagctacttttgtatggttgccttgaaaaggaaagtgtgtgttttcatattgaatgcaactccttggctctgttttctgaggacataaatgtgaatgttcagatgctctgcatgcacaaatgtcattgagggtgcttattttggtaatgagtcctttattttaaaaatatgtttcacgaataaaacaatgataacaatttgcatgtgtggctggggcatgctgggtcagacaggtaagcaggcgatgtatttgactcctgaatgggaagcgtcagcagcctctggtcctcctacctggcctgttgtgatgtagttcctacctcggtttgctgtggtgtgctttctctgcagttccattccatttctcacgagacgtggtgttagctaattgtagctacagaattcttgcaatataataaagcagaataaatccctgaatcctaaaagctgcattttgaaaaccccatgcatacacttgtaacaaatggctctttggcaagatggagttgagatctgctatctggttctatgcaggtatcattttcttataagcagccataacaagttctcaaggctgtagggggccttcagagaaatccagacaattgtcaagacaaggttctcaatacataaattatacatttaccgagtaatcagttgccaagatgcaaaatgtgtttcatgtaagttgttatctccaacacactttgacactggattaggaaagtagagagggtcaataagactaataaaaatgatgacaatcttgaaatactcaagatcattctacaaaggaaaaggcctaatgttattaaattctgcactgaagcttcacaaagtatcaattgtaatgtggttcagctgcaacccttaattattttttatgaaaatatctctagatgctaaattctcaaacacccactttgtatataattataatcatagtaactctagcctgctgtataattataagaatcttaaacagatttgatttatcttgcttttcagtataagtgcatctatccccaagttgaaaaaaaaagattacaaagatatgatttaaatggactccttcaataagactggtctagacatttaaacaattaacaatatttaatgctattagaattacctgagattctggccatccctacttgcattcatctaaacatttttaaatttctgcattttggaacaccatacatgtaaaatctgttattttgatattattcagatttctcattggcaacatgtcccactgaaagattgcccttgttcttggattggtgaatctttaataactgcaattccaactttagtaccatagtttcagttgaagaaaccaactaactaatactgttgtccatataattggcctcttgttgttcattagagaaatttgcacatttggtcttcttggttgctgtggaaattgataactattcctatttaactttatcataagcaagacacttgccacatggtattattcattgaagtaaattaattaataagtaaatggacagaaagcaatctttaaagttgtatttctgatgttttaaaatgtctattaaatggtgctacttccttttatctgtaataagcagatattgagaaagaatacctttttatagaagacacgtttaggggaaaatgtgaaattatcagaatagcttttgaatctagattaaagatgccaagtacctataatttctctcagaagtagcaattgtgtaaccaattatttttatatcatcacagcatagaatcagtaagtgatggaagcttagttcctcttctgtagaagacaggcaagataaagaaaaacttaacagaaaaacttcgtccaaaataggaagtaaaatcagcaggcattgagaatgttttggtaatgctcactggttgtcagttgatcaaaagagaaacagcaacaaactttccctgtaatcatgagattcactcttcagacatcttgaaagcaaaagaagtttgatgtccccagttggtaggattttaccttttttcagcacaaattaagccctcatcaaatgaaagattcagggatctttgaaaaatattgaactccagtaacctcaggactgtccagaaggtccttaatgggcaccttgcaactccctgcccatcatcttcttggttaaatgatcacatgctgattatctcggagcaacctgagagtctctgaatgttgacctccagaaagaagaccatctggtgtgggcagagatttccccaaaagaaaaatacctgactggactaggtaattttatagtctcattgacaaatttaatgggaataggtgaacatcttttcttggcatttaggaaacatttggcaaagcacttgaccttcaccaaatctttatttctaatctcactttgatttatgcaaagccaactgtctgaactttcaaaggagagcgtttcctgagcttgaaccaactgaagcatggcagaggggcctttggtcatccggtcattgcatgccacttggtgttgctgatgtgtctgtgatacgttctggattggacaggtccatcacatcagcttgatgaatggcttgcttgaattaagcctgggggcaggcttctctttattgattggctcatggtttgtgtattatgacttggttgttgttgcatcttgaagcagccaaactgggaggtgcggagggggtggaaaagattccctgtttgatcaactgtgccacaaatatttgggaaaatgtgatgtgtacatggctttgatgaaagtgttatctccccagacagacagacatttgtcatgcttgtcctgcttgctaacactcttaacatttcctaatgatcagtgcatgaaaatgtccctccacgtcagggctgaaagtagctagatgcagaccgcctagagacggaagcaagacagtttttcactcagatttcatcacagtccaattacactgatagttaccaggggccatttcttccacataaaacatgcatttcttgtaaagatccatgaaagccaagaagcttttgacattaattgcggcaccaggccacacaggtatctctaaactgagcaaaagatggcaaccaacataattttgttttaatgtatacctttttggattctgaggccttaaagtttcactgctaatgtagagttagaaattgctacttttgtgtgacaaaaatgacatattggctctgttgtaatatgaaaatatacatatatctacataaatgttacgtagctcaacttaatagaaatccaaataaaatgccatattatcttcctctctgcacacacacacgtacacacacacacactcacttgtgccttggggcctcacaagggacttataagtgttttcaggtaaagcttaatgcaaagagaccagggcttgttaatttcaagtggtcacaaactacatgctagagaacgtaagttaaatatgacattcataacctatgaataaaaggttctatttcagagacagatttgtgtttcttagaacctagtaaggataagtaggcatattttcaggttcatagaggatttagtcttattttaaaattatttaagtgacagagatagacatatacatacatccatgcttacacatacatagatgggtgaaggatgggtagatggatagatggagataaatcgatacataggtgggtggatgaatggaaaaagagggaaggaagcaaggaagggaccatctttctgccctctaatatttcatcataagctaaatacagaaaataggactaaatccttatgcacaaaagattgtacaagctgaactaaaaaagtaaaaggatttgagttgatttccattagcgcaggctacttcctgtctattttagaatttttctggcctcagattaagtagtagagaaaggctgtcatgaaaatagacaggcaaataagtatatttacagtgatattccattttaattggagttcttatccgatgatatatactaaaaattaaggaattgtcagcatataaagtatatgagcatcctgaatagaaaatttaatttaccatttaagggcttatttttgtaggaaggttaattttttaagaagatgttgtattttatggacattatgttttcattttttttttcccatgggataggatatagtttaacctgtggataatttggaacccttaatgaaagtacacatgcaaagcagacaaagggggcacttgctttgctttccccagtcctcttatctgaaccaagtttgatagggattgaaaatatttctagctaaacagcagtagcagcccttgttcttattctttgtgatgtgtggcaaggagagatctcaagatcttattctagtgccgtattgaaagcagtatctcccaaggccagttcaagacctggcacctgcctttgatggcatatttacggtttatcaaaacggaagaacaccaaccatgtaatatggttgtcaaccctcttttctgggaaataggctgtatctattcttccttctcacatgctgtttaaaaagatttataaaattagaacaatagcaaacggtagttttagacatccaattttgtttttcatgttcttccttggcaaagtaaacattggcaactttatgctagactctgtatcattttatttacatttgcagtctctgagaaatctgttggaaaaatatagtgagagcattgtaaaacatggccatgccagagatggtattctcagatcaacaaggaactgaggatggagttcttgggggttcagaagggatgggagagttttccatgccatcttcccagctgggatacagacccaaaggcagagagaagccacttgcaagtttgagtctaggctgtggaatcaatacgtggcaaataagccaaagtcatatctctgtgccatttttgatggtgctttgaagaagctgttcttggttttagttttttttttttttaatcttttatttttactcaacctgatgaactctcttgggttctataattttttttaaaaaaaagatgatctgtcaagttgtaataagaatgtagcagaaatgagtcactcatgcctttatttacatcctcctgtgcccctgtgtctagaaaagcacgtccaggttttagttagaactccaggttgagcacgtgtacatctatacatatctacatgtataaacacacactttttcttgttcatttaaagtttactttcctaacagatccattttgttgttgttgttttttggggtttttgcctattcagactctccttaggaagaaaaagtgaaagcaattgtcctagacagctttcgggtaactagaaacacacagttatacctgtgagattcctattacaaagcacacatgccagataaatttcttaatacttctatgtgtgtgtgtgtgtatatatatatatatatatatataaaacagtgctcctcttaaagtgatgttgattgtatattctccaaaaaattaggataactaagataattctatttcctcctgatctgctctgtagactgtcactgatgtatggagatggctctgaaatagtgaggaagggaaggtacatctcagcttttgatagtagagtcaccgtaattttttaaaattgggtttatgcatgtcaagctctcagtactgagaagtaatatggctgtaactgatagatatatttcctgagtttctcttagtttatagaaatcacacacacacagagacagacagacagacacacacacgttaaaagaaaatgtgttcaactttctctctcaagaactaattgcctttggtccataatctataatggcttcataacaactgttatgcactattggatgaatatgtaattgaatcagtttaaaaaaagaaccaatcctgtaacagtcaacagactggaccaccaaggagttggggagagattaaaggaatttccaagcccaacagaccgtagctgtcacagccacgtgggtagacacttttgccagtgacaaggcaaggtgtaacaactcctttggtcatgtcatggcctaattacacactttttaggtcgcagatcattgacttgataggccacaaaaaaggaaataaagcctgtcttttcagtagcagcatcagaacccttcagctgtgaagggtttagaggcaggttgggaaagcctaatgctttctaggtgtagctctgttgagaatatacgtgcaaagccctatgaatgagccatttctattgctaaaaaaaaacctgcattctagaagacagtaatccagtaaagcagaagatagaatatcttagctcatgcagcatttgtggatgtggcaataaaaattaaaccgctccactttgttacgttgttctttgtttgggttttatgtcactaggtagtatactatggatggtagtatactatctttcaagataagatgaaatttttcagtaaaagtgtctaatatttcattttaagttatcaaagcaagttctgactctgtacttaccacaagttgaaattcttttccagaagaactgatttctatttcaatgtggcctctaatttatttccacttttgtgtgtagtacatgcatgtaagcagtcaccagacagaaatgacttatggcttccttggtgtaaatcacaatgcttggttcctgtggaattaggcacttctcaaaaactatgatgaatttcatatttaattaacatatgaaacatttagaataggggccactattggaatttgaggggatgggagtctgtggggcaaaaactagggagaatagaaggagtaactagtcacttttctttttttccaagctaattattgatacattatgatgtgtgactgttcaaatagattaacagatttctgaaagctgaaacataatcaaagccaaatattctcgtaattatcccaatcatttagattgaaatgctttggcctgagattatagaaatatgccacacatatgataagctaaatcagtggttctaacgggtcttggggacctggaatttaaagaaaaaaaaaaacatgattgttagatgcttctaacatcctctcaattcttgcctttcatggtttcaattttgtaatttaaaattttagaatgtattaagagatgaagaacttgttttttccaccatttctgctttgttagagtgtttgtggatgactactaccaaacagaatatgagcccaggtagtgggagtggaggcactttaataattcttcctggacaataccagcttccctgttttttcagaatgatcgtttccccactatttttgttttcttccatttctgtctcccaaacttagaaaatgaacaaatgggggaaaaggaggattaacttgttctgttttgaaatttcaagatttgagtggatcatctaaaaagcctgcagagccttgccttgtaaagtgtagtttccagaccaacaccattgggctcaccaggagcctgtgagaatgtagaatcccaaaccccagtcccagccgtgctgaaccagaagctgcacttcccagactccagaatgactagtgaagtttgagaagccccactttagagaacaagcttctgttctaccccgatatgccataatgttgacaaagggttgtcctgccacaaaccttgcaagagataagaggatctatctttataaattattgacttttattaccattgcctctctactctcccttcttcaatgagagagtaagaactatcaacagctgagtgacttcttccctctcctggcccagggccacaattaattctttaccccaaaagatccgtggacggaaacagttatttatgctaacatcgtgtcattaattgcatagattcacgctaatataaaggagtacctgaaaaagttccatctgatttcactttactgaccctcagttttttcctatgctaagtggaaagcatggtactaattagaatcagaaagagatgaagaaggtgaacattataaactgaaagaggtggtgcaaatgttatcaataactcggtttcagattgacatattttggaatgtatgctagtatttgcagtgaatatatagaggcagtagcaagtacattaaattaaatgcatttaaaaatgtaaggttatttttagtctaggcaatctctaagacacactgtaacactaaccctctgggaacctgtgccttgcttagcatcccaggtcttgtaggtaactgtgtcaagatttgaaatcagatcttttattctcattggacctactctgatatagacatgcactagcaaatcattgctgttgatacagagaataggattacagattgagatttacacgtgggtcctgaatctctgtgaggttacttactacacgagataatttgggcaggccaacattgagctagttgaccctcaactgcctcatctataaagtgggattaatggatgaccattgcttctttgcgtggttgtgagaatccattgctgtcatgaacagaaagcccctctaagagatcctgacacttagttctcaggatattagcagcagcagcatcactgaactgtgggattatcgtgttctgttctcgagtgaaaaaaaaaacaaggagtttcctgtggaaacgggttttatgagttagaataatttttgactaaatacatttgtttttggttgttttaaaatcttgacttctaccctagaaatataaacataggttggggaatagaaattgggaaccgcaagatcaaatatcctatccttctttttcaacctgtgccttggatatttgttatcttttctgctcatggatcagcttaggccaccacacatgcattagctttgtagaagaaatgcccaatctcccagtataaacccagccttcgaactatcaccgctttggatttttgtaaaaccaattgcctgccctcttctttgggtggagagagaaagagactttcctttaggagtctacacagacaaaaaaagaaaaagccaatttttctaccaataaaatgacttcacatttgtttctcattcaacttgcacaaaaggtctgggaagggcatgtactgtttttatatctcaatttttccaaatgaagaaactgaggtccagacaggtgaaatgaattttctattggaatacagcttatatgcaacaaagcatggttttcagattcacggttggttctctttcacctgagcctagacaagaagtgcagtgggaactggggagaatgttaaatgttggaggaactaaaatgacaaaagggaactgttcaaggtctccaagtaatggagatgaacttgggtttgaatttccaaaactcagatctttttttggtagaatagccaaactggggagagattcacagaccttatcttctttctgtttaagcttctttacgaatatcatgttagcaataggaactgtgtctaaatgaaatgtttttaagtgtattttcatgtgttcccccttttcaaaaagagataggtgtaggacctttgagagctttctataatcaatctgtttggttacttgtctgtgtataccctgtctcattctacaatttgccacagtgtattgaagtacacgtgacaacactaaactgaataaaagtgacagggcaggtaaaaaatatgaatctgaatgggatttgtaccattctggagtagagtattagtattttatgtggaaaggaggtaaaatactgattgcaaggaacctccctttgaaggtgataaaactgaaatataaattagattatgagcttccagacaggcaagtccaagatactccagtgatttaaaggatatgagcatagcatcagaccccttagacttagctcagtgcctgatatgtagcaagcccctcatttacaatctgagggctgaatgatgtgagtcaactctttggtaagatcagcaatatgaattttaataggtacatcctatctgcatattatgtttaatattcagaaaacactcatggctgagttccatatggcacgtctagcaattttaacaacaagaataaactgattattgtgactttccaccttaattttacatgtaaaaaaggaagcaacctggtaagcatgattataagacaattactaattataactactgtaattagtataattagcaattaaaatattaagtataaaatgttaaaaatcaacactagtgcaatttaaacccaaaagacacaactgtttcctgaagaggcaagatacatatgttcagagaggtattcatacagtgagatgagttctccgtgctggctgacagatgagaatcaaccccaggggtttttcaggcatatctgtacatgggaaccactctcaaagatgctcaagttaaatgaccggggtgtgggcctggtcattggtattttatttaaaaaacaatcctagctgaatatttattaaaaaacaaagtattggctgggcagtcagggctaaaaacctctgccttataaacaacagatatcccaatacgtacaggtagaattggattttgtcccactgctatcctggggcatcttggctgccatctaccaggccagaagaccaacttctcagctgtagggattgcctagtaggcatccttggcaggtttaaatgtgtgtgtgtgtgtgtgtgtgtgtgtgtgtgtgtgtgtgagagagagagagagagagagagattcaatattcatagcattggatacaagaagaatcttgctatgagtgatatcgatcctgagatatatttaacaatagcaatgtaacagaattaagaagccaaataatgagaagtgagcagaatctttgcccataagacttaaagacagtattatttgctatggggaatgtttacgtcccacctgcccgcaccaaaagttttctctgacttgatatctagcatctcatgtcccctccagcaacacaggctggctactgttttaatttaactctgagaattcagctgtgggtaatttttcagaaggaaaactgccaagagatgagatttaacctaaggaacaaaagtgggctatgagggtgatatgcggcaatccacaggactaatttaagtgtaccaccagctgaggcagatagagtatagatggttgatctataaaaccatcttaaaagattagtcaggctagtgacataagagtgaaagagacagaccatggcatatgccatttcataatcaagttgttgttagaatatgtttttaattctttctctcaattattctcaaagaggagttcaaatatttcttagaggaaatgaagattcagaatgttaagttactccacagagacatcacacctcactgctgattaaataccccctacgtgaatgttccaagcagaaccttagatagtaaaagcttggtcttgagccaagccaactgtgttcaggtttcacctctaccacttaacagctgctcgcattatgtaacttttccatgcctcagtttcgtcatctacaagacgaggataaaaagaagggttataagaaaaattaaatgaatacataggtatgacacttggcaacttgcagtcataagtgccccatcagtgttagatagtagccgttgcaatcaacattcccatgagccaagacaaacacagccttctcccttaaactcaatttggccatttcatcatttttcatacattggtaatccttcctcttctccacccccaaccaagccttcccagttcaaaataatcttcctgggacaggtgagctttgaagtgaaaatgggaatgaacttgcagatttttcagcaaggttgcccaaacttcaaggtaagaagcagcaggaggcgtgattccctcacagcagaatctgctacctacagaacagtgaaaatgagtgcctgtggagctgatcaacaggcaggcctgagttcttattaagtgtatagattaccagacctctctcctggaaattctgattcaggtggtcagagttgaaacccaggaatctataccttgaatgagcactctaggcattcttatcttcagggaagttggagaaattttggagtggaagagaggtagaatatagaaaagttgtgggtgacaggaatgggaaaatacagaagtaggggccaactcaaagaaaaatggaaaaacccaagcaaggatgatcttgagtaaatgcataagaagtggtccattaagaggaacaggtaaggaagaactcaaataccaagagtatgatatggccactgtagagcagtttctctttcaggatgaggtttaaagtcaactcttagaaggcatctagaaactagaagtaccctttcttggatactgtatcaggtttgtgtggttgcatagtctaaaacctaagtagctaggttgccctggaggcaagcatggtggccaaacagaagctgcaaaagtagaaaccaaagttggaagagattcagtgattcaactcccttgaatcccttccttgaatccacttccttgaatctcttgaatccctctgccttggtgccataacactgcttctcagctgggccacatattagagtcacctatagagcattttccgaactactttccaggccctaccccagatcaattaaagcagaaacctcaggaatgggccctatcactggcactctcttaacctctatgaatctaaggagcagccaaggtgaggaccattcacctcaacaagtgattttcaaacgaagaacgttagcacattagaatcacttggaagcatttaaaaactgctgaggcccgagacccagtttcagaggttaccatttaattggtcttcagtgtagcttggtaaccagaaatttttagaagtgcaccaattatttacaatgtgcagccaaggttgagaacgactcagccagacttgttttatgaacaactaaggaacagaccagtttgtggaaaatcaggtgcattttgaagtttaaattcacgggtctgtgttgagagaaagcagcacactagggtttgcataaggagacagaccctggtaccagccttctttcttctcctgagaggcagccccactgtccagaatatacctgcattgttctgatcttttaatttttctgaagttgtttggatatagcggagacattcgtctctttgatcatatgtgtctctggtcatctggggcaaatggcttgagagagggtcatagatgatccatttatgggccctctaaatcaatagtcttaatgttcaaggtgaaacagctgtacataaaatggcataacatggtgaatatagacagcaacatgcaatctccccttagaactgtaccagaattcttctgttgtcctgacactgcaggccaccaaagccaatctgattttacagacatttcctgttaattgcacttaccgattgatgaaagcattgttcagggaagtagtgatcacacagattgaattcatggaattaattaatgaactctatagaaaggcactttctgacaccttatggtgacctttctgggatgtagtgggattgtttatgtggattaaaaaataaaatagtacagaatggatacgtcaaaaaaatacttaactggtagctgttaactccttttaaatgtcactattattgagaactctgccttgaaacagatgtgaatttgtagtcagaagtaatctaagccaactcttttgaagagggtgagttgtcaaagggagtagtcccttttgttctgaaacttagggatcaagaagagaccaggggtaaaaaataaaataaaaatcaatacacataggttttcaaaaaaaaaaagtgggggagagaaagaatgaagggaaaatgaaaggagagaaagaacggaaagaaaacggaaaggaaaggagaaaaggaaggaaagggtaggagaggaaaagaggaagaaaggaggaaggaaaaagggtagtttaaggttaagtgcagactcaaaaagaatactttcaaggacaccatcatactataaaattctgaaacaatttttaaaaacaagcctagtttcttagagggctgtttctattcatacttgtaggttgcattttaaaagttacctattcgttcagtcacaattttacatctgtttttgtctccaagtggctttcctgatgtctagcacattggacagttccttagggaaaattgcagaaagggaacacaagctagcaatctgttctaggattaggcagtagaaattgggtagagctgccccaccctcctgccatagatatgtgaatgcctagtgcaaagaccttgccgctttggataaatcatgtcgccattcttgcttacggtagcattcttaggagcattctgtaaatagaggttattctaagtgcctgttttgtgcagcccagaatatcatacctgtagttaggaattcccgtgttattgccccttctataagtcaaaggtgagtaagtcaaatattcaaccaaaatatctcctttgttttcagggataaattttattgctcctctaacatagggaatctggggccagatattcatgcggctcaaaaagtctgtgtcaaaaagcccaaaatcttatgttaacttttattgtcttaaggaaagtgataaacttagttgtgacttgttatgtaggagaaaagtactaaaaatattattctcaaagcatgtataacttgtttatattttattggtgtagaaatgactagaatttaactgaatgtgaaattctagggaatattcaaatggcagctctatttatattccagggtgtacctcttgcaacagtaaaactttcttaagatgttttaagaaatgctccatcactagataccttttgaagcactgaaacatttgaacaaaaccaatcatactaagaagaaaaatgcatttatcttggttcttggtgatccataagcataataaaaatctaaccgatgaaaacccagagcccctgtactgctacttttgaggcatttacgaacctagccaacctcattgtgccatttttataatttgactcagacgatcttatttgtagacgaattagtacctctgaattagaacacataatatcgtggaagtgtcacagttggaaacgtcttaagagagttttatcatctttctgggtttactaaaagtaaaatagcattttctattttcattatttttaatactgcatcattaaaaataattagggtttatttcaattgacaagttctcttagctctatgtagcaagctgggtttgatgaggaaattattatccataacacatcaccatataaaattgtcttctgaaatgacagcactttttcttatttttttttgatattataagtctagaattttataatttttctagctagctgtagtataccctatttcttaatcattagtcccattttaaaaagtaatctctttagcatagaaagtcatatgagcacaatttgaaatgctttagccttagaaacatatcctggcatgttttggtaacacatagtattaatatttggtgcaacagcttgtacatagttcgtattctgacattaccatgactttaagaggtccccgcatgcttatttcatgatctttctaaactctgaggtacatcagcacatttcctcgcaacatccattcacacgcagcacccttccctcccctcatctgtacacatcgaagcaattggcagagagcacatttccccctgagcgagcagtattgtgaattttatcttctcttccagaaatcagttcgtcttcgttgcagcagatgaaatttcttgtaacacctctgcaggtaacaaacgttgctacttcttgatgcatccatccaagtctcagtatccttttttttttttttttttcttcttcacatgctgcagttggtcactctagaaagtttagttaagaaaaaaaaaaaagatcttatatctttggagtacagctgaagccttgaggctctgccatataagacgacattaggcattttgctaactttgatgttttatttctggttttaataatacatggtccagaaaagtaagagtatgttgaatgaatccacaagaaaatcttacagtataatcagtgctcttatggtaaaatagggaacaggaagattaggtacacagacgtatgacttccatgttttttgacgtgttatgtctgggttcatagagactgatgtgtgaattatttgggatctttatggaatattagaggctgtaaaagactgaatctataaagcttagaggcattcgagaatataattatctctgtcttataagaaggggatcttcattctattagccaaagatcctctatttcctttcttataaaacatctctcaagtagcaggacttagagagaccaggtcttttggttttgaaaccaggacattggcaaatggaaattgcatagctgcatgatacgtccatcaaaataacacctgtcttttttctttgatgtggttcagaacagttaaatttgtactttgattagtatggagttaattaaatgccaagataggtgaatgccttaacactagatttccttctttttccttttgtcgtttttaagcctaaactatgaccaaaacaatcactaggaagtcttgccaatgtgttgctttcagcctgcgagggaggacgttacaacttatcactacataactgagcatcccatgaccttcagacacatacattaaactgaaccttacaaataaacactcatctgttaccttttatcaatgctgcagtaaaaaaaggcttatgtgccaatgtttcactccctatttactgcctttggtgagaatgaatgaatgaaaggaaggacagagagctaggaacatgcacccaactatctctgttctaaaaggcagggtcagttttatttatatggtcagcctcaaccttcataacgggttaaagtcttacctggtgagttcaagaggtatgcatgatgcatgctgacattttaaaacaatggtatactctttctataaaacctctttgctgatggtcctgcaatttccctcttaacccctagactcgtatctctgcttctcattgtgagaggtggcgacatccttaacactttactaatgcccagtgctaggtgcaatggttaattgaattgctgggagtggcagggaatgttcctgcaatacaaaagttgtttaacattttcagagccttagtggaatggagcatgaaacaaaaggggagaccgcttggaatgggaggtaggggtggggaataatgttaatttaaaatgttcataggcctcatgtatagatgcctcagtgcactagagcttctgccttctgttaacccctgtgcatgttccagtatgttaggttatatttggacatcttagatcaaacatgaaaaagatattgattttgccccgtgacttaaaccctgccttataagcaagtgatccacacacaatatttctaagaaaggcgacagaaaatgaaagtttgcatgcgtgtggtgagtgtttccatctacctaatctagatggctgctcagtaaattcttaatgaattgctattgatcacatttcagattgagagagatatccctagtcctttgatggccattttaatattatgttgcatgcttcataaggttccgtttgaactctgaattttgaatgaagcatgaaaaaggagacacccatatccatcaaatgtcagattatctcccagcaagttcaccttgctcatagagcgaaaatgaaaaatcaaaactgctcagtcaacaaaggttgtaactcgtggtttcagtgaaagccttctagggcatcatctcctacatgctgaaaaaacctgctttgggaggccaaggtgggtggatcatgagggtcaggagtctaagaccagcctggccaacatggtgaaaccccatctctactaaaaatacaaaaattagccgggtgtggtggcacatgcctgtaatcccaactactcaggagactgaggcagagaattgcttgaactggggaggcggaggttgcagtgagcagagactgcgccactgcactccggcctggacgacagagcaagcctccatcaaaaaaaaaaaaaaaaaaaaaaatcctgctgtgcccactacccacattctaaacagcactactgtaatgagctctcacctccttataaaaacatttattagagcaggtgtattgaatcctgctatctactggatatcagagtttgacaaaagacaagttctctatttttaaatggagaaaaaaaaatcaacatgcttaaaatctcagtgtggggtttgatggatgttataactgaaattcttataaagaggtgctattgtcacattgatgcccatggtggatgggctaagcataggcagccatcaggggcttcgggtggagatagtgagatgaaaatcattaagcagtagaacagcagcatttcaggatttgttcttcacgtttcccaaagaaaagcaatgccttttacgtgggtcttgtgtcgagagtgccaacacatctggtctgctttttctagccacatggaataggcatttttcattaacatttgtggtctgtgagactaatttacaaggatatctattttcttacctaggagtttcaacaatgctattagttgtgttgttttgttttggtttttcccaaagaatgtgtgctctgttgggtatcacttgggactaggcttttataacagggcaggacacctcctaatgcatccagcttggacaactgagtaggtcctcattcagtaacatcaagaacctttgatgagttggattcttcaatagatggtgaaaagggagtaaatgattttcccttcttagacgggaggtctccgtctgtgattcattaggaattttccagggtgggctagtgattgtagtagttgcagaagaagggtctggtatgagaatggaggttgaaaagcaagttacttaatcagtgactagaaattcattttagtcgattaatatctctagtcctttgtgggtgtcaggaactgttctaagccctggggacatagcattaaatgagtcaggagaaggtctcatcaaaagaccttcatggtatgggagaacagatcccaaagcacgtatatgaataagcagataatatatatgcatagtaagttatgtacttactgtaatgaatcaaaaagcaggggaggggatggaaagtaaggtgcaatgctattttagactcagccatcagagaaggcctgtctgagggggtaacatttgagcagggatctaaatataaagtgaacgtgtgacccatgaaacatacagcaggtgcagagaccctgtggttgagacatacttgaggtgtccaggagtaagacatccagtgtggcccacggatatgagtacaggtgagtttaatagataacatctaggaggtagacaggggtcagaggaagttaggacttggaggctgcagaacatatttgggattttaacagtgatgcagaggcattggagggagggttgtaatctgactttaatgatcagataagactgctttgtggagaccaaactgccaaagaacagaagaaacagcaccgaagggcaatgggggggcccttacagctgtccagagaggggtgacaatggcttgggttagtggggtggctgtgggtgagaagtggtcatctttaagctgtattttgatgggagaacaaacaggacatactggcagattagaagtgtacaagctcgagtctgttaaatgtccactccccactcttgttctaagggtctatcagttaattccatggagcaccaaggctttaatccctgaggaaagcaaaccctttatccctgtagtaattgtcccttgttgagggctttgctgaactctccaaggtgtaatagtaacttactgtcatttattgagcaaattatgtgtgctagtatgatatacatacatgcatgtatatgtataatgcatgcatatgtatgataaactatatatgcatgtatatatgtatcacagtagttcaacgaggtgttatccccattttggaaagtgaaaaaaacatacactcaggtccagaaacatttagtagcttgcccagtcacactggagtccatctgatgccaaaacccttcccctgggtcacactgcctccacacacacctttttcttcacccttggaactttggccttctcactccagatggaattctaccttccccagtatgctatcttgctcctatgaaactagtattttgagtcggatgacaaagttgttactatttggaagagacccaagggcactgtatgattctttagcagttgttccactggaattttatttaacttggcttgtccccttcaggcagcaggcatatgtttagttccgtgtgctgggagtactggtgtagttgtggggacagagggagcagatgtcaggtcaggaagcatgttgcgtattagggaagagagggttaaacaggccaagtgtgttctaggttaattcaccagacgtctttttgctgaaagttagtggctgaaaaacaattaacaatatgctagtccctgaaaaccccagacaggttgaaacagttgttttagacacagagtccaagagggtgtgtgtgtgtgtgtgtgtgtgtgtgtgtgtataaagggggtaggtggaggctgggactcactagcaggaagatatgccccttccaccatgccaggacccaccatgcattcccttagcaaatctggggacatgttttcatctcagttcctgatgagtatgggacacaaccatgtggggtgagggtagggtctgcaagaaagccttgagcaaatgaacaatctgcaaaagctgttgaaactgttctctgtggggcaggttgctacccaagttaccaattagaagcaagttcaggggtacaaggaggtgtcaccagcgcctttcatttttctatccccacttctcaacctacacatgctgccagctacattaaaactttaggtaatatttaatatttagaagaagtttcccaattggccattcctctaactgatccttcagcaagtctcatctaattgtcttttctgcattttagtgatttgattattcagcaaagttgtcatgcagtaaattgatttgtggctaattggtccatttccaataaagtgtgatatgtattataatagggaaagtacagggagctaaggggccatataagcaaaggaacttaggaaacatactcccacttattgagaaccttctgtatatgaggcatagtctcaggcttgctgcatgcaataacaataccctataaagtgtgtgcaatcaatttgtgaaaattaaagatgtctagatagtctgaattagcctaagtgggaaagtgctgtatccatgcatgcagaattttaaaaaatggaatggtggttatcaaattctagaagaatgcaccaaagtcacctggagaacttgttacaaatgcagagcctgttttgtcgccttcccctgcccctgagattctgattcataagtccggagagggagcctggaaatctgcattctaacaagttgccccagataattgtaatagaaaagacctcacaccttgggacacactaactgatcaatcagggaccttttctctttgagatagggtctctgtcatccaggctggagagttcagtgcaatagcctgatcttagcttcctgtaatcctggacctcctgggatctagcgatcctcccacttcaccctccctagtagctgggagtacaggcaggtgctaccacacccagctgatatcttaattttttgaagaaatggggtcttgttctattgcccaggctgatctcaaactcctggcctcaagccatcctgcccctttggcctaccaaagtcctgcgagtacaggcacgggcccaccacacccagccaacgttttttgtttcaatggtaaaaagagcacacaataggacttgctaaagttgtgttcacatgtggctgtggagcccttgagatgtggccagtccacaccaggatgagttgtaagtaaaaaatgcatgctggatttccaaaacttagtacaaaaatgatgtaaaatatatcaataattgtgagttacacattgtagtgatgacagtttgaatattctggagaaaataaaaatgagttcaccttttttttttactttttaaaatgttactgtaaaatttaaaatgacatatgtcttgcatgtgtggcttttattatgtttctctcaatcccattttagaaccacatttttcatttggctcaaatgaatattgaaagagtttgtgtgtccccaagaactggtcatttggaggtgggggatgttcaccaggagttaaaatgttgtgacagataatctggacattgtcagtgtcttggtattggattttaacgttgcctcctggtgctaggtgggtgtgttggtgctgtagagggacattccttggggttcagggcccagaacctccctacttctcaacctgcttgttttgtcttaatctttgatctgcttgctttgaggatgggagatgccagtacataagactttggatcatcaatccaattcaggggtagctctgacacatgtacccctggggctttaccgggaagctcactgatcccacataaaatagacgagaggcaatagctgcagtcctctcagtcttaataactgtcacttgtttagtccttaactagtaatcataaccctcctctcaccctcactgtagccttgtacgatgaggatgcaccattatcatctccatttatagatggtataaccaactcaaagagaagaactttgagatagcttagcaagaagtaacagtcagtgtttgactctagaaattctgactgagggatccccagctgctgttcaaccctgcttcatggaagggtattgaaaatctcataagggatacaatttgtttttcctcctatggggtaaagtatagctggggtgccatggtgatttcaaagcacaataaaaattcttagtgattttggtagagcaggagtagacaaacaaaggagaaatgaaatttctaagagaaggatggccttgagctctgcattaaagagaatgtgcctacagctccttttttagaggaggtattctagggcaggagaatttcatcaccaaaagtgggacttacttactgtgtcttctctactccgagagtggctgctattctgctttccctcaaatctgctgttgggtttcagaataggaagaggttttcagaataggaagaggttttgaatggcattggtgggctagagaaaagatgatgtgatctgatttgccatgggtaaatggtctgagtcttttagatgccacagtgttggatttgtgtacgtattatgtatgcatagttctgatgtatgacaggtatccatgggcaaaaaaaagcaagttctgtggcttctcatgtagggtctaaaaagctcagatgtgttccctcctacttctcaggggaggcagggaaatcacgaggttgaaaaatgtgctaagtgatttctgaagttaagcgctttaaagacaagctaaggaagtcagcagcaatgaaactcaaacagagccaagtagagatgactccatgttatcttggagcatttcttccacttctagttttatcatttttggagactttgctgcatttttagtcattttgtaggtcaggggtccccaactggacacacagcaggtggtgagcggggtggggggtgagcaacgcttcctgtttgcagccgccccctctcactcacattcctgcctgagctccacctcctgtctgaccagtggcagcattagattctcatgggagcaccaaccctactgtaaactgtgcatgtgaggcatctaggttgcacactccttttgagaatctaatgcctgatgatctgaagtggaacagttttttttcctgaaactattctccacctccctggtctgtggaaaaactgtcttctacaaaactggtccctggtgccaagaaggccagggacttctcctctaggtgtttagggactggtttagttcctccaacttcagtatcttgagaagctttgaggataagtgagcttggtcatccctatggtcaataaatgtataagtcattgctcaaattaaaactaggagaaggctatagtaaccacagaggagtatttccctaaattcactaactgaccaacagatctgaagtccagaactcagttgacccttgtagagtgaaagtgaacaggaacatttcctagataaaccattgctttctgaatttcccaatacatccaagtagttatgttaatgctttcaggagggtttctccctgttgcagcaaaccagggtgcatggcctgaggttctggaaaccctctcaaatctttctgtagggcagaggtggggtggttggcacctgttgtctctccatgtacctgcatagtgcactgagataacttgtcctttccttgaatggctcttctcctgcaagattaaaatcttggccataattaccccaacattttctcaaatggatgcgcactgggattagcccagaccttacaacctgggattctgcgatttgaaaatggagattttggttgtgtggtaaatatttattggcatgaagataagagactgatcatttcagagatatactgaggtgtcctaagctcggaatttttgaaagatcttctgtgaagtcccatattctgggctacatttctttgtcctttgaagtgagcttttgtctccattctgaccccacagaatccccaagaagctgaggggacctctctgcagttgcagaattgccaagagatttgtcagaagccttcagcctctttcagtaggactgtgagatcttactgttttgctgcattttcatttagtgacgagtatgggatggttgagttggaaaacataaatgcccataacagtttatgattgacaacggattcatttatttctagttggatgagagaaggaagtaaagcagtagctggggcagtgctgcagaactcagaagccatgcgccctccccttctggtcttgttctttcttttcctggccaatattggctgtgactcctttccagcccctgagaattgctgaaagccgagcattttgtccaaacacagaacacttggtctggaatgtatgttccagatgcagttcctccggatgggcaaaagcaacaactcattggtaatgataccagcaacaatgcaaaccaaaggattgtcttcaacacatcatttatttttcatttggaaaagtcctcaaaccccaaaaatgagggcaatgaaataggatgaatatctgagtgggatgagaatcacttcttcctgggtgcaggttaccttctgatgtcccccttcttacctggtgccccagagcaccccaaccaggggggtagacagcagaactgctaaatctcatttgaccctatacagggaagtgaaagagaacatccctttagctagaccatggctctctaaagagcatgcttttagaaccactgaaccacagttggtgccctgttgctatgctgtacggtaagtgtgcgacttgcatggattcatttttccaaatacttaagactatgccttagatataaggataaaggaggcactgtagtccctaattgcattgcagagacccgggccattcattgatccctggtgagacatcccattttgaatgcatactctgcagcccttctctgtgttgggaggggtacaagcccatgcattttcttgctgccatttggctgtttaggatgtctttgctaccttctgaacttcatctgagagctgagcagatttcactcatctttctgctccacaggattcacccagctatctctggggtgagaagcatggggagatgatactaatggaagaataaaaagttcccagggcataaacgctcctcatcaaaatagggagtaaaatatagtgaaattaattagtgttcttactgtggccctataagaaaattatgttaaaaccctggtgtggagtaccaacatgggcccattgtatctcattagcatccagcttgtttcaagtaggtgtacatagtacttcttgctaacgtgtctcagtagagttgataaagcactttaacaaacacgggtttatattcccattcaagaggctgcatacttattcattttgctccaacacaaccttaagttcaagtaagtatatccatttgaactacatctgtaactcataaattagatctcaactccaaaagcatctgtaatttgatcggtagagctgcatgtgattatattagaatggaatttttcaattgcctctgcagaccaaaagtctgggcaaggagggagagattggtttgtgaaatacaatctaagaagccatgtatcataatctcctctatctgtaggtggcttaatatttacctggctttcttgaatgcaccttgagttaggtagggctcagtcagaaaactactgctttacaaatgaggaagatgaggctcagagagcatgctctgtccaagtcatgagagcaaggacatcataaaagcagaactcaaacctggatctttttgccccaagtcctgaatctccaagccctcgggttgcttcccagttttaacttgttgctaaaggtcaaaaagatgaggtctcatgatggttgcaagccatggtgaattagccaggaaagcagtcctcttttatatctttgtttagtttttccctgaaggcttttgatgagttttatggcaacttggccagtgttttgcaaactcacagaaatgatgtaaaaagtgtacactatttctagagtccccagaaagttttcttctgtcttgaagcatcctgaatgtgtctgggagcagctgacccagagtcttcaaaaagcgtatctgaatgggatcataattacaggcatgagtgtctctcccaggccccatttctctctttactcctttgtcttgctgcctcctctctacctgcactgttctagacagtggggatgcaatggcagacaaaatagacactgccccagcctccatggagttctcgttccaggagggtgaaaggtaaatgatcaggtggagtgggaaataagattattagagttgctatacaacatgaaggggtagggatgaagttggaaagtgcccttaaaaataagagcagtcaggctgggtgtggtagctcatgtttgtaatcctagcactttgggaggccaaggcaggcagatcacttgaggttatgagtttgagaccagcctgggcaacatggtgaaatgttgtctacaaaatgcaaaatttagccacgtatggtgatgggcgcctgtaatcccagcaactggggaggctgaggcagaatcgcttgaacccagaaggcagaggttagagtgagccgagatcatgtcactgcactccagccgaggtgacagagcaagactctgtctcaaaagaaaaaaaaaaaaaaaaggcagagagccagagaaagaagcatctcttcatctctctagggaagggacatttgatttgaaacataaaagatgaaagtcaggtggagggtgagcaagtgccaagactaagcagagaatggatttgcatgtgtgcaggaacgatcaagaaagcctgtgtgggccgggcatggtggctcatgcgtgtaatcccagcactttgggaggccgaggcaggaggatcacgaggtcaggagatcaaaaccatcgtggctaacacagtgaagccccatatctactaaaaatagaaaaattagctgggtgtggtggcaggtacctgtagtcccagctattcgggaggctgaggcaggagaatggcatgaacttgagggacggagcttgcagtgagccaagattgtgccactgcactccagccttagcaacagagcaagaccaactcaaaaaaatattaaattttttaaaaatcctatgtgcctggagcacagtaaccaagggaaggaagatgaagattgaaagagggacagaggcagcttattcaagtttggattttattctaggatcaatggaaaactattgaagggttttaagcggggagtcataggattagatttatatttaagtggagagatggacagacttgagagatttgatacatgtaaatagctgctggtttgaaggagcaagagttgaaaaaatgagacaagatttatggctgttgagttggtgttgatgaactagtggcatatattagtgtagtcatcatgtgcatggagtaaagtggacacattgaagatttcttccgaaattactgatggatgggaagtgggcacatggagatcatcatgatctgactgcactactgcccactttggccagggatgcatggtgtggaggatgaccatatagctggtcgtgtcctaacatggcgaccgtaagacctcttcccatcattcctgtggacatcctgggtattgctgtgctctgtctccgggctgtgcttagccagctctgaggacatcagattgctgacgtgcttggcatatctgctgcaaacgtagcactcaagtccacatcttccccaataaccttgtgactaaattgtagtgtcacacaagggcgtgttcagaaattagcatttgaaaagaagcctccttgctttcagtttgagctgacatgatctcttttcctctggggaaatgaaatttattaatcataataaaaccattggattctgaaggtagaggtcaccctgaagagaaaaggaggcagctcatttctgaggagtagttcaatgctgctgtattttccttctgccttggaagagaatactgccaaattgttaccttgggttttccacaaaggttgaaactatgcccagcgttatagaatttaccactgaagtatgcagtaggaaaaggtgggagctacgcttttattaaatacattcaaattgcccatatagtgtctccccagaagaggaaattattgccacagtaaaaccatttccccaatttttaaaataatatatctgaatttgcatcttttcacatttgttttgaggtaacaccttgccataacatcacttaacaaactctcaaggatttcagtttgcctctgcacttcatatcctatttatgaaacagctttgccaaatttaagtaccttaaaaataaccctattaacagatttttctctggaccaatcaatcacagacttcattccctcatgaaataaagagcagtaccaaggttatagttttccttttatgcctgttactatgtacttctagttaagtgggtaaaggcccaggtctcaggagtgagctctctgaatatattattattttatcaaaaactttttaacacatctgcccttggaccgatacctgtttttcctcccagaaagaaggataatcgttgattaaaggccatttttgataagaaggactgaagggtgtccccaaagaatgaaaggcaagagggagatgactgtcagtttcactgacagattcacctcagaagagaggcatcccttcaggtccttgtttgaggatcaggagaatcctcttgaagctgaaagcctcatctagattatttgcactcatcaagtgccctttgacacaggcagatgggcttgagagttggaagatgcccagtgcaaacctggtataatcaattgttttattccacctagggtctaacttggagtctgagaaggtccatcatcacgctttcttcaccttctcagactccatggtgtgaggtggtcaaacatgtattggattggtatcacttatctaccaaccatgagaaagcttggaaggaaaatggggggaaaacaggaaaggagagggaaaaggtacgtgcaaattgggctctaagggatgagagacgagctgaaggttgataatacagacaaaccatttcttccaccagccttgttccttcattcaggaaatggtcaaagaatcaaaaaacgatgtcgatcccagtgagtgtctgatgcattcatgccgagctgctgtgaatgttggttgctaacagtacagctgttcccttctccagaaaattgccccatgtcagaggaagccactttaactcaatggtgcatcactcactcctcaggaaagcccacagctaatgccgaaaacttatgtaggcattaaaaagccaacccacttgcctctaggtggaacctgctgtagcatgaaacccataggatcaggtcgcagatattcatctcagacgttgcgttttttttccccttgctctgacctacttgcccctctcttcctcttgaggacaccccattcggtaagtcacttgcacaggaatctattccagtatcagctttcaaggaaggacgtcagcttcagtcagtattaagatagcagcattcaaactatctccaggaaaatatctggcagggcaaacaagtatgggcacaggatacggtggaccaagcacgcaagttgccctaagagattcaagtatcaggctgagtgcagtgactcacgcctgtaatcctaacactgagaggctgaggctggtagactacttgaaccctggagttttgaaccaacctgagtaacatagcaagactttgtctcccccctcataaaaaatcaagatctgccctgtctagttatgcgaccttgagcaagtgacttcacttgattcctttaaaaaaaaaagttaacttccagatatttagtaggcattcagcacgtttggtttccatctcttctccatttttatcctaaagcctataccagaagccatggcaggtagtaggatggtagagagaaaaacacaaagatgagtaaatgtcattaagatttgttgtttcaaatgcctcccccttcccagaacctggccatggattaatgtgacagaagttctggaataataggatcaaaaccaaatcagtctgattgaatgggaatgggaatgggggtcccacagaccctttaaggctgcttccattcaaatatacttgttcctttccattctaagatgctggacactaacttcagacaggttcacttcaccctttctgattcaccctatttcacttgaatggtgacagctgaatcaggagaaaaaggcactctcttgagaattaaaataccctctgtgggtgctgggcttaatacttgaagttgtttctttcttacctacctcagtctctaaggcagctacttgagcagtgtagaaacagtattatggggggaggcagggaaaagcatatgtaagtacgtgtgtatatatgtatttatctgtcaaacatagcaatagcaaccatgttaaatgcacaaaaaatgtatcatgtacagatgaactcttcttatactacacagcagagtagaatttgcttctcactggaagatgagtagggcccctgcatactgtcttggtattttggattttatgattgttattgttttgtaattgcatactgtggatcaatcttcacctctattttcctttcagttacggacgagtttatgctgccgacccctaccaccacgcacttgctccagcccccacctacggcgttggtgccatggtgagtacaagtttctccttgtcctcactttctcctgcctcccttccctttccccagctgggacctcagtacgggttgacgtcctctcacttcccgttaattgaatttgtctcttgtgctaacagcagctaaaatgccacattaatcctcccagtaaacttgataaatgtcttaatttcttggcaatgtagtgcatgtaagttattatatttctaattttgcaagtctcacctagcagagcacttaccttaatggaataattagtcattttgataattaaatccatcactaacagaatgcagtgtcaatgcagaacttttttttttctttttttttccctcccttgctgctcattcacatagccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggtaagggtggggtgaacttgcctgtacttgttcaaacttctatgcactgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaactcccttctcaagatcagattccatacagcttacagagccaagttaagtaagaagtaggttgagattttcatcccaattctgcattcaacaactctgcttcaacacctagtccacatgaggaatgtgttggagagttgaattacattcaacaactggtccaaattcaacctcaagtgcagattattctgttataaaaaaatgagacagtgaaaatccttccattgtccagcttataatagagtccttttagctaagaggactggctgacagaatttggttttgcagggaatttctttaggaggagctattggggaaggtcaggaatggccctatctttagttctccaagaatgacctgggatgggtagggggtgcctccatttcggttggttttgagtgtctatttttcacattagtctttttgatgatccacatgttgcaaaaggaaaatgtaaaaaacacacccctcaaattgctttgtttcagaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 349 - DNA, 380590 bp, Homo sapiens; identical to SEQ ID NO: 348

SEQ ID NO: 350 - DNA, 380590 bp, Homo sapiens; identical to SEQ ID NO: 348

SEQ ID NO: 351 - DNA, 384633 bp, Homo sapiens
agctggacgagcggcagcagctgggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggtgagcgcgcgcgcgcagggcaccttcccgggcccccgagggcagcgccgcgccagggaccccctctccgcgccctctgcgccctccgcgccctccgcaccctgggaccccgcgtctccggactcccggctccggaccctgctgcccgggactcccggatggacagtcctgccgttgccctgtccccaccctggtcccagacgggccgccgcggggcgcctcctgccctctcctgctctcaggcgcctctagagcgcccaggggcggcgtcgcgggagcctttgctccacctgactaggagcgcgcggggtctgtgcctgccctggagggcagcgcctcgggtgctctccgacccggggttccctatctctccgcctgcttccgggcgcgaggagccctcgccccccaccccttgtttccggggggggcggcgccctgggtgtccttctctatctccctgcgggcatgggacatcctttctcactcctctgtgcctccgggcagcgccctgtgttatctcccattgcccctccccgagggcctgggttcccctttccactcctcggtcacatcactgcgggcccctttcttccccagtccctccagtagtggggcatcctttcctccttcccagtccccctcccagaggacaccaccgccgcggggtcactctcgccctccctctgaatgcgtctttatctcttctcttttcccgagggtgctcggggcatctatgggtacatctgtcgcctgccttcagcccctaccccgacggaaacgctccccactatcccgccacctggtggtcgcagcctcctctcttctgcaggagtgaaggcagatgggggttacagccgagctcccacctacccccacaaaggcggaagactcttgggcacccgcctgtggctgggagtttgcacctggggtacagaggcagggaggaaggcgggtgactctgtgggtaactagctggaggctgggccccccgggctgcctgacatacacctccttctgcttttgcaggggcttcgggaagcagggattccagtgccaaggtaggctctggggctttggggatgctatttgtgggaagagagggtgaaaaatactttatagaagaagttactgagttaggcagagagtgaaagaatcacgttggtcggagtgacctcccaggctaggaattcttcaccacaacagggtcctttcaaggggtgtgtgtgtgactggggccgatggcgcttgggagtcttacatgccaaggaagttcacctacccttcctgccttcccggctctggaagagtcaaagcggtctcctgaagcaatcctggcatggtcagttccgctgggggagaaagtgttttcccgggacgtttctgggagaacctgtcctccttagttcccctttctctgcccatgtcccttccttatctcacccagggaggttctgcctctccctgccttgcagaggtctctgcaggtggctgccgctcctctgcagatggtgcatcccctagaaaggcgactgtgtttgtcgcctgggcctcctctctctctgaaagaagtatttccagagggagtgtttctcagatcctggtttaaatcaccctatcttctgggttgaaacagaaaggtctccagggcactggttacctgagttcttgcatctggcttgagatcctggactctaaccaggggtatcaaacctgctggtggtgagttgatcacgtgtaaagtgtccccctcccccgtctttggggctcatgtctaaaagacagattgcaaattggctctccaggaccaaaagttacccgcagctctgtgtagcccttagggtgtcttacttgtgaatttgatgtgaacgttttagaactgggagatttcacatacacatcctaatttccaactttaactttgctgagaaatggtctcactttcgcttgaaaacaatcgtttggagctgagagccgtcgtcgtagatggggaacagccttaccattttgtctcagttgatcccagtggggaacacttcacccatttctggcccctgtgggcatttaagtttgcaacctctcatctggaaagtttgtgtgttatgttttctttttaatttaaattttaatttttcactcttgggcttggtaagattgagtttggtaagaaacggcacatttctggggtattgtatctttaggggcaaagtgaccaccaccctggtgagctgggtttaaatcaaaagaaagtatttgagtgtggaagagtctgacgtgatttagcactgactgacagttttgtggctgcacctccaccctccagggaaaagtaaagtgatccctagtgagtgtaggtggcatcgtcagtggtgcagaatgtttgcttgctggcagcatggcactgtgctcctctgagactcttgcatactcttctgagatcggggtcccggtgggctcagtgagccctgccaacctacccagcctgtcttaccaagatttggatcctctgcaccacaccagaggactcctcaagtctctttaagtggcaacaacttaggccctggtgcaaacaaatttggattgttttctagaactttgacccctcaaacaaaatgccaatggtgtcttggcaccggaatgtgtaatttcttctttgaggttgcctttcacttccatgaatcagtttcagtctttgtctcttgctgagatcgggggcgatttttaaacatttttaccacggatcttctatgccacctgctctgctgttattgatggatgggaaagtcactttggaatgtgcaaggcatgacacatttgaaataggagatcctttaactcaaagtctggaagataataggaattttctgatgttaagagaaaaaggcagaattaaagtttgtaatgaaatatgggcgctctagagataggagtgtcttttttttttttttgacagggtctcactcttttgccccggctggagtacagtggtatgatcagagctcactgcagcctcaaactcatgggctcaagtgatcctcctgcatcagcctcctgattaattgggactacaagtacgcaccaccatgcctggctaattttaaaacaacttttgtagagaaggggtcttgtgatgttgcaagactggtcttgaactcctggcttcaagcaaccctcccacctcagcccccaagtgttgggattataggtgtgagccactatgcccctctggagtgtctattttttaaattgcctttctttttctcttccctgcctccccaccaagaggcagcgtagagaagtgggcatttgcacaggctaccaggcaagtccctgtcggtctgaatcctagctttgagacttcccaggcatattacttagcctctctgtatttcagcctccttgtctataaaacggagtcagtaacagtaccatagtgtggctgagcagctccaactcattgcaatatccaagattcttggaccagagcttgacacagagtatgctcagaaaatatctgctcttatgattgtccccagactaccccaatggtggggcagctggcacgagagaagactggctctgcagggttgctttgctatggaactgcctgccaggtaagagtcaaaactcagccatgaacttctggtcactctgtgtagctgctttgacagcatattccatttgggcagcagtagggaggagtgaggggaggggcagattggcagtccctgaaattgagatgtttagaatgggaacatataggaaagagggaaatttatccctggtactcagcattgcctgggactaattctggaaccactgaggagttccttagtatctgattgttcttggtatcagatatttcctctgaaagtaaatccacttacgatggaatcaacagtttatacaaaacacataaggttttatgatctcacttaagtcagcaatccagagcccagggcctcaggttcctttgagttttctgctccactatccctggggagtgacaattatctcatggtccaaaaaggatgctagacgctggagtcctcacacccttctttcagctagcaggaaggaagaaaggggtaaagaagggcatatagcacatgctcggtgtcacttgtttaagttgctcaagatccttctacctacatcctcttagctagggtttaatcacatacccacaccttgctgtgagggagcatgtgggaaatgtagtgtttatttcaggcagccactatttagaggatgtttccatttcaaaaatacaagcagagagaggatgttgtctctgccactctggtaggaggtgtgtaggatgatcgcaaggcaaagaaaccattgagagtaaccttcaggctctattacattgtcatggaaattggggacactgctatgggttgggagaggaaggatggaaaactcataaaccttgggaaattatggatttctgtgtgctcaggggagcttaagaatagattttcttgctttcgtatgatgataggacgaaactctaggttgactgcctcataatttctccctttttgtttccactctgtctatttcttataaaaccactctctgggaggtaatttaagaatgtgtttgatgacagggaactggggctgaagatccctattgtaaaattgcctaaattctagagtagaagtggaactcctttgacaagcaaggcagatttctctctatggcatttttttctttgccttttatttatttatttatttattgagacagagtctcactctgttgcccaggctgcagtgcagtggcaccatttcgactcacggtaacctccatctcctggggctcaagcgattcttctgcctcagcctcccaggttgctgggattacgggggcctgccaccacgcctggctaatttttgtatttttagtagagatggggtttcatcattttggccaggctggtcttgaactcctgacctcaggtgatccacccgcctcggactcccaaagtgttcagattacaggcatgagctacagtgctggctgtttctgtggcattctttacaggaacttaggacctgcatttgagctttaattttaattaaagtcttctctaagaagatttttggtagagagaaaaaccttcttcttttattttaaattttgtttttagagacagggtctcactgtgtggcccaggctggagggcagtgacatgatcatagctcactgcagcctcaaactcctgggctcaagtgattctcctgcctcagtgtcctgagtagctgggactgcaggtgtgtgtcaccacggcccttttttttttttttttttttttttgagacggagtcttactctgtcatccaggctggagtgcagtgacgtgatcttagctcactgcaacctccacttcccaggttcaagtgattctcgtgcctcagcctcttgagtagctggaactacaggcacgtgccaccatgcccggctaatttttatatttttagtagaggtggggtttcgccacgttggttaggctggtctcgaactcctgacctcaggtgatctgcccgccttagcttcccaaagtgctaggattacaggtgtgagccactgaacctggccaaatacatattttttaattttaaaattttttgtagagatagtggatcttgctttgctgcctgtgcctggtctcaaactgccagcctcaagccaggagtctcattctgctttggcctcccaaagtgtttgttgtttttgtaaaggaagtgactttggtagaaatagagaggcaataaaatatagagattcagaattcttagcaatgagttggagtccagtagaattgggtatgtatctctgatggagccgcttactccctgtgtgaccttgggcaagtcgtcccccagcagcaactttggtctcctcatctgtaaaatggggataatagcacctaactcatagggttatggtgaagaataatgaggtggtgcatgagaaatagccacagcaagtatcaatgactctaagtgagaccatcagtattacttgattagctgtaggaaactgtgtcaaagtgggacggagttcattctggaacttgttaaatgactaggcctctttcatgtacttagatagtttctcttcttgggtatatttcttcctgggtattgggtaacaccagtgagtgctcagttcagtgtctgggcccagaaacccatgcctggttagcattgtcttttcttctgagaaagatctgaacttgccatggactctctagaaaaaccccagtgtacaaattttctatgaaaagctagaattgatgattataatgagtaagttggctcttccttttcccatgtagattagaaaacatgtttttaaatcttctaattgaaattattcttaaaaaaccccaaagtctgacatgactccaactattgttgttttcatcaatatcaatcctatcaaatcaaagtttattttagtgtgtaattaacacatgtagactagaaaagtttgcacttttttatatcacaaaaaaggttaattttattttctatggaaagctagaattgatgataatgagtaagtcagctcttctttttcccatgtagattagaaaacaggtttttaaatcttgtagttgaaattattcttaaaaaaccccaaatcatgacatgaatccaaccattcttgtttttatcaatattcaccctatcaaatataaagtttattttagtgggtaattaacatgtgtagattagcatagcatatgtgtatttatataacaaaaaatgaatcaaaagttaattttattttgggcagtgttccctagaaacttataatatggccccatgcacttcaggttgaattttcttagtaaaatcataaagaggtccattttttcaaaaaatcaccaagtcaggctgcaagtttagaggttacttctattgtttcacttctctttcttcccagaagcagaccccagagacctgtgagccaaactccactcaccttttagcttattctaaatgtgtcctgcgggcttctctgtgaataaaaggcagaggctttttgacttcgtgtttgatgatttggcttttttcttttttttaccacctgacgggggatttcaggctcaatgtcccaatcgaaataagaatctttgagtgggttaacattgagtcttaaaaaggagggctgatttgttggagaggcaacaacgaattcatttttcactgtagagcactcaggaggagtctgaagctttgtcactgggcaacagaatgcctttctaagtaaatatggaaaatatgacctttgaaaatctagctgatatgatatatagattcttaggatataatttttaaaaaatatattatttccaagcactaatgatactccagagatactgcccacaaccagatgcagcatgtttatagtgtatctaggccaaaaaaaaaaaaaaaaaaaaaaaaaaatagaagatacagaagaaggcaattggtcaaaagattaactgaaggtttgaaaataattttatacacatttgtactgttggggtctctcttctctctgtctctgcttatccttctgtctctgtctctttgtttccatcacacatgcacacacacacacgtgtatacacacacatatatgtaagtagatcaatatgttataattttcacaatacgcatcttcttttgctacttttcagatacaggtcattaaattactaagtataatttaaaatatatggtctggccttttaactctgcagttcaattaattcttgggtagatagggggatctgctgaaaagtttgtctctgacgccttcaaaggtaagtcccttatgttctggcatttgctctaataacatgaattctttgacttcattcatccaatctcttcattgaaattgtgtgaaattccatagatagaatgttagcctttttacagagaatacaacatccacagtgtttacatatggcatttggaggtgtgatggctgcttgaaaatccagtaggaaatttgtctattcaccacatacattcatttattcatccatccatccctccatttatccacccacctctctattcatcatccgtttttctgtttatctatttgtccatccatgcatccatcccttcactccattctccttctaaaagttcttttttttgagacggagtcttgctctgtcgcccaggctggagtgcagtggtgcaatctttggctaactgcaagctccacctcccaggttcacgccattctcctgcctcagcctcccgagtagctgggactacaggcgcccaccacctcgcccggctaattttttgtatttttagtagagatggggtttcaccatgttagccaggatggtatcgatctcctgacattgtgatcctcctgcctcggtctcccaaagtgctgagattataggcgtgagccaccgcgcccagtctcttttttttgtttagacaaactctcactctttcgcccaggctggagtgcagtagtacgatcttggttcactgtaacctccgcctcccaggttcaagtgattctcctgcctcagcctcccaagtagctgcgattacaggtgcccaccacctcgcccagctaatttttgtatttttagtagagacagggtttcaccatgctggccaggctggtctctaactcctgacctcaagtgatctgcccacctcaacctcccaaagtgctgggattacaggagtgagccaccacacctggcctcactgattaagttctatgtgtcaagttctatttgtcaggaactattttaggtgacagaatacaatggtgaatgaaactgagaaaatttctgttgtcatggagcttatgatgtagcggggggagataagacattctacagatcatttcactcatatttaacctcatttttattaggtactttgaagaaaatggactgggtaccgggagaatatataatgggaagctaacctatgtaatggctggggatgcagtcagtggtctgggaattaaaaaaaaaaagcccaacttctcattctcattttctgaggtaactggagaaagtctgagttgtcaaggaactagagctaaaaatctgtattgtaaaactgcccatatcctggataatatatgcaacagggctgaaggcagtggctcatgtctgtaatcacagcactccggaaggccaaggcaagaggattgcttgaggccaggagttcgagaccagcctgggcaacataacaagaccctatctcaattaaaaacaaaacaaaatatgtgcaggagacttatctttgtgacattctatggagaaaccgtaaatatttatttgtatcatggctgcaagtaagatgagtaagtatttggtagaactagcctgttaccttgagatggcttctttcccagtttgacagagaacttcatctcctcttagttaataactcagataatgagctgacttcctttttgtttagggtttacagtttgaggtggctgttctaaagaagaaaaatcagacaatttcagaggtggaggagcaagtctgggccaatagattgaaaataaataaaaagagagagcacggcatttcagtgagaggcattttgagctgaaagtcagttttcagggagcacaagattactcacattgcctgccaaataccttcctcaccctgtgtccatctctgatatattacaactcttcattcctttggcttaggcagtattttctcttgttcagaagatactttttaagtagtttaacaataaacagtgttgactcacttatagagaaaggacttttgtcaagtctgtctttctgatttcattaaggagaaagtctcagttggtgttaatatatctttaacaaccctctaacacaaatctgggcacttagtagatatctgttgaatattctttttttttaattataaaggaactacagggaattatgagaatgtaaaactatgggctgggtatggtggctcatgcctgtaatcccagcactttgggaggctgaggtgggtggatcatctgaggtcaggaattcgagaccagcctggccaacatggtgaaactccttcactactaaaaatacaaaaattagccaggtgtggtggcatgtgcttgtagtcccagcttctcgggaggctgaggcaggagaatcgcttgaacccgggaggcagaggttgcagtgagccaagattgcgccactgcactccagcctggcgacagagcgagactccgtctcaaaaaaaaaaaaaaaaaaaaaaaagttagtttctacctataaaccaacttttttttgagtcagcgagggtacacttttacctaatgttgagcctggttctgttctaccctgagcttgattctgtactggctattcctccttgtgaacagagaagggaagttcagtgtctttcctggaaatttttggtgttgtaaggatgctcagtgttcctgaaggttgagaggaacagcaaggacaggatctggtagagatgtcgcttttattcagaagtgctaagctgttaatcattaccatggttgttattaccttttaattgccatttgtcctgcttgtttgtggtctcctgggcatctccttccccctcagcccacaagcagaaagttgccctacagagtcaggaggagaactcaaacccagaccagagagctctgatccactcctatgggtcttggaactggctaagtagatggaaattaactgattcaagatatgcaacaccattagttcaaccatagctgtgttcctggggtgaattctagctttcttttttctttcatcttgctacttcccagagaccagactttgggcctctagggaaggagtatcaaattgggcttgagagttcaagctcaaaacagacctgattttaaatcttggttctgcttctccatatcttcatgacctttgggtgggtaaaatatgatcctgcctctatctatctatctatctatctatctatctatctatctatctatctatctatctatctgtccatctatctatctatccatccatccacctatccaccaatacatccatccgtctgtccatccatccatccatccatccatccatccatccatccatccacccagctattcttccattcattcatccaaacatccacccatccacccagctattcttccattcatccatccaaccatccatccatccatccatccatccgtctggctatccaaccgtttttccattcatttaatatatatttattggatgcctaccacatatcaggtactgttctaggcattggaactagaacagtgaacagaacagcatcgctggcttcatggaatttacattctagtagaataacagtaataagtgaataacatagaacgaatatattgtataatgtcaggttgccatatgggctttgaagagaagtaagacactgtcctcacccttaaagatcttcctggtcttttaaaaggagaacagcacatggccaattagttctgagacataatgtaaagtgctacaccaagaatgtaaaaacactttggatggcatccctactcctcctcggaccggtgaagattccacagaggaggtgacatttgggaacagtcttacagcaggagtgggagttcccggattgacaaggggatgagggcaggggagggtgtttcaggcacaggacaggacaacgcagttgagatagtgaggagagagaatagggcacatgcagggaacaggaagaagagggtgtgagggagggaggagcaggtgggaggtgaacgtcatatcagaggggttggcccctgtgaaggcagtgtagtgactaggaagtggttgttgtcactgttttaaagtgggatgtgtgggggtgagtgaaatggccaaatgtttgaaaaagaggagcatgagatgcctttggcaacaatacttgccatgactcaaatcctgaaattctaggcctgcagtgatggaagtcaggcaggagaaactgaaatggccatttagaagcagtgggggtgccttaccggagcacctcgtggctgttgctatttttcacaccctaaagagacatttggaatttcatgtcagtcatattgttgattgttctattttgagggtggttactagttatttttatggttctaacaatagggacatctctcttcactgtatccttagacgcggagggccgtagaaatgaattttcctctgaaaggcatcctcccactccctctccctctccactgctgtcacccagtgggtacgtgtttattgagcacatgctgcacatggtggtgaagagttggtgttttggagaaagaaaggcttcgatttaaatcttgacttcttgctgtgggaccttaagcaagttacttaacctcttcgagcttctgttttttcatagctaaaaggatataataataaaacctactttatgtgaagtgtttcttagcaccctacctgacatatatacagtaagcacttgataaatggtagctatttctgttcttcctaggactgggcactgtccttgtccttactgagtttataatcctgttggggaggcaagatgaatgctcttgaatcaaggagacgacgcaagaatggatgtgcttacatgtcgtggtcaatagcattagctgcaccttacagtggatcttagagagaaatgcttggttggggccggagaggtgatttgagtgtgagtgagcacagtgctttctgagaaaccctttcctggcctgcaacactttaatttgtgggaaacctcaggaagtagaattgcaatctgtgatcgccccatcggctgacctcacttcaaaaatgtattggtagcatttcaactttaaatagatttgtgaccatttcacccttctaaatttgggttcccttcaccctttgggtggagtgtttatatcccttttcggttgaagaagctgacagatagtgtaggtgaaggtggagggtgaagtctgaaggacggtcgcttgtctcattgggatagtcagggcagtgatttttgtgggatggccctatattgaagatcttctttccctccctaaaggtagagaccattctttagagtttagtgagtgctgcaaatgaagatttgatcgttatttggatttttttgcatgtgtatgtgtggattttttttggtagttatccagatacattttgtggcaaaatttatggctgagggtattgataattgtttctgagacaaacagtgcacttagggaaacaggattgacatatagagtagagaaggacttctttttatttcagttggatattcatcttttggtggctagctttttttaaaaaaactattaatattatttttgattgacaaatcataattgatggggtacaatgtgatgttttgatacatatatacaatgtgtcatggttaattcaaactaattaatataaccatcagcttgtttacttattttttatggtgagacatttgaaatttacttagttatttgaaatatatgatacacttattattgactatgttaccctgctgtgcaatagatctccaaacctattccccttgtctatctgaaactttgtatcctttgatcaacaactccttccctcatcccagattctggtaaccatcctcctactctctacttctatgactacgactttattagattccacatatacgtgagatcatgctgtatttgtctctgtgtttctggcttattttacttagcataatgtcctccagattcatgtatattgtcacaaatgatataatttctctcttttttttaaagtctgggtaggattctattgtgtgtatacaccatactttctttattcattcatcctctgttgaacacttaggttgattccctatctttgctattgtaagtagtactgcaacaaacatgggaatgcacatattctttgacatattgatttcagttgctttaaatatatgcccagaagtgggattacttaaaaaaaatttaatttaattttttttaatttgagactgagttttgctcttgttgcccaggctggagtacaatggtgcgatctcagctcactgcaacctccacctctcaggttcaagacattctcctgcctcggcctcccaagcagctgggattacgggcatgcaccaccacgcctggctaattttgtatttttgctagagacggggtttcactgtgttggtgaggctggtctcaaactcctgacctcaggtgatccacctgccttggccttccaaagtgctggaattacaggtgtcagccaccatgctcggtggtagttcacttttttgtttttttgagaaacttttagtactgtttttcataaggctatactaacttacattcccaccaacagtgtatgggtccccttttctctacatcttctccaacatgttattttttatctttttgataaaagccattctaacaggtgtgaggtgatatctcactgtggttttaatttgcatttccctagtgcttagtgtgctgaacattttttcaagtacctattggccatttgtgtgtcttcttttgagtaatttctgttcagatcccatttttaaatcaggttatttgtttacttgctattgagttgtttgagttctttgtatattttggatattaacttcttatcagatacagcatttgcaaatatttttcccattctgtgggctgtctcttcactttgttaattgtttcctttgctgtgaggaagctttcagtttgatgccctcccatttgtctccttttgcttttgcttaatcattgcccaaaccaatgttgtggagtttttcccttatgtttttctctagcagttttatagtttcaggttttaagtctttaatcaattttgagttgattgtgtatgtggtttgtaagataaaggtctaattgcattcttctacatgtggatatccagttttcccaacaccatttactgaagagactgtcctttccctcattgtgtgtttttggcacctttatcaaaaatcagttggctataaatgtgcaggtttatatctgggctttctatcctgttccattggttgatgcatctgtttttatgctagtaccgtgctgttttgattacaattgctttataatgtattttgaaattaagtcgtgtgattcctccagctttgttctttttgctcaatgttgtcttggctatttggggtcttttgtggtcccatatgaacttagggattgttttttctatttctgtgaaaaatgacattggaattttgataagaattgcactgaatctgtagattgctttggctagtatggacattttcacaatattaatttgtctagtccatgaacacggaatatcttttcatttatttgtgttttcctcagtttctttcatcagtgttgtatagttttcagtatacagatagtttgcttccttggatacatttacacctaagtaattttttttttgctgctattgtaaattagtttgttttcttaattttctggtctggtagtttgttattagataagctagtatataaaattagaataattagataatctaatatagaaacactactgattgtatgttggttttgcatcctgcagttttattgaatttgttgatcagttctaacagcttttttagtggattctttagggttttctgtatataaaatcaccttgtcaacaaatagagacaagttcacttcttcccttcctattaggatgccttttatttctttctctttcctaattactctggctgggacttccagtactctattgaaaagaaagggtgagagtgggcgtcctgatcttagaggaaaggctttcaacttttcagtgctgagaaggatgttagctacgggtttgtcataatagagcccatagtgtttattgtgttgagtgcatttcctttataccttattgctgagtacttttttcatgaaagaatgttaatttttttcaagtgcttttttttcctgcatctattgagatgatcatatgatttttatcctttattttgttaacatgggtatcacatttattgatttctatgtgttgaaccatccttgcatcccagggagaaatcccacttgatcatggtgaataaaattcttttaatgtgttcttcaatttggtttgctaatattttgttgaggatttttccatctatgttcatcagggatattggtttatagttttcttctcttgtgtttttgtttggctttggtatgatagtcttggataatgagtttagaaatactcccttaattttttggaagagtttaagaagaattgattgacatccagatcaagaaacagaacatgctggtaccctagaagcatcatctcacaatccctatcaaccgtatccttcaggagtaatcactatcctaacctctatcacctatgattactttcatctgttcctgaacttatgcccacttttctgttatgcaactccattgacttatgcccatttttctgttaaaaaatttaaaaagtgcagagctttaagttactgaggctgagcctgagaaatgttagctgggacttttttagttttgcatagaggaagtgaaatccgtatgggagacaggcaccttctggaatcacccattggggaatggtgccgtttgccttctttggggaacatctgcttcctgtttcaatgttgcccatcggttccagactgttcaacaaggaagccagggcattctgacagtttttccacacaataatttagctctgtaaatactaggaaaacttgagctcacaaactatttttagggcttaacatttcaaaaattctgtattagtaagaatctattaaagctgctgtaacagacaaaccttgaagtctctgtggcttgacagaagggagtttatttcttactcatgtcactaaccagtgcaggtggtcctggtcaggacatcttccacagagtcacacaggaccccagggtcctccccattgggccagtggaaggggaaagggaaattgagaaagcacactcatttcacaacaacttcagctggggaaggaagtcacatcacttctgctcacattctatttgccagaacccaggcaaagaggcaaccaacggaagggggtcctgggacatgtcgactagctctatgtccaggaggaaaagaaaacaggttttgatgaactcagtaaatctcactccagtctccaaagccataatttcctttgtctttctttgcggtgatgtatctagttttatctctcacttgactggtaaaactaagatgcaaaactctggacgtctttatcttatcaaacatagcagggaaagagtgagttctatttgtgttcctaaaagtgaaataaagaagcacttttcttgtttttagttattagaacaatctggctcttgtcagactttctagtttttcaatcagtcagaattcttgcctctctggttgcctgttgtattaatccattctcatgctgctaataaaggcataactgagactgggtaatttataaaggaaagaggtttaattgactcacaattcagcatggctggggaggcctcacaatcatggcagaaggcaaaggaaggtcaaggcacttcttacatggcagcaggcaagagagcgtgcacaggggaactgccctttataaaaccatcagatctcgtgagacttattcactatcacgagaacagcattagaaaacccacccccatgattccattaccttccgccaggtccttctcatgacacatggggattatgagagctacaattcaagatgagatttgggtggggacacagccaaaccatatcacctgtggacatcccaagcagatctctttgaggccgggttagttctcttctaagctgacttgttatatagaagaatcctttgttggttctacttccagatatttgactggacacccaacaaatcaattatctattgctggatagcacataacctcaaggcttagtggcttaaagtagccactgttttatttagttttagtttctgtgggtcagtaatttgggctgggctcagctgggtggtctgtctgatctgggcagggattggctgttcttggctgggctcatttaccttcctggggcctcagcagggatgtctaggacaactggggcctctcttcaggtctttcatcttccagtgggctatcctgagcatggtcatatgctgatgggtgcattctctgggcatgagcaagggctgcagggcttcttgaagccaaggctcagaacatgcataacatcacttctgccatattccctggtcaaagcaaatcacaagcccaccccagaagtaaaggaggaaatagagaagagaatagagatgcctcctcttgatgggagaagctgcaaataatttgtgatattttttggaacccaccacactaatttcagtgtggtcctcgcaattgcttggctgtctaaaaacatactccagtctagtgtgcatttctgaaaatgaacttgatcaaaggcaggccccaaatgagtgctcaacatttacacctgataataatactacctacctcctagggaaatggtagggccagatgagatgctgtatgcaaaggatacggccaggacttagtgcacacgcaacactgaatactaccaccatgactactgaatactgccatcaaatactaccgttactaccacttggcactccctaaaagcttgagattcagagaaaggaagacaaagcccctgtacttgaggagggagagaataaagagagccggcgggggagggggtggcaggagagagagagagagagaggcgtgtgagtgagttcttgcaacacagtgtggtcagtgtgatcacagagctgtgatggagtgcggatgaggtctgatgacttactggtcaagagcatgggttcaggcctcagttcctccccaatcacatgtggggtcttaggcatctttctttttaatcttcagtttctttgtctgtgaaatgaagataatggcacagagcctacctcccagagttctatgtggattaaatgagacaggcaaacaacaacaaaaaccacaaacaaacaaaaaacaaaaatgaaaacaaaaatcatgtgattgcttattaaatgttagttatagaaaaaaatataagttcttaaatgtgcccttgtaaaaatgtcctaaagacctcatctttatttagttcttctgcaactctggctagcatcattgataaattgtcttaaaagatgaagatttgtatgcaggtggtttattggggatgtagctcttgggaacaacatctataagggatagagggaagcagggaagaggtagttgaactgtggtgcaatagttgtaatagaggccaaagccaattccatggctggagctgagacggcccttcagaactgggacaagccaatgcatcaagtgggcattgattgtgggctgctctttggaaggcagcattaccttgggcaaagcagctcccttcttcaggggaggagtcccagggaggacacagctgtgagcaattggttttcccagcagctgggggaatgagtgccttgtccctatagatggttttgagggggctgcatttgggggaatgccttctggggttcactgcgtgcttctatgtctttcttagaggttcatttcaaactataccttggttcattcacagtactgatttagttactatccagattcatagactgtacttgctggcactggaatatcatggacagagagtcctaatctgactaggcctagggaatgacatgggaatagcttgtcctgggtcatccagctaccagagaggagagctgggattcatatccaaccaacgatactttatacctcacattacttctgttatgctacacactcctgagtcacaggagattccaacttgtatttcaagcccagactgcatgacttcaatgtcctgttgcccttaacccctgtatcagattgcagccccactctggaaagttttcttgaattcttctatgtatgttttttaaactgtgggtcatcactcattagaagttcatgaagtcaatataataggtcaagaataccatgaagaaagcagaacagaaaatatcacagtgcatcactctcaggaagggtagatattgtttcacgaaactttttttttttttgagacagggtctttgtctgtcgcacaggctggagtgcagtggtacaatcatagctgactgtatcctcaacctcccaggcccaagagatcctcccacctcattctcatgagtagctgggacttgaggcacatgccatcatgcctggctaatttctaaaactttttgtagagatagggtctccctatgttgctcgggctggtctcaaactcctgagctcaaacagtcctcctaccttggcttcccaaagtactgggattataggcatgagccactactcctggcctcatacaatttttatttgatataaacatatatagccatgagtgaactgggtcaaaatgtaaaatgtgtctcttactgcaggtaactgtcaatgtagttcgaatatcactgtgaaatatatagagaagaggctctgggggctcatgaacttggcccatggactgttgaggctttttttttaatctttagagatgatataaatgtagtgctttgaattctttataattagaagttttattcttaccccatcaccatgtcccaagataatttttattatcatctttcagctttaacatatcacagacaaaagttatttttccaaatagaattttaagtatggtataagaggtttttagaaatggaatgattggttttggcggaactgcctggcctgacctgtcactcgggtgaagtgtcagagagctgtgtcgaatgctggcggagaactgtccctctcctgcagagagaaggagctgcttatcctgggggataatgtgggttgagaaagaagtgttttatgagcagaatcagcacagagggagggaggaggaggtgtttaggggctgcagagagccgccagaagatgtgggaacagtatgccagcacggaggtgggtcagatccccatggtgggactctgctgagggttgcctccagccgagacttccaagggctgggattcagtgtgtgtttatgttctctggtgtgcctgataggtgggggcccacatgacagctggcctctctgtgtttcccttctggccgtctctgatttggggcccaagggccataggggggccagggcactccagatgggacgaaaagtcaagtccaagaaaaaaatgaaatccgggctaggcttgtccctgcttgaggatgtgagagagagagagagagtgtgtgtgtgtgtgtgggtgtgtgcgcacgtgcgtctgcagtccctagaaggatctctattcattggacagagaggccaagggaattttccatttcctggatgtcttcaaagatttcaaatgccattaacttgagctgacatttattgagtactcactcggtgactggcactgttctaagtactttacatgtattaacttatttaatcctcacaacagccctgtgtggctgctactgttattgttgccattttatgctgagaaaacagcacaaagaattgagaaatttttccaaagttacagttaggattcaaaaatagacttggttttaggattgtgtaacttcagaattgatggtgacaatgacgttgatgatgaggatgatgatgatgatgatgaaggcagctaatatttcagtgtctgcaatgagctgggcattttcacaaactttatccctttgaatctttaccttccactaagatttgctgctattcttatcccttttgtagataagaaagcaagcttagagaagataaaacatttgcttaagtaactgcagagcgtagattgaattcaggtccattcgagtcagactgtctgttcaccaaggtgaagggctccgggggtcacagaggagcaccatggtgaggaaggccccgtaagagtgtggcagaatggcaaccaggaaggatctggtatacgggatggtgataaggcccatctctcatggccaggaaagtgtgcctgccacagcaatgaatgaaactggcaacatttgacaggaaggggaaattctctagtgggaggaatacttccatcaaactgttttttttttttcccagtgggggagtttgcacatgtgtagatttttttagccatagccttgaataaggaattcagaaagtggcttctagtttgaggactttcattggccacgtgatcacagtaggctgatttcttcatgcctaagttaccaggctgggaggacaggctgagaactatgcaagctgttgagtcacttggaaggaagagggttacatacagcaggcactttcatggaataatacttccctgaagagctgcactaatttattgaggcactgagctggatgcttcacacacatgatctcattgaatgtccacagcaccctaggaggttgatctcattattaacttcatgaagtgactgaggcttagagatattaaatagcttccagcctgggaaacatagtgaaaccccatctctgcaaagaataaaaaaaaatgagctaggtgtggtggctcgtgcttatattcacagctacttaggaggctgaggtgggaggatcccttgagcttgtgagggttgaggctgtagtgagctttgatggcaccactgcactccagtctgggtgacagagtgagaccctctctctaaacaaacaaatcccaggagacattaattaacttgccactggtctctaagctaagtagttgaagagggcaacaaacccaggtggtctgactcctaggcttgaaggtccaggttcagctactccaccagtatccctggtcagtctttggccagggcacagaaggtggcatatcaagttgtggggtctgatttggaaagtgtgagatccctcctttgtatcttttccaaagtccactcagaagagagtagtgtaaaaggagtgatagcacagcgtggtctggctggcatagtcagccgccctgtgatgggcagggggaagctgctttctgtcctcaagcagcccctaaacttgtaggccagactcataaatcacacattgataactcagtgtgatgtgtgctgtaatggtggagaggggggagaaatgccaggagcagctcacctcccagggtcctggggaggctgcacagaggagcctgagttctcagttgggttttgaggcagaggaagcagtgaaagagagaggaagaatgtcagtgaggtgcggggagaagcaagagagagaagacacttggcaggaagaagtagttgaagtacccggggatgtttagcttgaagaatagaaaatttggaggaggcagagaaaaggcaggaaactttaaaagcaggagagaaagacctccaggttcccaaagggagcatggcacttctcaagggggtgaggttgacagcattaggagagagagagagagaaagagagagagagaaagagagagagcgagagagttgtcaaggaagggaaggacccatggaggggagagcacaggtgaaaatgagaagtgatgggaaaatgggtgggaaataaatgaagttttgaggccagttgagaaatcttgcttggtggtttctattttctttgtgaagcagaaaaaaagaggaattagacagacctgcattcaaatctcatgaccccaggcaaatttcttatccttagcttcttcattttgaaaaaggggtgaatgataataggacctacctaataagagttgtcaggatcaaatatgttagtgcttgtgtaagatgcagtggcaccctggcacttagtaccaaaaaaaagtactataaatgttgtcacctattgagggagtccgggtttgggtgcttgatacatagaaatatcatgaatagcagcagagaatacaagaagaagagaaagcttgggggagaagatagagaattatgcgttgggtatgttgaggatgaggtgcctgtgccatatccgggtgtaggtgcccaaaggcaactggaagtcatgagaagtcagggatagaggtaaatgtttgggagttgttaatacaggggtgcatttttaaaatatctgaagtatgttactggtggcactcaaagatttttaatgatgtaaggtattcaacaacatggaactacgtagttttaaaagaaattctcttgtaggccgcgtgtggtggctcacacctgtaatcccagcactttgagaggccaaggtgggtggatcacttgaggtcaggaattccagaccagcctggtgaacatggtgaaaccccatctctactaaaaaaaaaaagaaacaaaacaaatcaaaacaaaaaaaccgggcatggtggtgtgtgcctgtactcccagctactcgggaggctgaggcaggagaattgcttggacccggagtcagaggttgcagtgagccaagatcgcgctactgtactctagcctaggcaacagaatgagactcagtataaaaaagaaaaaaatgtttttttcttttaattcttcgggttaaggagagtgtcttagtttggtgctatcatgtcctaaacatctttctaatgcatgcaaatctcccttttaagctaaaagaatgaagcaatctcagactcagagctatgtacctgctagaatttaataatttaaattttcattgtgttcttcatactcaccttctatttatagcaagtgttactagctctccaattctggaggttgtttcagataggatgcattagttctttttttttttttgagacaaggtcttgctctgtcacccaggctggagtgcagtggcacaaacacagctcactgcagcctcaacctcccaggctcaagcaaacctcccacttcagcctcccaggtagctgggactacaggcatgtcccaccattcctagctaattattttattttttatagaaacagggtctcactgtgtttcccaggctggtcttgaatttgggctcaagcaatcctcacacctccgcctcctaaagtgctgggattacaggcatgagccaccatgcctgacctgctttggttcttaaaaacagaatatctggcgagcctaacaaggaggctggtggttccagggttggtttaatcaaagacttaacactgtcatcaagcgcctctcagttatttgctctgccatcctcaaaatgtgatcagtgtctcccttcttggtcccaggaaggctgtgatagctcccagaatcacatactcacagggcaaagcaggaaggaaggggacataggacaaaggatttgtgtttaagtatttcatgtcacatttgcatgtggtgcttggagctgtggcagctatgttttgaccatgagggacaaggttggcaagctgtaaatggcagtgtaaaaagagggagaggatctgtctccttcacaatatccttgagcccctgaattcactaatcttgatatagctctatctcttgaaattttgttttgttagataattctcttactgcttaaaacgtcttaagatgggttttctgttctttccagtagaatgcattgtatctcacacaatttgaggttattgcctcaacctactctgaatcattgctcctcccccttttttcctggttgattagcttctcttgagattgtgtcttatcttcctggttttttgtatgtcgggtaattttggattgtatcctggacactgtaagtgttgtgctgtggagactctggattcattcgtatttctctgaaaagcattgatgtttttgttttagtaggccattgacttggttggacagtagactgtctctgggacaccagctcagatgtcagttctgttttttattttatccttgagtcttctttgggactgccccatgcatgcatggttcaagagtcagccagacatttgggtggggtttagacacagaatttggggctcttctctcttggctgtctctattatggaattccttcctcactttccagaagccgtgagtgacctgaaacctgtcctctggttctgtacaccagaaagacttgaggcttcatgttgaagttttagctgacagcagcttgcgttcaggggaaaagctgtaaaatgaccattcccttcttccaagtttcaacctctctgcagaatctgctttcttttgttcactttcgagtaatttcaggaaaaaatttttttttcgttgagagtttttacttgttacctatggaaaggttgggtctagctgaagcttgcttgcccataacagaaacgagactcttttctgtctaacacatgggaaaactaacgcccagagaggtgaagtcatttccccaattgtcagaggcacttgagccagagtgactccatcttgagtaagggctaggaaaataagaccgggacttgctgggctgcattcccagaaagaaaggtattcctagcctctagatgtctacagttaagggaacagattgataatgtttactaaacagagccaggcttggcagtgtccagctatcccgatatcttgagaacaaaggcattcctaattttgctttaaggataataatattgattattgcaaaacagagtaattaagaaaattaatcctttatcacaaacccttgtagcagaacacatctctccatgatttttaaaatcatatatatatgatttatatatatgattatataatatataacatatatgatcatataatcatatatatgcatgtgtatgtgtatatatatacacatgcatatatatgtatatatgtgtatacatacatacgtatatatgtgtatatatacatacatatatatgtgtatatatatacatatatatacacatacacacacacacacacacacacacacacacgaatattttacctagggtggacgtgctccttctcttacttttaggaaccccctactctgtctatggagtaactgttctttcaccactttactttcttaataaacttgcttttgctttgcactgtggactcaccctgaattctttcttgtgcaagatccaagaaccctttcttggggtctggatcaggactcctttcctgtaatacaatgtcacagagctcttaagtggcagagcttggggccaaacttaggctgctgcacccgatgtcccagctcctctgccctatctagctgtggatttgtgcctcgaaatagaattgcattttgaatgcagtttcattttcgtatggaaagtgtctatcctgtaaatgtaactgtagcagccccaaagctgagctgggcagttttatggcagcctggagtcagtcttgtccgcttccaatcagggttcctggactggctcctatattaaaattggtattagtagacaatgttccaggcagagttttggatagaaactatccatcagcaccaagaatgtgcctgatttggtaatctttttaccaaagtaaaagtcagtagtaagttgtggttaaaagagaggaagttcagagttcagtacgttatttctctctctctctctctttgtttaaataaaagaggaagttactgctcttatttttgtaccagcccgtcagtaatgggtacagagtaaaatcttagctaagctgaggtcaaacttcaaaacttagtaataaggatctcccttgttcctttgtagggcgactaacatgaaggttctgactcttaacccatagagccacaaaaaatagtcctaggaaaatcatatgattttatttattttaggaacagaaatggtcccttccgaagtagaggcatttctacttctttcctaaacaccatctctgctcagtgagctctcccaccctcaggtactgtgtttcaggcttattgctgtattgctagaagtatcctcaccttcgagattaagaaaagatatttattgccgggcacagtggctcacgcctgcaatcccagtcttttgggaagctgagacgggaggatcacttgagcccaggatcttgagaccagccagggcagtatagtgagaactcatcttgaaaagaaaaatttattgagctcctactgtatactggggatacagcaataggcaagatagcccttgctcctcatgtaacctacagataataaacaagattacaaacaaacaaaataagaggtcgttctagattatgataagtgatggaaaagaaaaaacctgtatctacttcttatagcagagacctgcattgggagttgctgtgatcaaacaggaaacggaaggtggagtttgcttctgtatccctccatccctgagtggaggctgggtgcttctcacgaccagggcctctgagatttctttttttgttttttttaaattattttagattaagggagtacatgtgcagtttcgttacgtggttatggagcgtgatgctaaggttagggtttctattggtcgcgccactcacatagtgaacctagcatctgataggtagttttttgacccccttcccctatgccctctccctcttggggtccctagtgtcggttgtttccatctttatgcccctgtgtacccaatgtttagttcccacttcgaagtgagaacatgtggtatttggttttctgtttctgcattaatttgcttaggataatggcctccagctgcatccatgttgctgcaaaggacacaatccaaataagcacaatcagaaatgaccaagctgacattatgactgatcccacagaaacacaggagatcctcagggatgactatgaacacctctatgcacacaagttagaaaacctagaggaaatgggtaaatttcctttgcacacaacctcacaagattgaacgaggaagaaatagaaatcaagatttattttctgttttgtttgtgtgtgtgtgtgtgtgtgtgtgtgtgtggttttttgtttgtttgtttgttttttggacaggatctcattctgtcactcagactgaggtacagtagcacaatcacacctcactgcaaccctgacctcctgggctcaggtgatcctcccacctcagcctccagggcagctggaactacaggcatgtacaacaatgcccggcatatatatatatatatatatatatatatatatatatatatatatatatatatgtgtgtgtgtgtgtgtgtgtgtgtgtgtgtgtgtgtgtgtgtgtgtgtgtgtatatgtatatttaaatttttatatataaatatatatctatctttgtagaaatggggttttgccatgttgtgcaggctgaaattgagatttcctaatgtaagaaacagagccccaaggggctcttcttgggctggtcgctgtatttcatcaggtgcctctgtgttggacacttacttccctccattgcatagattggatcctttatgcttagcctagactctgccctttgggatgcaaggagctgagtgaaggttctgggagagtaggcttaagcccagaagagggaggcctctctctggatgtcatgctagagcctgccttttagtctttgtgtttccactctccatcctcctcttctggagttcagaaccccttcctggtcaaattgcccccgggctctatgggatcctgtgggattctatcctttgagtctaccccacccttcaagtacttcctgtcttttcacacctaagtgaaagaaagtaggataagaacagcagttgttaacttgattgattgtaaattgccttcattagaaaatgttaattatcgcccctgggaagggattaatcctttaggtctctaggttactagactggcaaaagccaagtgtgccttggttgactgtttctttctgagagtaaagagaaaacatcaggggaggtagaaacctcagtcatggggtaatcattatggccatgtttatccccatacacgtatcttctgctgattctggagtcagctagattttgtgacccagcatagatgatatagtgacattgtcctgctgtgttaaaaaatttaagttcataagaaatgcataagtacaatctcatcaggataaattacacaacatagataagattgaagaccttttaactcttttgacgtctcaatttagtcccctctaccttccccagaagcctattgtttgtaaatttggtgtctcttatagaactctgtagcattccaaagtctgaactttctcccatgcatatggccacttccctgttgatgaacatttagattcttttttggaggggttgtgtctattacaaacagcatggcaatgagcatctttctacacatctcatcaatatgcaagtgtttctcgtgttcctcggaagtataatggcttagccctggggtatacacgattcagcttttaataggttttgccaaatgttctccagaatagctggaccactgtatactcccaccagcagtgtgtgtttccgtctcactgcatctttcccagaccatgatattatcaggccttaacacttttgccaatctgatgggagaaaaatggcatttaattttaatgatcctttcctgtccccttctcttctcttctcttcccttcccttccccttcctttcttccttcccttccttcccttccttcccttccttcccttccttcccttccttccttccttccttccttccttccttccttccttccttccttccttccttctctctctctctctttctttctttctctttctttctttctctttctttctttcttttctttcttcatttcctttcctttctttcctttcttactttccgagtctcactctgtcgcccaggctggaatgccgtggcatgatctcagctcactgcaacctccgcctcccaggttcaagcgattctcctgccttagcctccttagtagctgggattactgccacctcacctggctgattttttttgtatttttagtagagacggggtttcgccatgttggccaggtgggtcttgaactcctgacctcaggtgatccaccggcctcggcctcccaaagtgctgggattacaggcgtgagccgctactcccagccacctcttcttactagtgagactgaacatctttttacatatttattggacaattgtatttcatcttctatgaatgtctccctccccacttttttataatttcatattgatttgtaataatttttatttcaatctactagacactgatcctttgctcgttgtttgtgtttgtgttgtctattttcatcaagtcctgggtcctgtgtcactttagtgccataagggaatgacagactcccttattattggtttagctcttgaagcctaacaaagtgtttccaaacagttcattattcccactttaaggatgtgaagactgaggctcagggtcacaacttgtgcaatcttgggtagactttgaatctctgagcagacttagaagtagaccaaactgctgtgagccacagggagattattattgctaacttttccctgttagccaaacacttctgcttggtccctctagagagaagtctttaattattcatctctttccaagtaattggcgacaagtcctgcagctgggagttggaataaacttggttgctaaaagcatccatcacacataaaacaggggagatctggctccaaagaatggtagatgtagatcttcccctacggatttgttttctgaagatctccttatacactgacctcagccttttgctgacctatccttgtgaactgaaggctgaaaaaaccaatgtagccatggtccacatccatttatcactttcagaaatggcccctgcactttatatttcttcaggtcctgcaaaaaatattgaaaatcctttacaaatagaggcaaggtcaggccatccctgtgggatttccagggagcagtgcactgacccgttttgcagaatgggaagcaaaaaataaaactcagacttagacagctggcataagcaaggacttccctattctgagtgccaaatgtcaatttgaaatacttgaacttttattctctgggacatgtactggcattagtaagaatttctatttattgagcatttatttggggcaggcagatgataagttatacacattaattatcttatttgattttcacaatgacctatcagttacataattgattgtctgcattttatggataaataacctgaggctcagttatttgacttgctcaaggtgatgtaacaagtaaatggcagagccatgatttaaataacaaaacgcatgctcttaatcaccacattaatgtcttgatatcaattaatagaaccatttcccctccattttctctttagtttcagaactggtaagagtttgtctaataagatttttataaagtggtgacatgaatggcttgtggggatggagactggggccggctgccaagggtacccatctcacacgaagcatcaggtccacttgggtttgtttttggctgattacaatcttgaatcaaacttttcagtacagctggtctcccaagaactttctaatgttgatttgagcttccctgaatgaatctcagaaaataagaaagggagagagaatgcctgtgtattgagcttgacccatttcacagatgccgaaatagaagtgaggcgacttgcccagggtccctgtggtggattgtgttgttgtctcaattatttgctcccacctcatacaaggattatacatttcacacatggctatgtgacatacatgtctacttgcagaagggacacactttccttcccactgatgtggagcattggccaatggaacgtgagcagacacaatctactctacatttaaacagaggctttgagaagctattgtgtggtttagccattgttcttcccacctctgccacaagaccaagaaagggctgttgcctcagctgcgtcctgggatggaaaagacacaggaagtagaatcacagagccacagacaactgcagtgacacgtagcacgagtaagagctaaacttcgaatattgtaagtcactagaattttggggttgcttattattgcacttacctaccaaaagctgactaatacagtcatatagccagtaacttgactaagctggagcttgagccaggtcgaactcccaatcctatccatggtctttttcttatttcagtcttccctaatattccattctaacttacatcatattttctgtgtctgtgtgctgtctgtccttttttcttttaaataaatctttttctaccaaagatatagaacaggaaataatatttttctttaaagagtctgttttttcatttcaacccatttattttgaaggaaattttatcatcgtataaatagaaaaacagtgtcatcacaaataattcataactataagcagtggctcacgcctgtaatcccagcactttgggaggctgaggtgggcggatcacctggggtcaggagtttgagaccagcctgaccaacatggtgacactccatctctactaaaaatacaaaaattagccaggcatgctggcagaggcctgtaatcccagctactcaggaggctgaagcaggagaatcgcttaaacctgggaggcggaggttgcggtgagccgagatcgcgccattgcactctagcctgggcgacagagtgagactccatctgaaaaaaaaaaaaagggtaatttaaacaatattatgaagttctagctaggtactgttggcagacaagaatctgattttgaaatatcgtctctctatgttccaaaaaggagtttggcaaatattagaatggtgttcaaaacatacaagcaccaaactgatactttctcctttgataaatcaggaagattaaaaaagaatcagaagaacaatttcttcctagtatggcttggtgtgatgagtgtcatctgtattccatataaaattctttcagatatcaccaatgagtgatatgttcattacaatggggggtgtccctttctttggttcatgtataataactggaaacatgtatatagcatgtggtatgtgccaggtactcttcaagatactttagttatttaatctattgtcagataaggaaacagaggcttggagaggctaaacaacttatcctagctagaaagaggcagaattggggcttcaagtcaggtctgtttgattccagaggcaacatcctaaagcaaagtttccttctaactgctcacttgggacttttaaacgaagccattaggtgcttcactttcttgtggcatgccagagtggtagctgcttcagggcatcagcctggggccacatcaggacctacctgcacgtaggttgatcaggaccctggcagggctgtcaggtacagccacaaagcaagctgtttctgactgtgttcccacactttctcaggcatccaccctggtgtatgaatttgcttcttctttataacaaactacctctaaactgcactctagtctacagatcagctgggcaatgctgttgatctcggctgggcttgctcgtgtgtctttggtcagctagcaggttatctggggcctgattggtctaggatggcttcacttgcacatctggcacttagatgtgtgttagctggagcaatagggggcctggaccccgtgggtctccttttccagcaggccacttgggcttgttcacagggcagatgggcccagttcaaagggtctgagaacacaacggtactgcaggatgagctttggaactgctgcaccgtctcttccactgcattctgcatacgggccctaaacaagtcccaagccttctcagattcaagacatgggggatgggctgtatctcttatggagagagtcacatagcaagggtgtggctctagggaggaatgaagagtggtcaagtgcagcctgccatgctggctccttcaccagcctgtcagttatatgagccaatgggctgaatcatagtcatctttctctccacatgcctggcccgtgaaggatttgcctgcccagcagagaccgtggaatgaatgtgtgctccaggcactctgccttctctctcttctttgacttctctaagctcgttcctgcccctgtccccctctgtctctcttccccaggatcatggcattagtcggatccttcccatcattttcattttagctccagtatcacctctttgagccttccctgactacccttccagcattctctaatcccatcaccttgttttttttatcttttctttttttttgagacggagtctcactgtgttgcccaggatgaagtgcaggggcacaatctcggctcactgcaacctgtgcctcctgggttcaggtgattctctggtttcagccacccgagtagttgtgattacaggcatgtgccaccatgcctggctaatttttgtatttttagtagagacagggtttcatcatgttggtctggctggtttcgaactcctgacctcaggcaatctgcccaactcagcctctcagcctcccaaagttatacaggttttttttttttttttttttttaaatcttttcatagcatctgtaactgtttaaaatattagtttgacttccttttctagaatgtaagctttgggagagcggggtccttgcctgtcttgttctctgttacttctccagctcccagaatggtggctggcactcagggggtgctcaacacacataattgtcaagaacatgctacatcaaggcctgagtggctttgccacggctcttcttgtgactgcaggccttggtgccagcagccaccccagttccaagaaatggtctcttgctggccaacttagcaggaagaactggcagcgttcctgttacagcacttccaggtggctgcttttccctgagtccatgtggcttctccatgtctctctgttggagtcacaagttgtggaaattcacttaggccaacttagaccaagaagtggaatagttaatagttaaatgtcagtctgggcaacatagcaagacttcgtctttacaaaaaatttttaaaaatattagctggtgcggtcgtgtgcacctgtagtcctacctactcggggggctgtggtgggaggatcgcttgagctcaggagttggaagctgcagtgaactatgattgtgccactgcactccagcctggatgacagagcaagaccctttatctaaaaaacaagaaaaaattaataaataaaagttaaatataaggtctctggaggtatcctgtttgggttcagattctggctctgccacttcctagttgggtcacttttgggaagttacttaacctctttgtgcctcagtttttcacctacaaaaatagagcaaagtgtaaaaatatgaactacctcacagggttgtcaggaaaactaaattttgtgtatggaaagcactgattgctgagcagatggtgagcatctctgagtaggagctcctgctgccattattattattattattattggaggttatcatgtgtgattgaagagcaggaacttcagctgggcttcaggagcaactggttagaaaaacggaagacttggcccggcgtggtgtctcatgcctgtaatcccagcactttgggaggtcgaggcgggcagatcatctgaggttaggagttcaagaccagcctgaccaacatggtgaaaccccgactctactaaaaataaaataaaaaataaaaaaaaaattagctgggtgtggtagcggatgcctgtaatcccagcattttgggaggtcgaggtgggtggatcaactgaggtcaggagtccaagaccaggctggccaacgtggctaaaccccgtctctactaaaaacacacacacacacacacacaaaaaaaaaaaaaaaaaaaagaaaaaaaaagttagctgagtgtggtggtgggcgcctgtaatcccagctacttgggaggagactgaggcaggagaattgcttgagcctgggaggtggaggttgcagtgagccgaaatcgtgccattgcactccagcctgggcgatggagtgaaactctgtcaaaaaaaaaaaagagagaaaaaagaaaaaaagaaaaatggaagacttatcgggaatgcaggcagctgtgcgatttcagcttctctttgtttttggaccatgggttttctggttcttctttggttcctgcaggtctgactttctcctttttctgttgatggtctttcttggcctgtgtttgcaatgggtcaaccatgtgctttctggccatacttcacacttacttcccaactgggacagatagcatttcttaagtctaattccaaacttctgggataatctgattgcccttcattgagtcagaagccagtggatagggacatggaagatgctatagctgggctccacccttgcaggtgagaggagcagtttcaggaaagtctgccaggcatgagctgagaccttaagagatgtcagctagaattagccactgtcagtatatctgcttctgggtcccactcttcatcctgcttttcaaggttttcaaatatacactcctactcagtctcatgaaaattattatttttaaaataccctttagcacatttacctctaatgatactagattcttgcctcctgcctctgtaaatcactcggtcacttcccgatcttatatttggctgtcaagaatgtggaaatctcacagaacccttgaatttcaaagttggaagggaaaattgcttgtctatgcttataaaaaatacacacctacacccacgtacacatgtatttactaaaatagtattaggctaaatattcagttgtacagctttctgatttcattaacaatgtctgtctttccgtgtcagaagagatagacatttgaaaaaacggcagcgtaggattttgttctatggatgagctaaaagttctttcacctgtccacaaacttccacctagtccgtgtgccttataaaacacaaattctgaaatcccatgtaacgtgtcagctagattctgcctatcactgagtagagatgaaccatcacatctcatgttctagatttggggttacaaattcaaattcctacaggggccaggcaactgtcttagatgtgtgaaacgtcctagatataagaaatgcctgtaaatgaaaccttaagagtttttataagcatacaaataagtatgtaatattttgaaacatacttattttttggtgtacccacacaggcctagcatcaccagattcttctctctttttttttttttttgttttgccccaagagaggcaggaaatgagtatatttatgggagctttcctaattgtgaagtgttggtaagttcattatttttaaaaaactaaaaaccaacttgcaggccaaacaaaatgtgggccaccaatgtgtaatcactgatgtagataatgcacttcaattaatctaaaatcatcaactattttggcagccctctcagactgctgactcactgagcttttcatctgatgaaatccttaagtgattcacaaatacttaatctgaaaacctcttaatctaacttgtgttcctggacttgtaaattgggtttctggaccttaatacttgctcatgttaaatccattctgttacttatgtttaaggtcctacatctgtcttccagcctgatcacccatcttttcagccatgtgttgtttttgaattcaactcatttgatcctttctctatgtcctttttttttttttttttgagacggggtcttgctctgttgcccaggctggagtgtggtagcacgatcaggactcaatgcaacctcgacttcctgggcttaagcgatcctcctgcctcagcccccacaagtggttgggactacaagcacgtgccaccacacctggctaatttttttgaattttagtagagatgaggtctcactatgttgcccaggctggtcttgaactcctgagctcaagtaatcctcccagctcagtctcccaaagtgctgggattacaagcgtgaaccaccatgcccagcctctctgtgtcttatgataaaaaaaatactggatgagacaagactgaggaggaagacccagggaccctttttagcagagcttaccagcgggtgtccaaggattgaatttcccttcctagacatgttttgcttcaactaaaaagatatatatatatatatatatatatatgatgtatatcacacacatatgtgtatatcacacacatatgtatgtatatcacacacatgtgtatatcaaacacatatgtatatcacacacatatgtatgtatatcacacacatatatgtatgtatatcacacatatatgtatgtatatcacacatatatatgtatgtatatcacacacatatatgtatgtatatcacacatatatatgtatgtatatcacacatatatatgtatgtatatcacacatatatgtatgtatatcacacatatatgtgtgtatatcacacatatatgtgtgtatatcatatatatatatgcatgacccatatttaaaagtaggatatttcataacgaaataccagtattaggtatcttttgaaaaagtgtcgtaactgacagcccaagtctgcattccttcatggcaccagggctagaactgagaagtagctgactttttggggtggatatgggctcccctagtcatgctatatgcctcattttatgtgactggccgggccccataggcgtttatgtttgccactcttttagaggtccctttaaggttgacatatattcattgattgatcaactcatttacacacgcatgcagtcattttttggacccctgtctatgtgctctgcacaatgcgaggtgtgggatataatggtgaccaagacagattccaaccactcactcacagatcccacagcctaccagggaagccagatatggaacaattatatacgtaattttacttgtaagtgccacaaagacaaattgtattaagtagtaccatgtggctgtggaagtttaacttgtcactaatccaccaaactctgagaagacagcatattttccgtcattcccaaaagactatcacaggcaacattgaggaatgctttgttaaactccagggatatattccacatcacacttcccccgtccaccagattagcaactgtccaaggacaaaacaaaacacacactaaaaaggaaatggggttagtccgatatgtctccatctccttatgctggttcttttgtctgcagaagccacggtttctttttctttttgaaaaaaaaaaatgacatttgcgtacctctctgcgtttctctttctccaggattcttctgggatcctaggcagtgtggtttggtgatctcactggtgagatctcttggagccctggaatgcaattcatctgggccagaagagttgaactaatttaaggacatctgagtgcttcactgatgtatttgttctgctctgtcccttcaaaataccactactcaaaacaatgttcagctggagaaagtggttaacactggaattttctttttttctgagacctaagtgacagggaagggtggatgaaggaaacatatcctttgaaaatcctttagttagaatcctttggttgcaagtaacataaatgaactctgattaatgtaagcaaaaaagaatttgttagaaggatatggggggggagggatggacagagatgtgaaggaaaagatgaagaaccaggctttagaaagtcctgaaaccaaatgaattctagggatctaggaagcagggactaatgactgtttccttcaggacaccagagatggggtgaataactctgtaaaagatgcaaatttcccacctgggtaacatagtgagaccctgtccttaaaaaaaaacagtagccaggcacagtgcctgtagtcccagctatgtggaggctgaggcagaaggatcacttaagcccaggagctcaagactgcagtgagctatgatggcactgctgcaccccagcctgggcagcagagggagaccctgtctcttaaaaaacaaatgctaaattttagagagaatagagagaatcttttcttaaaaaggtgctaagtctggggaaggagcttctgattgtcctgccttgagtcacacgaccatctctgacttgttgacccctctacaatcccatataagactccccaagagtagattctgagcaggtaaagcccatgggtgttcccaaaagtcggcctcaacctgaagccacttattcactctgagctcatcaccaatggcatgccgcactgtcaaaactctctttctgtgcatttgtctgggccactcaactcaggaaagttagttgttctgtgtgagtccccatgttctcactgatttcatttcagtctttaagctaaaaatctgtgtaaatggtaatggagaatggctacatcacacttagtatgtgtcaaagcagtatcctaagtgccttagtggtatcagcttatttaagactgacagtactctgaggtgcagtcacttctttttttttttttcctttttttcaaaacagagtctcactccgtcatccacactggagtgcagtggcatgatctcggctcaccgcaacctccgcctcccagggtcaggtgattctcatgcctcagcctcctgagtagttgggactacaggcatgcaccaccactcctggctaatttttgcatttttagtagagatggggtttcaccacgttggccaggccggtcttgaactcctgacctcaggtgatccacccacctgggcctcccaaagtgctgtaattacaggcgtgagccaccgcacccggcctgtcacttcttgtcattcacagtagttatgttctgtaaagtcactgcaaacactgaattaataaacactgaaccattgttcctaggtgaaatacaaagttgggttcctgtgagcctttggtcacagcattttcatccactgatcaacccgtaagcttattctgtgtgtgtttctgtttaaagacaccttaatatatattgttgactcattaacatctaactcactgccaacagcactccaactcgtgcctgatcaaagcttatataacacacgcatgacacatctcggactccttgcacttaggaacaccagatagcacttcaccattaccctatgggaccattttacagcaacgtcaccctcaaaaagcagaaaaatgggaaaaagcatgctgctaatataccacagagagaatgcttgtttacagcatgagagctgaagtctgaaggtagaacatggttttgttcatcctcagctgggaacacatgttggctgactcaaatattttgccactccgtacatgtccgtgagtgatcatgaaagaaccttgagtatggatttggcggttataaataaattttagcaagaggtgaatttgcaaataatgaggattgactataacccctgttattagctctagttaacagatgggggaatggaggtaaacagctctctgcaggtcttgcagccagggagtgtagaggaggctttgtcattctgggtgcacagcctgcgtccttaagaggcaatgtagtgttggctgggtgtggtggtggttcatgctgtaatcctagcactttgggaggctggggtgggtggattacttgaggttaggagttcaagaccaggctggccaacatggtgaaaccccgtctctactaaaaatacaaaaaaatcagtggggcgtggtggcacgcgcctgtaatcccagctactcaggaggttgaggcaggagaatcacttgaacttgggacgcggaggttgcagtgagctgagagcgtgtcactgcactccagcctgggcgacagaatgagactccatctcaaaaaaaaaaagaggcagtgtagtggttgagtgcagtgtagctcctgctgagagctggttttcatgttttgtgggcacacaggaagtagagaatgctgagagctgggcactgaagcagtaggagatatgggagtgggaaagtggttttctttagtaagtctgggctgttttcatagcctaggatgaagttcagcaatactcaaccttgaggttttccaggcaccttctccttgacatgaatctcctgcaaacagatgtcatagtaatctgggaataaacctttgttgttggtcctttagctatccttttttttttttttttttttttttttttttttttttgagacggagccccactgttgccaggagtgcagaagcatgatctcagctcactgcaacctccgcctccccagttcaagtgattctccagcctaggcctcccgagtagctgggattacaggcatgcaccaccatgcctggctaagttttgtatttttagtagagacggggtttcaccatgttggctaggctggtctcgagctcctgacctcaagtgatccgcccgcctcgacctttcaaagtgttgggattataggcgtgagccactgagcccggtgccctggtcctttagctttctaagacagcagcatagtagttcagagcataggctcttgggccatagcttcctgagttcgaatcctagctctgctgttttttaaactctgtgaccttgggcaagtcttaacctctctgtgcctcagttttcttgtctgcaaaatgggattaataaaaacaccgatctcataggattgttgtgaaaatcgagtgagtatgtttatagtgtttaggaaagttcctggtacacaagacatgctctgaaagtgtattaatattatttgtccttagactcagtagtactctgggggaatcgaatccccacccctaagccaggcagcatggtagaagctaggtcagctggcaggctcctgggtcttttccattctgctgcaggagatgcctgactcacctcttgtgctcacacagatgacagctaaatagaagggctctttcctcctagtattagcttaattataggggctccctagaacagtggggaaaatgagctttgagaatccccccaccacacacacaaggcccacactagcacctgaaagaggagtgaacattgcttcctgcctccttctccccctccttctcacatatgcctttgtctctgtgattctgcacgtttaatttttaatcccgggatgggttctattagtttttgtgtattttctctgccctggtttgagctccaaaaggtctgtttgggtctctgtgggtgtctgacagcctctgcaggcctttctgaattatataactcaagctttgtattttctatttgttactgggggttctttctgtgctataattttactcttagaaaatgaagtagggtactagaattttctctgggatcccctagggtttccttctgaatattttttcctgccatattttcttcgctaaaacatttttttttcttatttcagaagcaatacatcttcattatagaacattacaacaagatgcagagaaagaaaataatcttatcaagcagaaatgttaataccttgctatctacccatgtctctctgtctctgtctcctcaaacacacacaaatggggtcaagatgacataagagactatctgcttttcaattcacattttacgatctttttttttgtatggttctgtagtctccactgcttggcttgacgatctttaacaggtgccctccggatggtcatgggggtattttccatttctcactgttacaagcagtgctctgatgaaacaccttttgctggcattcctaattatgtcctgagagcagacttctagaagttttcagcagtgaggttaaagggaatgtttgcctctcctcttcactctgtgatgctcctgggggcccaggcccatgagtctctgtgtccatcttcccaagatgaaagacaaagaatgggcagagcattgacagggccctgtgttgactccttttctctcttttcccagtttttttttttttttttgagacagagtctcgctctgttgcccaggctgaagtgcggtggcgcggtcttggttcactgctacatttgcctcccaggttcaagcaattctcccgcctcagcctcccaagtagttgggattacaggcactcaccaccacacccagctaattttgtatttttaggagagacggggtttcatcatgttgcccaggctggtcttgaactcctagcctcaagtgatccactcaccttggcctcccaaagtgctgggattacaggcgtgagccactgcaccctggcccattcccgttttttaaaaaaatattttattccttttagactatttagccacagttttccattctattccttgggataagtgaaaacttgatttttaaaaaataattacaaaattttaaaatcatggtaaaaaacacataacataaaatttaccatcttaactatttttttaagtgtacagtatcattttaagtacatttacattgttgtgcaacagttaggacttttcatctcgtaaaactgaaactctatacccactggcaataacttcccatttcttcctccccaccgagcctctggtaaccaccattctgcttcctgtttctatgagtttggctattttagatgcctcatgtaagtggactcttgcagtatttgtcttttcatggctggtttcttcctttttttcttttcctttctttctttctttctttctttctttctttctttctttctttctttctttctttcttccttccttccttccttccttccttccttccttcttcctttcctttctttctttcctttttttttttttttgacagggtctccctgtttctcgcaggccaggctggagtgcagtggggcaatcacagctcatggcagccttgacctcctgtgctcaagggatcctcccatctcagcctcctgagtaactgggacttcaggcacacactaccatgcccggttaatttttttcttgatttttaatagagacaaggtcttgctatgttgcccagggttgtctcaaactcctggcctcaagagatcctcccatctcagcctcctgagtagctgggattacaggtgcacactaccatgcccagttaattttttttcttgatttttaatagagacaaggttcttgctatgttgcccaggctggtctcaaactcctggcctcaagtgatcctcccacctcagcctctcaaggtgaagggatgagcctcccaaagtgaaggcgtgagccattgctcctgggatgactggtttatttcacttagtgtaatgccctcagagttcattcatgttgtagcatatgtcagaattttcttcctctttaaggttgattaatattccattgtatgaataggcaacattttgcttatatattaatcggtcaatggacatttgagttgctttcacctcttggctattgtgaataatgctgttgtgaacatgggtatacaaatatcttttttttttttttttttgtagagatggggtctccctatgttggccaggcttgtctcaaactccttggcccaagcaatcctcctacctcagcctcccaaagtgctgagattacaggtgtgaactactgcacctggctgagactccacttccaattcttttggatatagatcctgaagtggaattgctgatggtagaaactgtctcgggaagatttttctggggatttggcttctaactgcaccacagctccagtggaaacatctattcattaaactggcatttattgaggaccagctttgttccagtcactgaacaaggctgggggcatagcgtggcttacataggtccccaccctccatggagctgatattcagcaagaagccagacaatacacaggtaagcaaattgaaaaaaacaggatgagatccactggcgataaatgtcatgatactgaatcaggatttgacaacagagtgatgtggtgagtggctactttagatcagaaaggccttcctaactgggtgacaggtgacctgagaactacaaggtggggaggagctagccacacagaatttgggaaaataccattctgggccctgggatgagcaatggaaaggtcttgaggaggaaagtggctaggcgtgatccttgttgctggggcgtggtgggtgtggggccagatcataaggggccccacaggatgagcctctgtgctaagtgcagtgggaagccactggagagttttaggtaggcgagatgcaaaggatcagatttgtatttaacacaccttccattggctgccaagtagagaatggattgttggggactggagcagaagtgggaggatgagtcaggagtcaattgcagatttctaggtgagagatggtgtctttgtctgcacgggcagcagtgcagagggagagacacaggcagatttgggaggtaaaaggacttactggtaaatgggatatgaattggaagagggaagcaaatgcacagctgggcacctggtacactttacatatgacgtctttgaacttcgtagcaatcccataaccacattttgtagatctgtgttgtccagtagaaatataacatgagccataaacctgagctgtgtatgtaatttaaaatgttcttagcaatcacattaaaatggtcaaaggaaacaggtgaaatgaactgtgagaatgttttctttaactcagcatattccaaatattcccatatcaacatgtaatcaatataaaattattaatgagatattttacttccccgcatagcaagtcttcaacatttgatatgtattttacacgtacagcacatctcaattcaaccacacttcaagtactcagtagccacatatggctagtggttaccatattggtagcacagttatagatgaggaaagagagtctcagagagtataagttcttatgcaagcttatagaattaggacttgaaccctaatttgactctggcacccgtgttgtgctcaaagcactgcatccacccccaatgatgaagacattttcaatgtaagcaaaagtcctggagatttccccacatcatatacatggggacataggaactaacatttgtcatatatttatattttcctttccaaagcagatcaaccccaagttaccttcccttagctctcgttttctgcctctctttgcaaatatcacttcattaaaaattgtgaacattctctttgccttcccttatgggcttcctgtttgaacaccacatccagggcaccctgggaactgaaccatctccttttctttttctttttgagtcagggtttcactctgtcgcctagactggaatgcagtggtgtgaccgtagctcactgcagcttcaatctcttggcctaaaacaatcctcccacctcagcctcctaagtagctgggactacaggaacacaccaccatgcctggctaatttttttatttttattttttgtagctgcaaggtctcactgtgttgcccagactggtctcaaactcctggactcaagcagtcctcccacctcagcctcccaaagtgctaggatgacaggtgtgagccacaatgcctagcccatatctccttttcttttgtggcattctagtagccctttggttcatgcgatcatttagttgttcagcaaatatggatgattgaatggatataataggtgcagggcactcccaggttctcaagatggatgatcttgggcaagttatttaatttctctggattttagtttccttgccagcaaactcaagataatagtaatgcctacttttaagtagttattgtgaagattataaggaattaacaataacgataataataagtaataatgatacatgttgtttattagagcctgctatatgccagacactaactctatgatttaaccttctcctgctaccctttactcttattatttctttaggagtgaaattcactaatcattaagctttttaactaactgaatcaattctgtttcttaagcagatgggagatcctgtggctttttaccactatccacagctctttttttctttttcttttcttttttgagacggagtcttgctctgtcacccaggctggagtgcagtggcatgatctcggctcactgcagtctccgcctccctagttcaagccattctcctgcctcagcctcccgagtagctgaggttataggcgcccgccaccacgcccagctaatttttgtatttttagtagagatggggtttcaccatcttggccaggctggtctcaaactcctgacctagtgatctacctgccttggcctcccaaagtgctgggattacaggcatgagccactgtgcctggcctatccacagctggtttcccctctttgcccccttttctggcattctcttctgattcactctcaactctgatttccaagctacccagctccttcccctagtgtgaatctgtatttgcactggatttatttttaaatgggaaatgaaagccactgtgtgctggaaaatatatatttcagacacgaggaagctggcggggaaatattttttggatgtctttctagatctcttaaaaatcctgtgagccatcaccaggttgatcttgtagtaaggtggccttggccttagtgtatttctttttgactcgatattgggcggcaggaggtttgaggattgtgatactaacaacattaacaacaacaaactttcattgattgattgccatgtgctggaaatgtgctaataaattacatttattttctctttgaatcctcaaaccaactctttgagacaagtgtgttgtattacagctgtagaaactgaggtcctaagaggtcagtagatttgctgaaggtcacagagctgagatccaaatctaagcatcacagcaagaagtatccttaaccatcatctttgctgttggttggcattagtctggctgtgctaagaaagtttcctttgacttgcagatggatcaaggcttttcttgagagaggcttctcttgcctggttctccttgattcttttactctaggagactcagttcttctcaaatccctgtctgtgggactttgggcaaaacattcaacgtcatctttacctcttagagtcactgcgagggttggactatggtgtgttaggtgttttttttttttttttttttttttttgatgaagtctcactctgtcgcccaggctggagtgcaatggcatgatcttggctcactgcaacctccgcctcctgggttcaaccgattcttctgcctcagcctcctgagtagctgggattacaggcacgcaccaccacgcctgactaatttttgtatttttagtagagacgaggtttcactatgttggccaggctggtctcgaactcctgacctcaagtgatcggcctgccttggcctcccgaagtgctgggattacaggcgtgagccaccgtgcccagccgtgttatgagttgaacagatttcttggcttcagcaggggctcagtatgggcctatcatcattttcatttatctccttttatgcctcatgctctatctgtccccttcatctctgcctgtagcagccacagaccctctctttccttggtgcatgtccctccttcccactttcctaatttcagcctgacttagttctctacctgtcagcttggacttaaggaaaggaagttctcttttcttggggggtcactggggccatgggcgtctttccactccatttcttttccaaagctgcctctggaacgaatctgtaaatcccagggcattgcatgagttttcttttctttctttccttctttctttctctctctttctttccttcttgctttcttgctttctttcttgctttcttgctttctgtcactgaaagcaaatattgtagacagatatgcttgtaggatagaaataaaatgccccattctttgaaacatattttgttttttattttagattcatggagtatgtgtgcaagtttgtcacatgggtatattgcgtgatgctgaggtttaggcaatgaacttgttacccaaatagtgagcatagtacccagtaggtagtttttaaaccgttacccccttctctccctcctttccgagttcccagtgtctgttgtttccatatttgtgtctgtgtataccccttgtttagcttccactataggtgagaacatgtggtatttggttttctgtttttctgtgataattcacttaggataatggccttcagctgcatccatgttgctgcaaaggacatgatttcattttttttatggctgtgtagtattccatagtgtatatgcaccacattttctttatccaatccattgttgatgggcacctaggtggattccatgtttttgctgttatggacagtgatgcaataaacatgagagtgaaggtgtctttttggtggaatgatgtgttttcctttgggtatatacccagtaatgggaatgctggattgaatggcaattctatttttagttctttgagaagtctctaaactgcttcccagaggggctgaactaatttacaatttcaccaacagtgtaagagcgtccttttttctccgtaatctcaccaaggcactgcataagctatctgagtggccagcaggcagaatgcttgaaggattctccagctgggggtgctgggcccaaaggctggcagctgtatggtcctggcctttttctctccagcagggtccccatgatcttcccaggtctagttttttcttgagcacacctgcatctgacagttaattgcaagaatctgacttgctgaactctcatttctccctcctcctttagcgcatcaagtccccttctttgttttcccagcttggttcttgcaaggactacctagaggaggacttcaggcaatccctttctccctggtgggctgctgtgttctcaccaataaatcaatgctctctctagtttcaggctgcctcttaggacagatgctgataccaagtgacttttgaggttgttgagttgagacacttggaccaaacagcggaaggcacagcttggctcagctaaaggaagctccgtgaaagctctctgagtgggcctattggctccatgagttggcaggctggccctcctctaggagatggtgggtcctcatgggctgtagcagggccaggccacaggagcagactgctggaggagaacatttagggccatcttccttgctgcctttctgtgatctcttcacccaggaagctgaatgctgttggcaagcaaaagggtgcttggtaaccatttcttttttaagtgtgtgctggtgccagggagggagaaatcctcaaaacccattgtgtctgactcaggcaccactggtttggccataaccgctagtttatcctccctccctctgccaccctcgtcatgtttctcgaccacaacctgtctggaccttccctgggttggccagggcttgataatctttttctgtaaggagttatcccttcctcatctgccaggatggggctactgtgcagggactgggtaacaggcttgaagttgcaagagggctggaagggtctcactagcaagcacacattatgtcttatataggtccctggccttgtgcttcagaccctatcacagcttttccacagctggggctgttgagaatgtaagtggtgacatagctggatggctaagatggggggagtatgagacctgcaagcgtgtgagtctccttttgctagcagagtgtgaatgaaatgtatttattttcccaataaattcgacatgactgatcattcatccacccacttacccacccatctactcactaacccacccactcagtcatctacacagctgttcactcgtccatccatccatccatccatccatccatccatccatccatccatccatccatccgtccatccacattcaatgtagtgtaatgattaagagcatagagtttggagttatcctgcttaggtttgaatcccagctctgccactcaccaagcatgtgatcttggttcagttttaaaacctctccttgtctcagtctcctcagctataaaatgagattgatgttgaaattaataacagagcctaccttacggcattataaaggttatgtgagtcagtatgtgtaaggtgctttcagtagtgcctgggtcatagcagtgctatctaagtgttagctattagcattatggcatctactcacctgtttatcatctataatagtcattaaaggtcttcaataaatatttctggtctttggccttgcaggccaatggtaggattgcactgcttgcctcccttgtgggtaggtggggccgtatgagtagctctgaccagtgagttgtgatccaaagtgatgtatgttcacttttatgctgggacatgtaattgctggttctagattatccagaaaaaatctttgagttatggctgctctatcaacttgctcctggagacatagaacttcttccttagctgatcaggcatgaggctgtagtatgtgagaaaaacaaacttttacctattttgagggttattactgcaggataacccagttctatctctgtctctctcatctatcatctatctatttacaataattccagtctcattttatttcccttcccttttctttttggcacctattactagctggcattttcttatattttttggagtttcctcccaaaatttatttgttattaattataagaatatgttttccatgagaaaaaggacttattcacttatctaattccaatagttagaatggtactttacacatagtagacactcagcacatatttttaaaacaataaatcagttaatgaatggatctacttgacttttagtaggtcctattgaacactgcattccacagctccttgaaaatccttactgaggcagctaatatttaagaaggaacaccctgacctttcactgtccagttttattgcctgaatcaagaaaaatatccctgagatagacctcactgcctctctgcaaacctcttaatacccttagtcaattgtaagaagctgcttggaaccctgtaagatggtctttggccagatcaagtcttgctcctcttcctctgaatcttgtaggggcctttaatctttctgtaactgtgattccccagaacaggatgcctttgttagcctagcatcttttctgttacttctatgaaacaaggagagacgctccctgggacccttaactatttctggaagcaaaatgacccttgccccactgaagacttaggagcctggtcacttccaaccgggcttttcatctttgtgactcccagtcatgggcaagaggctagctagctccaatcctaatgcccgtgccatcaactgcttcatttctggtttcttccttgcttttgtgataccctcattgactctttccactgtaccctgtggacttgcctctatgggacacttcctccccatcctgcctgaagaggaaagagcctgcctttcttctgggaacatcatcccattcagaaacaacaacctttctggagtcaggagtttgctttcctcttgttctttattgctgcttcctggagattgcattcttgtttaaaagctcacctgtaagactctgatcaaatgtccattcttccctctcacttcatccctgaagatgaatgggacatttatctttatatatgtatgtatgcctaggggaaaaaactgaaggaacattatgtatatatataatgcgtgtgtgtgtgtgtgtgtgtatatatataatgtgtgtgtatatatatatataattttttttgagacagggtcttgctagactggagtgcagtggagtgatcatggctcactgcagcctcgacctcctgggcttaagtgagcctcccaactcagcctccctagtagctaggactacaggcatgtgccaccatacccagctaattttaaaatttgtatttattattatttttggtagagatggggtctcactatgctgcctgcgctgttcttgaactcctgggctcaagcaatcctcctgtctcagcctcccaaagtgctggaaatacaggcatgagacactgcatccagtctatgatattcttatgtttttacaatgtgcttattattgagtagggaaattatgagtgatgtgtgtgtatgtatgtgtgtgtatacagatgtatgcatctgtgttcaatttttcctgttgagagtgagtaaacaaatatttttgaaaataataaaatacataaatgaggggcaggggctctcttggacacttccaaaagtactttgctcaattttctatgttaggcctatctgcaagaagcataagggtttgtcaggagctattatgattatttattctacaaatcccagttcaacaaagaagggtgaggcttgagtgttcaattagagaagctggccagttgtggtatcatatcagctctacatccaatgctcagttttcaaggggtcatgttgctctgaaaggcctggtgaggttgatgagtgtcttaatgaagccacttgtgaaagataatgtgacatgtttgtccatcacattgacgcaggaaaggagctttcacaaaagacagcacagaaattttgcaggctcggaccagaagggaatttgtcagtgtttagcttggctgacatcccacaccctaccttcttgtgcagttagaatcccttctagtgtaatgtgtgaaaaaccataggccccctgcccacaccctcctagagctgtatcaccaacagctttcaagtgtgtgcaaattgggagacggctggatcccacatctctgggtgacatttgctgaaacaaatgcctgttaataagtggcacgattcccttggtctcagtgataaagatgtacctgttactgggagcccttgagagaaatctttggtgaaggccttcacactcattttaattggtgatagacagatgtgttgagaaaacttacattttttttctccatccgtctcaattagaatgttatgaaatagcaccccctttgctcttcgtgctttatgccctagactttaaagactgacaacgagtggttaaaaaatctccattgcttcaggatgcagtatcagctgatttggtggattaaatcgttttaaggtcctgagctttaattcttacttcagtgattctcaaaccttgttttgcaaaaccccagagctttaatcttaagggatgagcctgctatttccaagacaacaaaattatttctacttcatattaatacaaaacattaaaatatacattgtctttgtaatatagtttattaattcaaagcacttgcattcccatttatctggtcttcatacaaaaccatgtatgagtgagtaggcagatggtcttatttattacttcgttcaatatatagatttttgagtgcctaccggtatacagcactgaacgaaagagaaaaatactagtttggatgggagctcaacacaatctgaggggatatattggacccattttgcagaggaagaaactttggttcaggaagggaaagtgaactctgaagtttgacataaagttagcttcagaactagaatatctgccttctgatctcagcctatcacctatctcaggttctgtctccacgataccatgtgattggaactggctcattaacctggggatggatcaatcagcatcttttttttttttttaacaggattggatggaaatctgcattccttgatcactcagtctatagggtgaacttacaatggccctcatgcttaatcttgaaatacagggatggtctgatggagtgtgctggagaccctgctgagatctttggacaactcctctccagtccactacctgaatcctttctcttctcctcaaaaaaatctgagactatccaaatgaagagtaaataaagggagaagtaagaaggaaacatgagacagagaggcagcaggagcagaatgaaacttggggagcagagggagaagccaagaaaacttactggacttggagccaataaattggccatggcatgaaggtttctgccagcaatatggcagcccattccagctctttccattttcttttcccagctgtgctgccaagcaccatgcttaggctggtttaacagagattatgctaggaggattttctaacattcatgtcctgattaccccttatctgattccttagcagtagccttcagtggcctcagagaattccaggttcagctgtctgaacagttcaatgactgtttgtaagttctgacttacgatcaaggcaggaaatgtgaaaagcatttttaaaaaggaaaaaaaccatccggcgttgttaacatttttgttattccagtattttcccatgcatataaatatgtgtacttcttttatttttcacaagagtactctcacaccataatattgttttataaccctcttttccactgtgctctagtgtaaacattttactgtaccaaatctttttccacaaaaggatttttaattactgcatagatttctattgaacggatgtactaaaatttacctaaacagctcttattattcaacatgattcaaccattgttacaaataatatagttgtatatttatctttatggaaagctatttctgaatactcctaaggataagttcatgtattagttaggttttgctgtgtaacaaatcatcgcacaacttagtggtgtcaaacaatgactatttacttacctctgcaggtctgcattttgggccaggtagttctgctggactaggctggaatcagtggacataggctctggttacttatgcatttgcaatcagctgggggactgcatgggatgatggtggtatgtcatcttccagcaggccaggttgtttccatagcagttagagttgcaagagcagcaaggaggcaaaccctgatgcacaaactttttttcaagttttggttgcatcacatttgcttctgtcccataggccaaagcatgtgacatggccaagcccggagacagtttgagaagacattaccaaaggcatggctacaaaaggcatgaaagtctcaggaccattgttgtaatcaactcatcacagtccccaaaatgggagtttctgggtcaaaaagtgtggccatttaaaggttttcattgtcacattgctctccagagaaattgtaactaatttacacaccacctagagtacatgcatttccaaattcacttgatcactggatataatcattggtttaatttccccccagaaaataatattattgcttttgaagagtacatgctttgtgagggaagctgtcttgaatgtccagcttccaggtgcaagcgcctgcatgtgtgcacaggtgacaccatgtagaaccgaagaaccacctggctgagtctagccaacccagagaattgtgagggaaaagaatatttttttaaggcagaagaaaaatgtatgttcattgtaaaaacctgaagcaatgtggtacctttatcatcaatatcttccccagtatttgattcattctgacattatgttgttgggttacatttatttctattacatttaggacctttgagtctatattcattagtgaaatttgtctgccatttactctttttttttggtttgctgtctttgacaagtttttgctattttcatcaaaacatctgggaagtcttccatcttttcttgttttttaatgcttaggaagagcataaatggcaaaggatttagaatattttttagaagtttgagtggatttaccatacccccaaagcaaaacaatttctgggcctggtgccttttccaagattagttatttgataattttttctggtgtatttcatgatcatttttggtatactttcaaatgtgttatgtttttttaagaataagcatttaattgagtctctaatttattagcataaaactatatatattgtcctgtaatgatgtgaaaaattgccttgccatctgcaattctcttttctcattcttactgagttcctatttttagtttttgaaaattttcttatgagctttgccagagtgtcactgttttatttttcccctcaaacaaccacctcttaaatttattcttcagttcaacttttttctgtttccagatgcattaatttctgctttttaattatttcctcagttttatcactcttcctagtttcttgagctaaatgtccctatgtactttcaattatatctactgatttgtcaaaaattggatagtatgctcgtctcctactatgatagtgatttttcaacacctttgtatttttttaaacaaattttgttttgtacatttctaatgtacttttatgttataggagttagagtttcatgattctccagtcttattgtgaagttactcagatctgagttcaaattctcctgtgctgcctaccaaatgatgaaccagttttagattctcctaaaagcttggtgataataatgccagtgttgcttatttttaatacttaaattaaatgatataattgatgttaagtgctcatcatagtgccaggcacatggaacacacactgctattggttatattgttattattgatgtactctttatgaatacaaaatatccatctttgtcctatgtaatatttttatgctttacattttatttgtctgataattaatatttctgctcatggcagcttttcccaccttttcattttcattttggatcattttattttcagcaagtctcatgggaaccatgtatatttgaattctattttttctttaaattatgaatctttgtcctttaatgggataattcaatccattcacattttttttttttgcaagacacagcatttggcaagtgtttacttctttcttctcccaatccactttcctgcctttgaagattttagaaccagaatttatgaaaaaaaataaatatatttgatttcccatgaattgctattgacacatgcattatttcatgcaattcaagacttttttaaagatgtgactctcaaacttacttcattactcactttttatgttttttggacccatttccctcttattgaattaattgattgattcattaattcaatcaacaaatatttattgaaaacatactgtatgcagacactgtgctagggtctgagagaaacgtatttgatgtaaacctggtctgtgtcttcactgaatctacatttagattcacaaaattagagacacaaaaatagatgacaaattaaagcagatataaaggaaaccaataagggtctcaaggagagattagtgaacgtgcatgtgagtatctatttagcaagtttaatgaggggatgctttttgtgaaggtgacatttatgctggcagcttaagaagtggcattagctgtgtgaagagaggaaggaagaaaggcattccaggcagaaggactagcatatgcaaagggcttgaaaggggaaagagccttatcctaatgttttcatagaaattatttttaaatactcaacaattagcttttgaattaaaggaatgcacacaagtgaagttaatctcttataggcaaaaccaaatgaaggattggaaaatgcctctgaagagtcagctggaaggctcttcatccatccatccaaccatccatccatccatccatccatccatccatccatccatccactcatccatccattcatccatccatccacccacccatctacccacccatccatccatccattcacccacccactcatccatctatccattcatccatccatccaataagcagtcattgagtgcctactgtgtgccagaccctgtgccaggtgttgatcacaaataatacaagcacctcctggagagtagagcctagttgtgtacatgggatggagggcccatgataataaagctggtacttctcatggagtgggatgggccaggggcatggggaaggcacacgtgctgtgctctgtagagctctgagcagggagggacgcagtgggaaagagctgagaacaattcctgccagatggctttattctttcccctgaaggaagtggggacttcgtgctgtgacatgatacacaagaacagtgtttcctgtgggtttgcaagggcattttgaatataaacactacagctcgctgatgtgtgaaaaaattattttttttgctttttcagactttgtgaagggataatcagatcaattttataagtctggaaaacaggtatttggggtgaattttaatgcacacattatagtggctggaaccctaaccaaaggcagctgtcacctgttggtgggttctcttaggcacgttgtttgttcatctagctgtcacctggcagcttatgccctccagttcctggaactgaccagttatctgcaactgactaagttctggtactggatcctgtgtgatttgactctaacctccaagaaccttactgtctttagctgtgaaatgcggagaagactggactacttgatctctcaacactctatatatctttaaagttaaatcatttgttcagtcatttgccctttcttctgccatttctctttccctctctcccatccatccatccatccacccatccacccacccatccatatatctatttaatatttatattatttatgttatttatttatttatttattttgcaatggagtcttgctctgttgtccaggctggagtgcaatggcgtgatctcggctcactgcaacctccgcctcccaggctcaagcgattcttctgcctcagcttcctgagtagctgggattacaggcacatgcaccaccatgcccggctaattttttttttttttttgagacagagtcttgctctgtcgcccaggccagagtgcagtggtgcgatctcggttcactgcaagctccgcctcccaggttcacgccattctcctgcctcagcctcccgagtagctggaactacaggcgcccaccaccacacctcgctaattttttgtatttttagtagagacagggtttcaccttgttagccaggatggtcttgatctcctgacctccagtgatccgcccatctcggcctcccaaagtgctgggattataggcgtgagccaccgcactggaccctgtctaatatttaattgagtgcctgttgtgtgctaagtactgtgctgggttctcatccagtggccagtaaattagacaatcctcccatcatagagcttgccatctagtagggagacagacaagcaaataattacacaggtaataatacaattacagttatgataagtattacaaatgagaagaatggggtaggtgagcatgtgtattaaggctatcggtctcattttgagggccagagaactctttcttgacaaaatgaagtttaaacaaaaactaggtgaagattggcagaaaagcatcccaggcagagggcacagccagtgtgaaggccttgggataggaaggggcatggccacatcaagggaggtaaaaatacataacaaaataataatatgagtaacaatggcaactactactgaaggaggaccgcctatttgccagggaccatgcgatccttaactgtgtggttttgatcaaatcatctaaactccttgcaccttggtctatgcatctataaaatggggtgatagtgatcgtgtatacttcatcaggttcttctgaggcgccaatgaagtaacgtctgggaaatccttaggtctatgcctggaccataggaagtgtttaagagacagccgttgtgactgttatttttatgaatggtattgggtgagaaaaagttcgtgttgcatctcagggcttgccttggaccctgttgatgatttctatgttgaggtcactcttggagtttctgcagaagtagaactcttggaagtctgctattcagcagatgagtgaaacaagtgcttctccctccgctcccacagaaagaggggcagagatgccagccacagcttggctttcaggcagcaggcacattgggatcagtgattggcatttgcaacattggttggcatcacagagagcatggaaggtcaaggtaataattatcaaggacagtttaagggaaacagtacattccattccttatccattgtaagaccagtacattccctgttctttaactcttgggaagacatctcccccagatctctctgctgaggatcagggccatttctctgttaaaaatgtcaaacagcaacttaccagaggaaacagaatggtggaaatgccatctcagcattcaagaagccccagtaccaaactttgcatgtatatacgtttgaaacaagctttgtaaattacttttgttcatttgtaattacttatccataagaactctctctctctctctctctctctctctctctctctctctctgtgtgtgtgtgtgtgtgtgtgtggtttgttgtcacctgggctggagtgcagtgatgcgaccatggctcactatattcaaaatcctgggctcatgcgatcctcccacctcagccttctgaggagctgggaccgtaggcacgtgccaccaggcccagcaaataaaatttatttatttatttatttatttatttatttatttatttatttatttatttatttattgtagagatagggccttgctatgttgctcaggctggtctcgaactcctggcctcaagtgatcctcctgtctcagcctcccaaagtgcagggattacagttaggtatggagagagaaggaaataaggaagacacagttattactctttaggacccataatttaactcaagtgattttgcccccaggtggtatttggcaatgtctggagacattttgtttgtcacaacttggggtggtgggggttgctactggaatctagtgggtagaggccagggatgctactgaacaaaatatacaagacagcctcacaacaaagaattgaccagtccacagtgtccacagtgccatggttgagaaaccttgatctaactgcttatgacataccacttccataaagccgagagatatcaattcttatgcagttatcactgtgtacaggaaattgtgtgtttgtacatgtgtgtgcatgaatgtgtagatataaagggataaaacctttatcttcctttcctaggtatttttacctctgtattatcaattgaaataatttgtttttgaatatacaatgcaaagtttgaaatcctacaggtacaacaaggtatacagtgaataaagaatctccccattccacttctgtcctcaagtcttcagttctctggaggagtactactgtcattagtctcctatatattagtagagagacattccgcatatgaaccttatacccttagtagcacctcacacatatttttttccttgttgcctttttttttcctatgtgatgacgtatcttagagatattttcatatcagcgcatatagagcagcctcattcattttaacagctgcacaggttttttttttttttttttttttttttttttttgtggctgtcccatacggtcttctgttgatgggcataggttatttctagtcttttgcataacaaacagtgctggagtggatctccttgtacctaactgtggacacacatgtgcaagtacgtctgtaatccaaaatcctgcaagaggaatttctaggttaagatggcatgtgcattttaaatttggctagagatttctgcagtgatgtctgatcctgtgcaccgtgcattcatcatgtgacccatttctagtccttcttgaccgccccctctcctatggggatcctgagctgatagggtcacttctgtctctcccccacactggaacagctctctctaatctacaagattaattttttttcctaatcaaaacacaattgccaaggatagtttgaaaaatattaattgtgtctgtcatcctggggctctgagcacgtgagcgtttgggatataatctttgcaaattgcctatagttcatacagcacagcaagagcctctctctctgcagccagtcctttatgatcgatcatacccaccccctctcccaatgggctgtatcctaagggtaagtagacagcatgggttctcttgcttaaaaaaaatcgttaactcaacgggggcgcctgctgcttgattgggagtatgtcggcatttagagcctgctggctgcaatctcactacgcagactggaagttgtggggtgtttttatcagcaggaaacagctttgagagcggaaggggagtgagagtagatggatagatgagggaattcgaagaggaggaagccgtgggagaaatgtcttcttttaaagacagacaaggcagatttctccagcccatctctctggaatgtcaagtaggaatgaaatgggaagttgggttaattctaccaggcctgcccagcaaccagcctgttcaggttccccaggagttgcagcctgttgtctgagactgtgaggttctcttccctgaagtgtcttgtgggaattggctggtggcagcattttctctgaggtcccaaaaattcgagtggtcaagaagacaccctgcaatgatcattccccaacattggaggccataaaagtcagtctgggtttgcaaatacacactggaagtctcagagctggtgcagacatctcagagctggtgcagacagacactgtggctgagtgtgtgtgccttgttcgttatggtttcactgctactggattggtacctggtacacagtaggcactgaaaaaatattcactgaaagaaagagaaaacttgatggcagttgtaggtctgggtctgttggaatttttacccccaggaagagatttgattttaactcaaagccagttgataaacagcctcacccagcagacagagggcagcttgggggaaactggagggtatgtagggtggggtggggctcttatctgtatggacaatgccatatattttctgaaacttggatttttctccttataagggagaagatccaagaagacaatgaaaaaacatttgcccctgcctttagaaaaaataaccttttaatttttggaataatttcagatttttagaaaagttgcaaaacatttacagagagttccactgcatacccctcacccaaagtttccccctaatgctaacatcttatgcaactgtgatgcctttgcccctaccattttgaggttaacaattaagttagtataatacttattctgtaccgagctctattctatatcattttcctgcagttgtttatttgaccctttcagcatcctttgaggaataagcactgttatagcagtccccattttacagacggggaagctgaggctcagctagactctagctagtgttcgaaacctaagttgtctggctccagtctctcacccctcaccattattatctgcacagtaatgatggtaactgtcatctcttgatgataatgcgttcaggaactgagctcaaaagtttttccctccctcccttcctcccttccttccttccttccttccttccttccttccttccttccttccttcctccctccctccctcccttccttccttccttcctttttttgagatagggtctcactctgtcacccagtctggagtgcagtgtcacgatcgtagttcactgtaaccttgaactactgggctcaagccatcctcccacctcaacttcttgagtagctttgactacaggcataagccatcatgtctacctaatttttagttttttcttttctttttttttttttttcctttttctgtagagacaaagtcttgctatgttgcatggctggtctcaaactcctggcctcaggagccctcctgcttcagcctccccaagttctgggattacaggtgtgagctgccacgcccagcctacttatgttatttctaaaccctcccctgactcagagctgtggtaaagagccccgcttttgttgtcctgctcaggacaaaaatacatggccccaggcttttgtgagtaggatccggaagggaacttaagtgtgtgtgtgtgtgtgtgtgtgtgtgcacccacgtgtgtgtgggggagtgatagagattctcctggtttctgtcctagttttttctaagcgtatggagacaggtctgctccgtacatctggggattggtattaccacatcatttcccccctaacagcagcaaagattctcaaagcttcatcagagcatgaacaatcagaaatgccttaattttgttagtcacaataaataatactttgattaattagcaagcacatgccttgggaatatgagaaagtaaatgatttctaccctagatctttcagatagctgggagggaagagagtattaaaatacgcttttaactatgggttttggatggagaagaggagaatgccggagaggggaaagcagcagtggaattgttcttggagataggagaaactgaaactctttccacccagggtctttgcagaaagtggttcccactgcctggaatactttttcttctctttacatggtgagctctcactctagtctcaacttaaatgtctccccctttgacaggcccttgctaacatcctgtttcaagttccttctggatattgattaggatggtaagcttcatgaggttaaggatctctgtttcatccactgctccatcctctggtgtctgcaacgacgctggcacaccataggcccttattaaatatgtgtcgactaaatgaatatgtggtcttattaaatatgtgtcgactaaatgaatatgtggtctatttcaagtcctcgtttgtgtctgccctagaacttagcactgtttgccattagcttgtctatttccttgtgaatagctagattccctcatgagctataagggccacgatggcagggggtgtgtctaccttgttcaccaagggtacccaggatgaacctggcctgcagctaagggggtgggctctagggtcagattacttgggctcaaatcccagatttcctatgttccagctgtgtgatttctgctaattgtcaagccactctgtgcctcattttccacataggtgcaagaggggtgataatagcatctatctcttggggttgttgaaagaattaaatatgtcagtattggctaaaacacttagaggaagctgggcgtggtggctcatgtctgtaatcccagcactttgggaggctgaggcaggtggattgcttgaggccaggagttcaagaccagcctggccaacatggcgaaaccccatctctactaaaaatacaaaaattagccagacatggttgtgggtgcctgtgatttcagctacttgggaggctgaggcagaagaatcgcttgaacccgggaagtgaaggttgcagtgagctgagatcgcactactgcactccagcctgggtgacagagcgagtcttcatctcaaaagaacaacaacaacaacaacaaaaaaccacaacacttagaagagtatctagcatatagtaagtgcttcagtgctttatacatgtcagttattggtagtactcaaaatatttgggatttaaaagttgggggatttttacataaaaggcacttttcctctttgagtggtaaaatctcccctaagaaagaggcaaggacagatggagatgatctgagaggcccaagagatccttaaaaccaggctttttaagaaatctgatgttttatttctccgtattgtcatggaaaaggccagcttttagcatgcctggtgtttctggtgttttcttctcttcactgttttctacatttctttctttgcattggtcctttttttttcttttttttttttttaataaaaaaaaaatagcacagctcggagtcttgcttgctgacttactgctagagtgtgggatccattgcttccatttagagaagcagccggccctggaatgtggccgcagggctgccaggctgactctgtgagctgagctggcgaggaatgcactttgcagcttgcactgagtttggccttacgtctgtggaatttcttctctcttcttactcattcgtgtcgttaaataaataacaacacaagcagtgcatcctcccggttataatggcaaacagtacaatgtgttacaacacacagtagcttgaagaggatatctctctcctgtggtagatgcttcattccccagaacttcactcctcacccccagaataggttgcccagttaacaggatgcctggttcagtctgcattttgggtaaacaaggaacacctttttagtataagtatgtcccaaatattgcatagcaccaacttatcctaaaacactatttgttgtttatgtgctattcaggtttaactgggcattctgtagttttatttgctaaatctgacaactccagagagtctcctagaaccagtttcctgtattttcttccagtaattttccaagcatgtgcaacctatggatatcttggcagacttactcctggtagaattcccatcacctagaacagtgcttaggacattgtaggtgcttaataaatatgggttgaatgagtgattgactctgtacccaccccatttttcttcacataagtggaaatatattatagtgttgtttcatatgtagcttttccttttaataatgtctcatggggattgatacatagagctgcctcatactcctctaagggtttcctagcattcccttttatgatgcataatgtatttaaccagtcccctgatgatcgacattggtgctgttgagagtctttagctattataaacaataaggtagtgagcattcctatatatgtttacctctgtgggtttgacgacgtgcaaggataggtgtcgcattggaatcatgaggacggaggatatgtgctttaaaatgtggattgatgttgctgaattgctttctgtacaggatctgttcacacttccctcagacagcttgttccccatctccttaccaacatagaatattatcaaactttttcattttgccaatctgatcagtgaaaaactagtatctcgctatcatcttaatttacatctctttgcttatgagaacatttttatgtttgaaagctctatttctttttctgtgaactgcttcttcttttttgcctatttttttctacttattgatttttaaccggtttttgtttgtgaaagaacatgtctgttagcctggcatatgttttatatataatgtaatttataaaattggtgtttaactttgaaaaagtgatttattatggattttttaaactctgtagacattaaaaaattcctcagtagtcaatttatgagtcttttcttccacatattctacattttgtgtcttgcttagaaaggcctcttactcaatgagattatagaggaattctcccatattttcttttactactttaacttctttttttttgcatttaaatctttaatccatctggaatttattttggttttaggagggaggtgaggatctagctttattttttaccagatggccagccagttgtcccaataccatttattgaataatccatcgcttcccacagaattgaaatgctgcctttatcatatattaaattgtggaggagggattttatactcattttctgacagcctccagtgccagctaggcagcaaggattttagggggtttcagctgactagaggcaaagatcctgacctgaaggataaccgcaatttattaaaccagaaatactctgtgtaggaacagtgggtttcctgggtggggacagggttggggtgggggaaagtgagtgtcccgtgctgggaggaatttagttacagcaagatttctcaaccttggcattattgacattggggggtggaataggtctttgttggagcctgtcccatgtagtgtaggatgtttagcagcatccttggtctctacccagtatacaccagtattaacttcaccctgatttgtaacaatcaaaaatgtctccaaacattgccctgggtggcaaaatcatcttcagttgagaattactgctttatcaagcctgggtcgagcagacctcccatccatttcttttaaacagaggcagggtcttgttccgttgcccatgcagtgcatgatgtgatcatagctcactgcagcctcaaattcctggctcaagccatcctcctgcctcagcctctggggaagctaggactataccacatgcccagctaattttttagtttttgtagagacagggtcttactatgttgcataggctggtctcaaactgctggccacaagcaatcctcttgcctaggcctcctgaagcactgggattatgggcgtgagccactgtgcccagcctgaacagaccgttgattagatgcatgtgaggccctttcttgttctgagagtctgtcatcagcagtatcaatggctccagatgtctgggaggcaggaagggaggtgcctatctatctcagagaccagaacacccagatttctggtatgagtgtggggtctgtggggaaagggtggaaccataccggtcgactccgggaggaacagaggttcccacctagccctacaggtgaatcttgcaaaactccctaggacctgcctgggagcctagccattccccctgctaaccacacccccagacaacaaggcctggccatggatccaggaacaatgactctgagaaccggaggtggcagatgttttgtgatttaacagcatatcggtttattgtcttatttttcttaggagtaaaagagtccatgggtgtattgttgggggcagcaggaagcacacgtgtctattcggagatttggggcagcaggtggggagagaaagtccatctagacgagggaggtgtgggagtgagatggaagaggagagggaagtgggtggaatccctgggagctgggggaaggaggaaaacacagagaggagctggctgaggtttgagcaaggcctctggagattggtgagagctggggcggcggggattctttatgacagtgctgcagagggaaaaaggattgttgctgagttgggtggaggtaggtaggagtgatttgaagaaggaggtccccttgggaagttgcattagtgggtgaatgggggttttataggccaggcagagaatatggggagggcaactccagcagatgaacagcttttgcaagacacctgtgtggagcatgtggcaccacctgagcgtcctccccaggtgcggctctaacacaggtgcaggttatgttgggagatagagagccagaactcaggagtgccttgggtgccttgctgtaagatttgggctttccctttatttctttttttttgagacggattctcgctctgtcgccccaggctggagtgcagtggcgccatctcggctcactgcaagctccgcctcccgggttcatgccattctccagcctcccgagtagctgggactacaggtgcccaccaccgtgcccagctaatttttttttttgtatttttagtagagacggggtttcaccgtgatctcgatctcctgacctcatgatccagccgcctcagcctcccaaagtgctgggattacaggcgtgagccaccgcgcccagcctgggctttccctttatttcaaaacactcctcacccactcaatatagaaaaccaaaaaatagaggtgagcaaaaggaagagagtgaagaacagcgtggtgtcacccacccagtggccacctccataaacgctgtccagtttcctctgcacgtccttagcatgctccctgcacacccactgggacaccagctttgtgaaggcaggggtttgttttgttttgtttacagagctaggcgaacagttggcactcagtaactgtgtaatgaatggatctgtactgcaaacctgatatcacttgctcttttcacttcgaagttcatgattcgcttccttgttagtagatacctttctgggacaggtttttaatgggcacaaattattggactgggtaaataggccacatttcacggaaccaacaccctcctgctttttatcagttttcttccacattcctctatcacaagtgctttcatttgtttgggctgctgtaaccatgggtggcttaagtgacggaaatgtattttctcacagttctggagctggaggtctgaggttcttggcgagaccctcctcttggcttatagataacctctttctccttgtattctcacgtggcagagagcagagagaggaaatcagctctctcatgtccctttttaaaaattcacatacatttaagttcaagtgcagttttattacatgggtatattgcatggtggtgaagtctgagctttttgagtaaccatcacccaaataatgtacattgtatctactaagtaatttctcatccctcaccctcttcccaccctcccaagtcactatcattccacactctatgtccgtgcacacacattataagctcccacttgtaagtgagaacatgcggtatttggctttctgtttctgagttgtttcagttaaaatattgacctctagttccttccacattgctgcaaaagatgcgatttcattccttttatggctgagtagtattctgtggtgtatatagaccacatttgcttcatccattttgagtcccttcttataagggccttgatcccattcagaaagtctccatgatctgatctaatctcatgatctaatcacctcccaaaggccccacctcctaaaagcaacacactggggggttaggcttcaaccaattaatctgtagaggacaaacacgttcagtccatagcaggaagcagtgccgccatggggaagagcattgtcgtgaaaccttttgcccctcttgttgagttttctcctccagcacaccctgaacatgctgacagtgtcaccttcctctttacttgtccctcttccgctccaagttgcctcctggcttcccagtgtctctgtgggcttgagaccagagcttgtcataagagatagatgacgtcacttgatggaaagagtcaagtgcagtgaccagcacatagaaggcggccatcaacattggtttcatcctttagagcaaagtttccccaagcgcctggtgtgcactggtgagatttggggacggggtggtacttaagacctggcactaattaacactagatcactgtgtgggaaacatagtcccttttctgttctcttcaaatccttctgatcgggctgaggagaaagcctcaggttggtgctgatgtgcttttttctcccagacccccatcctaacagaaacagagcaggtctcaggctcgggccgttaggcaatgatgtcaagccagaatgaactaacattattttgttctcgttgtgttttattttcatgggaaacttagagttatattcagagatattgatttttttaatcccatttaaaaataatgttttaattgagataaaattcatataatgtaaaattcacattttaaccatttaaaatgtacaattcagtggttttaaacatatttataatgttgtaagccatcaccactatttaattccagaacattctcatcacccccgaaagaaaccctgaaccccattagcagtcgctctccattttttttctctcttccctgcggcccctggtaaccaacaaactaattccgtttctgtagatttgcctatcctagacattttgtataaatagaatcatacaatgaatgatcctttgtgactggcttcttagaataatgttttcaaggctcatccaaggcatgtatcagtacctcattcctcttaatggttagatcactttccattgggtggatggaccatattttgtctatttattcatcaattagtgagcatttgagttgtttccactttttggctgttataaatagccataaacgtatatatgctttttttttttttttttttttttttgagacaaggtcacccaggctggagcgcagtggcacaatcacagctcattgcagccttgaactcccaggctcaagtgatcatcttccacctcagcttcccagatagctgggactacaggcatgtgccactatgcccaactgatttgtttattttttgtagacacagggtctcactttattgcccaggctgttcttcaactcctgagctcaagtgatccacccacctcggcctcccaaagtgctgggattacaggcatgcgctaccatgcctggtccaattttttgtataagcatgttttcaattctcttgggtgtcttcctaggagtggaattgctgggccctataagagctctgtgtttaacttttgcaggccatttcctgagtgactttaagttgaaaagtaagtcagtttaaagaaaactattaatcatattgcagatggtgtgtggacatgacaaacgtcataaacgtggtttgcagtgatggaagagtagaaatcctgcttggacatgacctcctccatcaactgtttcccactcacctttccagcctgtggtgcctctgttcccaggagcctcagtgcagccacgctggcctctgaactgtcttacatgagatgtccttcttcaaagatactgccgtttgtcttgtcctgggatatgcgcgacccacattttttttttttttttttttttttgagatggagtctcactgtttgcccgggctggagtgcagtggcaggatctcggctcactgcaacctccgccttctgggttcaggtgattctcctgcctcagcctcccgagtagctgggatttcaggtgcgcaccaccatgcccagctaagttttgtatttttagtagagacggagttttgccatgttagccacgctagtctcgaactcctgacctcaggtgatccacccacctccgcctcccaaagcgctgggattacagacatgagccactgtacctaactgcgccacccctttataccctccagggagctggacttttcagagatcatctttcacttagaatctaccgtttaacccttaattgcatttcccctcatattattatactcactaatgattttgttggagaatcttttgcctctgctataagccacttgagggtagcatctatattcaagtagtccattgttcctctcatagtgcagcctcacctgatcaatggtgaacagctgctgatgaacagaaccttccctggaggcccctgttctactgaatcttggtcagccccgtgtcctgatgcttgccctgcttgctgttactttttgcctgtggttttactgtttagttaacttcttcttttcctttctttctttcttctttttttttttttttttttttttgagacagagtctctctctgttgcccaggctggagtgcagtggcgtgatctaggctcactgcagtctccgcctcctgggttccagcgattctcctgcctcagcctccagagtagctgggattgcagacgtgtgccacctcacccggctaatttttgtatttttagtatagatggggtctcaccctgttgggcaggctggtctcgaactcctgacctcaggtgatccaccctctttggcctcccaaagggctgggattacaggtgtgagccaccgtgcctggcctttatttatttatttatttatttattttttgatatggagtcatgctctgttgcctaggctggagtgcagtggtgcaatcaaagctcactgcagcctcgaactcctgggctcaagttgtcctcctgcctcagcctcccaagtagctgggactacagatatgtgccaccacgcccagctaattgttgtattttttatagagactggtcttgaactcctgggcttaagcgatctgcccaccttgacctctccaaatgctgggattgcaggcaaatcagattgtttcacagacttcagaatggaggctgaggttcaaggaggtggacaccaggcagccctgggaggccatcttccatccagtatgtagagtaaggaacaggaaagcaggtgtaccgagaggcaagaaccatgaatatggacaaggagaagccgagagaacacaaggggagacccaactgtcttccagttcccagttctcttcctttccttcagccagaccgaccttcctcctattgggcccaaatcatgtcaaaaaaaaaaaatctgactggccaggcttagtcaaggaggggatcatagagtcccagtgccatgggtgagggaggcagtcagtgtagacatcatatcactggggagataagccttcaatggtgcccactattgggtgaaaaggcagacctggagctctgaacttcagcttccccttcttcccaaggttgtagaagtgggaaagccaagctagtcatttctgagtgcgggaggagaataatgtgacaaaaatggttaacatcagactagctagccttgaaagcttgagtctgaacggtgatatcttaggagaggggaaaaaataagcatgaagctgtggctctgctccatttctggggaaggaagctcttctgacttttctggctcagtgcaggaagggttgaagaatctcttaaaatctcctgagtcctctttgtccttcatctcagaattcctgtgcaggtgatgtttggctgtatgctccacgaaaggaatagggaacttggctccctccctccagggactgttgctgctcctctgagtttccttagcttaagctgtgccccctgtgtgccatttgccttgggacagagatggcccccattttccaatcctgttgtaggggtgggaatgctccccagtatgtgaaaatatccccaagctgtgttttttttttcttttcttttggggcaggctcttgtgttgcccaggctggagtgcagtagcacaatcatagctcactgcagcctcaaattcccaggctcaagcaatcttgcttcagcctcccgagttcctaagtagctgagactacaggcatgtgcctccctgcccagctaattttcattttattttattatttttgggatgaggtcttgttatgttgcccgggctcatgtcaaactcctggcctcaagtgatccttctgcctcagcttcctgaacagctgaaatatccctaggcttttaagcctcagttacttaatcaacacagtggggccagtacagcccatcattggcatttgtggatttggcagtggtggttccttttctcattagctacccagaagatccttagcacagcatcataagtcactgtcttgaaactccaccctgaattggatgcttggtgagcatctgggagaggcagaatggtgttggaaccaagattgtgggctctggagtgagatttctctgtaagtctggacaccaccccttggttgggtgatcttgggcaaattaattaatgtctctatgcctcattttccttgcccataagtgcggatgacatagcacccacctcacaaggctgttgggaggtttaaatgagttaagacctgcacagcccttagaacagggagctttcaatatgtgttggccacagctcttgtgcccaatcgatttcactcatttgggcaatgcctgggttctagatgaagggggaggaggctgcctgtagtgtcttcttcatgggccagtccagctctgcagtggactgtactggtgatgtccaccgtgcctcagcttttaagcatatattctccttgaaaactatttaagcagaacacactggggtcaagccagtccaagccagatgtttggggtcctgggtgcttctgttttctccatgtctgtttacctttaacaagatggatgggggctgtgaagcccctctgggcagccttttctggctgtgacatgcaccagaaacccacttttggcctgtttgcactgtgttagaaaacagcaggtgcagttggcagcctctcccctaccccttctcccgttagcccctgatctctggggactccttagactaatgcagttttaatgaatacacattactgtttacatgactgaaatgagaggctggctgcttattttatgctgaggtttacagccctgccttttaaaaccctctctcccttgctctgcttctggccatggcgatattttctggcggcccctatgctgtccctccaaataaggaattcaccatgaagtcctgcagcagtgtcagagccattgccttgccccggaaggagtgaactgtgtagaacaaaagcagaggctgggagctgtagttcacgcctgtaaccccagcacttcgggaggcagaggcagaaggattgcttgagcccaagaggtctagaccagccctgacaacacagtgggaccccagtctctataaaaaatacaaaatacaaaaatacaaaaattgatgacctgcacctgtagtcccagctactagtggacactgaagtaggatgattgcatgagcccaggaggtggaggctgcagtgagctttgattgcaccactgcattccagcctgggcaagagtgagactctctatcaaaaaaaaaaaaaaaaaaaaaaagcagaaagatggattctttatttttttaatttaaaaatactttttacaattcttaaatgcttgcttatgatagaacaattagaaaatgaaggtatacaaagagaagaaaataaaaatcacctctaattccactactcagaaaaaactcgatcgttaacattcctgtttatgttttagcatattttaatcaatctacatttatatgtattttaaattaaaattagaaaccaaacttaatacatgttattcagaaatctgctttttaccctacctcacaattaatatatgatgaatgtctttccgagttaagaaatatagatctgcagtatcttttctttaattttaattttaattttttagagacaggatcttgctcagttgcccaggctggagtgcagtggggtgatcacagctcactgcagcctcaatctcctgggctcaagcgattctcccacctcagcctgccgagtagctgggactacaggtgcatgccaccacatgtggctaattttttttttttttttttttttgagacgaggtcttactatgtagcccaggctggtcttgaactcctggccacaaacaagcagttctcccacctcagccttccaaagtgctgggattacaggcttgagcaccatgctcgatattgcagtatctttttttatgcatcattgtatcctattctataattgtttctatggtctcatttgtagaaaggttaacattaaatttcgaatagttatatgtactcactggttcaaaattaaaaaggcacaagagctttaatacttttattgaaagatttctctcctatccctagcccttaggccactctgttcacctcctttttggcacccaatattcaactaataataccaatttattgtgtatacttctggaaatagttcataatgtacatgcacatcatatacatttatttttctcttcctcaaacacgtacattcaaatgttagcttaccttgctttcttcacttcacaatatcctgtatcttggtgtttgttccatgtcagtgcatatagaacatcctcattcttttttttgaaacagagtctggctttgtcacccaggctggagtgcagtggtgtgatcttggctcactgcagcctctgcctcctgggctcaagcaatcctcctaccttagcctcctaagtagctgggactacaggcacacaccaccatgactggctgatttttgtatttttttttttcattgttgttggtagagacagggtttgtccctgttgcccaggctggtcttaaactcctgggctcaagtgatagggtcacctgggcctcccaaagtgttggggttacaagagtgagccactgcacccaatgtctcattctatttttatttatttattttttgagacagagtctcgctctgttgcccagaccggagtgcagtggtcttgggtcactgcaacctccactttccaggttcatgtgattcttccacctcagtttcctgactagctgggattacaggtgtgtgctaccacacccggctaatttttgtgtttttagtagagatagggttttgccatgttgcccgagctggtctcaaactcctgacttcagatgatccacctgcctcccaaagggttgggattactggcgtgagccaccacgcccggccacctcattctgttttatgattgcatcgtggtccatagtatgggcatccctggggtgtttccaaaattgggatatattgactcagaaacccttcctgtggttctgtccaagctccttgttcatatgacctggcctggggtgactggaggaaggatgtccattcggagattaggagggactgcagctctcgattatgaatgggattggcctccacaggcctgagtgacaaggacaaagcagagctggtgagccccatgccaggtggcggtcactggtggaaggccatttgtgacttctctgcagttctccagatggaccacatttaaaacagaggcactgccattcatttctacttggttgaggaaaggtttcatcgcaggcccagagagaggatcagatgttttttgcagtttctggcaagacattagtgggtatcagagggtaagtgatctcgtaaagctgactcaaagcaagagaaaatttcgtgtctgtcttagaaacacatttgcctccaaagggaaggcagggtgtggaggactaatcaacgcatttcacatttggtttctttgtctttcttggtgatcttacgtgactagccctgaatattttgcatatgtcaaggaaacatttcaaattactaagatgagaggaaaatatggggaatgaataaaatggggtttatcagcaagaacagcaaaagacttcttagagccggctggggattgttttgtgaatctctaaacaagaggggcagtttgacttggggatgggggatgttttgacacttggagggatgggagggagccaacaaagatgtaaagcaaaactgggatggtggtgatggagaagcagtgggggtttctatgggaagacataggaaataatggtctgtccttcacagagtaggtgaggtctactagaagatacttatcttttccctaaatttcagtcaacttcacatgattaagtttccattattaaagacttgttctttgtgttacctttttattattattattattattatttttttttttttgaaatagagtttcactctgtcacccaagttggagtgaattggcgtgatcttggctcactgcaacctccacctcctgggctcaagagattctcgtgcctcagccacccgagtagctgggactacaggcacacaccaccaggcctaactaatatttgtatttttagtagaggtggggtcttgccatgttggccaggctggtctcgaactcctgggctcaagtaatccacccgcctcggcctcccaaagtgctgggattacaggcatgaggcaccatgccaggccttttgtgttacttttgtaagagatgaaatgaaactaatatctaatcaaatctaagcatcaagcaattaaaaatattttcttaaataactattgagttaaataggactcaaaagtacaattgcagagaggctataaatgaaaaaaaatagagtgctatataaaacaatggataagatcagccaatgctgtgcttgcagataagttcatagctttaatacttttatgattaaggattgagatgacttgctttgagcataatctggctattcacttattctaaggaacttgtcatggctcaaacatgtttctagtatcctctttagaaattccgtttagatacagttttctttattaaaccttctaaggtgactatttcaaagatgaaacattcattttgttgtttaaattaacacgtattttttaaagggttatgtaaatgtgttatccatcaagtatatctttgagccttcatcacagtgtgatgtaagggatataagttgttaaggatccagcagtagagaaaatttctgcacaaaagtaactatagctctattacttttggaatattccctaggatacatccaaaaccaaatcaaattatactacttataaaacacatttggaaagatactatgtgaatatgctttgaatactgaggcttatgttagaacagagtcatggacgaatttgcaaaaaaaaaaaaacctccaaaatttcctggagtctgacaaaaataccggatagggttcctgaatatattttcatgatctttgctatataaccagatatctctatattttgaaatggatcatattttattagtttttcttagtacacaagcaacatgctatcattgcagatgccagaaagtaggatcacattgttgtgctatagatctccagaacttctttatcttgcaaaactcaaaaactctatcatttctcaaactcaaaactcaacaattctccattccctcttcctccaccccatggccaccaccattctactttgtctctatgaatttgaatactataggtatctcatataagtggaatcatccagtatttgtcatcttaagatttctttctttgtgtaacgttatcaaggttgatccacattgttgcgtgtgtcagaagttcccttctcttttaaaggctgaatatttcattgctttatagactgcacttttttatccattcatttgtcaatggacagttggattgctctcatcttttggctattgtgaataatgctgctatgaacaggagtgtacaaatatctcttcaaggccctgttttcaattcttttggctatgaacccagaagtggaattgctagattaaatggtaattctatttttaatttgttgagaaccaccatacttgttttcatagtggctgcaccattttgcattcccatcaacagtgcacaaggatttttccacatcctcaccagcacatgttattttctttttctttttttgatagtagccatttaatgggtatgaggtggtatctcattgtggtttttgatttgcattttgctaatgagtgatgctgagcatcttttcatgtgcttattggccatttatgtgtcttctttggagaaattctattcaagttgacttctatgattttgcattatcacatctgtattgattcaagcaagccaactagaataaattctggcatttaaaccgattttgtggtttttctgcaaataaattctgcccccaaataacctccaactttctggaagcagtcagcaggagtacagttctgaagataactttctttaaaaaaggaaattcataaaatatcatgcatcttccttttttgacactaatggaacaatttaatgtaatttcagagggaagcagagcccctggaaaggctggtgtgataagggaaggttacccagctttcctgtcaggcggtgtgtgggagcagagagtggcattctctgcatactcttggggagaagagtgggtgagacaggctgctcagggctggggcagagcccaggggaaggggatggaaggggaagaacagcccttcaagagtcctgcagaaattggtggaagttatttaacagaagtgttcggctccacccagcacattctgttgccttctacatacagagtgtgttagtctgttctcatgctgctaataaagacacacctgagaccaggtaatttataaaggaaagaggtttaatggactcacagttccacatggctggggaggcctcacgatcatggcagaaggcaaatgaggggcaaagtcacgtcttacatggtggcaggcaggagacagcatgtgcaggggaactcccatttatgaaaccgtcagatcacctgagatttattcactaccatgagaacagtatgggggaaaccacccccatgattcagttatttccacctagccccacccttgacatgcagggattattacaattcaaagtgagatttgggtggggccacagccaaaccatatcacagggtaatgaagaatgtgtgcccaagtagtagagggcttaagaaaaccactcttgggctctgagtctctctaggtctcagtttcctcatctttcaaatggcaatattaataagacccacctcatagggattgtgtggggtttaaatgagaaaagacaggtaaggtgctggtaccttataagtgattaagttgccattaaggtattggggacttagtgcttgtccttgaagagctttcggtctcgtgaggagacagcctgatcgttataaactattatagaaaatgggaagaaataagggttgaggtgtgataaagatgtgctaggccaggcaagatggctcacgtctgtaatcccagcactttgggattacaggtgggcagatcacttgaggccaggagttcaagatcagcctgaccaacatggcaaaaccctgtttctactaaaaatacaaaagttagctgggtgtggcggcacccatctgtcatcccagctacttgggaggctgaggcaggagaattgcttgaatctgagaggcagaggttgcagtgagccaaaattgcacaactgtactccagcaagactctgtcaaaaaaagaaaaaataaataaaaaaagatatgctataccctcatatcacaataatgccaggaaatagatcattaattctgaaccctaattcttgggtgggcatcaaggcaggcctcacaagaagaaggcatttgagttgaatcttataggctcagctgggttccaacagcaaagacttagggaaagggcagagcaggcaggggaacagtaagagcaaaggcttgaaggcatggaagttcatgggtaattactgactgagatgtttggtgttatggtgcatagaacactatcggatgataatgaaaacattgaattccagcatgtttagaaggacattggctgataaaaatgacgtcttaatagttatctgtggacaaatttgtaaatgtaaaagagttgtagactcaaatcctacagaaattaggcaggagacctaaatgagtgaagtgggtgggtataaaacagaggtggtggcaggaacccatgttgaattgaatagtgggtgttttgtttaaaggggcaccagtagtaatttttcctctgttggaatatgatcctagggctgccagctcttctactttttcaagagaagccagaaatctggatttcatgcaaaatttcttgtttttctttttattaaagacatggtatggaccaaaaaaagatgtctctaggctagatctctgcaacctctcatctatactctatttgcatttttaaagactatatgcaaatgttatttagcagagctacctagtttttttgtgtgatgatagcatgtgaaagagctatgatacatcttggaaatgtcaactttgaaatatacagtgactgtgttggtcactacagaatgatctctgcagaaacttcagttacattttctctaaatgacacctttgctttgacaacacattttcaaaaagaaaaatagcaaactacccttcctccagggccttagccacagtagctcctgccagcataacacaatgctgcaccttactgagggatcaggaaatgtggtttgatttataattatggcttcatgggtagaatggtggccaatgtccacatgagccacactcagtggctaagatccagagggcatttaatttaggtagccagtgttacagacatagtttagatttttgcagccttgaccaatcttaatagatctgtctgttctttagagttacctttttttcctgcctcctagctacctacaccttttaatgctaaatgtagttagctagtgaatgctgttatttgaatcttaaaatttcaggttgggacagaaccttaaaattcatgtatttcaaccaccctttgtatgaggcaggaatcttggttatgacaggtgacagaaaattcaaactagcttaattcagaagggaatttattgcctttataaaaccaaaaagtccaagggtagctgccttcaggtattgtctgatccaggggtttgttatgtttccaggacatggtttcctttattccatctctgcttatgtattggctcccttctcagatggaagagactcccctcatcaaggtgagatggctatggaagctctactcacatttcctctaggttcaagtccatgtagagaagagcacctctttctcttgttatatctcacaggctctaaattagctactagggccagtgaaaaagcaatgtgctgattgaccacccttatctactcttggagttccggatggaattaacactacctgaattatgtggaccaagagtgggaaaggaatagttctccagaaggatatttggtattgttattaaaataaggttaattgaatactcactgaaccatctaatgcttgaattcccttcatagcacgccattggtgactgtccaatcttcagttactaacatgctacccccaaaatggtgtgtttgtgcagctctaataatgacagggtttctcctaatactgagatgatattggcatctccatagttccagacattatttctggtcccaaccataatcaacctgttttgacacgggtgaacatgtaagggaagggattgctcattgtggtcacagaagtaacctacccaatagaagcacaccaacttgaagcatgcttccatgatcactgagggaggaaaatgattggcaagtctcgtattggtccttgaagcgctccctataaacacttgtcactgccaagcgtgtatcactggccaaagcaagtcacattgtgatatgattagactttgtgtccccacccaaatctcatcttgaattgtaatccccataatccccatgtgtctagggagagaactggtgggaggtgaatggatcataggggcagtttctcccatgctgttctcatgatactgagtgagttctcacaagagctgatggttttataaggggctcctcccccttcactcctcactcttctctctcccgtagccatgtgagaaggtccaagcttgcttccccttcgccttctgtcataattgtaagtttcctgaggcctccccaaccatgcggaactgtgagtcatttaaatctctttcctctagaaattacccagtctcgggtagtatcaagatagcagtgtgagaaccgactaatacgcatggccatgcctaacttcaaagcggctgggcaagtatcatattgctgtgtacttgggaggaggggagaatcagaatatttgatctggcgaccaccacacaactgaacttctctatttctgtgttcttcttgttaaccatctagtttctgtttcctcttgtgacacatatattaattaatttttcaatacccaaacacaagcctctaatatttatctttgtttagttacttcctaataaactaagatatctctacatcctgatcctaaaattcaaaggctccacgtataccatggtgactagttaattccaatatattgcatagttgaaaattgccaagagagtagattttaagtgttctcactacgaaaaaatgcatatgttaaatagcttgatttagccatttcactatgtatacatgtaggaaaacatcatgttgtacactacagatgtatacaatttttacttgtcaattataaacaacaacaacaaaactgcaaagtctccttagacccacccaatcacatgttgtctgctcatttaatgagtaaatgctatataggttcattctggacctgggtaaaatgatttacggactgggaccaagtgggaggaccctatttcaattcattaggtaaggtcttccaggtcaatatttgaccattgattggcacatctggggtatagttatttaactgccttctagtttacctcaatatgacccctcagtggagggaaaatggagcacaatgactagaagaatgttgagagatgaggaaagagagaatgggatggaaagaacataaaataggaaagcattgacattgtcacttcttggctatttcttcctgtaaaattttgcctggagtgccctacaatggggtccccatcctctgccctgataacatcttagtggatcactcctctctcccttttcattctgcaggacttgcccattggggctctttcagacctgactggtcattgggtatctgtggccatgataatcactctcttcctggacgtgaccctcctctcgttaaccaggatgcctgtgttcttaaggttggccgtttccaaggacagagagcttgcatcccatttctaggggactggggatccaaggactccattcttgacattgtcttgtcagccttgaagtgccgaaacccagcatccctgtctgaggtcatcctgtctctcttccaaacatgaggacttcttaaattttttaaaaaaagtttttacttgtataaattgagaaggcacaagtgcaattttgttacatggatatgttatttagtggtagaatctgtgcttttggtatgtccatcacccagatagggtaccctgtactcattaagtgatttcttatccttcactcccccacccaacccttccaagaaggatgactattactcaacagtcattcagtagccattggagaatgactattattccatactctgtgtctatgtgtattatatagttcccatttataactaagaatatgcattatttgactttctctttctgagttttttttttttaagataatggctttgggttccatcctgttgctgcaaaagacatgatttcagactgggcatggtggctcatgcctgtcatattagcacactgggaggctgacgaaggaagatcacttgagcccaggagtttgaaaccagcctgagcaacttggtgagactccggctctataaaaattaaattagccaggcatcgtgttgtgtacctgtggtcccagtttcttgagaggctgaggcaggaggatctcttgagcccaggagttcaaggctgcagtgagctatgatcacacaactgccccccagcctgggtgacagagtgagaccctgttttagtcaggacttcaagaccagccttgccaacatggtgaagccccatctctgcaaaaatacaaaaattagctgggcatgatggcgggtgcctgtagtcccagctactcaggaggccgaggtggaagaatcacttgaacccgggaggtggaggttgcagtgagccgagattgccccactgcactccagcctgggcgacagagtgagactgtttcaaaaaaaataaataataaataaataaataaaaataaaatcaaaggtcttactcttttttatggctgagtagtattctattgtgtgtatgtatatatagatatacatacatataccacacacatacgtgtatatatgtatatatatggtggtatgtgtgtctatatacacacaatgatatgtatattaatatatatgtatatataaatatatatacattttctttatccagtcatccattgattgatgcttaagttgattccatatctttgctattgtactgtgataaacgtatgagtgcaggcatcttttatataataatttcttctttggatagctgcccaaaattcaggtaaaagatctcagtctacaaggcagctcccaagcttcaaaaaattgtcctgccagatttttaaaagcaagttttctcaaaagcttcgatgtatacattggtcgatttatttatccattaaagtatttattgaatacttcttactgcgtatggtggtggtggtgctgaggtgtctcacagtgaacacaacaggcgtagcctctgctattaccaaaattattgtctggtaaagaatgcagatggctaaccaggcaggtgcctgtacggtgagatatgtgctgtgatggctgtaagcgcatggtgtgagcgtagagttgggtgcttaattgaaggcatcaggaaggcttccaggactaaatgatatcaaagtcccaccttaaggatgacaggtttaactaagtaaaggaggatgtggaaagaagggggagagtgctccaggcagaggaaatagtatatacaaaagcacaagaggattgaagaaccaaaatcactttggcatggctggaatgaagggcatgtttgtgtattttcagggtaggggatgtgtttagggacaagctcagagaaaaggaagtaaggaaccctgtcataaagggctcatctgtcctatgaaagagtgtgtacattttattctgagagtacagagccttttcttttttctaagcattacatgattagatttgtcttttagaaaccactctggctgccgttaaaaatgaatttcacagtgacaaggctggaggaaggatcttgggttaggaggcggtggtagtaatctaggcaggacttgaggacgcctgagtggtggtgaggaaggagagaggtggatggaagattcaagagatatttagggggtgttattgagagaacttagtgattgatttggcgtgggaggaatgagaaagtcagggatggctccctggtttctggcttgggtactaggtgcgctggtggtgcttttgacagagatagaaccatgggaggaggaacatgttttgagggaaggctgtctcccttttagacacctagttggtgtccaaatggcacagaccagttggcgtgtggatatcttggggcttagggcgtggatctgggctcagggtggagatctgagccttagctgcacatcagtagtcattgcagtcatggagtgtgctggggttttgccaagagctcatgtagattcaggcgagaagagaggaggggcccaggctgggaatactggctttggaaatactcttgaaatatatagaaatgaaagaatgtatagggctgtttccacagacgtttattttttatttttatttttttgagatggtgtttcactcttgttgcccaggctggagtgcaatggcatgatctcagctcactgcaacctccacctcccaggttcaagcaattctcctgcctcagcctactgagtagctgggattatagatgcccacgaccatgcccggctaatttttttgtatttttagtagagacacggtttcaccatgttggccaggctggtctcgaactcctgacctcaggtgatccacccaccttggcctcccaaagtgctgggattacaggcatgagccaccgcgcccggcccacagacatttactgagcaagagcttgtgcaaggcactctggtatgcatgcagtcggggaccctctgatgaatggaactcaggccttgtataaggaagtgacctccatcagagggtggagacgctgtcagtgaacatccatcacagacaagtgactgagctaggagctggggtaaggtagaaagaggaggacagtgggcgatatgagctgggaaatgcacctctgttgggggactggggagggcttcctggaggaggtgattttggtatctagtggttttgttttgttttgtttgttttttttgttttgagatggggccttgctcttgttgcccaggctggagtgcaatggcatgatctcggctcactgcaacctccgcctcccaggttcaagcgattctcctgcctcagcctcccaagtagctaggattacaggcgcccacaaccatacctggctaatttttgtatttttagtagagacggggttttgccatgttggccaggctgttcccgacctcctgacctcgtgatccgcccgcctcggcatcccaaagtgttgggattacaggcgtgagccactgcgccaggcctgtatccagtgtttaaggagatgttttgtcagataaagctggagttttgtaatggagttttggagatggggaagggcagactggcttaagagggtgctgcataagagatggctcagaggagagaaagtgtacgatgttttcaggacaaattagtccttcaccatggcaggaatctaggcggccgaaggacatttgtgggaaattgtagcagaaaatacgaggaggactttgatgccaggccacagagtttgcagtcctttttggagactcaggggagttattgaacaattagaaactaaaggctgatgtgacctccacaggatactggctaaacgcatgaactcttgaaccagatggacctggatttaagtctggattctgccatttccttgctgtgtggtcttaggcagattattaacctctctgagcctcagttttctcatctgtcaaataggagtgaaatacctcatagagggttgtgaagagtgaagtaaactaatgtggagaaggcattctgcagtgtctggaattcagcgacccctcagtacatgttaacacactaatactttctacgtaatcatacctgtaacaacacagagacgatggtattatctttacagcttgttcgcttctgtatcctgagcatctaggacagtgcctggcatgtaatggatgctggagaaatatttcttgggcaagaaatgaattgcaccagtttctttttgtaagggatctatttttttcttgtctggaaaaatactttgataaaaccttagggaaaagatgaaattccctttcttctggagcctagatttcaaagaggagaggttgagtgctctgcaaagtagaaggagaagattttgggcagtgaggaggagagaattgatgagatggtggggcacagcgtactatgaaatgtgactcttcccccgggacccccgaaaaaatcttctgtaacattttatatgtgtaagacatctctctaccatctgctatggtcgaaatgggatttgtagagagctcatgtgattctcaaacctcctagtaactctgcttacatggagagacagctgtctccaagccagctgttgtcttttggaaagctttaatctgggggaagataacaccttgagaaaagatgtcaggattggaggcagatgttgacggagccagtttctaatgccccaaggcagccacactttgtatggattgtatggatgggcaggtgcacaaggtgagttatttttttccctacccagaaatttatggaagcctggcatggtggctcacccctataatcccagcactttgggaggccaaggtgggcagatcacttgagcccaggagttcgaaaccagcctgggcaacatggtgaaaccctatctctactaaaaatacaaaaattagcctggtatgggggtatgcacctgtagtctcagctactcaggaggctgaggtgggagaactacttggacccaggaggtcgaggcttcagtgaaccatgttcatgccaccacacttcagcctgggtgagagagtgagaacctgtctaaaaaaaaatatgaagttgctcttttgaagagcattctaatgacttatctggagattctaggaaagaaattaaattcagctttcaatgtctgtctttctagatttcttccttctaacgttattgttgttatgtcctcaaacaaaaacatttagtacttattatgagcttcatagggttgttgtggattaatacatgtaaagctcttagtgcaatacacgacacatagataacatttaattttattatcgttactgttgggtagcactcagttcatgaaattcccacacacagtcaagtggtaaatgctattactttgtaaatatcatcgatgaggaacctgaagctcacagaggttgatgacttgcctaggatcgctcagaaagcaggcagcagagctgattgccatggtaaccatttccaagcttcagtgcccagagatggacccagtctggcatgggcttatcccctggagcactgtgagtgtcttgacagataagtaaaggaagtctttaatttctgaaaaatgcccagctgtgattggcattgttaggggtcagtgaagacacgctcaaagaccttactgtccagcttttttatctttcacctttaatgccgctgttagccccaggagctaaccaaaggggagttttctttatcagttccaagagggatgccatggttgtcccaagattctggagctaaaggtgggaccaggaccagaattcagtttctgtgtttccaaattcagttctattctcctctcagtagaccaggaggcctccagacaagacagatggcagacagctacagtagtttaaaatagcctgagctcacttctgaggtagacatgtgcgtggagtgagctggaagacagggacccctgtgtgggaaagattttggcaaagagaagcccagtggggagttctgatgctaggctgagtgtcatcaggttggggtgagggtgtgagaagagacctgagcaggtgccaacctgaggctgagtggggaggagagaagcgagaggacaggtgccaggcaagatgcggcactgccaatcagtagaagcttcctccctcctttccagctgtgctaccgagacggggaggtcaggtggtcgttctgggagggctggtgccttttacttcccggccttctggcctgctgggtcttggagtccagtgcaaaataatgaagttcctataaagacagtttgtatagatccttttaggatgacttgaaagcctatgcatttccttaacaatgatcaattcttggctaatcctctttcatccatatccgcacccaatgcttttcactccatttccatactggatgttttgaaataaatcccagacaccatataatttcagtaattatcaatctcaatatcacagaaagtcaaatagacattatatatcttctaatatgatgcaaatagaagtggccaatgctatctatgcaatattattactaaagatctaaccaaatttacaggaaatacagagaatatgtaggaaattctacatagaaataacttgatttcttcacgaaaccaatggcatggaagtgtgaaaaaaatagaattaaaagatatagcaatctaagatagtgtgtggacctcatttggaaataaattcaaacaaatcatccataaagaaaacattgtgagataatcaaggagaaggaaacattaactgaaatataaaatgataataaagaattgttattgcttttactgggtgggataatggaattgtggttgcttttttgttgttcttatctgtggagatatgctgaagaatttatgggtaaaataaaactaagcgatgctaggtggggaggaacctatgcatttcctattttttggcaaaaaggccccaaggtgtagtccctagcacctatgttcgaacaatgtgacccagcattcctgctgatccctgactgaaccaggtatggctccacttgatcctctctctggggactgggagttagcattcagaaatgccagctagcctccatcaacagcagactggaaggatcaggcatctcaggaatcatgcaatgtgcatcaaaaaatagagaaagcttatcttcagagagacagacaagtgaagctggctcagaggtcatgtggaccagagggatgggggaagcagttgccttggttcctgacaatcctgcattgaagtcaaactgctgttcctttccctggtttctgtttccttgtaacagacttattcctttgcttgaactgggggcttttagtggggttctgttgcttgcaaatcttaagtactctgagaaacagctaaggagatgaagatggaaaactttgtcatgaagggaatgggttactggaatctttctggagggagaatttcagaattacgaggatgcagttctgattgaagggggtcttgtgggtatctgggatttggaagtgagaatgaatgctgtagcagatgctattagctacccatccaatggcgattccttctttgtttctagttttgttcggtggcaatgtgcccaggggacagtgcatgcatgacccatgattatttccctttcagtgattggtctggaagtgggcactggacccagtttgggtcatgtaggaaagactctttcttttcatcctttcttcctgctctggaggctgttaggtgaggacataattgttggagctatggcagccacattatgactatgaacaggtgcctagatttgtagcaacactgactgagagcactgtcattcttgagacactcatacctccttctttcagactttattattttggggatgatatttattgatgagccccttttggttaagttgcatatggttggctcttctgttaattcaagccagaagattcttaattgatacagttaggcttcataatttggaggtttgggaggaaaatgaggtgaaagagcatgcattgttggggaagataatattttaaatcagaaaattaacattttctaccagaagaccttcaattattatattatagactggtttgcagagccttttgagagtggtgtgaactgatatccatccatccatccatccatccatccatccatccatccatccatcatcttctgtttgttgattttctatccatccatccattcatccatccatctatccatccatccattcgtccatccatctatccatctatccactccatccatccatccatccatccatccatccatccatccacccatccatccatcttctgtttgtcgattttctattcatccatccatccatccatccatccatccatccatcatcttgtttgtcaattttctacccatccatccatccatccttccattcatccatccatccatccatccatccacctacctcatccatccatccatccatccatccatccatcatcttctgtttgttgattttctacccactcatccatccatccatccatccatccatccatccacccatttgactttctttttacgaaactttccctttgatcaatggaggatttccttcctggacttgcttggttctgtctattatcagctgggtataaaatgcttttccttcttcagttaggtcacgtgtagagaattgatattagatagctatggtgaggagtgaatgggattctgcctggcctctctctagggacactttgccttctgcagtgtctggcatttctaagaaacgttgatttttaggcattgaggaaaaaagctgttttttttttttttttttgacattaaaagctctagttttcccttattttattccctggagcttctttcaacatattcaagcactgttggcttcaggcgtggctttgtgggctggaaagggccagggtatgttttcagaggaatcctgtgggattgaattaggaatgctgccttcaggggataagtattattttaataggaagatattctttattttttgattcttaggaattgctgtttctcatgtagatgtacttacctttgttacattaataagttccataaaatattttcagcgtatagaatttttatatatctagaccattgtctgtttcaggttaggaattgtcagtgtttatacgtgcgcctaatcccttgtagtctgttcgttactgggatggtggtgatgggggcactagagggtggaatttgcgcacatggagagaggagatggtgcatgtcagtgtgttttccagttgaggcccttggggttgtgggtggggaggaaagaggaggaggaggaagccagtgtggtaggagtgtgatccacattctcaggaagaaccatatttgatttcatttagaaaacggaattcttacttcttgaacaaagttggcttttcttctctgaacgtggcctttgcaaatgcttgagtctttgagtatggtgatgactgagtgagaggagggatttgcttggggcagcaggcacatctggaaccattgaccacaaacctggctgagcacagagccacccggatgatgggcttaataggtacaaactgggaacttcccctcaggcatgccaactcaggaggttgtcaccagtggctgcagcttggagtgatctggggatcttttaaatgccccaatgccctgcctctacctctgtcagtgaaagcaggctgtctgggagtagaatcagagcagcagtattcattaaaggctctccaggtgactgtcatcagcatccaggtttgagagccactgtggggaaataatctgtactttctataaagccagaagcagtcagttttctgaacatcactgattagaccgtagccattttccagtatggacaaagtaggttctctcctgccatcccccagctgcagcaaacttctcactaatgggcatgctttgagaaacaccaaactgcagggacccaaaggagcatacaattaacgttaaatcacaccagctttgggcatatatatccctcctccaccccaaaatctcttttaaaatagtgttttaaatgtattttttgtagtatgttcacaggactcaaaaaaaaatacaaaatgctgcactattcacaataacaaagatatggaatcaacccaggtgcccatcagtggcagaatactatgcagtcataaaagagaatgaaatcatatcctttgcagcaacatggatggagctggaggccattattttaagcaaattagagcaagaacagaaaatcaaatactgcatattctcactgataagggagagctaagcattgagcacacatagacataaatatgaaactagacactggactactggaagttagagggaggggtgggtttaaaaactacctgtcgagcactgtgctcactgccagggtgacgggatctgtacaccaaacctcagcatcttgcattattcccgtgtaacaaatctgcacatgtacctactgtatctaaaatgaaagttgaaatttaaaaaatgtttaaaatccacacagttttaaagtctcttattctcttctgttctccatccacccatttcccacccccttctctggatatcttttcagaaatcttttccttcaccccctttgttgtcacacaaaagatgacatactgcaacccctattctccaccttgttttttttttttcctgctaatatttggctagtaagcaccagcatggtgtaatgactggcatttgttctgatttgttgagcatcctcagtgactggcagaagctcacatggtgctgccagtctttagatatttgaattacttcccctgtccaccccacgtctagaagatctctctaagcaatgcaaagacagcttccttatactactttttaaaatagatgtagagtatatatatatttgagacagggtctcgctctcacccaggttgcagtacattggtgcgatcttggcttactacaacctctgcctcccaggcttgagtgatcctcccacctcagcttcctgcgtaggtgaggtcacaggtgtgcaccaccacacccaactaatttttttttttttttttttttttttgcatttttggtagagacagagtttcaccatgttgctcaggctggtctcgaactcaagcgatccacctgccttggcctcccaaaatgctgggattacagatgtgagcctggcccaagtattcattttttaatagatgtaaagtatggataattcataatttattaaacaagtcctgtagggatggactttaggtgatttccaatttggggccattacaaacaatgccattaagaatagtgtggccaatgcatcacttcagatgtgtagaaatccatctgtagagttcccataagtgctatttcttggtcaaggggcatgtgtagagtatctttagcgacgggaaatttcacgaaggcatcacattttccagtttgctgtagcaggcagctctgcttctgaaattgtagtaggtacagggttttcttttctttttttccattggtggctttgaggaactttcagatgggatagttgaaaaatgtacatctaatggttttagaggagatgcttctggagctgcagttctcctagggcctttcttgaatgacctgcaggcaccatctggtgtttgttaaaaatgtggaccctgagccctattagactctttgaggcaaggcccaataaatttttaacacaagcttcccaagcgatgcttctgtgcactgaagtttcagaaccactgttctaagggatttgttgtagaacaatgccgtgagaggacatcttttcatatgattagcacagtggaaccacactggtttactcgggacaaagtctgcgactgccatgaacattgcaagctcaataatgccaagcaaagactgagtcttggcatcgggttgaaaataacatttggctatcaacctctgatgcagcatttacaagtttgccctcaaatgcccatagaataggaggaacagggtcaacaacactgaaaatagtcagataaccagttgctggaatctcagtgaaatatccattaactcaaaggcagatggcactggattggatctacccttcacagtcaacacctccaacaagatggaacaagaccaactggaaacagctttgtctatcttccactgtcctattcctagactaagagactcagcttcgtaccaagtgggaagtcactctcttctgctcaaaattaagtttttgaaatgaccacaggcctcttacgatggctaattttcctacattcattcagagaagccagcaagggaaggggaggcagttaacttgtgcagtggtttgtgtagggaactgctggtggtgaattgaacgttcagttgtgtggctgccatacgttaggtgcatagaagagaccgaaggaactagggtgtgagtgcattgtggaatcagagaatcagattgtggaggtgggagaagagtctgaggcagttcaagagagctgcagtggatgagtgcttgctaaaatcccagtgctatatgtgtagttctgccctccaaccatggcttgagaagaggactggaccattactagcgaaaacatcactaggaagggcagcctatacaaccaatcttctggcagacacagggcctggatatatctttccaaagaataacccagtacttaagacaatgcagctgcgtttacagagttttgaagggaaatgttatcatctacatatttgattctcagtcaaactgtcacttatgtgtgaaggcaacagaaagacagttttcagatataaaaaggcactgcaaatctaccaccactgaaaaagttaattgaagatgtactctgattgagagcagatccaaaattaggaacttaagaatgaagaagtcatggtatggaggaactgggatgagcacttccagtaattaaacataatattgagtccaaataattgttataagtctccaattaagtgtcagacaacaataattatttgtgaatgagtagctatatggtgtaaaattagcttcatgatctatttgagtgcaaaatcctagcatataaatgaagactgggaagtagataacataggagcaaggatatgaaaactttacttaatctatcatcttttattggttttacttaatttttcatctttcattgtggaagacagtcagaaaacatgctgttaactttctttaatcacaatgaagtaaaactagaagttaataacaaaggttataaaaaatcaatgacttaaatataaaatactttccttaatgaccctgggacgtgttcaacatagtgctgtatgttcctgttggtccttaccattgcaatacggcaaaaaagaaagaaagaaagaaagcatacaaagaaagaaataaaactgtatttatttgcaaacgacatgcgtatctgtgcagaaaataccaaggaatctataaaacaaaccaatcaaccataaacaagccatcctacaacacataagtgaattcagcaaggttgccagatacaggggaaacatacaaaaaacaattgtatttctataaactagcaatgaatacgggaagactgaaattgaaaatataatactattgacaattgattgctcaaaggaaaaaaataattagctgtaaatccaacaaaacatttgcaggacttatgtactgaaaactgtaaaatgttgatgaaagaaataaagaatatctacataaatgaagacatactgtgttcatgaattgaaagactcaatatagtaaaggtagcagctatccccaaattgatatacaggtttaatgtgattcttataaaaatcccaacaaaattactttgtagatataaataagattattctataatttatatgagaaggcaaaggaactagcatagctaaaacagttttgaagaagtagaataaaatgggaggaatcagtctaccgtagtcaagactatgtgatattggtggagggacagacacataaatcaatagaacagaatagataacccagaaatacacccacacaagtatgctcaattgatttttgacaaaggcacaaaaggagttcaatggagaaatgaattttcaacacatagtgctagaacaattggatatttattggccaaaaaatgaacctcagcccaagtcttgcactttatacaaaaattaactcaaaattgatcatgctattaaatgtaaaatataaaactatacaacttttagaagaaaacataggagaaaatttttggaatctagggtcagggaaaatttcttagactttacaccaaaatcatgatccataaaaggaaaaattgaatagtcggacttcatcgaaactaaacgctattgttctgcaaaacgctgttgagagaatgaaaaggcaaactacaatctggaccaaatatttgcaaatcacttatctgacaaaggactattatctaggatacataaagagccctcaagtttcagctgtaagaaacaaacaatccaattaaaaaagggcaaaagctatcaacagacatttcaccaaagagggaacacagatgacaaataaacacatgaaaagatgttctacatcattggcttttaggaaaatgcaaattaaaagcacaatgagatatcactacagatcaaaatgtcaaaaatgaaaaataatggtaatgccaaattctagcaagggaggctgaggaacaactagatcacccacacatggttgctgagaatgggaactgcagtagccactctggaaaactggcagttttttaaaacatgccaactgccctatgacccagcagttgcactcttgggcatctatcctagataaatcaaagcttaaaggctcatacaaaaacctctgtgtgaatatttatagcaagcaaggaaaaaaaaacccacaagagaaacctaaggtgaactggagtaagaatatagatgagaatatataatattttatattctgatgaaatatagtgttaggatatataaaaaggattgtgttgatacctctaagagttagtcctggaaaacagaacaaagcaaagcaaacaaaagagccaataaaacatctacttctaattatatatttaatcatatatatagatcatatatatatcacgcatatatttatgtaacatatacaatgaatatatatagcaaatatatatatgaacaacatgcaagttagaagtgagaaaggacttataaatccagagatagaaaaattataagacgagatgtgctattacaatggtgttcagactggtactctcggatttatgtcgtagcttttccactactgttttctgaccttgggtgattatttactctctcagtctcaatctcctccactataaaacagggataataacgcagtagttgtatggatttggttaaataatgcatgcaaatagctcaacccagtgttggatgcctcatagaactaggatgatagctgtttttcaatttttggtattaagtttgaaagtccaagaagacagaaatgctcaaattgtctaccataaaagatagactgcctagattaggggttggcaaatgttttcttacaggactagatagtaaatattttaggtttatggggcatctgagcaactactcaatgctactattgtagcatgaaggcagccgtggacaatttataaagaagtgagcatggctgtgttccaataaatctttatcaaaacaggtggcaggcctgcaggctgtagtttactggcctctagtctaaaccaataacaagaaggaagtaatgaaagttttcaaaatcctcaccaaaacctatataacaaatgatccttttggtttttaaaacatttctctagaccatagggaaaaaggacactgtctcacttctctcctcttaccctagcatcatacatacacaaaaatctaacaaagataaggcaaaaaataaagccatggtctaatttcacttataaacacagagaaaacagtcctaaataaaatcttggcaagttgaatcctctaggatattaaaagaacaatgcatcatgatcaaggaagcttcattctagaaatacattatgatttattattaggaagtctattaatacgtcccatcaatatgtcaaaggaaaaatatgatcatagatgcaaaaaaaagcatttgttaaaatttcaatatttgttcttggtgaaaattcttggagaaaggactaagaacaaaaagatactttttcagcatgatgaagactatatgtggccaaccagtagccaaaaatatacttaattttgagatacttaaggaattcccattaaagttaagaataaatgaaagatggttgatagcaacactgttatttgtcattgttttggatgttctagtcaatgaaacaagaaaagaaacatataaatactaattacatattggaaaaatgaataccaaattaacactattcacaggttatattatttattttagcaactctaaaggaatccattgaaaaactattagtacaaataacagaattagttaagagggctgattacaaaacatgtcaaccaaaatcaataactttcttagagagcatctctaacttggtggatgacataatggaaaaataatcccttttggtctccagatgccaccagctcccttttcctcctccgcatgcttggcagaaggccagaggaagtactgtagtcctctactacagagggaagtgtaggaaactggaatattaaccatggattggcaatctgtgtgtctaaaggaaagtggtttacattttcttttaaacgtcacacttggcatgccagatccccatggcgttggagcataccaaagtgatagagcgtgggcataatatgtttcaggcaaaatgtttagcatttgcacagttaggttctcaccaatggtgtgttccttccatagacatgtgagcctggagcttggagcattggagtttgagaaatggcttgatgagggcattgagaagcactagaaaggatatggatagcaactcgattcaaattttatttttgtctacttttctaagtttgtttacttcaagcacttaaactccacttctttgagcctttgttgccttgcctacatactgaggataattaaacctttctcctagggtcttgtagcagtaaatatgattggatgaaaaatacgaaagcatgtcaacaactgcttgttaaaagttagttacctttctgcttccttcttatgcttgactagctcccttgactctttgaaaacatcagaaagcctagccttaaactcctttttggaaactaagcattgggtcccagagcctgaggtttcttaacgtctgcccctagtctggttcagcttctgcctgtttctcaactttgctctcatttcaggaaaggagacaaatgaattattcacgattattgtctcttgaggggcagtgactgtctcttctatcttgttcttccactcccctccggagcatccagagcaactctagaaataggagtgtagaaataaaacccaggaaagagggactttagaaacaagaggcaatgccatggacaggggtggcagaactgttgcccttccagtctttgctctgccatccaccagacttgttgcatgggaaactcagtcaaactctgaagcttcggagtgttctccactataaaaggagaaaaatgatcatctaccttagggtggtgttgtaaaggtcacatatgtgtggccaggcacagtggcttatgcctgtaatcctagtgctttgggaggctgagatgggaagatcacttgaggtcaggagttcaagaccaacgtggacaacatagcaagaccccatctctacaaaaaaagttaaacaatactaaccaggctagttgacatacacctgcagtcccagctacttgggaggctgaggcgggaggatcactggagcccaggaggtggaggttgcagtgagccatgattgtgccactgcatttcagcctgggtgatagagtgagactctctctctctctctttttaaagatacatgtgtgaatgtgtcttatttaactatgttacacatacatataaatataaattctgtttattaatagctcatataatatacagactctgcgcctgtacaaatgtaaaggcaatgcattttacgtaggaaaaatggttgagtcgaatgatttaatttttttacaaatcacacaatacttgcatgaaatagcaacaggtgcgaacctcctaggcagataggagtgcagtgctttgtttcacagataccatcaagcctaacctttattgtgggcttactatgtgtcaggcctgttctaggatcttgttaatgaactgattcatttttttctcataacaacatagaggggaaaagatcacatggggaaggcaccaggtccctggactttgcctcgcgtgctcctggcattttgtagagaggtaaggacttggttccttatggacttttaagctcatgattggtttggtctggtttcaattctcatcttcatgtatgctcttagaaataatctcattttaggagagaaattcagagtcaacacggaaactgaaaagctctagtactgcctgaagtctcagaataaagggtgccttcattttcacttttccaaataatctatgagagggacttttagtagatccgtaagatgtgatactaacatagtatctgcatattgtgaaaaatttataactgtatccataaaggttatttgactccattgcctcaaagtctatataattagaattccatgatgtcatctttgagctttaatatagcttaaaattatccttctgtaggttgtgtttctttctgaaacattttaaatttagaaaattaacttgttaaacttttttaagttaaatctttagatttttttttattcaccctgctgtgggggagtcagaatgacaaatgcttgaatcatcaaagtcaaatgttagggcattttagcccctctgggaaagctaaggtctccatggcccaagaatctaactctacttatggggatgatgatctcacatgatctcatgatctctgtgttttgccaacattccttcttggcaggacttaggagtgcagatgggccccagagagcatgccttgctcaagccaggtccccctcctgctgccactttgggtggctggaaaaacctcacaaagggtgcagtgtctgcggttgggagactggtctcaattttcctccatcacctgctcataaactctcatgggtttctgggtcacagtgcagccctaggtcaatcttccaaaagctgatttgctgaatttcatgtgaattgactagcttcatgtcagcattttagggaacatttgattggtcttcatgcctgctttctgcctttgcaggctgagaaacaatgaggggagagaatgagggacagagagaggaggggactgaggggccaaggaggttccgatgagcaaaaatggaagagaaagaacgtcagagaggaggctattgggggatgaggagagagaccagagatcaagaagcatgaaggtattgagggccagagaggggacttctagggacatggagaggctgcaggacagagaaagggctaggggaacgggacagtggttctttcatttcaatgatcaaagttcccagctttttgacaccacaggggcaccctgacaattctggcaataagaacatgaaaggcctggtctttatttcactcaattcctgctatgtgtggtgagtgtgggtgagccaaggggaaggtgatcctattgtcaggaggtaatttaccatgaataggggatgatatggaaataatgtgtgtgatccttcccctgccactgttgggatgtctttttaatttccttccctcatttgtcacagccgtgaaaatactttttctgatatgatgaatgacagatggcagggtgccggcagcccttctggagggatgggaggttgtgtgtgtccacgataggggcccaataagtactggctgaatgagaaaatgaggagcctcactgtgggctttctttggggtgaatggaggtgctgagtgacctctcagcttcctagaagtcacaggccagaagccgtggaatctcagtggtggaaagtcctactgatttgaggatcagggagggagagaatcagcaatggtgtgctgataaatgtttagtagttggctctctggtaaaaaagaaaaagaaaaagaaaaagaaaacaaaaacaaaacaaaacaaaaaaaacaaacaatgaacaaccctggtatgcagtgcttgccactggtcagtttccatggtcagtttctcaccatgggcaatttcatgtgccatcactgaacacagagtagggaagagatccacgccattggctcacaagctggccctaccacaccaccaggaggaatatatattgggcaacgactaatagcaatagaaaaactcatgcttctttctcctggcatgacttcatgtatatgacatacatcctctcattttatgcttgtagcaactctgaaacctaagatttatttcctcattgcaggtggggaagccaaagctcagaggggttaaataatgtttctgttattgtacagcaaatcagtggcagagtggattctaagattcgtgccttctctactcacttcactgggctgtcagaggttaagggaagagttacataagccacctctgattattagagaatgacagggctggctaattctgcctggatagtattgaagaggagcttcattcaggggcaccgctttgctaaagagaccacccaaagaatgagtagttttgagtcaccaggtaccctgaagtggtacctgaaggtacagctggtatgatggatgacagatgccggtaccttgctgtcatccatcatatcagttgtcagttaccaggtagacctagcggtaaagggtaagttatatctcttgcctaaatgtcagtttcctcatctgtaaaatgggaccctgaaagtctactttagagggctatagggttgttaagatttaatgagttaagtccataaagaacctaacgtagtgtcagacacataatagatccagagaaatgctgattcttagcaggctaactttttctttttgaattcctctttaggccagaactgactagtataggcttttcaaactttagcgtgcagaagaatcacctgtggatctaattaagatgcaggttgtgatccagtaggtctggggaggggccgggcctggaatcctacatttctaacaagctgccagatggtgctgattctgctagtccatagatcacacgttttctttcattctttctttgtctttgtcttttttttttttgagacagggtcttgtgccgtcatccaggctgaagtgcagtggtgtgatctcagctcactgcaacctccaccttctaggcttaagcgattctcttgccttagcctcccaagtagctgggattacaggcatatgcaaccactgctggctaatttttgtatttttagtagagacggggttttaccatgttggccaggctggtctcgaacttctgatctcaaacgatccacctgccttggcctcccaaagcgctggcattacaggcgtgagccaccatgcccagcccatggatcacactttgagtagcaaggggctaagggatcctgacatagcattttggggtcctgcagcttcaacttactctgctgcctgttcccatgacctctaagactgctcttctcgagacagcatccttgttctgcactggttcctttggagcagctgctcagccctgctaaaggcatcttgctcagtgcaatattagtttgctgcggaagatctgggacctgggctcctctcctcattctccttgatcttagttttggttctgccaggactttgctgggcaatctttgtcatgtcctttcccctttttagattcaatttcttgatttgcaaaacaagacagtaggagagagtcactttctagtttaggcattctgaagttctgtgaatctgtgataccagctggttggtgcattttcctgccaggccataagcagtacttgcctttatttctgggctccagtgggggtcttcagagatacatagatgcatatagtcaggacaagagttaggaggagtaaaggtaagggttcaatccaaaccttttggaatagtaacagggtggcccagagagatgaagaatgattggggcacaggaatcttcttgctttggggcctaaacgacatctccagggaatggctactcattgggcacatatgagccaggcactgtgccaagagctaatgggagacacttgtcattctttctggccacacactctggagccgctttttttttttttttttttaatatttgtgaattcgccacctcataaacccatgtctctttaatgcacaactcagaaacccactcgcccaacctcccttgcagctagagcacagacatgtgacctaggatctgtcaatcaggtgagtccttgctggactctgaattggtggctagaagcagcagacactgtgtttgatctgttctggagggggaggtgttaagtatgtccagactgcagagtcagctatggtggggcttctagcaagatctgtcccttgtgaatgttgaatattcacagcatctgtagtgcagattgcctggtctggactctggagtggtggcagcgggttctgtactgtggtcaagatgtttcttctggctttctaaatgtgtcctaattggattctcagggcctcccaaagcttgtctttcctggttaaactggttagagtgggcttccatgtttataaataagaatcttgactgcttacaacactttatgtgtgttatctcattgaattctttttttaatttttgagatggagtcttgctctgttgcccaggctggagtgcagtggtgcgatcttggctcactgcaacctccacctccagggttcaagcgagtctcatgccgcagcctcccaggtagctgggattacaggcacacagcaccatgcctggctaatttttgtatttttagtagagactaataaggttcaccatgttggccaggctggtctcaaactcctgacctcaagtgatccacctgccttggcctcccaaagtgctgggattacaggtgtgagccaccgtgcctggccctccttgaattctcacagtaacctagtgaggtaggtgttattatcctcttcttgtaactgaagaaactgagtcaagaagagatgaactaacttgctcaaggttccactgtcgataagtggaggcccaggatttgagtccagatcctctggttccaaagcacacattcttaaccaccatgcatctcctgtcagagatttgtgggtgtggaaaggtccttgcaaatcacttgtcagtagtacagggtttcatgagatctacacctgggctgggcacgcctgttggttttttactgacaacgcataatttttcgaggagtggtaatcagaggcaaccgttctagtgacagtgattcaggcgtaaacacttggctttggcccagaggttgcactgtgtgagaccacaggtgaacactagaatgtttacactcttccggagtctgtaggtggatgccagggacagagaatgagattgtaacccagagaaagaaagaaaagaaagaacgaacaaacaaaagaaagaaagaacgaacgaatggacaaaagaaagaacgaatgaaagaaagggccagcccctggggcctccttagataaggaagagaaaggagaccttgcctcaagctcagaaactggttaaaacacgagcccagtcacctagtgataagcagtgcttggttctattaactctgacaacatagtactatcttgggcagagctctttggagaagcaggttggctaactggccaacctcagttgattctcatggtcttggaactttcctgggggtccaacttcctccgttctgcccctcttttttctctaccttctatcgttttattctttgtctcctttatttttcttcaacaaatatttttgagcacctattgttaacaattcaaccaatatttattgggtgtttgctcggtgccacttacagttctaagtgctggagatacagcagtgaactagccagacaagctgtcatagagtttccaatttagtggcagtggggtagtccagtaggcatgaagccaggcaggtaccagttgttgaggtggtggtagttccacccagtactaggaagataacattcttatccccattttacagatgaagacactgaggcaagagagcttaaattaattgcctgaggtctcacaggtaggctgggatctctgtgagatctaggagtgccagagccacttgggtccagccacccacacctcttccctgtgcctcaggctgggatgacacccagagcctctcctttctccctcacctgggcccagagaccacctccttccctctccttgcattgctgctgcccatgctaaccgaaggagcctcgccgtggggcggatgtggcctccccagtggcccacttcctcctgcttctgccaacagcagcattggcccctatgatttgaattttttttttttttttttttttttttctgttgatccctctagcggcaccagatgtgggtggggtggagggtgggtacacccacactcccttaagcctggaagtaacctaggttccagactctgtgtgtccctgaatggtaatagtgactctcttcttagctgtctgtcccactgggtcctcccactccccaactggtgctcctgcttttcctcagaatgggggacataaatctccttctagtcccaacccattgtcaggcagggcttcctcctggagggctgacttcccaggactgggccagctaaaagctaagcagtatgggtaagagcacggggttctggagtcagacagacctaagttcaaaccccagtactgccgtggacaagctgtgtggcctcagacaagttgattaacctctctgagttccttttaaaataggctgaggtctgtagggataaggtacctgaggtcttagtgcctggcacagagtaaacccacgtgttggctgtttccattattgggtagaacagaggggcctcctggcatcagtgggcattttgggcctgctgctgtcttgtctatctaggccttggttttgcctttcaggctggtgcctctttgcagtttcactttagcaagtgaaactttatttttcctgtttctcctgatctgtttcctccttattttccatagtgaataatcacacataagcctttcttttctcagggcaaggttgctgtctgtgaaggagtggaatgcctgagcatccctggtaggaaaggaagagtgaccagcatcaatggggtactctattccctgagtagcaagccctcttcccgccttgtccctggctcccacacctgttatcctgccggcagtcatctccagtatcccagaggagccatagggatgggtgtttgaatataagaacactctgcagctcagatatgcggcattacttttcctgtttgactcagttctgcagagggttgctgagtgactgtcatgtgcaaagcacgtgggaggaaagatgaataatgagagcaatcgaatgcccattcccttgcatccagggtgctctactagacctgcgttcttccatcattctttcagcccacgtggttgccaatactgggagttatcagtcttttccatttttgccaatctaatggataaaatatcttgtattaatttgcatttcccagatattcatgagattaggcatacgctttttgggcacttgtatttttttctctgggaattccctcttcgtattactttgtcaatttttctagtggcttttttatttgagacagggtcttcctctgtcacccaggctggggtacagtgtccagatcacagctcactgtaacctcaactccagtgatcttcccaccttagcctccctagtaaatgggactacaggcacacaccactatgccaggctttttttttttttttttttgtagagacagggttttgccatgttgcccaggctggtcttaaactcctgggatcaactcatcctcccaacttagcctcccaaggtgctgagattacaggcatgagccactgcacctggtcccctgtctttttttttttaattaattgatagtaactctttatatattctagatgccaatccgtgatttagtctaaaaataaatccccttggtctgtcctatgtcttttcttttggtttatgaaatcttttgtaatacaggaacgtcacacttccacagtcaaatgtgtcagtcttctaaatagatataggtaccttgtatatactccttgatatatcacattgattggtggtgacctgtttgtctccctggctgtcagactgtgagaaacttgagggcaggggctgtactttattcttctctgtctctctagggactagtgcaaagctgggcacagagttttgtgcctgaatgagttttttttgtgtgtaaacgtggtataaaacaggtcttgtgactgaatgagggaatgaatgaaaaagccctgtcctgccctccctgcagagatggggtctgctgcagagatgggagtgagtcagggagtgaatcacaagctcttccgtggctcagctgacatttcaaaagccctgagcagagaagcccccctcattccaagagagcctccgcctctttgagcaggcacagtgaagctctgctgattatcaaactctgtgtgtgtatgtgcacgcacgtcaggggtttagcagttaaaactcttagtgctgcatattctgcgtatgtgtgaacaaggctttaaaaaatctctcagaggacctgtgtatgtgtgtgggtgctgggggctgcatagagagagagttaaaagagatgagggggtgtttagaatcgttgcaatgtattgcatttgtttctgggagggtggggcgactggagggggttaaatagctcccagaggcgctcttgtgagcggagcttcctgaaatctctttatctgtggccacatgctgttcttggttgtccacgtggttccctggtgtccctgttgctgaaggcacttctgttttgttcttggaggcttggcttctcattgccattttctaaagcagtagagagtgccagttagattgttagacccaaataatctgaaatgtgtgaaaaaatagtaaatatttactgtaccttttgtggaacaggttattgccatggaaatgcactgtacacgaatctggatgatggagggaagctggctcaggagctatgggagtgtttggataccatgccgcctgaattggcaggtttaggagtgagtgccgtgggtttagaatcacagtgtggttgggtgaggctgaaacacttggtccccagtcaacctgtactgagaggggcatttattcattgcttcccacatgcagggtgcttcctagagcattctccatgcattattgcgtttaatcatcatgccaccccaatgaggtgccattatcctccctgttttacggagacacagagtgtttgatctacttgcttgaaggtacgcagtcaatgaatggcagagccccctgactctgttctctggagcttgatccttccctgctcagctgtttctctcactgtgatttaccctagagaaagctaaccagctgtctaccggggttttattttccaatattgacttcggggctgacatttagaaaccatcaacaatttccagcttctcttgaaaatgtgcacaatctggctactgtgtggggcttccctagtggctgctcccgagcagccatccaggttagccgggcatcagctctgcagttggcgctgggcatcctcctgttgcagctggggagaaagcatggggtatcacacccaggggctccttgaattaattgagaactgtctgttgagagctcctcatcctgttagacttgacatttaatttagctgttgttttcatttgccaattagagcttttgagattcttttgattttcttcctgtggtctcaaggaatttgtgggtggttgagtgaagatcttcatggcaggaaaggaaggctgcaacaggagatgtaatgcgtgagcacattcattcattcattcattcatttacttgtttattcatttgttcaacatattcattgagtattggatgttgaagttacaacagtggaagtatggcaataaataagacagacccagtcactgctctcaaggagcatatagtcaaagagggcagtcagacatcaactatgatgcacgttacagggaaggcatccatcttttttttttttctgtgtcacccaggctggaatgcagtgatgtgatctcagctcactgcaacctctgcctcccgggttcaagcgattctcctgcctcagccttccaagtagctgagattacaggcacccaccaccatgcccggctaatttttttttaaattttattattattatattttaagttttagggtacatgtgcacaatgtgcaggtttgttacatatgtatacatgtgccatgtagtagagacggggtttcatcatgttgaccaggctggtcttgaactcctgacctcaggtgatctgcccaccttggcctctcaaagtgctgggattacaggcatgagacaccacgcctgaccagggaaggcatcgatcttagactgacttagtggtgtctaggtctctgaaggaggtgtcagagaaggtctccttggctaatctttgtgaccaccggagctctgttagtttcataagacataagtctcagcaactgttgcagaaagacccttcctcagtaaggatgatgggctcctcgggctcttgcccttcccgtcctgggaggaaccttctatcaagagccatggctagtcatttcatccattgggaatgagcttactggctccatttatgagagttagtttagactgaggagtaaaggaggagtgaaggagtttgggagttgtcagtgataagcatgcacatttggagttgacaggacagcatggacactagagcctgaacaccttagttcagcttagctgcactgcctattatgtgatactgggctggtttcttaactgttctatgcctcagtttccccatctgaagttgggaataaaatactcatctcatagggttattgtgaagagtaaatgagtcaagctgggtgtagcggctcatgcctgtaatcccagcactttggaaggccgaagtgggtggatggcttgaggtcaggagtttgagaacagtctggacaacacgatgaaaccctgtctctactaaaactacagaacattagctgggattacacatatgcaggtgtgtaatcccatgaaacacatttcaaataattgctaaaatttttcaagctgtggcataagagacaacagtcctgaagaggactgaaaggtcttgggatgcaggggagcttaatgtattaaaaggtgacattttggatcagtagggaaaaaattacacacaggtgtgtgtgtaatcccagctacttgggaggttgaggcacgacaatcacttgaatctgggaggtggaggttgtagtgagccaagatggcaccactgcactccagcctgggcgagcgagactgtctcaaacacacacacatgcacacacacacacacacacacagccaggcaaaggatgaagagaagcagttaataaatgtgagccattcacgtgtgtattatgattatcacgtgatatcagccagtcctgcttgagactcacttttccgacagttctttcttcggtggactgtacccatgcccctgtgtgccatatatttgtgatttccagccttcctttctgataacttcaattcattgctcttcccaggcaagtccttcaatggttatggggtgccgcgcttgccctcatccccagctgagtgttctgcgtttggggacttgtgtttataagtgtgggaggctgtcccctgggggttactgcccagacagttagggttgtccataataacagaaaagtgcatggagagagaaggtgcaggtccgcctatttgatgttgggtaggatgtgctgcttgatgaccggtgaaacatttacttctcccaccatgggcgagaccttggatgtgtcctttacctctctctttgtcacttctgtcctgaactgcccatgagtgaccaggggcttccgacagaagtgtctcacaatccaaccacacagcagaaaggcattttcctttggatttgagctttgtccctgcactgactttttgtgtcatctcctcttcattcaatgtgagatactcaccttgattcatagaatgttttctcattccaggtttgtatttttttaatcaccaaaagaagcacttatcataaaagactgtgatgatgtataactgtgtatttagtttgaaaatcttcaccttatagaagcaataaacaatatttaggtgtattatcctgtgaaatttttataaatataagactttattacgaataaacaaaaaaagagatcatatcctatatactttttttataattttttttgagagagggccttgctgtgtcatctaggctgaagtgcagtggtgtgatctcagctcactgcaacctccacctccagggctcaatcctcccacctcagactctcaagtagctgggactacaggcacgcgccaccacgtccagctaatttttgtaatattttttttttgtagagatggggttttgccctgttgcccaggctagtaactttttcccttattaataccttatttagatccaccttatgttttaaatggctgcagagtgtttcataatatggccaccatattatttacattcatatttataatttgtctaaaacattagcaataggcatttggattatttccaagttttctctataatgaacagtgcaacagtgaacactcttgggcactgtagtggggatttccatagaacaattcttagaaatggggtgtttagggcaaaggatattaacatttttagttgtaatagatattgctaaattgctctcaaatgttgtgccaatttatgcacccaccaacagcgcacgaaagtgcctcttagaaaatgtcttttagaagataaaatacctattgttaagccatgaaacacatttcaaataattgctaaaatttttctagctgtggcataagagacaagagtcctgaggaggactgaaaggtcttgggatgcaggggagcttaatgtattaaaaggtgacattttggatcagtaggaaaaaaaatggcttatttaatacatggtgctggcataattgggaggccatgtggaaggatgctgagtttgattcctaactcatacaaaaataaattacaggtggagtaagctataggcagtaaaaaaaaaaaaaaaaaaaaaaaaaaagaatattagaggaagttttaggagcatacttctgtaaccttgagtgagggaaatccagaagccataaagaaaaagattagacagtttcaattatgtaaaaataatttaatcttttaaaaggagaatgtattcatgaattgcttatgtaataagaaagactattaaaaataggtccagtagataatgtacaatggtttccaatgtgaataaagttgaagttaataaagaaaagaaagttttaggacatgtcagggagtttttgttcaaggattgagattctgcaatgtttattctaaataaagatgaatgatagactagtgcacatgtagtaaactagtaaatgtgtagcccataaaccttgtaagccctggaagggtaaagaaaaagggaaggaaatgttgttttctgcctctttattttttgttgttttgagaaagttgagtacccacccaaagccccaggtgtcccaggagagagaagattgaaaacatgccatcaaaacaggagcttcagcctcagccacaagctccagtgtttactgggggccagtgcccttattcccacgtgaagcatctgccttttttgcccccttgaagtctgagtctctcgtctgttcctggagatttttagccaagcccctcctccccacccctcaccttagtatttgtaccaccctctgaatcaaccccaaagacacccctttgtactcttcccttcatctggccatcaccagggtactgtggtcattgaagctgagtgtgtgccctcactttccgtaaactcacagttcctttattctgcaccttcagggattgcaaatcgttaagggtatgccttcaaataccagccctctgacttcctagctcaataacctcacacagctctatatctcagtttcctcatctgaaaaacagtcatgaaatggcaccacctcctagcattaatgtgaagattgttattattatgtgttattaattattattatgttatcctattaatatatgagacagaatctcactctgttgcccaggctggagtgcagtggcacaatcttggctcactgcaacctctgcttcccaagttcaagggattctcctgcctcagcctcctgagtagctgggattacaggtgtgtgccaccacgcctggctaatttttgtatttttagtagagacagggtttcgccatgttggccagggtggtcttgaactcctgatctcaggtgatctgcccaccttggcctcccaaagtactgggattacaagtgtgagccactgcgcctggcctatcttattattattattattattactttttgagatgggatctcactctgtcacccaggtgggagtgcagcagtgcaatctcagctcactgcaatgtctgcctcctgggttcaagcgattcttctgcctcagcctcctgagtagctgggaccacaggcacccaccaccatgcccggctaatttttgcatttttagtagagatggggtgtcaccatattggccaggctgatctcgaactcctgacctcgtgatccacccacctcggcctcccaatgtgctgggattacaggtgtgagccactgcgcccagcctctttttattattatacttagcacggcacttggcacttaggaaatgttcagtatatgttagctattattggctactgttatttcttcttcttctcctcctcctcttcttctttctcctcttattcctcctcctcccccactcccttccaccccctcttcttattcctcctccttctcctcattattattttaagtacctccttaccaatgcctacagaaatagactgacctagtaccaggatctagaggagttcaatcaagttcgtctgttgccttcaaggtaacagcgtagtggtggttccgagccagatgccagacccagtctgcctttgttcaaatcctggttttacacttaatactgtaggtacctcgggcaagttacctaacatttcttcacctcaatttctccatttgtaaaatgtatataatgatagtacctaccacgcatggttgttaggaagattaaatcaattaatatttgtaaagtagagcagccggctcattgtaagtattgggagtattggttaaaataattacaaaataaacaatctcacttagatacatcccttaccccctgtggattatgtcaagggtgaaagaaacagtgtgcttgaaatcctgctgtgcgccgagctgtatatcagaggtgttatggtgattcgtcatcattctcctgaccactttccatttttcttttagagtcaacactggccaatctttagggaggagctctgatcattgagaaactgacactgtggaagggggcatttctgactctctcttcctagctccatttgatcttcctaaatctttcaataatgtgtcattggggtaggaccaaagaaaaacggggtgaatgtacggttgctgctttgtttcccatagtgggagtgactctgatgtttcacaaaggcaggggtggagaggcagcgcctcgcaggaaagccttcttgctaaatcgaggacttctgcacagaaatagatacaaacttgcttactgtttaaatagaatattagcgattatcttttatccagctggagtctcctcggtttggtactgcctcaaatgagcagcctgcaatcttgggtgtcacttcctcactggttctgctttccataactgtgttgaaatcactcccccagaaggtcaccaaaagggaaaatattagtgtgtgtttattggcacgatcttgcaggtgctgggctaagtgtagacatgatttattttcatttaatcttcaaggtagttctaggcgatgtccccccactttgcagatggggacactgatgtgcaggaaatgaagtgacatgctgtagcactgttggtgctctgctgtgtcccctcacccttccatttcattgcattctggcctggcttccaatgggcagcaactgcagctgttcacctgagggcttgctctgccgtagtccattcggtccataggcatgtcaggctgtggaagcacaggaggagaggtgagggatggtgcaggagagaggagaggatgattaatgtcccccagggcccatcctcaaccaatgacttatgggaaacaacctcctagagttgtattaagctccagtgacccagaatggtaacaagctcacaaacacttccttttttaaaaaatttcacaaaaatactttattatacccatacctccttgttttagcccatcccagtacggtggtatcttcagaacacttccactttcccctctcctcacctcttccctcccacccttgagatgtaatctttggaccacttttacttctttgctttctctcagcaccctttctcccctactctatggtgactttgtgtttttgaattgaagtcgtttcatgtctgtgtcttttttttttcttcaactgttattttaagttctagggtacatgtgcaggatgtgcagatttgttacataggtaaacacgtgccatggtggtttgctgcacagatcgacccatcacctaggtattaagcccagcatccattagctattcttcctgatgctctccctcttccctccccactctgacatggcccagtgtgtgtcattccccaccaccaaatgtccatgtgttctcattattcagcgcccacttataagtgagaacatgcagtaaaacactgcctttataggcttccttcccttcactgtcttacttccccactccctactgctgctctctgggatcacctctcacagaagctgtttgtactttaatcattgtctgagagtctggggtatcccaaactaagataattgcccaaggtcttagctaaattcaacagccctatttgtctttatcctccttgtggcaatgccactactaatggatgtcccttcttaaaattcttccccattttggcttttgtgacacgtaatagaattcttctacttctgattatttctttcctttttcattaattggcagctctttctttttaaaaaaatttgctagatttttgcttatttttttttttaagaaatgaggtctcattatgttgcgcagactggccttggaatcctaggctcaagcgatcctcccatctcgtcctccgaagtgctgggattacaggcgtgagccactgtgcccatctttcttttcctttctttagccacccagttttaggtacctccagtatcccagtattttagttgtaagtgacagaaaatctgactcaaattggtttatgtataacaaaatgtaagttattggatcacatacttgggaatcttaggataggtggcttcagggaagatatgatcaaggtgttcagcaatctgattctctctccatcatgattcagctttcctctgtattgcttgattctcaggcatgtgcttgactaatgaggcaacaacaacttgcaggtccaatcttatcttcatcaatggtatcttaactacatcagtggtataggactgcttctttccttagagtcccactgtaagttttgggtttcattctcattggcctgtgttgagtgatgtatacatttctaaaccaatcacagttgccacggagatgtaatacaggttgagcatctcttatccaaaatgcttgggaccagaagcatttctgagtgtggattttttttttcttcagattttgaactatttgcattttacttgccagttgagcatcccaaatccaaaaagttaaaatccaaaatgctccaatgagcctttccttggagcatcatgtcagtgctcaaaaggttttgggttttggagcatttcacattttgggttcctggatttggggtgccctcatttcccaggctgggtcacataatcacccttggagctaaggttagagttgagccctactccataaggactgagagtggggagaggtgatttcgcaaaggaaagtcaaagtgctgtcacatgaggggatgggtactggagaggcaaaaacaacagatgttcatactccgcatctctgggttcatttatctgctcttctctttctctgtgaatcatctgatgatttccactcctgcctgcctgagtaggactctgaaactcctgcctccagatctgactccacttctgagttgtagcctcctttcccccaccctctagagttaggcatttccatttggtggtgccatgcagacctgaaactcagtgtgccacaaccctcgccacctcccacctggtttcgctccctaacgtccctgtctttgtcagtggtgccagttgggtttccatctctccctcatccgtcccaacccccacctaatttccagccccattgtgctgcttttgattccttgaatgcacctttgcaatgcttttccttggtttgtaaccctctttagcatattcttggtttggtgaacccctggccatatttagatatcagctcagaattcacttatttgggaacctctaacctggtcacccatctctgccaagcctgagttagatgctctttccctgagttctactaggccttcatctcgtctaccacagcacttctcactcagactccaatgactggctccattgcctgccttccccgtaagggcaggggcacatctgtgtaattcaccattgtatcttcagcagtccagcctgacaattgagtctaggctggtgtccaacaaaccagtctttgttttttttttcttttattttaattttgatagttttgggggagcaagtggtttttttggttacatggataagttctttcatggtgatttctgagattttggtgcacccatcactgtaacagtatatgtggtatccaatatgtagtcttttattcttcaccccctcccaccattccccggagtcctcaaagtccattatatcactcttatgcttttgcatcctcatagcttagcttcatttacaagtgagaatatatggtatttggttttccagtcctgagttacttcccttagaacaatggcctccaacttcatccaaggtgctgcaaaggccattatttcgttccgttttatggctgagtagtattccatcatgtatgtgtaccacattttctttatccactagagataaaccaggttttgaattcaggatccacctctcctgagctgtgagcacatgggcaagtttcctcaccagtccaagcctgttttctcatctctaaaatggagacaatgacggttcctccctcactgagcacttgtgagaagtaagtggtgatcacggttacaaagtgttcagcacagtgcctggaacacggtaagcgttcaatcagtgccaatgatcatttattatactcactatgaacattatttttacctcatgcagtgtctagaacataatcaactctcaacaaatgacagctcttattattagccaagaatggaacctgaaacatagtacgctccatggatcattgaagctttgtttttgaaagtttgaaattaacaaaaagagcctttgatgtttcccttgctgcacattcttcccctccaggtggagtgggcagtttccactgggtgctggaaccaaccctcctgtagttggaggtgatcttctctgatgtcactagggtgccgaggtgatgtgtcaccagcacttgtttgcttgtgtgatgtaatgagggtggacttgcttctcctagggaagagcctcattaaggttagcaaggggcttgttcctgggaagttctaaggaccgcctggggctgccacataaggaactccccttttctcattttgtctccggtaagttgttattgatctgtacatgatgtttctctttcttaccagccgtgggaatgggccatcctctggcatcactgttgccttgaacgttaccatcaccaccgttgccatgaagtcatgacagcagcaccattggctctggtttattgggtgtctaccatggacagtagtagggctagacatttagtatactccagggctactgcggggattaaatgaggtatgaagcatctataaccccacggtccaatagggtagccactagccatgtgtgcctactgagatatacattttaattaaagttaaataaagaaaaaattcaatttatcatgcacagtagccacatttcaagtgctcagtatgtgctcatggctgatgtagctggcagtgaagatggggaacattgtcatcatcacagaaaattcttccacagcgctgatctagatagaacaggattcagtccgctgtggcttgtggatccatggactgaattcatacacacagaattttgtgggaacacagctgtgcctgtttgtttatgccttatctatggctgcctttgcgctacaaggatggaattgagtagttgtgacagagaccatgtggcctgcaaaacctaaaatactcagtctcttatccttgaagaaaaagtttgtcagcctctggtctagaacattgcctggctcttggtaaggttaaatacatgtttggaactttttatttattgaaaataatatacattttgttctccacctaaccttttaaggtaagtattgttatccctgtcctagagatgagaaaactgggactggaattctgtactgtcacttccagggggcaaacacctcatgaggttttttttttttttttggcagtcttgctctgtctcccaggctggactgcagtgtcgcgatctcagctcactgcagcctctgcctcctggggttcaagtgattctcctgcttcagcctccccagtagctgggattataggtacctgccccctctccccgctaattcttgtatttttagtagagatagggtttcatcatgttggccaggctggtcttgaattcctgacctcaagtgatccacccgccttggcctcccaaagtgctgggattacaggtgtgagctaccatgcctggtctcatgagtcttgttcatcacttacctccttttgttcttccagcttcagtttcaggttcagggggtacatgtacaggtttgttacatgggtaaattgcatgtccctggagtttggtgtactaatgatttcatcacccaggtagtgagcatagtacctgatagtagtttttgatcctcaccttccaccctcaaggaggtctcagtgtctgttgttcccttctttgtgtcatgagtgcctgatgtttagctcccacttataagtgagaatatgcagcatttggttttctgttcctgtattaactcacttaggatagtggcctccagctgcgtccatgttgcagcaaagagcatggtttcattcttttttatgcctgcatagtattccatggtgtttatataccacattttctttatcccatgcaccgtggatgggcacctccgttgatttcttgtctttgctattgcatcacttactcttgaatctggagcagtgcctagcacataatagacattcaggacatgtttgttgagcaatgaatggatgagttaggaatcaattacatataaatcaataatcaataatcatcaatgatgaatttctatgaacaaatatgaaaattagatcggccgcattgtagagatgaggagacagccctgtagaaggaaagtgcctcatcaaaatgcaacatcgctgtgaaagtgtagacttggagctccagctgaagtcatctgtgtattttctaagctgtcccctctaccatcctgccttctccgggagctgccaaagtgcagcgctgatgcctcctctctctgtcccacagcctgacttttgttcagctcctgcttctcttcttcaccaactgccagcttcagctgctttgtggcaccctggggcttgaagcttcatttctggtgctgtggcaccacaaagctctgccccagtgtcacttgagtccaagtagatcagccaagtttgaatgatctctctcttggccacttcagtctatgaagctggagttgagaccatctgtgattttacacattcgttacagcaaaaccaagagggccatggggtaagagggccattaagctagaggctgagcaaaactctgctcttgaagcaccttctgagatggcttctcatggaacgtctgcgcaaagtggcttcacatccaattaagtcaaagatgcattaaatgaatccagtttgtaactgcttccaaccatgaagtcacagttccatctcttgccctgggaggggcttctttcaggctctgaggactggagccctggagactttattgccttacggtttcctcctctaccatcagatgtttctttttcatgtgttctggcctggatttgaatagactgcctggatttgaatgctgccttcacctctttctggtgtgtaatcttggacaagttaccttctttctcagtgcctcagtttcctcttcagtacaataaggataataataagacctaccacatagctgtagagaggattaaaggagccaatatgtggaaagtatttacaacagtgtactgcatagtagcttttctataagtgattattattattatcccttcgaatctaaaatccctctagtttgtttcagaggagcaaggattgtgtctcgcctgcctttaaatccctttaagttgggtgtctcaagcccaaccatctgcaggagactagaaggggacttacatgagtgaattgaatcaggtgtggatttctgtgaactagagaatgcaaggctgtctgaaaggggaactattccttattcatgcatcacatatacactggtgtgccaagccctgttctgcatctggggacacagcagagaatgaaccgggcaaaattccctgcccccttggagttgatgttgtagtggactaagctctgatgactctgttgctgcatgagaatgtgggcccactgctgacaaaacttctgatttttctgtaagaaaagccggaaacctggatttgtaaaaaccgtgaactctcctagcttaagaattggcagtggtttccatttttttttttttttaaagcacagtacatgctgtgaacccaagagccagtttgcagcccctgccttaagacactcctctaattgctctgggaggaggcctgtctctgccctgcaaatcagcagctggtcggatttcaaggtcgttggtgtggagggcgcctcctccctctcctgcgtggaggttattgtggctttttctgcccacagagcagatgacgctgccaccaggcagtgagttagaatattccttctcttatccttccttttggatggtggccttggctgggttcccagccccctgacagcagaagacaaaaggatggaagcagcttcctcatagtcacccatgggggcgatagggtggtgatggtgatgtggagaaaatgcattgggtcaggacagccacctttgaagccagaaaattaatgatctctgttgcctgaatcttttcaaagtggagaagtaatttaaaagcttgtgtgggaaggattgagaatgggattgagaaaagaagtttaggttgctatcaggaacaattcctaacagcaggaggtttttggagaggcagtggtgaaattccttggaaatttttgtgtggtgtctttttttcttttttctttctttctttcctcttttttgtttttgtttttctttttttgagatagagtctcattctgtcacataggctggagtgcaatggcacaaccccggcccactgcaacctccacctcccaggttcaagagattctcctgcctcagcctcccgagtagctgggactacaggcacccgccaccatgcccagctaatttttgtatgtttagtagagacagggttttgccttgttggccaggttggccttgaactcctgacctcaagtgaggtccacctgccgtggccttccaaagtgtttggattataggcgtgagccactgcgccgggccttttatggtgtctttgaagtgcttgtttaaatttacatgtggttgcctctcagtggggtgcatgctctctggttttccccaagccccaccactccctgttgtgctttacccacttgcctgacttagttatgcttactggcctggcctttgtgggtctttgagtttgtgccttctgctctgaaggaagcatgcttgagatgatggaatctaggttcaaacctacctgccctatctgccctttactgacttgtgtgactgtggacaagttcctccacccctgaggttgtcaggaccctgcaggaaatagaaccattcaggtggctgcaagaagaaagtttcatgaaaggactatttagggagacttgggcaaggttaagattacaaataaggaatgtggaagcacctagggccttgcaacagcaggaggcggttaccgtctgtaaagaggaagaagcaagcggagggaatagtttggagcctattgagagctggggctaagaaggaaggcatcgccagcaggaaccatggtcctggagggatgaaccgcttcccaaatagcagtaccgaggcagggaggaagagggggaagaaacaccccagcttctcttcacctctcccattgcctgttggcctcacccactggctgaacccagctggaaaccagaaggaccagatgatgaattctgtaagggtcagccttttggggctcagctcacagcagaatcagagagaaaaaaatggatctgagaggtgaaacaaggaacaagcagcacgtaactctcagcttccctaccttgaaagtggaggagaatgagataactgaccttggaaggttattgggtggctcatgtactctcgaagggaagggcctggtcaatattaagtactcataaatgctgagattcagtgtgggtttcaaaccgtttctaggagctaaaggtcctgagaaagggcttcagtttcagtatcaagagacattctcaggtgggcagatctcttgaagccaggagttcgagaccagcctgcccatcatggtgagaccccatctctactaaaaatacaaaaattagctggatgtggtggtgggtgcctgtaatccaagctactcaggaggctgaggcaagtgaattgcttgaacctgggaggcggaggttgcagtgagctgagatcgcgccactgcactccagcctgggcgacagggtgagaccctgtctcaaaaaccaaaaccaaaaagacattctcctccttcccctgcagtggggcccactgggaatggttgcatcttccatggggagtttaaagtgaatgtgtagtggctaagagcaaagaccctagaaccaagtaggtggacactgtggtagtccatcagtgtggtagacactgatctttctgttactatagattaatggccttgtacagtatgcactattttgtgtctgccttctttcacttaaaataatgtttttgagactcacgcatgcatgtgcctgtattggagtctattgagagctggtttccagtcctgattgccactgacagtcaagttacttaacttttcatgccttattttctcatctgtaaaatgaggatgttagtagtttctacctcattgggttctgaggattaaaatgagttaatctacgtaaagagcttaacacagtgtctaacacatagtagacaatcaatagatgttagctattgtaattgccatcatcgtcatcatcatcatcattatcatcatcatcgtcaccatctccatggatcagctcaaatcaaaactgacccattgtcaatagaaaaattctctgtgggatgaagtccatgccaccaggcctctcgggaacttcattgatcataccattatcttctcatcctcccacagatatgatatttcagggagtgattgataggtgtgtgtgtgtgtacgtggggaagggtgggcttgtgcctgactccagggacagagtgctttgttatgcagaatagcttgcctgtcatcccactacaggccccttccttgaaaagttccaggctatttttgagccctcatggctcacatgttcctttctacatcatgtcaatgccagtacagaaaaattgaaaccttttggcagcatctaaagcaaaagagatttcaaagtgcatggaggatgagtgttgctcaaatgacagggtattaaaacgtgacaagaaggctgagttaagagactgcaggcagcttgtgtgtttgtatttggaccttgctggatttcttgggaaatcagtggagttgtccaaggttaatgtcatctccaagaaggcaccaaagggtagtaacactccttcaccctcatttgtacatacactctgcaagagcggaagatgatgcagccagtggagtgggcggttgtcccagagcaccacctgggctctgagctacaggattctgcaggggaaagcacctgaggacagagtgaggtgggttggtgccacctgggagctccaggcttttgtgtgctgatgtgcaggcagatactggagccagaccgaattgtgtgcgaaatgtgggtctaagagtgaaggcaccaaaccctcactttttttactttcattcagccttcccatttttcttcaaagggcagaatatgactttggagtcaggtagacctgaattcaaatccctcttcttcttcagtgagtagctaaatctttccaatgctttatttaaaaggaatcacgatcacactttcagggttgttgagaggtttagagattgtggtgttacagggcccctggggctcaaaaggtgtttgctgaacccctgtcttgtgttaaatagtcacaatagtcccaaggggaggatgaacaggtagcactgccatttcataaacaggtgactgaggtgcagagtggcttatccataatgacacaggaggtgaatgctggagctggattgaaggctgagtcattggactctcctctgagggaggcagtacagagtagtggtcagggcttgaccaacctctagagtccatgggcagattttctgggcctctggcttagttttcctcatgcataaatggaatgtggggattatagtagatgtactttctatggttgtgaaggttacatatacatgagataattctataaattcttagcatgtgcttgagttacagtaaatatgcaatgaagtattcactactgttttagtattatttttattagaagccgtggcagtagttaccatcattgtcaccatctccatcgatcagctctaatcaaaactgacccattgtcaacagaaaaattccctgtggatgaagtacatgttgtaggtgtagcgggcaatcgtgatcgccatcagaaattcatattggggtttggtttacaagtgttggcctctgggagtgtttcctacgtgctccttctctcctcccctttgaggacggatggtgtgatggttcctctccatttggtccctcctctgggaccagcattctcctgccttctttgtcctactctgtgtcccaggaggtagacccctgtggactgtatctcctggactcccttgctggttgacttttgtctgagttaagccaaagggaggtggcagcaagagacgagaaggtgggaggagagagagtttggggtatttccacctgcagctccctctgtccatctctggccccgctctgtgatgctagcccccgcgaggttgcccatctctcagggtttcctctcttacttgcccctgttacgtcatttcatgggactatacctttagctttaggtgcagaacagttttccacagttaaatgtctttaattgaacatctagaatgcaaaacatattataagataatgtgttggattgttttcctttaaaaaatggtacaaccactttgcaaaacaatggcagtttcttattaagttaaacatagagttacagtatgatacagcaattccactcctaggtatttatccaagaggaattaaattgtatgcccacacaaaaaatgaatgaataaattaagacttataaatgaatgttcatagcagctttattcataataaccagatactgttaaaaaaaccccagaatattgatcagtagatgaatggataagcaaactttagaataatcatataatggaatattattcagcagtaaagatgaactaactgctaatacagacacgtgcatgcgcgagtctcaaaaacattattttaagtgaaagaaggcagacacaaaatagtgcatactgtacgaggccattaatctatatagtaacagaaagtggatcagtgtctaccacaggctgggggtgtgtacagggaaactttttaggtggtgcccatgctctgtatctcaattttggtggtacatgcgtataatacatttgtattgtcttgtatcaaagtatgcctcatgaagttcaggtatatgaaaatttgtatttgctttattatatttaaatatcagagaatgcaaaattgtaaaaagaaaaagaaatcctgaaagtccttttaactagagacaaccaccaccatccacattttatctatttcctttcagtttttaattttttcctgtacttaggttttccccttcactgtcttatttaaataaaaaagaaagcaaatggaaagtctcccatacgaaggcctttttgctatgagtttaccttgtctaagggcatctagcatgatggtgagaaggttttgtcttgtataactaaaatgtattgggaggaaatgaaaatgtttagcctggtgaaggggaaacattggggagaaaagtgagggagagtgtggtctacagtcgtgagctttaaatcacaaccaatcagccaattaaatactgagctcctgttatgtgtcagtattaggaagacagtagtgaacaaaacatatggctcctctgatttaatggagttaacagtctgggagggaaagatatttttattatttgcaacaacaatagtaatagctaatatttatgatgagctagtgcctattatggtgttaaggtttagttttttcttttagtgtttttaatgtgttgtcacatttaatcccagcaactccatgagtaggtactcttaattctcatttcatggttgaaaataataaagtggcttggagatgttaagtcaaatggggtcatacagtgagcatgttaaacctagactggcaggtcaggacggaagtgatatttaatcctcagtgaaatgatttttttctttttaatttttatttttattgagacagaatctcactctgttgcccaggctggagtgcagtggcacaatcttggctcactgcaaccttcacctcccgggttcaagcaattctcctgcatcagcctcccaagtagctgggattacaagcacccgccaccacgcccggctaatttttgtatttttagtagagatggggatttcaccatgttagccaggctggtttctaactcctgacctcaggtgattcacctgcctcggcctctcaaagtgctgggattacaggcgtgagccaccgggcccggcctctttcagtgtttttaatgtgttgtcacatttaatcccagcaactctatgagtaggtactctttttattcctactttatggttgaaaataacaaagtgacttggagacattaagtcaaatgggaacatacagtgagcatgttaaacctagattggcacgtcaggacagaagtgatatttaatccccaagaaaataatatattttttttctttttttgagacagggtctcactctgttgcccaggctggagtgcattggcatgatcacggctcactgcagcctcgacctcctgggctcaagtgatcctcccaccccagctacctgggtacaggcatgcaccaccttgccccgctactgttttgtgtttttgcagagatagggttttgctgtgttgcccaggctggtctcaaacacctgggctcaagcaattcacctttcttggcctcccaaagtgctgggattacaggcgtaaggcactctgaccagctggaaatgatatttaatctgatatctgaaggatgataggagttaaacaagaatcaagtgtcagagaccagagatatgaggtctcatatatatatatttgctcagggcagggggctggttttgggtgataattaggggctagactgaacagaattagtgtttggaagtgagtggtggtggtggtgagggaggagagaagggtgagtcccagggtaagggatgcaggcacatcctgagaaatgaggcagaagaatgagaacttggcttggggcatgttctgttcatctgaatggtggtgctgaggagacaggtggacagagaggtgtggggttcagggaggagcacaggactgagagggaccagcaggaatagaattcctgaagtcccttggattgacaagatgcttcagtgagagagagtccacagggtagagatcagcacctaggacagagcctcgagaacttcctctaggatagggaagggctggagaacaggaggaggagccaaggagaggaggaaggggccaagagggcaggatcaggactgaggcaggccgacttctgcgcagttgaagaactctaatgtcagagctgtccttaggaggcagagaacccctcgtcctggaagagtgcagggagctgcttggtgaccatcctttggggatgtcatggaaaagatatttgcatcaatctggggtgagattaggtgtctggattggttcaggttcttttgtcatttgtaagcacacaaaagaactctagttatctaaaggaaaaaaaaaactggaaatattatgggttggcacacgagtggtgccaggcctcagagagtacagggcccagggtggctctggggatctgggtggcaggagcgaatggatgaccttcacagggtgacaccatcgggaggaatcagctccagctgttttctgtccttgtcccaagaatcaaatcccagggagaacagtgtgattccccaatgttgtgaggttcagtcatgtgcaaggggaaagccgggcacctcgattgacagccccaccaggactgcataccgtggagaaaggatggcttcccaaagaaaaacaacattccagctaccagagaaaagggagtggacgctgggcaggcaaagccaacagacactttttgtagtctccatggtcctgtgtatgattcagtgatttttgcagtattcacttagcaagtcattcctcgttgcagaattgttgctagtgtttttcctggctggggattaagctttttccatttgcctattttagagtgagttgggggcctgggattgacacgcatttgtctctgggcttcaaggtagcccagagattatgccacctcaggaggcacaatttggtggctgtcactccttgtcatgtcaacaaagggtgtggcttgtggctctgtggcctctgctttaccagcaaggggaggatgctggtagtagcaaagggtctaaatcgctgttgcatcagcgaggtggatgtgcctatcctaaaggcacctactgagaagatgcccaagtaacagacactcatgggcacagtagacctgtcaaacctcatagttcctggctgactctctttgggtgacctgagtcacacgcccacgcctgaacacccactgaaactcctaggtgcattacgtcttctgcaatatctaaaggaattaagggaaggatgaaactctgtatctcaactttcctgaattcaccagtatggactgatggaattgagtgctagtaacaccaagctcctaaataataataataaaggcttacttataggaacgtacgaagcacaagagaaataagggcccccacggcccacccttcaacttctcacatttggtttgttagtcaggactcctttggtcacaagagacaaaaaaaacaattcaagttggtttaggaaaagaggcatttattggcttgtacagaggagttgagagttctttaggtctggctggatttaggtgctccagcatggtcatggggcatctcttggctcagcttttctctgtgttggcttcattctcaaaaaaacttttccttggtgatggtaaagatggcagatgcagcactttgggagcctgaggcaagaagaccacttgaggccaggagttcgaaaccagcctggtcaacctagtgagaccccatctctacaaaagaaaaaaaaattcaggtgtaatggtgtgcacctgtagtagctactagggatgttaagtgggagttgcatgaatccaggtgctcaaggttgcagtgagccataatcgcaccattgcactccaccttgggtgacagagtgagattctgtctcaaaaaaacccacaaaaaccgcccccccaaaaacggatggcagatgcaaatttattccctaccagtttaacaactctgctggaaaataaaccctctttcctaataattccagcaaaagtcctgaagctgattctctttgggtgtcctgagtcacacgcccatgcctgaatccccactgtggcccaggtcccatgtccacccttagagccagaggatgagggcagccttagctggcccacacaatcagtgagccagtgaagagcgattcctcacaggagaagcatggaggatgggtgctgtcaggcagaaacaagacatgccaccacacttggttttggggttaggcctgcttctggtctgagcaatctgctgctggatatggctggtgagtgaagagatattgatgtgtcatccccttagaccatggcattgtgtcctgctctctgcatctttgggggcctgatcaaaagcgggaagtcatggggtcaaggacagtctccacgtgccacccaaacaggaaggatgtccccagcaggtgttctgctcagggtctggctctcccagggttgttactgcagagggaagggtaggggcagctttcttctggtggatttatttacttctcaggcctgttcttttcctcatgttggctcaactgttttatcttgcttagttaaataaatttggtaacattataaaggaaaacagtcttttccggcagttgctgaccactgcaaaattactgctctttcttttgtttttcctttttagtgctgggctgtgaataagcaaatgaagtttgctatctcttcctcccctcttccaggaagaaataatcaccatcagaactttaagagtttcccataagactgggcaaattagaggaaggacctctatacggtggaacagatgcaattgtgcaaacagaatggggttattctctacatatggagatggaacagaccctcccagatgtgttagtgtggggaaaagcaggtggtggaggtgcgttcagagtagcagtgttcagctctcccaagcacattcaaatcacccaggagcttttaaaacgtactgatgcctgcccaccaccctctcctcacagccccattaaatcagaatctctgggagtgggacttgagcacttttcattttaaaagctccctggtgactcctggggagccaggactgagaactagtgctgtagaattgtatatgggcaaaacagcagggatctagataaaaaaagaaaactgaagtagggaatatctcagtccgtacctacagatagcctcacacatgtggtcgcgcatacagagaacgtctctagaaggatacacaggagactggaaagaacggttctctccagtgatgaagtacagtggtgattctcaactgtatactcgtttgtaatgttggaattttgaagccacaagcataaatgctcactgtgtactgaaagctggccagacagggctgtaagatgacccctgaactctagcttgtctgtgttggggccggctgcccacagattcacacaaaccatctccctgcccgtggtctctgcttgccctcctctactcagctgcaatgagtggtttccgagtgtgggagagaccagaagagctcattcattcattcattcgctcacatttttagtaagaattaggtataagccaggcacgtggtaggcacgtgaatctgatctcaccttcacaaccgtatgtgaaattggtggtcttatctccattctaagattggggatattttaacacagaaattcatacaaccaagctgtaaatatttgaggccgaatgaccagctaagagagcttataaactggcagcacttagatgtgtttggatggcctgtacagaactttttaaaaaaatcctatttcacgactctggaccagtgaacccagggccactgttggctagagctgagtgtcccttggaagggcatatgcccctcagttcagcgcagtccccccatatcccttcccttctgtgtcacaccagccttgcatcactcagtcacaggcctagcctctgcaggcatttgcgtttgtcacccctgtgttaaggtaggtaggatgagtgaactgtcgtctgtcctgcagggatgctgagctgaagtgtcctgtggaatgtgccatttctattccaatctggccctctgtctgctggctggaaaaccaagctcctttgctttaagtttcatttgtggactgcatgggatgggctgtgggtattgatttgtttgtggaaaagatgtgcacaatagggaatgtgtaaaatacatcatggaaatggatggttaatgccgcctggctggagtgtggggcagtggagtgacaagagatgagagtcaagttagatggtggggtatactgtgggtagatgccgggctaagcattttgaactttaacctttaggctactgctgtccaataagactttctatggtgctggaaatttcttatatctgtactatccaatgttgtctccagacgcatgtggcatcaagcacttgaaaagtagctggcatgaatgaagatttttattggcattttagattttatttaattaatttacttttacatagctccatgtggctggtagctaccacactgggcgctgcagatttaggcaatagcagtggatgtgttggagcagggaaataatatcaaagctgaatcttcagaaggtgatttttccaggagtgtacaggccgcatggggtgagcagaagtaggtagggataatattgacacttcttagcatctattaggcacttcttgtgtccacacactgtgctaagataactcacttattcctcataacaactctatgaggaaagtactatcattgtccctattttatagactagaaaatgagacacagcaaagacaatgggcatattcaaggtcacacagctaatcaacagtggcacacggtgtagaatccaggcagctcagctgtagagcttgtaccatgaatccttccatcctggaaggaaataaatgaaccttcattgagaatataccttctgctgtcccctggtgctgggcattcacacgtaaaatctcatttagatttttgttaacactcatgtgccattcggtggatttagatcctttgtgtttatggaaacttgggctcatagggatgagatatcaaggcaactgcaatctctgtggacaccagttaaggctttattgtaaaattccatgcctgtgggggaaatcacaggctgtgggagtcggggggaatgtacaggaagatatggcataaaaggtgttgcgaaggaagaatcagtgggatttagcaactgactgaatggcgggggtgaggaaagcgggggaggctttctcctggaacagtgagatgaatgacaaacacacatgtaactgcactgtgtgagttgagagtgtgggctctagaggaagacaaactggtttcaaatacaagtgttaacacggactagctgaacaaccttgggcaaattacttctctccgagcatcagtgtccctgttaatataacgaggaccgaaggcaggaggatcacttgaggtcaggagtttgagaccagcctgggcaacatagtgagatcccgtctctagaaaaaacttaaaaaattagccaggcatggtgatgcatgcctgtagtcccatctactcaggaggctgaggccagaggatcacttgagcccaggagtttgcggctacagtgagctgtgattgcaccattgcactccagcctgggtgacagagcaagactttgtctctataaaagatataatgagaatcatagcaccttcctcacaggactgtgatgaggctcaggttaagcacggatatgaaagccctttgcaaactcaatagcatgaccctgtgagtcactcttcttagtgctggtgagaccagccattgggcagaaatggtgaccagaactttctgtctttgatcatggaaacagttcgggaaattgcctgggggaaccccacttcatcttaggtacttggtagagtttaatgcggataagtctgtgggtcagctttgacctaggaggaaagagtggttctcccagcagctgtagagcaaaatctgcatgccagtggctccaacttaaatgcccttttccaccaaacagtttgcatgtgttgtcttatttgagctgcacaacaaccttatatacataggtactgtgataaaataaggctcagagaggtggagacactgagctaatgtccttcagcttataggtagtaaaatgagtgttcaaacgaaggtcctcctgcttccagaaacttagcctgtaattcctgtaggtgatgggcttctcatttcttctcctaccacagatatctgcaactagcgctagaatttctatcccagattgacatggatttaagggtaaaggttgcttcctaagaatgtcagttttccactatagaccccagtaagaattgtgtacaagaggggaatcgactccaaacagaatatatatatatatatgatttaatttagtcctctttggaatgcaatgagtaaattttagtggttagagtaaaccactaaaatttgggagttaggggtgaagtgcagtgtgaagcagagttgagatctcagtgcttttcctggggcagaaacatccgagagggcccctgtcacccaagcttttggctacagtctactccttccatctgggattaaccaggcgtttcttatccttgctgatctagtgtttcttattgctgctgtaacaaattaccacaaatttcctggcctaaaatggcacacatttattatcttatacttctagatgtcaacattctgaacagcaggtcttccggggctgaaatcgaggtgtcagcagggctgccttccttctggaggctctaggggacaatctgtttcttaccttttctagaggccacccacattccttggcttgcgttcccttccagaaatggcacaattccaacctctgcttccatcatcacgtctcatcctctgactccgagtctcttccctccctcctataaggacccctgtgatcacactgggctcatccagataatctagtataaccccctttctcaagatccttaatttaatcacatctgcaaaatcaattttgtcatgtaagtaatatattcacaggtcccaggattaggacacggatatctggtggtggtgtcagggggtcgggggtaggggatgggaacattattctgcctacagagctggcaggtggcctttcttctttcctttcttttcctttcctttccttcccttcccttccctttcctttccctttcccttcccttttttccctttcttttctccttcccttccttttttccctttctcttccccttccccttcccttccccttcccttccccttccctttcccttccccttcccttccccttcccttccccttcccttccctttcccttccccttcccttccccttcccttccccttcccttccccttcccttccccttcccttccccttccccttcccttcccttcccttccccttccccttcccctccccttccccttcccttccccttcccctccccttccccttcccttccccttccccttcccttcccttccccttcccttccctttcccttccccttcactttcccttccccttcccttccctttcccttccttttcccttccacttcccctttcccttccacttccctttcccttcaccttccccttccctttcccttccccttctctttcccttccctttcccttccctttccttttcccttcccttccctttcccttccccttcccttccctttcccttccctttcccttccccttccctttcccttccctttccctttcccttcctcttcccttccccttcccttccccttcccttcgccttcccttccccttcccttccccttcccttccccttcccttcccttccctttcccttctccttcccttccccttcccttccctttcccttccctttcccttccccttccctttccctttcccttccctttcccttccccttccctttcccttgcctttcccttccccttcgcttctgcttcccttccccttctcttctcttttcttttttttctggagtcagggtctcattctgttgcccaggctggagtgcagtggtgctaacacagctcactacagccttgatttcccagcctcccgggttcaaccaattccccccacctcagcttcccaagtagctgggaccacaggtgcccaccaccaagcctggctaattttaaaaattttttagagatggagtcttgccatgttgcccaggatggtcttgaactcctgggctcaagcaatcctcctgcctcgacctcccaaagtgctaggattataggtgtgagccactgcactcagctgcaggtggcctttctgatcttgcctgtaataagggagggtgggaggtggatagagccggagacatctttttcattctctgctggagctgagtagcaatttccccttttaaacaggccatgtgtgcagtcccctacctggccgtcagacattttcattgctcacctggcccctaggcatttgagtttcagaccccattttgtagttctagtaaagccttgctatagactggggtcagagggctgcaggctttcaacctttgtagagcaaggggttattgaataaattatgaagcatctggagattctgggctcttaactgggtacctgtttgaaagtagggtctagtacatttttttcagtagctcagtaaatgttgcctcttcttaaaaaaaaaaaaaacagaaaacaaaaactggtcttactctgaatttgccaaatagaaatgagggggcgtttatttgtgtcacaaaaggatttgatttctttaaataggcagccctactattttcttcaaagtgttttagttaatgggaaatttgatttgcacaacttttcagaaacacactgtgtaaaggaattacctgcaccagaagctcatgaggtttttcaaagtctgttctcagcttctctgcacatcatgctggggttcacttggcctattgattctgcctcagtggggatggactattcatttctgtgggtaattggaagcctacctaaagtgaccttgtcaatggttggattgacaaatatccaggctggtgggatgtcaggcgatcatccaggagctacatctaccatgaagttggttatgttttctcctttttctatgactgatgatattcattttttggttcattcattcaccaaacatttatttactgaatatcaattatgtaccaggaattgtggtagacactaggagactagagatgagctatctttatccccttctgtctccaaaggggataaagatgaataagataataattgatttttttttttgagacagagtctcgctctgtctcttaggctggagtgcagtggcgtgatctcggctcactgcagcctctgcctccctggttccagtgattctcctgcctcagtctcctgggtagctgggattaccggggcctgccaccacactttgctaatttttgtattttttgtagagaataactgatattttagatgtttggaagaaaggttgtagaataaagcacctacttgaaaatgggggaaactactttcctaaatatttctgggtcaaagaataaattaaaaccatactaatagaccacttagaaacttgatacaatgatgggactaaatataaaacataggatgcagccaaaactgtacttaaaagagggtttttagccataacatctttaaatgtttaatgaagaggaatgggaataaattaattgagcagtcaattcaagaagctttaaaaagaacagtggataatattagctgacatttgtagaatagtcatgatatggttggcatggttctgggcatggaataactcatttagttctgacaacaccactgtgatatgggtcctattgttgctgtcattttccagagaggaaactgaagtacaggaagatgaggtagtgtacctagtcttagagtttgcaaatgatagacacaggatatacacctgatcatcagactccagaattcacattcccaaccaataagtaatacaaatacaagtaagcaatacaatcacagacacacagaacaaaaaaagttaaagtagcaattaataaagtaggctaaaaccaggtagagttgataaatataatcataatctgcttctttaacatgatagaaagataaaaatagacaagaaagaacacaaacttctggaaaaaaaataacgagagactacctaacaatgcaatatgaagaaagaaacaaagaaagagaaaaggtgtaatatcatcccagataagatgctacaatttaaacacgttgagaagaacactgtggataatttccaaggaaaatataaattccaaaagtttgtttgagtagaggtgaaaaactttcctgtgtggttgaagtgtagagagggagagggaggtgaagctggggaaagctcagggatggggcgagactatgctgtcatccctttactttcatgttgaataaaagggaaagttaaacatggaactacgacagggggaaaagagagaataataaaaatattatttggggtaatacggttttctatctggaaaactcaaaggaagcaactaaaactccacaaaagctatttgagtttttttaaaaaatgctttaaaataaatatgctaacaatctattgctttcctattgtttttgtttgtttgtttgttttgtgttttgagatggagtctcgctctgttgcccaggctggagtgcagtggcatgatattggctcacttcaacctccgcctcctgggttcaagcaatctactgcctcagccttccaagtacctgggactactacaggcacctaccaccacgcccagctaattttttttgtatttttaatagagacggggtttcaccatgttggccaggctggtctcgaacttctggcctcaagtgatctgcctgcctcagtctcccaaagtgctaggattacaggcatgaaccactgcgcacagctatttgctttcctatttttaaacaatgaccagttgggaaacaaaatgaagacatgtcaaatttacaatagcataaaaaagaatcccttagatgatgctaaagggaaaatgtgtaggacttatatggagaaaataagagttcaacaaggggacaatcatttcctgatggaaagactcattgttgtcaaggcatcaattatcttgaatttaatttctaaatttaacacaatttcaatcaaagtcccaatcattttttggaggctgagggttgactgaatacaatcccaataaaaattccattggtatttttaaaatcttgataaactgattctaaagtttacttggaagaataaatatgcagtgatagccaagaaaatgttgaaaataaggataatgagggtggacttgccctgccaagatataacatattacagagctactataattaaagcccatattgctatactagaagacagatcagtggcacagaatagaaggcccaaagacagaccccagtatatataattattaaacatataataaagttggcatttgaaatcagtggggaagggatgaattattcaataaaggatgctgggacaattggttacctctttggaaaaaaatggcaaattggattcccatttcacatcagattccaagaaattagacatggatcaaagagtttaaagtggaaatgatgccatataaaagtacaaaaaaactccaaagagtaatatttatatgaccttggagcatgaagaaggctgtttgaggtgtacttggactgtctttctttgtccagttttcccttttagtggtttaaaaggaatacatagtagtttttatatttttatttatttatgtatttatttttgaaacagggtctcattaggtcacccaggctggagtgcagtggtgcagtcatggctcactgcagccccaacttcctgggctcaagcgatcctcccacctcagcctccggagtagctggactgcaggcatgcaccaccatgtctggctaatcttttattttttgtagagatggggtctcactatgttgcccaggttggtcttaaactcctgggctcaagtgatcctcctgccttggtgtcccaaagtgctgggattacagatgtgagccaccacacccggtttctattcttatttttaatacttaattgttaacacgtatatttaaacttataatgtcctatatgcaatttctcaatatcaataatcttttgaggaatataagactcagcacattttcatcttgtaaccctcctgcaactcccatttcttatgacttgggttttctctacttctctatctcttcctctgttgaaaacttttcatattatggaaaaaattaaacatatataaaagtaacattagtataatgcatccttgtgtatgcatcacccagttcaataatgacccatcatgatcaatttctttttcatctgtaatcctcccctttctctccccaccttggcatactgaattattttaaattattttatccataaagatgttaatgtatcctcaaagataaggattctataagcaaagaaaaacaagaccattatcacaccaaatatttttcattccctaatatcagtaacaataattcccttatgtcatcagaaagtgagtatatccatttccctgattgccttacagttttttaaactgttggtttttttccacttagaatccaaacaaggtccacatgttaaatttagttgatatgggttgataggtgcagcaaaccaccatggcacatgtatacctgtgtaacaaacctgaatgttctgcacgtgtatcccagaatttaaagtaaaattaaaaaaatttagttgatatgtttcttaaattcctttgaaaatatacgtttctcgtcctattttctccccacttgcagtcctctcttgtagtctatttgttgaagataccatattctttgccttgtagttttctacattctgggtatttggttggggtgggggggggtgtgtttgctgatcgcatccctgtggtgtcatttaatatgttcctctgtcacttgtattttctgtaaatctgtatttgcatcaagagacttgaaccaatcatatttgattatttgacaagtgtacttcataggtagtgaagtgagctttcctctgtaggcaagtggtatctttttgtgaccttagcaaccatagatgaatgtcacctagactcattgtgtcactagggatggccttgaggtttcctgttctattttcatttactaagcatgcactttagaaaggctctgagctgctccctgaagcatggcacccgtcctccagaaacccgcagtctagaggttgtaaaagaagatttgaacaccaagactgtaaaagatgatttgaacaacaacaacaacaacaaagcagttttattttgtatacattctttcattgtacctcccccagagggatataacctccaaataggggagccataccatagatgcattaaattcacaccaattcaaatgtgtgtatatatgtatttgcttgcagactactaaagtgacaatgtaaacgttgctgcctatttttcccactcttctattagattgacgttgcttttggtgagatggggcatgagtccaccatcctgtcccctctgtttccacatgaccctcatcgtatgaacacctctcttaagtgtgattctaggatttaaagatacatatttcttatgcattatgcacctaaacacaagccaactacttcatctggcacctgatccaagaaacaacattctgttccaaaatcaatagaagacaaggcactttaagggatcttcaagggagtgtaattttgagcatatggaatctttctaaccctagctaactttagaagtttaactcctatgcaagatgaagcatctatgttcccaagagtttgacttcagcaaaggacaagctgcagaagctgacattattgtttattttggcataaaggctttacttgttggtgaagttcaagtttaatgatctcttcctccctttctctctcttcctcctctccgctttccttcttcccttcctcccaccctgattttctcttttgcagtttgctgctttgtggtgcacaagcggtgccatgaatttgtcacattctcctgccctggcgctgacaagggtccagcctccgatgtaagtaatgggcatcgattgcttttctctgtccacagtcaatgctgccttgtgattaaatgtgagtgagcattcttagacgagtaagtgtggacgatctcactctaaggcatgtggtggtccctatagcttttgagacagttttccttttagtggaaaacaaaattttggagggagtgtggctggataggaagtcagctagtttgtctactatgattttgctaatgtcttcactttgagagctggagcacggagggtgagaggcaggggcctacttggtagtgtggctgcaaaaaggtagtttcggtggtactttgcagtgcacgttatggcactttgttagggtgttctttcttttgttattgttattattatttttattatttttcagatggagtcttgctctatcgcccaggctggagtgcagtggagcaatctcagctcactgcaagctccgcctcctgggttcatgccattctcctgcctcagcctcccgaggagctgggactacaggcacctgccactatgcctggctaattttttgttttgtatttttggtagagacggggtttcaccgtgttagacaggatggtctcgatctcctgacctcgtgatccgccgcctcggcctcccaaagtgctgggattacaggtgtgagtcactgtgcccggcctattattattattatttaagagtgttgcccaggctggtctcaaattcctgggctcaagcaatcctcctgccttggcctcccaaagtgttgggattccaggcgtgagccagtgcaccctgcttgttagggtgttcctaatatcagggcccaggaatgaggaggaaatgaatttatcctgctaccatgaatctcaaagtatgactactgctagtgggacaagagatgcttgtaggtaaaatgtgcaaaaaatttttgttttaatcattataaatgtattttaatgtggattgggaaaaatgtatctagtagtggttttgcatttatgataaggatatagaatttcctacctaagtaaagatttttaggttaaacaaaagataaactgatttgaggacaatattaagtgaatgacagtatgggtgatataaggatatggcaaaagttttggtacaaatgtgtttaaagtttagggtacattgttgattggcctacccagcagccattcacagccttcatccttctggcagaggctacctctcatgatggaagctaaaaatgcctaatacttgcttttcccggctctcttgtagctgctgaatgaggatgtgacccaatcctgctaatgggaactgaggggaagacctgggaaagagtctaggaaagatttttcctttctgataagagagagacatcccttcccttgtcctcttgggcatttttgtacaaggatataatgcttggagttgtggcagcccttttgggtcaatgagggacacattgccgacatcctgagcatggcagagtggaaaacttaaaagaaccgtgggtccatgatgatgctgatgagctgttgataccactcacagtccttttatccccaagctggatagatgggagaagaagctttttttttggccaggcacggtggctcacgcctgtaatcccagcactttgggaggctgaggcgggcagatcacaaggtcaggagatcgaaaccatcctggctaacatggtgaaaccccgtctctactaaaaatacaaaaaattagccaggcatggtggtgggcgcctgtagtcctagctccttgggaggctgaggcaggagaatggcgtgaacctgggaggcagagcttgcagtaagcggagatcgcaccactgcactccagcctgggcgacagagtgagactctgtctcgaaaaaaaagaaaaaaaagaagctttttttttttttttctttttttttttaagcaaagtcttactctttgaagccttctcttttatttttgtttttttctcttttgagacagaatcttgctctgttgcccaggccagagtgtggtggcatgatcatgtctcactcactgcagcttaacctccctggctctagcaacccccccacctcagccgcccacgtagctgggcctacaagtgcatgccaccacacctggctaattttttatttgcttgtaaagataggttttccctatgttgcccaggctggtctcgaattcctgggctgaagccctcctcctaccttgacctcccaaagtgctagaattacaggcatgagtcactgtacctgaccctgggggcattcttttacatgcagctgaaactgtcctagctgagaaggctttccaccatgcacagtctttcattgcccaataatgaactgcattcagcataccccaatgcagccatcacccctagttctcttactttgtttctgctttgaatccccttcttgaaatttctcccattggctttgtctccattactggttctgttacccacttagacttgacagctgacagcttgcccaaagtgagtagtgactatcttctgtcattggatttctttagctcctgctggtcttctgcaaatggtcatctgccaatttgctgcaaactggggtgggagtttgtggggagggcatatctgttgccatagcaacacaaagatgctggagcatatgttggatattctttgcttggaaaatgtggtaattgaggttaagaactccaagaaacatggaacaaccaaagtccttggaaatctgtttgcaaagacaaagtttgagactgtttgtcatgttctctcagatcctatgccctagcccttgtagtgcaatttcttctctcctccctagcaaaataggcaggggagtttggggagactgccctactcagtatgcagctctgagtgttcatgcagactgaaacttgatactcaacttgcagccaagaagatggtgtttcccatattctatctatctgctgaatgtttctgttgcctaagacagaaactcagctcaaactgacttatatgaaaaggaaaattttgggtccttgaaatagaaaaggcctaagggttgacttggcttcaagcacagtgaatcaaagttctaaataatgtcctcaagaacctgtttctccccttcttggcttagcctttgtctgtgttgattttattttcaggaaggcttgtctcctatgcgagcatggtggctgcaacacctttaatcttatatcttatcagtgctgcagtgcagtaacaagagctaaagtctcattagaccatgaatcacatattgccagaagaatgggttatgctgattggccaggcctgggtatatgctgctgtggtgtgaatgttttgtttctccaaacttatatcctgaaatcctaacacccaaggtatggtgttagaaggtgggccccttgggaggtgatcagttcatgggggaagagccctcataaatgagatagtgcccctataaaaaagaccccagagatatccgtcaccccttctaccatgtgaggttgcaatgagaagacagttgtgtatgagaaagtgagctctcactggagaccgaatcttccagtgccttgatcttgtactttctagcctccagaactgtgaggaataagtttatcatttaaaaatcactcaggttttggtattttgttacagcagccagaagggactaggacagaaaattttggtactaacagtgtatagaggaacaaaattttaaggatgggttttctgaattggtttcggggatttggtaattggctgccaaatctgattagatttaagaatgctaattaccctatttctagtagtaaagagagcctggatagtccgtggcatgatctgtttatagagatacacaaatcatctgcattggatactcctaatcaaccatttataagaagcaaggagccaagtgattcgatatatgatacccaaacacttttggaaaactaaggcatataatgacttgctcctaatgtctctggacaaagtggagaaagaaaaagatgagctcagggatttgaattcccagctcaaagagtttcataaatgatctaagagcttctaggtgtgccctgaaggagagccttctagcctgtagttgcagggctgaaatttctgaaaattaaatgcacaacctcatcctgcaattggctgaattacaatgcaaattggactccccaccacacagggtgtctgctctaaaagcaagggcaagggcattgatcagaaaagaatgggatcccataaggtgggaagactctgatgaagaccctaatgaagctggggacattgagcccctaaattctgacaagtcttttttttaccagtggaagtggcctccttacctcaagcaaaagtgtcatccccactcagggtggcattggcctttccatcttgtctaagggaactaaccctgcattgccctaagaaacagtaatggctttccctgaggcagttgccatgccaggcaatgctgattcttgtcagcaccgaatcccaccaccccttcaagtcctagcaggctcctaaacgtgagatgcactgtgtgacccacggggaggtatgctataccccaaaagaactatttgagttttctaatttatacaagcagaaccatagggaatatgcatgggaatgatattaagggggtaggataatggtggaagtaacatgaagttgaatcaggctgaatttattgatagaagttcactaagcagagattctgaatgtaatgttccagcttaaggagttaggaagggctctaacagtttagctggttggctgaaacatggattaaaagatggcctatcatgagtgagttggagatgcctgacctcccctggtttaatgtagaggaaaggattcaaaagcttagggagattagaatgccagagtggatttgtcatttaatacccgctcacccatgctgggaaggtcagacatacctttaagaaaggtatgtctctgtcaatactttgagaaatatatttgtgaggggagccccagcgtcctttaagagctctgtgatccctcttctctatagaccaaaccttactatgggaaccacagccacttaattggaaaacttaaatgcaatgggaataattgggtcctggagtatcaggggccatttggtggcactcaactgttaaaggcaaggtaggtgcggttaccttaatggatcgcagagttacaacaacaatcggaatagcctgactcatgcagacctatggcactgcctaatcatggtgttgctagaagtgaaataggtgggaagcctactaaattcttacttgatctgtatagcagaaaaattctaggtgaagtgaacagaagtctaacttgaatcataaaaatagagaatcatagcccctcagtccattcccagacttgagccagtttatagacccagaaccctttgaatgaaagggaggtaaaatttccttgagaaagcgattatactgctaaaagtttatcctgttaatctttctcccagccttgcccaaagggacctactgctttttatcaggataactgtgcactagagaaaaggaaatgatgagaccttttggggactactgaacactagttctgaactgacactgattctaggagacctaaaatgtcacttgtccctccagtcagaataggggcttatggtggtcaggtgatcaatggaattttagctcaggtctgtcttacagtggatccagtgagtccccaaacacatcctgcagttatttccccagttccagaatggataattagaatagacatacttagcagttggcagaatccccatactggttctttgacctgtagagtgaggcccactatgatgggtgaagccaagaggaagccattagaactgccccagcctaggaaaacagccaaccaagagcaatactacatccttagagggacagcagagatcagtgccatcatcaatgacttgaaagatgcagaggtagtgattcccaccatatcccttattcagctctcttatttggcttctgcagaagacagatgaatctagaagaatgtcagtggataatcataagcttaaccaagtgatcactccaagtgtagctgctgtatcaaatgtggtttcattggttgagcaaattaattcatcctctggtagctagtatgtagctattgatttatcaaatgcctttttctccatctctgtccataagacccaccagagcagttttattgcagctggtaaggctagcaatacaccttcactgtcctacttcaggggtatatcaactcttcagtcgtatgtcataatttagtttgcagggatcttgatcattttttccttccacaagctatgacaatggtcctttacattgatgacattatgctgatttgtcctagtgaatgagaagtagcaactactctagacattggtaagacatttgtgtgttagaggatgggaaataaatccaactaaaatttagggaccttcttcctcagtgaaatttctaggggtcagtggtgtgtggcatgttaagataccccttttaacgtgaaggataagttgttgcatctggacccttctacatccgagaaagagacagatggcctactgggcctacttggattttggaggcaacacattcctcatttaagtgtgttatgctggcctacttaccaaggggccccaagagcttctggttttcagtagggcccagaacagtagaaggctctgcaacaggtccagactgctgtgcaagctgctttgccacttgggccatctgacccagcaaatccaatggtggttggttagtggcagagagggatactgtgtggggcctttggcaagcctttataggtgaattgaagcacaagtatttaagattttggaatatagtcctgccataatccacagatagctagtttcctattaagagacagctcttggcctgctaccgggccttcgtggaaactgacgatttgaccatgggccactaaattgccgtatgacccgaattgctcttcattaactgggtcttatctaaaccaccgagccataaagtgggcatgcacagcagcacttcatcatcaaatggaagtggtatgtatgtgatcaagcctgggcaggctctaaaggcacaagtacgatacatgaagaaatggcctggatgcctgtgctccccactcttgctaccctgccttctctctcccaacttgcacctttgggctcatgaggagttagttccctatgatcagttgacaaaggaagagcagactaggacccagtttacagatgtttctgtacggtgtgcagacaccacccagaagtggacagctacagcactgtagtcactttaggacatccctgagggacaatagtgaagggaaatcttctcggtgggcagaactttgagcagtgcacctggttgtgcactttgcttgggaggagaagtggccatacatgtgactatatcctgattcatgggctgtagccaattatttgactggctgggcagggacttggaaggaatatgattgaaaaaattggtgacaaaaaagtgtggggatgaggtgtgtggatagacatctctgagtgggcaataaacatgaaaatatttgtgtcctaggtgagtgcttaccaaagggtgacctcagcagaggaggattttaataattgacttgatagaatgacccgttctttggataccaggcagcctctttccccagacaccctgtcatcacacaatgggctcatgaacaaagtggccgtggtggcagggatggaggttatgcatgggctcagcagcatagacttccactcatcaaggctgacctggctatggccaccgctgagtgctcaatctgccagcagcagagaccaacactgagttcctgatatggcaccatgcctaggggttatcagccagctacctggcggcaggttgattacattggaccccttccattatggaagaggcagcattttatccttatggaaatagacatgctggatacagatttgccttccctgcctgcagtgcttctactgaaactgccattcatggacttagagcatgctttattcactgttatgaaattccacacagcattgtgtctgatcaaagaaatcacttcaaagccaaagaggtgggcagtgaactcacactcatggaattcactggtcttaccatgttccccatcattctgaagcagctggcttgatagaatggtggaatggccttttgaagagtcagttatgttgccagctaggtagcaataccttgcatgcctgggcaagattctccagaaggctatatatgctctgaatcagcatctagtatatggtgctttttctctgatagccagaaatttatggatctgggaatcaaggaagtggaatgggagtggtaccactcattattacccctagtaattttaccaccagcaaaattttgctttcttttcccatgactttatgctctcccagcatggaggtctcagttccagagggaggaatacttccagcaggagacagaacaatgattctattgatagttaacactgccacccagccactttggggttcccatgcctctgagttaacaggccaagaaggaagttatgaagttggctggagtgattgatctggactactaaggggaaattggacactactctacaatggagaaaaggaaaaatgtgtctggatacaggagatccctaaagacatctcttagtattaccattacctgtgattaagatcaatgaaaaactacaacaactcaatacaggcaaaactatgaatggcccagaccctttaagaatgaaggtttgggtcaccctgccaggtaaggaaccaccaccagctgaggtgcccactgaaggtaaagggaatacagaataggtaatagaagaaagtagttacaaataccagctatgaccgtgtgaccagttacagaaacaaggactgtgattggcatgattattggcattattttgttatggatatgtttgtgtgtatatatacatatggtgagcaaatatctttgttttctttgctcttttagttctttatcatgtaacgtaagatgtattgactttatatcagtatttttatgtcttagtatttaagttataggataccaggacaagaggaatcattactcaaggacttcatctccttttctggggaggggattattgcattttcagttgtacaaagtctaattgtatcacatcaggtggaattatgtccttgttattctttatttggaggttctttatttaagaaggtgtgtatggatgccaagttgagaaagggtggacttgtgatggttaattttgcacatgcagttaaccttgactgggctaaggggggtacccagatagctggtaatacatgatttctgggcatgtctgtgagggtgttttcaagaaattatcatttgaatcagtagactgagtagaaaaattgccttcattgacataggcaggcaccatctaatctgttgaggactcagaacaaaaaggcagaggaagggtaaattcactctctctttttgagctggaacattaattttttcccgcctttgggtgttggtgctccaggttctcagtccttcagacgtggaccaggacctactccattggcacctatggttctcaggtctttgggctcagatttcaaacattggactaaactatacccctggctttcttggttctctggcttgcagatggaagactgtaggacttcttggcttccataattatgtacaccaattcacgttattgatttttttttggagaaccctgactaatacattgtgcctacaccgtagatgagggcgtgagtgccccttccatggattgagagtggggaagaggtagtttctctgaggaaagctagagaaacggtattgtgtcctggttaaaatcacggattatggagccagcattcctagcctcagatctgtgtgaccttggacaaataacttaaatccatttatgccttagattcctcagctaaaaaatgagttaaataatagtttctacttgatagcattgttatgagtatcaaatacatagatatctgtaaaagcacttaggacagtgtctggtgcatggcaagagctatatatgtgatgatgatgatgacaatgacaatgaataacagtgcacacatgctgagcagccagcaaggacaggtgtcttgtcagacagaccaggaaagggtgaagaatgagcaggttctctgtctgccacctggcagtccttcctagaagtgtggaggctctgtaagtggcatgagacccctctctgtatgaatgaaggagtgcagccattcattgccttgagcatgaggagagcaggaagtactccctgcagccagcatgcataggatttggcagcctacctgaaatgattctatctctggatacagttccaaaaaggtcagttggcaccaaggatgatgaattggtccagacacctgaactggcttgactcagttcattgacctttttctgctcatggttggaggcatgattaaagacctagccacacctgcttgcccacctggccagactctcctttagctgcccctgatactcatgcaggtatggaggggtgccctctccttctgcatgaccttggaggaactggtgtgcagcaagttcgtgaagcagaaacacacaggcggtgaccttggacaaggctccatccacgataaaggatgtgcttggttgcatcctctaccctctgctgttccaagcccagtctgagccaggcaatattatggatattagtagagctttgtgctgttggcattatcctacagctatgttcacatcatatcacattgaggcaattttatgaaccaggcactgtcccgtgaacctagctactgagccaaccattcaataacaatgagaatagacaacatttatgggcactcgccattggagggccacaaagtgtggcagagttcatggatgatgctcctggtcacccacagtcatccttcttgttcttgatctcaccaggcaggaaatcctcaattcatctgtctcttgtacctcttagagagaccaggtctctggtactgtcataagcattacttatggacattataggttattcagcactcagaatactgaccacatacacagcctcctgtgacatctcagaacaagaaacagaggagttgtctctgagggttgggactagggtgagtcaagtgaggtactttccctgggcacagtttaaggggttcttgtctgtgtctgtggatagctggttggttggctggtgggtggatgatctaagatggcccctttcacatgactgacgacgagcaggttgtcggcctgtgtgatttggctctcgtccatgtggcatcatcctccatccaactggctagctctgacttgttcatatggtggtttccaggctccaagaagagcaagagagcatctcccaacactttttaagcctttgtatcatgtttgctaatgtcctaaaaagctagtctctggccaagtccagattcaagtggtagaaaaatagattccagtgcctcattggagaggaagtatctatggttaatctattgcagatcctgttaacccaagaggccatagcagaacagaacccctggagaccatcacactggactttataaaaatctgcatgttatagtgtggctcagagtcatagatggcctcatcaaaagaatgcacctaatttattccctgcctcaatcgccagtggacttaaccacctctagctataagtggttaatgtggcagtttattgatcacgtcaatggtggttaagagtatggactctgaaatcagacatacctgaatttgagtcttgattctgcccagatactcattaggaaaacttgggcatgtcgttcgacttctctatgccctagtctccttatatgtaaaataggatgttagtaccaaccacataggtttatagtgataattttaaaaatatttaaaatgagaaagagttcacaaacaaaagacaaatgaatttcaaagcccttacatgaaagcgcttggcacagtgcatagcaagcccttggtacatgtagctaaggccatttccattgctccacctaggtccataatcaagaatgtactgacaattctctacattcttccacccagagcatgcccttatgaggtgattacagtttccatttccattacttcacacaaacctcaaattctgtgatgcagtgctaagaaaagaactcaaactttggagccagaaaatgctggtgtcaaattccaaatggtctctgctatgtattgctccaatgaccttgggaaaataactttaagttctgtgaccctcagtttatgtctttaaaatagagaaaataatacctaaataaagcggtttttttttttttggtaactattcaataggagactgcttgaaccatccctagaataatgtctggcacaaagaaggcactcaatacctggttttaaaatcattattaatgtctggaggagcctctcctgctctataagggatacaggttaccctctgacctgccaagaaataatagctaataataatagctaactttattgaacagggtctctgggcaggcagtacaaaaggactctttgtctggtttgtctaaagatacctttttcaacactttatggctttagaaataatttcttatgatttatagtcaagttactgagtaaaacccactgttaggtcctgtgatctcctaattccatcactaaatcaggtcaattagagatggtagacactaatgttgaccttatccttttgatcaagtctcactttgtgataagatagattaaaaatcataaacttgttaaacttgttaaatgttgaagatttgataaaacagaaatgaaagtattaaatgtatgtatacattaaagtatgtaaataagtgagaacatgtttgaaaatctggttgaaatggatgattttctcataaaattgtcaattttgtctcaaaaagaaattgaaaaccagaataggcaaataaccgagaaagaaatgaaaacattattcaaggatcttttcttctcgtaaaaccccagacaaatatgtttcatgggtaaaacttcttaaattttagagcaacgaagaatttctgttcatttaaaattgtacctgattacaaagaagaaataaacctttacaattttttttaaatgaaaatgagagaaatccagctcaaattagcagtaggaaaagagggcccattgactcctgagaaggacattgggagtagagtaagagcttcaggaccaaggacctcaaaggctggaactgaagctccagtacttgcaagatacttttccatttctgctttattggttagttattttgctctgtaacaaaccattccaaaatttagtggcttgaaacatcagttatttgtggtttctcatgattgtgtgggttacttgggtgattcttctgacctgggtttatttgggtaatccctgctgggctctgtcctgggtcttggtcagctagtggctgggccgatgctggattacctagaacagccttgctagcattgactgagggctggcaggctgtcgatctgggcatttcatttttcctccatgcgtcctcttttcctccaccaggctagcttagtttcacggttccaagcacggcaagagagggaaatcccaaagcacaggtgtgtgtgtgtgtatgtgtgtgtgcgtgcgtgtgtgtgtgtgcgtgcgtgcgtgtgtgtgtgtgaaatggagtctctttctgttacccaggctggagtgcagtggtgtgatctcggctcaccgcaaccctcccagatacaagtgattctcctgcctcagcctcctgagtagctcggattataggcacccaccaccacgcctagctaatttttgtattttttgtagagacggggtttcaccatgttggccagctggttttgaactcctgacctcaagcgttctgcctgcctcagcctcccaaagtgctaggattacaggtgtgagccactgcgcctggccagcataggtgttttttaagcctttgtttgtgtcacagtggttatggacaagatcagatttggggtggagaaacaaacttcatctctggatgggaagaatagcaaagtcacatggccaaggagcatgcggggatgggagacattggtggccattgtgcagtctaccacactgacccttatctgctgtgccagatgcctcgtttgcccttccaatccactctgctttctctgagagactaagccataatgactgcttcaactggggctcccttaccctctgacctgacctctggttggactcaaggggaggggctaataggagacttggggaggggagagtgagaccctccccgagtcagtcagtatttattatggagtcatcttcactctaccttttgactataggttgctgctcctctacagatcatcttctctatgtaattctctccttctgggttccaggagctactcccttcctttgtcctctggctcttactagcctccaatcccttatactttcccaacaccatgcccacacctttagaaacagtcctttcattgaacctttcttaaacactcttcactttagtatgccatctgtttcctgcggggcccctgactgatgcatctgctttgtcttgcctcatttgctcctgctgtagatggaacatgtctgcaaacatcgttacagttgaccccatggaaagatggcaaccctagtggaggaattagccttcttcctgcattcgttttttttttttttttgagacaaagtctcgctctgttgcccaggctggagtgcagtggtacgatctcagctcactgcaacctctgcctcctgaattcaagcaattctcctgcctcagcctcccaagtagctgggactacagatgtgcaccaccatactcagctaatttttgtattttcagtagagataaggtttcagcatattggccaggctggtctcgaactcctgatctcaagtgatctccctgtctcagcctctcaaagtgctaggattacaggcgtgagcgactgcacccagccatcttccctgcattcataattgatctcagaaaatgttctgatggagttggttctctatcactgggagaacgaactcttataacctcagacctggatcccatggcatccctttcacccaggagcagtgtatgttataagaagagtgaaggagaaactttgatgcgctgatgaaagtaataactaattattataagcttgcttaaccacaataaccgctattacctagtaaagttggcataaaaagtaaactacaagccagtctcatacatgagtctagatgaacatatcccaaataaaatagtgaatgctattttattgttgtcacggacattatgcattcaaataatgtggaggaaacaatctagagataaaacaacaaagaaaattatgatcaatataacaaaatataggaataaagataaaaatatgccagcaaggaaccgtggaatctggaaagcataaatttagatggtagaagtgatagcagaatgttacccaaccaatgtaaatggattgaaattctctactgaaaggcaaagactatgagattggatgagcaatgtacaactcttggcagtgtataaaagatgcttaaagcacaggttttaaaaataaaagggacaaaagtgtatcatgaaaatacatatataaaaatgaaacatggtcttaataatgatatcaaaagaaataggactcaaaacaaaaagcataaacgggggcagatgtcccagcagatcacttgagctcaggagtttgagaccagcctgggcaacatggcgaaaccaagtctctacaaaaaaaaaaaaaaaaaaaagaaaaaattagccaggcatggtggcatgcacctgtagtcccagctactcaggaggctgatgtgggaggatcacttaagcctgggaggtggaggctgcaatgagctgtgattgcaccactgcactccagcctgggcaacagagtgagattctgtctcaaataaacaaaactaaacaaaaacataaaacagggaaggagaaaacatgaactctaatgcattactggtgagtggcaaattagtatatgttttctaaagagcaaattttccatacatatccagagctttaaacacatttttgacctaagaattactaaatctaatcattttgacctaagaatgacaattctaggaatttttggtaagaaaccatttcaggataaatgcatagatttatctagagtgatattcattgcatcagtatttataatatcaaaaatttgaaaatgacccaagtctcactaccaattagagtttatataagtaaaatatattacagtcatatggtggaatgctggccagtgattcagtgtcacagtgtctggggataaggggaatgttctgtgtcttgactgggatggtgcctatacaggtgtacacatttttcaaaactcatcaaactatatgcttaaactctgtacattactgtatgtaaattatactttaataaaaagtcacagtgattaaaatgccattggcctggaaatgcagtcataatatattgctaaatgaaaaaaaaaaagcagacaacaaaacattaggtcaggtatgatagatttaaaaatataaaaatatatacacatgtaaagccaaaggccacattccctaaataaattttcgtgaatacttaattctgttcactgtcttatgccagacttgttacctgcagagctctgaaggtcactttgggatgttctgtagctggtttctccagttttgtttgtttctggggccactccacctctagtgcagactcaggtttcccacttagttcagtgaggaccaaacttgagtggcggttccggcgtaatcgggagtcacttacagttccttccaaatgtggttactcttgaggtcctccatccgctgggagtcagctcagttcctggactgagcatcttcaggtgcttctaataagattctggcctctgataagtcttgacttcaattcatttttggccccagagaaggggaatcttggctctgccaacaaggccctgtccatttcctgcctcagtgtgagtggcaggaagaccaccttgatcttcagggcaaaggctcgcttcctcctcttggtgtcatccggtctccttggctcagtaaagcaacgtaacagtcaagtgcacttttctcaacgcctggtttcttctgtcttacataaccccaagtggggacacccacagtgaactttcaaaaataatgctccttccagggagcgaagcagcaatgagggttgaacatctctcttgggatgaccatcacctggaccaaaagacccatttacatctctcaaggataagtaatgtcaggggcaatttagtctaaatgatacagtctccacctcccttcctcccttcctcccttcttccctctctcacttatctattatctccctacatctgaaagtgcaccatcctgctgaaatcacatcctgttcacataacactgcagtccatagcttctgaatccacacagaagttctcgtgggcgataccaaatgccaagaggatgccttagaaggagtctggagatactcgaggattggcctctctagctcagaggttacactgtcatcaaatgtccaaagagctcttgtacagaatttttgtggtgcagttctaaaggagaagtaggactgaggtccatctgtgcaggctaacgaagaacagcccatactgaccaactggttgctacataataatattagctccccatccgaggatagtaaagctcaattgccaggcatgctgtagagggcatagctgtggtagatgtgggtttctaccatgttggtggttctactagcttttgttgttttgttgcatgcaacagaaaccatctttggttaacataagttggaaaggaattcattggaaaagatgtggcatccttcagagcgttgaaagaaaacttgaacaaccagaccagttctatctgattttggttcttgtgttacattcagcctaaattcaaattccagaaggagagagattatctggccgagctcaagttgcctaacaaactcttgggtcgggcttttaaaatgttctttcaaagactaaacgctgtgggggtaggatggcttttcaaaggagaatcgaagtactgatacggggagcagggggtggggagggggaagaaggcacagatgttgcgccaattggaacaacgtgtttgctacaatttctaaatgctacattgcagattgcagagagattggatgacaggcttcacctgaagagatagagatcaggacctgggaatccatgtgttaaaaagttcttgggtaattctgatggatagctgggtttagaagccagtgtaaggcaatatgtataaaagctctgaaaccagaatgactgagtttgaattccagtttggccactaactagctgataatcttgggctagttacctaacctccctgcttcagtttcctcatctataaaaagaggataaaatggcacccacctcatagggtccacgtgaggattaaatgagttaacctagatggtaagagcttcatgccgtaactggcacataggacatgctagttaatattattgccacaaatgatcctttcaagtcttagattgtgcatttcaaaagtccatccttatttttggaattgcatgcatttatcttgctttctgcaaaatggaaaggcatctcccatgggctggttggagagaggggctgataaaatgatggtaatgtgataaaatgcagttctcttgattgtcaagtgaattctgcatgattcttctgctctcatttgccacgggctgactgcttctgcaatgcagaacccgcttgtaaaggtcagaatgaattgcttccaaacatccctttgtccctcactgtcacgaagacacagagctgcatgctgtggaggaagaagcaaatccatgatgctggaaggccagagaacagaaaccaaccgtgcacagagaggcgagctgctgggacttgaatgaagctgatgcgtcccatctataaattattgtggcttctcctagttgggaggcaggaccagcctcacaatttcccagaagaccgtaatttctggagcctgcaggcctgggggcaaatggagaaatcaaaaggcagatggccttggagataggcagccagaaaggatgtgaaaggccctggttctggactcaagagacctcacgtttcctagtcttctttctgtctctgctcttttgtgttcatgaggttcatgccctcatgagggctcccccacctccagtggtctaggattctaggatgtcttggtattctttttcaaaaaaaaaaaactaagagccagcatttatagatataattctgtcctaaacactttacatataataattcttcattcttcattacaccctgtgagataggttatcattgttataattccatttcacagatgaggaaactgaggtactcagagactaaatgacttgctcaaggtcacttgtgagaggtccagctctaggccctctggcccgtggggctatgctcttacctagtacctcaaactgcctggtagacctcaaccctgtgtacctgcacaaatggtcctgaagcaggcagctttcttccctgagagctgcctttccagatatgcactgccaaaggtctgtgaccctacagccttggcctgatttggtccagatgcgtgtggacatctctcccaaacaggatcaaattggcctcttctaggagtttagaatttggaatcaagggtgctggttttagtctggactggtcacacagtttttgacaactgtttattgtacgggaaaagtgtccagcttgatgaattctcacacagtgaatttttctttgtaagcagagccccagaagcccttctttgctccttctaatctctacacgtccctccccatccatcaaaataaccactaccagaccagcaatcctttggctgcttttccccccacccccagtgatctattttattttattttggaaagaacacgtaacatgaaatctatcctcttaacaaagttttaagtgtaaaatgcatcattgttgatgatggatgcagtacgagacagcagatctctggggcttattcatcatgcttgactgaaacttgatgcccattggtaagtaattccccattttgcccttcttccaggctgtagccaccaccctttcactctgattttctatcaatttgactatttttgttactttacgtaagtggaatcatctagtatttgttttcctgtgactagtgtttttcatttaccataatgtcctcagggttcatctatgttgtctcattgcagaacttccttctttttggggggctgaaaaatattccatcatatgcataaacacattttccttatccatttgttcgtcagtggacacctagattgcttccacgtttagctgttgtgaagagtgctgcaatgaacatggaactgctaacatttcttcaggatgttaatttcaattcttttgggtaaatacccagaggtgagggtgctgaatcatatggtagttctatttttaatgttttgaggaaccttcacacgggctaaggacttgaataggcagttgtccgaggaagacatacaaatgaccaaaaggcatatgaaaatttaaaaagctaaacatcactaatcactaggcaaatgcaaatcaaaaccacaatgagatattatctcacacttgttaggatgactattttttttttttttttgagatggagtcttgctctgttgcccaggctggagtgcaatggcgtgatcctggctcactgcaacctccacctcccgggttcaagtgattctgctgcctcagcctcccagagtgctgggattacaggtgggagccaccacgcccggcctatttttttttttaaaaaagacaagtgttagcaaagatatggagagattggaacccttgtacactgttggcaggaatacaaaatgttgcagatactatggaaaacagtttgcctgcttttgagcacttaaaaaacaaaactaggctgggcccggtggctcacatctgtaatcccagcactttgggaggccgaggtaggggggatcacttgaggtcaggagtttgagaccagcctgaccaacatggcagaaccccgtccctgctgaaaatacaaaaactagcctggcatgatggtttttgtatctgtaatcccagctactcaggaggctgaggcaggagaatcgcttgaggttgcggtgagccgagatcatgctactgcactccagcctgggtaacagagcaagactccatctcaaacaaaaaccaaaaaacagaattatagagtagaccatctcttgtgtctggctggtttctttcatatgtgtgtgtgtgtggccacatgatattgaaaggacacatagcatcctgttcatcaggatgtccagcttcagagccagcaggggccaggcaggtgggtgaatgagtgacgtgtgtgaccacaggcatgtcccattggcccattgaacaccctatctgaaaggggcagcggcactcagctccgtttcctaattcctgctgtttaaaggatgaaggtctaagttttcccatttttttccagagaaatctgaaatcccctaaatttagattttgacagagaattcaagaattacaactgtggtgtattttaaacacatttttggactggattccttctgtgaacctccggtttacaacttctgcattcgtaggtggggactgtcagtggaaggtctcccccaccccacatcggaggggagaagggaaaatgtaaatttagtcaaatgggctttctttggagagtagagagtgtgcaatagtccaaggcagggagctttaaaagaatgcagaagtcttttttctctcttggtgtctgagctctaaattggctgggacatatccttagttaggagtcagtggctatagcgccccctgctgtcctttagcaccctcttcgtgtccagtgagatctgcaggtgagcctggaagccacttgcttctcctgcaggttttgggaggaagattcatcattttaaatattgctcaagtgcctgctgctgccagtgacttcataggctcctgttagactcaccttcacttatatttggtcaattacctactccctcagtcagaccttgccactcgattttttttttctttttgatacaaggtctcactgtgttgcctacgagtgcaatggtaccatcacggctcactgcagcctctgcttcccaggcttaagtgatcctcctgcctcagtctcccaagtagctggggctacaggcatgtgccgctacgcctggttgattttttaatttttttgtagagatggggtttcatcatgttgcccaggctggtctcaaactcttgggctcaagcaatcctcccaccttggcctcccaaagtgctgggactactcaggcataagccaccatgcccagccaccactctatttttttttaaattggaggtagggtaagaaggactgggccaggtcgtccttcccacaattccagtctcactgtttctatctattgaaaagcatttctggcatttgcttggtacctttccctggtttctgggctgaaatagattttatcccatttttaaacaattccttctgatactttcaggggtagtttgtggatgagagcagagtgaaatgcataggctcaggtttgtggccttgcaagttaataaagagtgtggactttggaactagcctgcctgggctccaatcttggctctggtacctactagctgtgtatcattgttttcattgttttgttttgttttattttgttttgtttgagacaggatctcactctgttgttggggccagagttcagtggtgcaatcatagctcactgcagcctccaattcctgggatcaagtgatcctcccacctcagcctcctgagtggttaggaccacaggcatacaccaccacacctggctaattttaaatttttttgtagagatggggtcttgctatgttgcccggatgggtcttagcctcccaaagtgctgggattacaggcatgaaccattgtgtcccaccttagctgtgcactttaaataagtcacttgacctctctgttcctgtttcttcatttacaaggtgaagatgataatatactacttcttagggtgagtattaaataagttaacctatgcaaagaggttaaaacagtgcctagcatatcatagaaatgtttgcttgacccagaggcctgaacctgctttgccttcagtgttggtctttaggtcctggcttcactccttaatgctgcatctcagcctttcctcatgaaactttctgtctttgatccttttcactccttaactgtgaatctcccaaattccactgagcagtgatcaattcttggggcatcttgctctgtgttcccagacattccttcaccctcattttctctccatggccaaatcctatagtgcctcctaaataattatagctgacatgtatgtagcacctatcatatgccacgtgctgttctaagtgattgatatatgctaactcatttaatcctcaccctatgagaaagatgcttttttaacacctattttatagaggaggaaactgaggcccagagaagtgaactgacttgccaggtcacataactaataagcagagtctggatttgagtttggctctagagcctgctcttagccaccatgtcccatcctcactgagaggacccttgttcaactccactaaccctctctggacaagtagcctctggtcctgtctccctgcttcctctctgtctcactggcctaccctttccacacctttctaaaaaccaaatgtgatcatgtcatcctctttgttgaaaacatgtcaatggcttcccattgttcttgggacaaagtaaatactctttgaagtggctgcgaagcagggtggacatacgtcctcctctgccaagcttgcctataaaccaaattggtttgttctgttgtgtcagcgtaccacaaggctggtgcccttgtcatcctcacaagagtccctgttggaagatacaggatatgattgtcctactcatgaggccctgcgtgctctggcgtcagggtccctccagcctttgcttgaccactctgagtaccttcgttcactcctctgttcatcctgccaccaggcatttgcacatacttctcccttggctgagatactcttctctctcttcttccctgtgagttcagtgggtctcaattctagttgcattgtagaatcttctgcagggctttttaactgaatgcagtgtctgcacccattccagaccaactaagtccaaatctctgattgattcagaacctctcagttgcatgcagggttaagggccctggtcaactcacgctggtcctctagactgcagctcaagcatcacttcctcagggaagcccttcctgacctccctgaccaggcccatttccaatattttgtactcagcacaccacatacctcttcttgctgtcacatatcttagggacatctaaatattaggttggtgcaaaagtaattgcggtttttgctattgtaaataatggtgcaatagtaattagttaaaagtaattaaaaataatggcaaaagcacagttacttctgcaccaacctaatatttacttacatggtgacaaagaacccagattctggataaaaatgaatcactagctgtgtgaccttgggcgagttacttaacttctctgtgtctcagttttctcccctataaaataggaatagtcaaaaacctgttttacatggtcgttgaggatcaaattagttcataatatgtaaggcgcttggaacagtgcctggcacatggtgagtgctgtatgtggtagctgttactgcactagtaattattaccccctgctgggatctgtaaatccctgaaggtggggttggcatccgttgtttgatcactccacacctaggatgctgcatgaacataatagctcttcaatacctgtctgttcagcagagtggcgtcctagtgaggttcttggtaaaagatgaaaggtgagatgtggaattgcaaaaaaaaaaaaaaagtatagacatcagagttggcctgcacagaattcaccttcctcagttagggcccttgtctatgcgggcctgctggttcagggtcattgtttctagcggtcatgaggatcagagcctgcctggacttgctgtgtgcagagtccccggtgcagatggccacctggcaggcatttgctccagcagcatcctttgcaggaatgggaggctcctctgtaattcacaaactcaccgtgtccttctatacagaggatctttctgctcttctgaaatgcagacttgggtgtgctgagagcttctgtgacagagggtgctgtcaggaagctgggcatccagggctgcacctggaaaccaagctggcagcggctttgcaagttgaataatcttatgttgtgatcttgcatttacgggaccccccacttagcaaaaaggggtgctcagaccacttcccttagttggcttacggcactgcagggggagaggggtggggaggggaggagatgggtgtggttttgtgggtgatggaggatttatttataatgtgggtgtgatccgttgccatgtgactattccctgaaactactgtacaccctgagcaatgaatgcacaacccggcctgcacaggaagaggtggggctcactctgtgaacagcctccaccagaactcgaaggccccctggggaataccaagcctaacccctttgttttcagaaggaggaactgagaccagaccatggcagtgacttgcccaagatcacagatgtcatttttattctaagctaacatttgtcatatggatactacatgccagtcactgtgccaagctaagcatcatcattgtgatttcattaatctgtacacatctagaaagcaggctcattatattcagcaaacacttgcatagtgtatatatgatgtgccaggcactgtgctgagtcttttacaaatattaatccattaaattctcataatcctatgaggatttagtgtgattattatttccttttatttatttatttaagacagagtcttgctcttgtcacccaggctggagtgcaatggcatgatctcggctcactgcaacctccacctcctgggttcgagcaattctcctgcctcaacttcctcccaagtagctgggactacaggcacccgccaccatgcccagctagctaatttttgtatttttagaagagatggggttttaccatgttggccaggctggtctcgaactcctggcctcaagtgatccgcccgccttggcctcccaaaatgctgggattacaggtgtgaactgccgcgcctggccttatttccattttaaagatgaggaccctgaagctcagagaggttgggtaacctgtccaaagtcacacagctgggaggtcattgagttgggagtcaatctcagacagtctggccttgaagtgtctgctccagcactgtcatttctctccatgtgacagctcttctctccattttacaggtgagaaaatcaaggcttatataactcaagtagcttgctcgaggctgcacgactggaaattaccagagctggtgttgaatttgcacattccagctatagaatctgacccctgatctcatgctaaactccctctcagtggggctagggtcttttggctgaggggtccaagctgggaacaggtcacgggggttgaggcagagcctgaagccagcaggtggaggtggggtggtgtcagccaggtctacctgggttgactctgaacctcatgcagtggagcagttactcccttcccatggggcagagccccagctaggtggccatcgcctggttacaccctctaattccttaagatttcagcttaaacttcattttctcagggaagccctcctgactctatccagccgacactctccttgtaaattctctaagcactgagtgtctcctttgcagctgttggaagtgtacattggtttatgcttctttattgttttccccaactagactgacatagggaaggtactcaacgaatatttggtgactaaatggttaaataagtgaatggcttatagctgtagtagaaggaattggcacaggaaatcaagactgaagtccaagaagtggaaatatatataaggtttattgggaaaagtcacaactcagtaggcacagggatgccctgagcagtgataattaataattaatagttaataataatagcttgtacttattgagtgcctgctctgtgtcaggcagctgttttaaaggttgtgggtaattcattccctagaacctcacaaaacaaatattgttatcccctagggataactaccgctagggttattatcctagctccccctagggttgttgttcctagacagttaaggttaactagggataacatcaagagagctggcccaaggtcaccatttcttcccagcttttaaccaacgttttgagaatacagtattccccatcaaaatcgtggctcaccacggctgtgagtttcacccagcggcctgggtggtcatggtgaaagctagaaatacatctctggaagacattttcaggtatgctacagaggctggcatacccgggctaagagctgctggcctggctaatgaactaagatcactcgttgaaacaacaggtataaatctccaagcagaaaagactcgcttaacatggatggcaaatgttgtctaccaagaagacccaagaaaataatcaaataccctttgccaagaatgtctggttataaaataaagatataaatgacaataacttttctgtattttagcaacaaccagttaaaataaatttgaaaaaatcccagttaaaatagcaataaagaggtaaaatacctaggaataaatacttaggccccaactaagagagtttatgggggaaaaaatcttttctggaaaaacacaagaaggctcaaattacatgtgaattccacccctagctcccccaatctgtttttctcctggcagccgtggttctatatcacatcccacctcaccccttagctcagccacagcacccagctctgcacaattccttattctaaattctgattggcccagttcttccttcataaatttcatatcactgacccaaccttggtctattcagcattggctggaagtatgaggtcagatgctttactgtccactgagctggtgctgtaggttggaatttttctagaagggtcaataagttaagcagccaatgattggcatttccagcacaatctgggagaatacatggataagaataaccaagaaaaatttgaaagtaagcaggaatgctaggggaggggccagtgggtataaaggtgtgtgcctctagataccaagagcttatactatggtatggtgcaacggtggggagagagagacagatcagtggagcataagacaatattaaaaaatgagccgagaatacataagaaattcgtgtatcataaaagaggcatttcaaatcagcagggaaaagatgcatttcatacatttgctgtctaaacattaagagtagaaataaaggtctttcttgagagctcatgctaaaatgaatgccaagggaaatgatgatttcaatgtaaaaaagtgaaaccataaaagactaccagaaaatatcaggaaggactttctaaatacgacagcagagacagaaaccatacaggaaaagggaaaaatttgcactttattaaacacgcaggcacacacacacacacacacagacacgcacatgcgttatacgttgaaaaaagaacatcgacaaaattaaaaggcaaatgagaaactgggaaaacatttactgcatatatcataggtgaagggttaatatccttaaataatacacaggaaaatttgttacaaataatttgaaagaaacaaacttgaattttaaaacaggcaaaattaatgataacagtgaacatttcttctttttttgtttgtttgttttggaagcaggatcttgctctgtcacccaggctagagtgcagtggtgtgatcctggttcgctgtagccttgaactcccggcctcaagtgatcctcccacttcatccccacaagtagctgggactataggcatgcgccaccataactaatttttttttttttttttttttttttagacagagtctcgctctgtggcccaggctggagtgcagcggtgcaatctcagctcactgcaagctccacctcctgggttcatgccatactcctgcctcagcctcccgagtagctgggactacaggtgcccgccaccacgcccagctaattttttgtattttttagtagagacggggtttcaccatgttggccaggatggtctcgatctcctgacctcgtgatccgcccacctcggcctcccaaagtgctgggattacaggtgtgagccactgcgcccggcccataactggctaatttttaaatgttttgtagagatagagacaagatattactatgttgtccaggctggtctcaaactcctgggctcaagcagtcctcccaccatggcctcccaaagtgctgggaatacaggcgtgagccaccggacctggcagaacatttcttaaatgttcatcttcaccagcaactttatgcagtttccatgcagtatctcactgaactcttactaacctaggaattaagcattattattattccagtttccacacaaggaaacgaaaacttaaaagggttaaataactttccctagagtcagaaagttaataactggaagagccaagagttaagcttagatgtggctactaattcacccctatattgacatggactgcagtgcagatcttaacccaggaaatggtattttaaattctgccaaagtttatacaatagaagcttatccttcaaatggaataattacgtattcgccaaatgggcggggttagaagagggcagggtatatcaggcggttgaagcaaatcgtcacccaacacacaagtgtttacatggtgttattggctctattcattctcctctccaggaacaaaatgaaagatcgtcaccaaattatagtgtccccttttcaaatgtgccatgcgtgtgtaattacagcttctaacattctccacttttcatgctcagacaatctccgtccactcagtctcaattaaggtttccctactttttttgtcttttgcaaatttttggccttttgtttgcagttgtgggcatggcagtactgatgtgttactcacggtggtagtacaagaggtgagatttttgtaatacccagataaaccctaaaatattctactttacatcaaaagtatagaaaagtctgtgctgagaagttttactctctgtctactttattctctcttgcctccatagatgaacacttgtattaggttttttttttctttttttttttttggtgtatcctgccagaggtgtaattaagagtcgactttccccggttactcaggaggctcaggcaggaggatcacttgagcccagaagtttgaggctccagtgaactatgatctcgccactgtgctccagcctgggcaacatagtgagaccttgtctctgaaaataattttaaaaagaaaggatacacacttaacttattgcacctcgctttctcacacacacaaaaggtaccatgtaatatacacacctcagcaccttgatttttttgtttgtttcacttaaaaaatacaaccttggtcgggtgcagtggctcacgcctgtaatcctagcattctgggaggccgaagcaggcggaccacttgagcttgagctcaggcgaccagcctgactaatatggcgaaaccctgtctctgcaaaaaatataaaaagtagctaggcatggtagcgtgcaccagtagtcccagacacttcgggggctgaggcaggaggattgtttgaacctgggaggttgaggctgcagtgagccgagattgcactgctgcactccagcctgggtgacaaagtgaggccttgcctaaaaaaaaaaaagaaaaaaaaatgagatttttttccatattaatgcagagaacttcctcattgtactttatacctgagtagtcttccattatgtggctacactatgatttatttaaacaaccctttcccagtgacacttagcgtgtttaaatcttatgctaccctaaacagggcttcagtgaataactgtatctgtatattacttcctatgtatgcaggttattttaccttcgtccaacgtgatggagtgaaaggtgaaaagaatttgtaattttacaaaagcatttgtactttggataggtagtgccaaattgcccccacaggatgacaccaattggcccacccaccaggaatatgtgtctctgtttctccacagcttttcaacagaaactgtcgggatgaacatttaaaattttcattttaaaattttaaattgtctacttcattttaaggtgcattagaaaaggcagtttgcatattgatcccatgagttcacactcttagtttcatttttaaaaataggtttatttaaataaaaatggcagtactgaattgaagaaaaatatcaagtaaatattatgttggtgcaaaagtaattgcggtttttgccattactttcaatggtaaaatccacaatgacttttgcacctacctaatactgttacaggttgaatgcaggcatgcgaagttatgacagctcatgactgaagctggggaaatgttgccatgatgattttttctcttgggaataataaaatcaagaggttttatgttctgtgtgcaggacactgtgcttgaggttttataaagtggatacggttattggacccattttatggctgaggaaccagagactcagggtggttaagtcacttccctgaggtcacacagctaactctggagcctgcgcttgttaatttccctctgttctgagggtatttccaactgggaccttcaatttaaccttgcctacctaccccatgggaagtagagcctcaggagctttcatagcttgtaaatgtccagggatgacacagtctgaacttgcaatttgcttttcctttctcctctatggatgctgttagcttgtgttttctctctgtgtgcctcatttcagcttccttattcctgcagttttacttcagcccaaccagatttcagcccacctgtgggcaaagctgcacagcccattcagactgagagagacttttctttttctttctttctttctttctttctttctttctttctttctttctttctttctttctttctttctctttctttctttctttccctccctccctcccttctttctttctttctttttttctttctttctttccttctctctctttctttctttccttccttccttccttctttcttttcctccctccctctctccctcccttcccttccttcctctttctttctttctttctttctttctttctttctttctttctttccttccttccttccttcttcctttcttcctttctttttctttcttttctccctctccctcccttccttccttccttccttccttccttccttccttccttccttccttccttccttccttcctccttccctccctccctcccccctcctccatctctctcacctgtgcttcctttcctcttagctgcctgtgtctgggattaagtgatgacctaggatctgcctgtctttgatgctggggattgtttttcactataaagactctggtttgggggtggcagggacccaagtactctgtcactggccggtgctgaatttgtgtgagatgaagagtgttattgtctataacccccgtgttaggtgggagactctctggggaggctgaggagcaggggggcagccaggggacactgaggggttcccactcggctggctgcatttctggagtctgacaaacttggcttccagtcctggctctcccatgtccttgctttgtgaccttgggcaagttacttctctgagcctcagttttctcatctggaataccaggataacagtctaactcctccatcactgggctgtcaggagaatctggggacatgacatagaggactcagcacagtgcttggcaggtagtatgtgttcaattcaataaaattggtggcagtaaaagtcacattcgacggttattttgttgttgtattcaacaatctcttgaataaagattggaaatggaaggaaatttgggaatccaagcttgcctaataccaggcatgtggagatggagcctcagcaacaggaaatactgggaagaggaatcgtgccaggatcctgtggaaacctgatttccaggggtgggcgagatgactggggatgatcaaggggtgatgctgcggcaggagtgtaatagtttcaaacctgtttttgagagcacttgagactgagtcagacaaactcactcgggagtttaggggatgtgttcacatggggttggattccagcactgttgggaagaaggtagggagtctggcagaggtcccaaatccaaattcctacagggtccaggcaggaaaggggaaagagagaagcaggcctggtgtaagacaatagggaagagtggggactgtggaaaactagaaagtttattacttatctaaaggggaaaaccactgctcagcccacagaaatgagtgttctgtgttgtcacagctgatgatttctcaaaaggaagcaatatttcacattttttattctttctttctttcttttttttgtttgagacagagtctcgctctgttgcccaggctggagtgcagtggtgcgatctcagctcactgcaagctccgcctcccgggttcatgccattatcctgcctcagcctcctgagtagctgggactagaggtgcatgccgccacgcccggctaattctttttgtatttttagtagagacagggtttcaccgtgttagccaggatggtctcgatctcctgacctcgtgatccgcctgcctcggactcccaaagtgctgggattacaggcgtgagccactgtgcctggccaaaatttcacattttaatctgatagttcctgacttaaatatagtaaacttatttggatttctaagaagcaccttgttggccaacggtagcttctttacaggcttgatatagcttctgggttccacactgtggcccctgggcatgaaggagggcccaggccagggatgggacaggctctaggtggcctggaggtgtctagtcagtgtggcctgggtgacgaggatctgatgtaaaatgagactaggggagggattgaggcagagatggaagctgtgtctttttttttgtttttgagtcagagtttctctctgtcactggagtgcagtggtgccatcatggctcactgcagccttgaattcctgggctcaagcgatcttcccaccttggctgggattacaggcatgagccactgctcccagccaggaagctgcatctttgaatgcgatcagaaccaaaccccatagagggagtgatggcttacaggccatgaggattcccagactcatctcaggcttggtcaatacccacagcatcaaggctaggaagggaatgtattttggttaaaggcaggactgatacttatttatttattttgagacggagtctcgctctgtcacccaggctggagtgcagtggcgggatctcggctcactgcaagctctgcctcccaggttcacaccattctcctgcctcagcctcctgaatagctgggactacaggcgcccgccaccacgcccggctaattttttgtatttttagtagagacggggtttcaccgtgttagccaggatggtcttgatctcctgacctcgtgatccgccagcctcggcctcccaaagtgctgggattacagacgtgagccaccgcacccggccaggcaggactgatatttaacctgcatgccctggcactactgtaccagtggtggaaatattgaaatactctgaaaccgatgggtaaatagccactgggtcctctgggccttttcccccaaccttccacttacccatatctgcctctgccagctcctaccacaccccctccatgacgtggtgactagagtgctaactcccagcacagccaggctctgctgtccattccgtttggtctgtgggcagtccctgagccaaggcaattatagatatcttgactcacccctggttgtaggtaacatgcctacctggattggctgaagcacaaaggacaaattttagaggacacagggaggcagatggaattggaaggcaggatgccagaaccccagggaccagaaccaggagcttcatccctggggtcatgtagtctttgtctttgtttctccaggttcctcagagcgcaccataaaaatcagcaccaactgtcatttgctacaatgtggatgaacctggaggacattatgctaagtgaaataagccaggcacagaaagacaaatactgcatgatctcacttagatgtggaatctaatgaagttgaactcacagaagtagagagtagaatgatggttaccagaagctgggggacagcaggaggcaggagtagggaagaaatggagagttgctgagcaaagagtacaatgtttcggataggaggaattgcctttgagatctattgcacagcagggtgacattagtcaataatatgtatgtttcaaagtaattaagagagtaaatttcaaatatctcaagctaagaaaatgataggcaagttaggtgatggatatgttaattttcttgatttaatcatgccacattgtgtgtgtatattcagaacaatcagaacaatcacattgtaccccataaatgcatacaattataatttgtcaatcaaatataaaattagcagcctcagccctggaactgtatgtctgctggcctcaggactgattacctgtgtcccagccactcagcatatgtgacccttgagccaagtgtccacctctgccccagtcagctgtgttcagggaatgtggatgtctcaaagtacaagcatggcttttgggaggtgcccatctcagagatggcattgggctcaggcaggcatggaaaggtaccctgaaagatgcaccttgagggtcgtggagggagtcatgaggaccacaggtgtaggagtgtggctttaagctctttcaggtagcaggaaggaggagggaagaatccactgaggatgacctggtttgtctggtctgaaggattggggcagtgggtgggtagagttggtgcctacaagtatgatccctcatgaaagcggagggaggggaatgaggtcagaggagctctccagcagcctctaaataagccgtaagaagtcaatgtttccctgcaacttgccgattggttttcctgtctctcatctggctctaatctgtgctgcacagccccttctaagtcattttcctaaaatagcatgtttatggtgcaggggtttgcagtggccaacagcgatgattgcagccctacagctgtcacaacaacccattgaccactgtgtgcaatgctgtgcttgccacgggcaaaacacttcgtctcttagttcttcggtttcctcatctgtaaaacaggggtagtaagtagtatgtactttatagggctgttatgaggatcgaatgcattaatgcctgatgaatcccttaaaatagtccctggcatgaataaatgttccataaatgttaactctcacttattaagtatttattgagcatcttctgtatgccaagtacagtttatgccctgagagtataatgatgagcaaaatttcctcacattgcatgcagtgaagtgtggaagagatgcaattaagcgtgcatttataagtcagtggtttaagtgccgtgatggagaggatttagaatataagttccatgaaagcagaagctcttttgttcacagctgtatccccaatgcctaggaagaacttgaccctcagtatacatttgctaggtgaatgaacgaatgagtcaagttctatcttagccgcacatgaagatgaggtgtcaatggagtaaagttgggagtgaggagagaagggaggggaacttggtgtgaaccccatctctgcaagggtccagctgggtggccttggtgaagttactctgtagttaggatctgtttcattgttgctaaaatgggaacaaatgataccttctgcatggcatgtcataaggattggagagagtacatgtgagacacccagcgtacacatgtagctctcaagcagtgtgttgagactgggtgtggtggttcacacctgtaatcctagtactttgcaaggctgaggcaggcagatcacttgagcccaggagtttgagaccagcctgggcaacatagcaaaaaccctgtctctacaaaaaataaaaattagccaggcatatggcatgtgccttcagtcccagctgctcaggaggctgaggtggaagggtcgcttgaacctgggaggcagaggctgcggtgagctatgatcgcaccactgcactccagcctgcatgacagagcaagaccctgtctcaacaagacaaaaaacaaaacacacacaaacacagaaatgtgtttccttttcccttcccattctttgtgcttcttggtatctcctcttgtttaagagactgttgatatggagaaaggtctggatcatttttggtcagaaatgcttgaatccttgtcttggagatcgctcaagaaaatatttacatgaagaaaagtgcaaaaccaacagaggcaacttattattagttgtgattttgccccagatcttaaagtagagctcacaaggccttgaggaactcctttcttctctactaggcaggactaaggaaattcaaacctgaactcaaacctaactcttggcctctgtaagatcaatatatcagagaaaccagaagggaccacaagagccaagagtagagacagaatgtgtcctaggtcttggagaggagctggctcaggccacttctaccaagggtctcagggcaatactataagacttggacccagtagcgtcctgggagaagtgaaggatgtaagggagaaggagaagagaaagatggcaaggatgccttttaacctccatgcgagctccaccactggggtctggccaatccgtgtcttggaatccatccaattaaatcaactctgcctccttagaggttaagtaggggtgtaagagaacctggagcttctcctacaggccaataccagtcatgaacaggggttccttttttattattattatactttaagttctggggtacacgtgcagaatgtgcagttttgtttcataggtatacacctgccatggtggtttgctggacccatcaacttgtcatctacattaggtatttctcctaatgcctcccctagtcccccaccccccgacaggtccaggtgtattatgttcccctccctgtgtcgatgtgttctcatcgttcaactcccacttatgagtgagaacatgcggtgtttgattttcgaacaggtgttcctttttaggtgggtttgaagcactgaactcccaactttaaggtgaatgtccaagaagcacaatgggaactgttctgtggcacagagcagggggactctgataggaaccttatgtattcacttagtctcattgtccggagatagagacatggctggttaagctgccaaaagggatcccttagttttttggggggtggatttccaagccctgttgttgttactaggacggcacctcaatctttgagcaggacagatgattgctggggtccttttgtagctgagagcactcagggtcccactggcgacagcagaaaagacctcgcttctcaaacttggctgtccagtgctctggacgagtacttcatctgcctgactgcagagggtgggaacgttgtgaaagaaactttgtagctcattaacaagataagaagcaaccgaagtctgcagtggctgaggattttcagtcaggtttattgagacatacgtttcctgtggtaaaagtcactttaaacaattttttttgagacagggtcttgctctcccacccatgctggagtccagtggcgtgatcatagctcactgcagccttgaactcttgggttcaagtgatcctcccaccttggcctccctagtagctagaactacaggcatgcaccactatgtctggctttaatacatatatatagtagagacagggtctcactgtgttgcctaggctgatctcaaactcctgggttcaagctcaagcagtcctcccgccttggcctcctaaagtgttgggattgaaggcatgagctactgtgcccagcaaaattcactttttttcttttttcttttttttgagatggagtcttgctctgtcgcccaggctggagtgcagtggcatgatttcagctcactgcaacctctgcctcttgggttcaagcaattcttctgtctcagcctcccaagtagctgggactacaggtgcatgccactatgcccagctaatttttgtattttaaatagagacagggtttcaccatatcggtcaggctggtcttgaactcctgacctaaggtgatccacccacctcggcttcccgaagtgctgggattacaggcatgagccactgctccaggccacaaattcacttttaaaaatataaagtaaaattcatcacagttaatatatagaccactccaatatccaaaacaaaaaagttgctgcatctgcctctttttagttaattccctatccacctccaaccccttttaaccactgatgttttctgtccccatagttttgtgtttttcagaacatttagaaatgaacctacacttgtgttgaacatctttgttttaccagaatcctttcgaggttcatgaatgctgctgcatgtgtcaatagttcattcctttttactgctgaaaagtattccactgtgtggatgcctcacactgtatccattcacacgtcgaacgacatttgggtcctttccagtttggggctattataagtaaggtagctataaaccttcatgtatggatatggttgttgttttttttttttccccttctctgtcacccaggctggagtgcagtagcacgatctcggctcactgcaacctccgcctcctgggttcaagtgattctcgtgcctcaccctcccaagtagctgggactacaggcatgtgccaccacaccctgctaatttttgtatttttaatagagacagggttcctccatgttggccaggctggtctcgaactcctgacctcaagcgatctgcccgcctcggcctcccaaagtgctggaattacaggcgtgagccactgtgcccggcctggatgttttcatttcaccgaaaagtaggattcctgggtcctaggagagttccagtttatgttctttcttcactaacacttggtatcgttggttttagttttcaaacattttagcaactctggtaggtatgtgatatggttaggctttgtgtccccacctaaatctcatcttgaattgtaatcctcataatccacacatgtcaagggagagaccaggtggaggcaattgaatcttggggcagtttcccccatgctgttctcatgatagcgagtgagttctcacacgatctgatggttttataaggggcatgtccccctttgctcggcacttctccttcctgctgctttgtgaagaaggtgccttgctttcccttcgccttccactacgattttaagtttcttgaggcctcctcgtcctcaagaaaattgactgttagtcaattaaatctctttcctttgtaaattacccaatctcaggcagttctttatagcagtatgaaagcagactaatacagtatggaattattttaaagttttgaaaagaacagtttccttaggagaagcactcatcacattaacagcacataaaagaatatctatgtagtatgtctgtttatttgcttacatgttcattttctgtcactagagtacaattttaaaggaggcatctgtggcagcatcaataaatacatgtgaatggatgaatgaaggaaggaagaaactggtagcatgtaccaaaggctagggtgtcagatcagccctggattggaacctaaggcccatgttattaacttctgccatgtacttttttttcctttttttaagagagagagggtcttgctctcttgcccaggctggagtgcagtgatgcaatcatagctcacacatagccttgaattcttgggctcaagtgatcttcccacttcaacttcccaagtagctgggactacaggcatatgccaccacacctggctaattttttattgttgtagacatggggtctcactatgttgcccaggctggtcttgatctcctggcctcaagtgatcctcccaccttggcctctcaaagtgctggggttataggcgtgagacactgtacctggtctgcaatgtataacagagaaagcaacttttacagaaagagttctcttgaactaaaaccaattctgtgaggaaagaatctcttgaagaagaaagagaaatgcagagccaaaggcttacaaagggcatggtctgtttgggagcgggggtgcgctctgagtgctgagaatgtacatagtatgtgtgcatgtgggtgggtgggaggagggggcttagctggggatcaccttggccaaatagtaatagcaatcatggaaagcttatgctgcttgctatgtgccaggtggttctaagacctctacacaggttcattcatttatgcttcccaacagtcttataaggagagcactagcattatcagcattttacagatagggaaactgaagcacaaaaagatcaaattagctgggcatggtggtgtgcacctggcattccagcaattttggaggctgaggtgggaggatcatttgaggccaggaatttgagactagcctgggcaacatagtgagacccccctctctacaaaaaaaaaaaaaaaattaaaaattagctgggcaggttgggcacagtggctcatgcctgtagtcccagctactcgggaggctgagacagaagaatcacttgaacccaggagacagaggttgcagtgagccaagattgtgccactgcactccagcctgggtgataagagcaaaactctatctcaaaaaaaaaaaaaagatcagctcagcatagttgcatgcacctgtagtcccagctactcaagaagctgaggcaggagaatcacttgagcccaggaagtcaaggtcccagtgagctataattgtgccactgcactccagcctgggtgacagagcaaaaccatgtctcttaaaaaacaaaagaaaacaaaaaaccatcaaacaacttgcacaaactcacacagcttagagccccggaagtttatccaagtctgccttttaccactgcactgcactgccaggctatcaagggcatatttattgattaggaaattatgtaaggttctgtgagaaatagctcccaaaatatagtgacttaaacaaggcagaaattaggtttttctctcaggggtcagcccaaagggacaaaattcaaggctggtagggtggctttgtcctttccacatatggctccaagtttgggtccaggacagtcacttccagttctcaccatctttgaaccagtggggagagggaaaggctcaaggaagtatgcatttccatttgaagggaatggccctggagcacacacatcccattggccagaactcagcaccatggcggcacctgcaagaggtgctgggaaatatggcctctatctggatagccatgctctctgctaaaactcaaggattctactattaaagggaagaatggatattggtggaaaaccagcagtctctgccacaacttgcagactgtccactgggctttgaactttattctgtcagtgatgaggaactggcaatggtttctaagcagggagatttcacatccagacttgggtttttgatcactgcagaagcatgcttggagaataaaggtggggagaaagaaaagtcaggagccctgtttagatgatgtgtctgttactttgttttcccatctctggagtccctactacaggcaggagcctgtaggttgagttcccaggcaggcccagatggagggtttgcaggcagggtgagtgagcatggggctgcaaagggaacaatcatctgtctttgtccttcattccttccacaactatttatccagcaccgtttctgggcacagggctccagcgatggtcccaacaggtacaatgacctctggggaccaagttcagttcttggtgagttctccagtgcctctcgatgtaggatgaaccgttggcatgctccactgacgctggctccttctgttgtttctcttggctccaggacccccgcagcaaacacaagtttaagatccacacgtactccagccccacgttttgtgaccactgtgggtcactgctgtatggactcatccaccaggggatgaaatgtgacagtaagtactttttctctctgggggcatctgctgatggcagaagcaatgggaagggctgcttccacttggtttggggtccaggtctgccatacattcccccctgtcctcgttggggctggtgtaccagttatctgttgctgcataatgatcctcccaccccaaaacactgtgactgaagacaataaacatttttttagctcatgactctgcaaggcagttctttgaatctgggctggcctcagctgatgtcacgcatgttcataaagcatgaactcatggttcatggtggattagcagatggaggtgggctgggagctgtctgggccatggtggcctcacccacatgtcctggaggatggctggctgtcatctgggtgatggtgatgaccaggccacgtgtctttcctcctcagtgggctaggctacctagcctccgtgcatgcacggaggtcacagggtcctgagtttcttaggagggcaagtcccattggcagccacacttcaagtctctacttgtgtcttttgctcctgatccactggtcaaagcaagtggcatgtgagatgcacagtcacagtgtgggaaggggcagtccatggctgttgacacccagaggcatgaacaaatcatgggcatttctgcagccatgcaccaccactgttttcagcattgagatgtggggctgatgcattctttgcatggagaagacctgtggccctgcagcacccacaggtttgtgctggaggaggaaagagcatcattctctggccaggatgtggtaggaaaggcaggtggggtaggactcctctttatgaggccaaggcccggatggcctgtggggcaggggagcagacaggctttgagagctatggccacaaagctacagggacactggaggtgctggtggctcccacagacctgttggtctgcagcaggctgggtgtcatgaggctagtggtactgctctcccaagggtcctgaggcccagaggacagagggagaaagtcatagggcagagagtgacagagaggactgtgagggtgaataagggtggtagggagcaagacagacagcaagaaacacacatgcatagacagacacagatgcaggggaaagatggacacatgcaaccctaacacagggaggaatgtggggcgtggaagctacagagagactcagctagagagagactcaggcaaaaggagggacaggcagacacacagaccaacagataagccaggtgcagtggttcactcctgtaatcccaacactttgggaggctgaggcgggtggatcacctaaggtcaggagtttgagaccagcttggccaacgtggcaaaacccaatctctactaaaaatacaaaaattagccagtcaaggtggtgggtacttgtaatcccagctacttgggaggctgaggcaggaaaatcacttgaacccaggaagcagaggttgcagtgagctgagatcacactactgcactccagcctgggtgacagagtgagactctcaaagaagaagaagaagaaaagataaaatgattggcatggacacagagagagacgccattacacaggctcatgcagaggtatagagatggaaagaccagagacagagacagaagcacacatggagagccacagagagacacggaggagagaggcagagagacacagttggagaaagggagagacaaagaggccagagacaagtgcagagagtggaacagaccgattcacagacacggccaaggcagtgagccacgtgcagaagtgggacagcagagacaagagacatgcagcaacgtggaaacagagagacagacacagaaacatggcaagagccacagggggacagtgaggttggagccttctgcctgcaggacaccagctcctcttaccacacatggggccctaatatagggacaatgtccctgcctcagagacagtggtgggtgggagctcaggctggtgctcaggtcccagagggctctcccttccctccccacaactcatttctagtttttgtaataggcctgctgcctcctgggacttgggtggtctgagaagggtcccttgcccccagatcccttgaaataggggcccatggggtgacttggcctctccttctggcttctccaactggaactagcgtccccctggagaatcctgggtgcctggcacaccttcctggagtggggcattattgctcaagacctagaagaaatcacccaccacattgaaatagacacagatactctacggaggagtgcgcagagggagtggatatcctataacatgagagatggccgaaggccaaattcagtgtataggcacattttatccaccctgccctggctctaaatctttttccttgtaattaattatggtggacactatggccagcccagaccccctcttcatggtcccaccccatcccctagctgtggttcacagcagtgccccatcctgcataattgcccaagataatgcctcttccagggagaccagatgattgtggtgcccagccctcttgtctcagtttggaacaactctgaagggtcatctcagctctgggctccccctaacatcagctttgattgcatccacgtggcaaacgaacttctccccacaagagcactccccaaaaaccttgtgctcaaaactccccgtctcagactctttccagggagcccaacctattagctgttaatatttaaaaatcagagctgtcacgtacacatcgagattcctgcatacgttgagaaatggggaatgtttttgctctgtttcccacttggcttggccaagtccctgccacccccttagctttcctcactcatgtgaccagccagcctgtgagcattgaagttggtgactctggcttcagagccttaaggggtgtggggtgtgcttgcttcagactgcacccttggctgtgggtggggaacagacaagttctacctcctttgcccatcagggttcagggggaagagttggaaaagcccttctgatgagatcctggcaggcaagttggtctcagccaggctcgtgtgtctcagctgtctcaaaggagggaaacaggaagggctcagcggtcttgggtggggcagatgtctgcagcccccagcctgggccagcctaagccacatcccctctctctgccctcacagcctgcatgatgaatgtgcacaagcgctgcgtgatgaatgttcccagcctgtgtggcacggaccacacggagcgccgcggccgcatctacatccaggcccacatcgacagggacgtcctcattgtcctcggtaggtggccctggggctccactggctcctgaccttgcttgacctgtgtgattgagaaggggagggtggcggaggggtggggcagtccagtggaggggtggggcagtccagggacggggagggggtgtggcactgcttctgccccatgccctgcccatgacagcccctccctgcagcagggggatctttagaaactgtacaccctcaaagcttcgtccatcagcaccccaggctgacttgggttcagagaggagacgtctgagttccttggacttctaacttcctcaggatcctccacttcccttctctccttctcatttcccactcttttttagtaatcttttgggatgggtagttgcatttcctttactcagatagcagagaagggaagcttgcttcttccgcaaacttttccagcaggaaaaatggagtcttgatgataaaccccagatttggagaatataatatcttgggaaggaggagggttggagggtgcaattcaggggctttccacatatttgaaatatttctttcttgaacctgatggtggctatgctgtaattttattattctctatattttctgcatgtctaaaatatttcatgataattagaaagcaggatggtacagtctcctgggagatgcagtgagaggaggagctgctggtggtggtggtggtggtggtggtggggctgtcactcatgtatcccagcattcaagacatacctggctctgatatgggaagttcaagcaaaattggaactcagcagcactggcttgaggaatactcagccataagccccggtataaccagcactgagctggctgggagtggagctaaaactttgcaggaatttcttctcaaaggctagtgacaaactactgtggactttatatatctaatgaatataaataagggtttatgagttggtaactcaggaaattgatcatggaagagattaattttgcaaaaattagtgtttctgaggcctcagactggttcagtagctctgatgcattgagccctgggttgcggaggggctttacgtagattgtgtaaaagctgaaaaatacttatccctgtacaatataattcttttaaacttgagatttcgtgaagcccagtgagattttagaaaatgtgcaatccattgcattatgttttcctccaagtggtcgcctgcctcccagtgtgatgcttgggggccccaggggaaatcccgcagtttcaggttcaagggaagccagttttccccactgattgaggttcccgatgctggtgagacaaatatgagactctgcttccctctggtgtcattctgtgggaaatacactcgttccaaagcatgactgcgggcagccaacatttatgggccgcatgggatgtgcagtgctctaaaccttacgtgttatctctttccaccttcacaacattgtgaaatctctattattcttgtttgagagggagactccatctgttgcccaggctggagtgtggtggcgccatcttagctcactggaacctccacctcccgggttcaagcgattctcctgcctcagcctcctgagtagctgggattacaggcgcccaccaccacgcctggctaatatttgtatttttagtagagacagggtttcaccacgttggccaggctggtctagaactcctgacctcaagtgatccgcccatctcggcctcccaaagtgctgggattacaggtgtgagccactgcgcccaaccttctattattcttgttttatgaacaaagaagccacggctcagagaagttatattccaagagctcacaccatttgcaataataataaaacaatagctaagatgtgtttagtttttaaaatgtgttaatcattgtgaaaagcacttacaggcagtatctgatttacattgtttcaacaactcaaatgagttaagttatcattctacccatcagaaaacacatttcctcacctaggtctgtttgactcaaaagtactatatagtaggttacttttttgtttagtttagtttcgtttcgtttctctatgccctccaccgtatttattccttttgtggtttggctagggcacctcctatgggcattccttagggagtctttgttctgatgtggtacagtacaatatttcttcaagttcaaggtcaaagtcttcccccttaatcatagatatgctgtgaactttgagaacctggatcacaagcccccgcttctcaggacacactgataggaggtgtatccatttgctgtggctgccataacaaaataccacaaactgggtggcttaagacaagacgtttaaaaaaaaaaaaaaagaaacgaaaagaaaaagaaaaaaacaataggccaggcacagtggctcatgcctataatcccagcgctttggaagaccgaggtgggtggatcacttgaactcaggagtcagcctgggcaacatgtcgaaacatcatctctactaaaaatacaaaaaattagccaagtgtggtggtgcacgactgtaatcccagctacttgggaggctgaggcaggaggatcacttgagcctgggaggtggaggttgcagtgagctgagattgcaccactgcactccagcctgggtgacagagcaagactccgtctcataaaacaaaaacaagaaaaacaaacaaacaaaaaaggccaggtgtggtggctcacacctgtaatcccagcactttgggaggctaagacaggaggattgcttgagactaggcgttcaagaccagcctggccaacatagtgagaccctggcatattgtaggatttcatttctttgggatgttcagagcaggcaaatgtataaagaagtttaatagcactttgtgcttttccaaatactttgatatcacaccattcgggaaagggcacgttgttgccatcatggaagggaaaacgaagtctcagcaaggctgaacaccctgaccaatgtcacatgctgagcaggggtgagcacctgggcctctggccccatgtcacaatgccctgcaattgcccatacaccatgctgggcacagcctgtactcagcatgggcttgttgattgatggatgatagaagagagccctgatgctgtggccgagttctctaaaaatagagccaagatggggattttgttccagtgatttattgggctgctcatgggaaaagagaagtgaaggaaccatgcttccttcctcaggcagggaaaaagcttggcgagagtgtggtctccgtggaagtcttcttcagcctggtatctggtggaattttgtaccaaacactgtagcacagtcagtcccatcttgaggcaagggggctgttctgtcgtgttccaggtcagtcagtgctgtgggatgacttgtgtctcccccagatttgtatcttaaagcctcacccccagtgtggtggtatttggagctatgggacctttgggtggtaattagggttagatgaggttgtgagggtggggccctcataatgggatttgtggatttctaagaggaagaagaaagagagatcattctgtctccaccaaaggaaggatacagcaagaaggtggccgtctgcaagccaggaagtgagtccttaccaggaattgaagctgctggtacctcgatcttggacttcccagcccccagaactgtgaagaaataaatgtctttttttctttttttctttttattttgttttagatggagtcttgctctgtcacccaggctggagtgcagtggcatgatctctgctcactgcaacctctgcctctcatgttcaagcgattctccggtctcagcctcccgagtggctaggattacaggcacgtgccaccatgcccagctgattttttttatttttagtagagacggagtttcaccatgttagccaggatggtctcaatctcctgacctcaagtgatccgcccgccttggcctcccaaagtgttgggattacaggcgtgagccactgtgccggcctaaatgtctgttgtttaagccacccagtccatggtattctgttatgacagcctgagctggctgatatagtcagttactgctgtaggctgctggggatggaggtgggaaggtagagtaacttcccaggtgaggaggcttctgtgcagttgaggacagttatctggacataggggtaactgtgagccattaacagccatcatacacagcacccaggggatgggtgcattggccagcatggaggggagctgggcagggtccaacagcatctggcacactcaagtttcccttggtctcctgactgtcttcctggtttcattgctgggactccagccccctcctccttggtcttggcaagacagatcagagaggagcgagcactaaaggttgtgcggggtccttcccagcagtgccaggccagaagtggccttgtggtgtttgtggaatggccccacctcatccagacccaagaagcatggtcagtattaggattttccactgaccatcagcccaggacactgccgtttgccctgagtgtcatatgttctttggaaatctcagcatctctagaggtcaaaggttttctaacttgcctggctactgaaattgagctcatatatctgttcttagtgttttggcaggtcaagatgagaataaatctgatcagttctcctccttttaaaaacccatcaatggtttcccattgtctttataacagactaaatctaacatggcgatctcattctttattcactgtctcctccccctttcttttaatccttggtcctctgcagactgccacacaccataagacatctgtgcgttctgtttagaatgtttgccattgccatcttctctttttctagcaattaactcttcctctcgatctcggttcatttttaccatctaataagcttcctccaacttccccctttcgtagacactcatggtaacctgagcttggccttgtgaaaggggtgattttatgttggatttgattaatgtctgcatctcatcacaaggcattagctccatgagggcgggactgtgtcttgccactctactcccagcacctagcaaggtgggcatcactaaatatttatgggctcaatggctgtatgtatgaatgagaaacccctggaggatcctgatagatagatataaggctttcactgatggtccccagatcagtgcctcctaaagtcaggaaatgaaggtcaacggattgtccaatttataccattattctcatgggaggtagaacatgcagaaaatcttaagtaccaggtccaacgtcaacagcaaatgttactgggactgagacccgcttgttggagtcatgaccacccttgttccctggacaatgtagaaaagacatggagcagtgggatttgtagtatcccaggaaaccgtattgacatcatgatgcccataggtgtcatgagatcaggcaatacaatgtccagatcagagttgtaaaatgctcccaaggtttgtgaagcctgcgtgttcatacatgcaacaataattttttttgtgtgtgtgtgacagagtcttgctgtcacccaggctggagtgcagtggtgcaatctcagctcactgcaacctccccctcccaggttcaagccattctcctgcctcagcctcccgagtagctgcgactacaggcgcatgccaccatggccggctaatttttttttgtatttttggtagagatggagtttcactgtgttagccaggatggtctcgatctcctgacctcatgatttgcccacctcagcctcccaaagggctgggattacaggcgtgagccaccgcacccagctaacaatatcttattcaatgctttttcaattcagtatctacctatcaacataacaactgacatctattatttatactcccatctacattacagccacctccaaatgcttagccatgtccatcctcatatctatctcccaaaagttgggagtgttcttaaagaaagcagaaagaacctttttttttttaaatgtttctctttggaactcccattctatattcttaccattatattgtgttatacagaaactttttagactgaaacatctccctgacagccttaggtactcccaatattgtgatatttaaatccttcttaagatctgacatccacacatcaaaagaaaaagagtaccaaagaggctgagtgtggtggctcacgtcggtaatcccagcattttgggaggctgaggcggctgtatcacctacagtcaggagttcaagaccaacgtgacaaaaccctgtctctactaaaaatacaaaaattagccaggtgtggtggtggatgcctgtaatcccagctactcaggaggctgagacaggagaatcgcttggacccaggaggcagaggttgcagtgagctgagattgcatcacagcactccagcctgggtaacagagtgagactccatcttggaaaaaaaaaaaaaaaagaattgggaagaaaaagggcaatgtaaacaagaaaaaaaaatccagatagcttaatatttatttttgtttaacttttatttgaactttggtgggggggtacgtgtgcaggtttgttatataggtaaacttgtgtcatgggggtttgtgtaatattgcccagccatgcgtcaattgcagacagaaaattattataaactaggccgcgagggcccactagggggcagtctctgccttcaaagccattcctcctcggaggctctctcaggagatgccccaatttgtgaaaccacagtactgtcattgctcataatggaaggtgcagcagagaccagctacgctcactgaggtccagagaaaggttacttcttcaggtcacacacagatagggcccagttctggtagatctcccttcccttttacattattggtttgtaattttttcccaagtctttattttgaactaagttgaaagaattttacagcaaacactcatttatccaccacctatattctgtcgttaacgtttccacacttgcttaatcacatttccaactatctcgctctccatccatcaatctgtcttatttttgacacatttcaaagtaaactgcagacaccaattcgatttcccccaaacacttcagcatgcccaacatcaatagaattcaaaatttacttgtagggtttcttttttttttttaacttttgaggtgaaatgtacatacaatgatacatacaaaattttttttttttttgagacagtctcactttgtcacccaagctggagtgtagtggcgtaatcacggcttactgcagcctcgacctcccaggctcaattgattctcccacctcagcctacaaagtagctgggactacaggcatgagccaccacactcagctaatttttgtagttttgtagagatggggttttgccatgttgcctaggctggtcttgaactccatggttcaagcaatcctcccactttggcctcccaaagcgctgggattatagatgtgagccactgtgcccggtgatgtcttaagtgtacaatggctgagttttgacaaatgcatatgactgtcattctaacccttatcaaattaattctcttttttgatgtcacagctgctgttgaggatccaagggaaggtatgaaccagagaaatgcctttatgtccccacacactgcactcatactcatgagctctggctattgggatgtctattatacctaaaatcccttagatgacatgaaacttaatagttgttcaattttttttgtttgttttttgaggagttataatgcagtaaagtagaaactttgaaaattggaaattcttgtttacaattttttgttatgtattcattgaagagcaaaatgcctttaaaaactcaatacacctgctttattttgctttttttttagtattgttgtaatgaagaagttcagttaaatcatatctgtctatggaacatctatcatctttctcagtgtattactgatagttgtctgcacaccccatgaggccaggggaagggtctcttgcccatccttccttcaaagcctatcagcttgttaggttgaggtgagtgtctcaggcactgaagttttgggatactggacctaaggagatgtagggaagctgacgtcttgctattcagtgttccttctcttcttccctggtcatttaagtctcatgagaattatcaaggccaggccagcgtctgaggccttcaggatgtgctgggcgcggtcattgctcccaaatgtctagggaattgcattgaagtgggcactgctgggacctgcagggctgtgacttgtgactgcctttggggacagtggtccagcaatgtctattaaaatatgtatacatatgaacattttgactctcacgttttcctttagggaatctattctcttaaaatgaaacaccagcgtgcaaagaaataaaatctagaacaagcatgtttattgatgttttctttgagatgcaaagaaaacatcagcctaatgaaggggtacccattttatgtgatactaggtagttgttgaaagcattgaattaggccaggcgcggtggctcacacctgtaatcccagcactttgggaggctgaggagggtggatcacttgaggccaggagttccaaaccagtctggccaacatggtgaaaccccgtctctactaaaaaaaatccaaaaaattagctgggtatggtggtgcatgcctgtaatcccacctgctctggagggtgagacacgagaatcacttgaaccctgcaggtggagtttgcagtgaacagagatcaggtcattcatgcactacagcctgggtgatagagtaagactctgtctcaaaaaaaagaaaagaaaagactgaattaaaatgagaaaatgagtataatttttgacatgggaactggttacacaggtgaatttcctttgtgagaattcaagctgtaagattatgatttatacacttttctataggtatattatacttcctatacttttattatttaaaagtttgtgataaaaattctaaataactaaaaacaaaacaccaatgggttagagctacagatattggtgtaaagcagaggttgccaaactggcctgctgcctgtttttataaataaagttttattggaacacagccacatccattcatttatatattatctatggctgctcttgtgatacaatggcagagttcactgcgtagttgtgacaaagcttgtacaatctgcaaaatgtaaaatatttgttctctggcctttactgaaaacatttggcagtccttgaactagaggaacatctatggttaagtgaaagggttaggttgcgtaaaaatatatttagtatgatctcattttgaagaaataagcaacagcaacagacacctcctatgtgtgaagttttgtctgtatattttataacctgtgtgtgaagaaaggtgtggaaggataccaaccaggttgtaaacactgggatcgcagcaggattgggagtgaagaggctgtggcggtgagggggattgtgttgtgtctctgtagttttcattacgtttcacaggttgattgcaatacatatcatttccgcaatttttgaaaaataaaaacagaaaaatctccaaataggaaaaatgaacagaaataaattgtctcaacaacaatagcagaaaaaaaaaatgaatggataatgccccaaatgatggggtgttggttgcttgaggagggttgttgggtggttctcagcttgagcagagctgggcccaggccctgtctgggtatttttgagtttttattgtcactagcttccatcttgtgtagcatctgccttgtgagctgggcctgttctccgagtttcatggtgtttgatgttttttgccttctttcagcaaggtcgctggcatcatccttgctgagtcgcatatgttctgggaaccacctcctcttctctgtgcctctcgcctggcaggtctacgctaaactgccccctgccctcccaggcccaccccacctccaagtctgagttctttgacttaaacttcaatcctgtttcccatgggctgtggcttcccaaccctcagtttcagttgaagctaatttttttttccagaaatcactgtgggccctggctgctctgggtgtggtctggggaccagctgcatcccatcggcattacctgggagctcgttagcaattcgggatctcagcttcccctccaggcctgctgaatcagaatctgcaatttaacaacatcccctggggatgcactgtaacattcgagcagccctgctgcagaggatcgcagtgagacgggaagaatgtgtcttttccactagatggcaggccttacctgcgcttggctcctgcgcagaccaccacaggtggatgtgccaggggtgatgtgaacctccagccccgcgttggccatggcatcttaccagtcatgaagctcgggtgtcagtcccgccagggctggaatcctctttcattggtgacctgcacctacctgcatgtcctggcctggtgcagcatgagcttctggcttgagccatttgtgtaaagtgacccagagcctttctttcttccctgctttgcctttgtcctctaccacctggaaggtgaaggcatgtctctggggagcttcctagtcattagcctctgtgttgcttttctggatggcttgctgcacgtctctgctaattttaggccaatgtggtctatgattacaaaggttttgcatgggctttggagtcaggcctgggtttgaatcctgcctttcccactcctccaacaagtatttgttgggggcctcccatgtgctgggcactgcttacaggcaaggcccctgtgctcatggcctctgccttctttctaatgatgggagatgaagaggaagcaaacaaaacactttgagaaaacaaggaacactatcaaggaaataaaataaagcggcatgatgtgatagagggtggccagtgggctgagtgtgattagcagggataatggcatttagttgagacctcagggaccagcaggagggagccagcttgctgaaaattccagggaagagtataccaggcagagggagcggcagaggcagaggccagagggaagagtgaagcagcaggcttgtgagtgacaggaactgacagccagtgggtgtgactggagcctcgggatggggaggggtgggtgacgctggaggaaaggcagggacagccagttaggctttgtgagccccatggtgggcttggtttctttctaagtgcatggaaatttagatcccaggagtatctgaaggacatcatgcaaggtcagtgtgtttaggccccaaaaccacccagtgggggcagtcattttgtttttctcattttacaaaggagaaaacagagccttgaaaaatctgagcctggtgtggtagcatgtggctatggtcccagttactcaggaggctgaagcaggatcatcagttgaggccacaagtttgagaccagcctcagcaacacagtgagaaaaaaagtcttaaaaattagctgggtaggcagggtgcggtggctcatgcctgtaatcccagcacttggggagtctgaggtgggtggatcacaaggtcaggcgttcgagaccagcctggtcaacatagtgaaacctcatctctactaaaaatacaaaaaaaaaattagctgggcgtggtggtgcgtgtctgcagtcccaactgctcaggaggctgaggcaggagaatcgcttgaacccgggaggcagaagttgcagtgagctgagattgtgccaccgcactccagcctgggtgacagagtgagactccatctcaaaaaataaataaataaaataaaataaaataaaatacaaattagctggacatggaggcatgcacctgtagtcccagctacttgggaggctgaggcgggaagatgacttgagcccaggagttggtggctgcggtgagctatgatctcgctactgcactctaggctgggcgacagagcgagaccctgtctctccttctaaaaaaaaaaaaaagaatttgagcacccgcctctagtccctaaggcagtgcatggaggaggctggatttgtaccctgggtccatctgtctggcaggttctaacacattaagtcagatgttggaaagatacagtttaagactatgagacattggaacataagaaacacccaccataccagtggggagaggaaggagatgcttcagcactggtagttctcatagtcttatctttcagtggctttagggcacaggttgggactagtttagccttaaggtcttggagaagacctgcttttcatttgcctgttgccccagcactgtggggtcagaatctttcttgtgatcagagtttagagaagggagggagcagtgggctggaggcattccaggtagccctggagaaggcaggagaggcataagttagaagggtgagggaagggaggagggccagtggctgacgcttactgagcccttgctgtgaacccagcacagtgctagccatcgtggggcacaaaagcctgtgcaagatgcagtcgcagctcctgagcagcctcgctgtctggttgggttccatctgctttaccactaccaacaaaaccaagggacggacacctcttactgatagtaaccaccaggcactgggcgaagcacgttgctcagccatgtcgtataatcctatcaacaacctgtagtcccagctacttgggtgggagagagttactgagggcatctccattttacagatggggaaactgagacacagagaaagaggttaaataacttgcccaagccacacaactaggaagatgtggagctgggacttgaatctaactatgccattccagataattaggctcttggacaccgtcttatcctggcactaagtacatcagtggagtgatgatgatacatgatattagtagcagccacttttacttctttcttttcttttctttcttttttttttttttataacagagtctcactctgtcgccaggctggagtgcagtggcacaatctcagctcactgcaacctccgcctccctggttccagcgattctcctgcctcagccttccaagtagctgggactacaggcatgcgccaccatgcccagctaatttttttgtatttttagtagagacagggtttcaccatgttggtcaggctgcctgacctcaaatgatctgcccacctcggccccccaaagtgctgggattacaggtgtgagtcaccgtgcccagccacagccaccttttctaaaacccttccaaatgcctggcttttgctaggaactctacaagcgttccttcaggtaatcctcctaacaacttttgctattacccgtagtccttctctccattatatggtgaggaaactgagactttgcttcatatgactccattttccccaacacttcctgctagcctgttttgctcctttgggagtatgagagtcagtgtttgctggactgtgaggctgaagatgataacatttcttcaaattggcctgttttttttttttttttttttttttttttttgcagaaagacagatttcactggccaagatctgcccaagaggctgaataaattcctaggttgtgagaagcaggtggatggagaagactttctctccaaacctccctgtgttaggaccagggaatgggttatgtgaatctggcaaccctgtcccaccctggacctgcaccctttaccactaccctggcacatccgggacctgcaccctttaccactaccctggcacatccgggacctgcacccttaaccactaccctggcacatccgggacctgcaccttaaccactaccctggcacacccgggacctgcacccttaaccactaccctggcacatccaggacctgcaaccttaaccactaacctggcacatccaggacctgcaccgttaaccactaacctggcacaaccaggacatgtgcccttaactattaccctggcacaaccgggacatgcacccttaaccactaccctggcacatctgggacatgcacgcttaaccactactctagcatcatccgggacctgcacccttaactactaccctggtctgcctccttgagtggcccagggaacatctagaagctgagagaaagagagggataaaaccaagttcacagcagtatcctaagaaagtgttctcacttaaaaatgcaaagatgctcacagagtgttcaggttacactggaaaactccagaaacaaagtggtttgtgtacatgggaggaagcagaatcaacttcccaccttagcattgtgggtgcttagcccacgcctgtgtatcgctcagggaatcagagtcactataagcatcatggaataagggatttactgtacacgttagaccttatacaagcttggagatgctggagacgggaagatctggaggggtgaattgagaatcagaggaagagcagtggtgcaggtggacaagtaggagttggtaggggatccaagaagccaagcacgttgagctgctgacatagatattgatgaatttcatgaagcttttacaggcactggtttcacccttgggtaactcagtacaggtatgttgacagccttccactaattcaaagatggttcataggtgtcccagaatcttttaattcccaagtgaggcagccccaactccttcagccatttactttctaatccttaatccacagcccacaacctcaaacacatgatagggccgagtatgccatcattgatgtcaacccggaactcttcctagacaacactccagttggagtagcttccttataaagcagggtgcccagagtgaaagagaatccacctgtgttgccgaggagcgaaggattgtcactttccttattctagatcagctgttttcaaacctttcggcttccagcccatctaggttttatgtaacacacacacacacacacacacacactgcacaaacaagcacaaactcacaaacacacacacattgcacaaacaagcacacactcacaaccaaaaccaaactgccattaatgcttacctctacttatgctcaccacacactctgatacattctcctctcttttgtggccctcttttctgttcatttccattctatttcctttaagaaaccctttaaggaaaatgctcttactctgcaaattgatttcactaacaattggcaaatgtgtcatgacccgccgcttgaaaaacactgtcctagacaacaaaattctctttctgcatcctgagatgatactactcttttggggggtctgggggtaccaccagccacattgcactgttgacttatcttgggtttatgatcagttaaagctctcttgtctatcacatcgggtgctgctagcctgcaggccccacatccttgtgcaagattttttttttttttgagactccaggatgaaacctgatgcatttcatcttgtagggtttggccttttgctccacggccaggctgagagcttttgggtcttcctgttcttgtgccgagtgtcttccggacatcaccttcctcacaccattctctgtgctacttgttctgccctccttacttttgaaaagatagtttattactcatagatgaggagcaggcgtgccactccatgaaaggccacacagggaagcagcagggtctgccaggaggcagaggaagcggaaagaaaacgtggcaggagcatttgctgctgtttctgtgagaaggagcaggtagggcgggaaaccagccttagggctggctggtttgaatgatctcagcagactctgggtgtagaggctgtctctctagttgcctggtacctgatacctggtgcttttacctggggtaattagcacaggctggcccagagtgtaagagccccatgaaggagttggttggaggtttgggctttggattggttggtttgcatatgaaaggtgcgcttgcaggtgagttctttactgtctctaggaatgggctagccctgggacagacagtttctccagggtcagcaaggctccgagacaccaaagcatcagaaatacagaaaatagagccaggtgcagtggctcatgcctgtaatcccagagactcaggaggctgaggtgaagaatcacttgaggcaaggagtttgagaccagtctgggcaacatagtgagacccctgtccctaaaaaaaattaaaaataaaattacccaggcatggtagtgcagcatgcctgtaatctcagctactcaggagactgaggaaggaggatcactgaatccaggagttcaaggaaagaggccgggcacagtggctcacgcctgtaatcccagcactttgggaggctgaggcaggtggcgagtgaatcaccaggtcaggaaagggagaccatcctggccaacatggtgaaaccctgtctctactaaaaatacaaaaattagctgggcatggtggcgggcacctgtaatcccagctactcaggaggctgaggcaggagaatcgcttgaacctgggaggtggaggttgcagtgagcaagcgagactccgtctcaaaaaaaaaaaaaaagacataaaattaatagaccttagactattttatttaattattttatcaaaataggataggcatagttaaaaatgccaatgtgcattggagagctgaggatgaaaagcaatgtcctgtacttgagcttgcatcagaatcatctagagagtgccccaccctcagagtttctgattcagtagacattgaagaatgagaatttgaatttctaacaggtccccagagaatgctggtgtgttcacactccggttaccagaaagggatcccgatccagaacccaagagaggttcttaggtcttttgcaagaaagaattcgaggcaaatccataaagtcaaagcaagcttactaagaaagtaaaggaataaagcatggctactccacaggcagagcagccctaaagctgctggctagccacttttgaggtcatttcctgattatatgctaaaaaaggggtggatttttcatgagttttctgggaaaggggtggcagattcccagaactgaggattcctcctctttttagaccatgtagggtaacttcctgacgttgccatgacgattgtaaactgtcatggcgctgctgggagtgtctcttagcatgctaatgcattacaattactgtataatgagcagcaaagacgaccagacgtcacttttgttgccatcttggttttggaggattttgacctacttctttaacacaacctgttttatcagcaaggtctttgtgacctgtaccttgtgctgacgtcctgtctcattcagtgacttagaatcccttaacctcctgagaatgcagcccagtaggtctcagccttattttacccagcccctattcaagatggagtcactctggttcaaacatctctgacactctgagaaccactgcattggaagacactattttcaactctttaaactctttcttccagcacttgagctctaaattttaatcatgtgctctgtctctctgtcatttcactatttcatggctctgacttcctgagaaggttttaattctctgatgtgatccctctagttctcttcccctcacatccagcacggggttactgccatttgtagttcactcactcaaaaaaaagtgattattaagcatcttctgcatgtcaggcattgacttagtcactggagatttgtcagagaacaagccaaagtcctgccctcatggagcttatattttagtgcagggcttgacaaactttttctgtgaagggccagatgggctttggagctatctggtcactgtcacaactacttaactctgccattgtaacacggaagtggccacagtgtgccaatgaatgggcacgggtgtgtgccaataaaactttatttacaaaaacaggcaggaggctggatttggcccttgggctgtagtttgtagacctctgttgtagtgtgggagaagacaaagtaggtaaataagtaaaatacgaacagtaagctaaggggaaaaagaaaaaacggaaaaagaggatgggaaggaggcaggaggggactggacctgcacatttagatatggtggcaagcaggcagtcactgagatggggacattgagtaaagactttcaaaggagatgaaggagggagccatgcatctccctggcagaagagcattccaggcacagtaacagctggtgcaaaggccctgtggcatgagcatgttcggtgtgcttgaagaaacagcaaggaggctcgtgtgtctaagtggggcaagtcaagggaagggagcaggagaggaaagcggaggaaacagagaggcagctgctgagggctatgtgattcttgggagggaatttgtcttttctcttagtccaatgggaatccattattgtgactctagtagttgtaatagttcctttaagttttatttatttattttagatacaggttctcactgtatcactcaggctggagtacagaggcacaatcactgctcactgcagcctcaaactcctggcctcaagcaatcctcctgcctcagcctcctgagtagctgggactgcaggcacacaccaccatgcccagccaaatttttaaaaattttataatagagatgggatctggctatgttgcccaggctagtttcaaactcctggcctcaagtgaccctcttgcctcagcctcccaaagtgctgggattacaggtgtgagccactgaacctggctatttaagttatgtatttgcaactccatttcttgctttcccaatggtaggcaatatctcttaactttgtcttttgtagagcatttttatatgcatgatatcatttactccctatgagatgtgactattgtccctattctgtagaggaggcaactgaagctcggaaaggttaaatgacttggccagattcatatagctgataagtgctggtgctggaatttaaacccaggtttgtcttaatatggagatcttagcacctattttatatgaagagacaatcctttagggatactggggaaacctgtggcttttggacaataaattaaaaaccctttcccaagaaggggagctgtgtgtgtatcaatcaaacaaaatgagaactattctgagagggaggaaaaggttcttttctgtgggaacgctgaccaagccgttgacagctcatttatgtgatgctggtgcagtttgacattcatagtacaagacttgcatgcaattagcacgaatcgttctaacagtctcttgaaaacatttggaattttccctctgtctggccttgtgcatgatgtaaacatggctttatttagttggtcatccatcccagaatagtgtggtctgcatctgtctgcatcactgtggtctgattgaggtcttgttttcctggagggcagagactgttgtgtaggcttgctttgtggatcctcctcccccaggatcattcgccacaaacccgatggcagcctctctctttagctcatgacaatttctccaagtgtaagctgggggtcccgttcagtatgcaatgcaaatgagatgcaaatgaggggccctcttgggcacaggccaggaggccagagctctggggacttctgtacccctcctctgagttgcctaatgaagctgaccgttcctttcacaatcatcttctccacccaccaaaggcctcttaatgagggcagaagctgactgctctgaaaccccttcagacacctggtgattggaagctggagagacagtgagctttagatgggctgtcagccgctgctgagtcctcatcagctgcctgctgggttctgagaagcactagggaaggaagggagatggccctggaactgactgctattgtctgttcctcctcccctgacgagctgcatgcggcagccacggatggctgggtttgggctttcacgtcggcttctctggcccttgctggatgcctgcttcagctcagagaatgtggcttcacagggacttggaataagagctgagagcctgttccccccatcgaggatcaatgctcctttgatttcatttcttctttccagacgaatccactgtcttagcccgttgttggagaaatcccgacctaagcaggctttcaaattggggaaagaaaagtgaaccaatctgaaatcatggaatggttggtggagaaggacaagtaggcatatccataaagagccagcagtcccaaaggatgttccagtgcatctttctgcttatttcttctagttttgtaggggtgtgtggtgtgcaatgctgtttgcttgacagaatcctttcagtctctctctctctcgaaatataaatttcctgcactacaacagcctactaagtgccagacacagtgctgggctctttacctgcatcaacccattttgtctccattgacaaaaggggaaactgaggctcagagaggttaattgacttgctcaaggtcaactgggcttctgtgtggcagaactggagtttggtcccaggtctgtttgcatctaacacccagccccttaaccactttgccgaattgagaatttggaaattaaaatggtgatttcaactcagggatgggtgtgctttctttcagccttgcagtaagtgcacatcttctttctcttttcctctttgaagctgccagcctctcccttggggttctccttggctctggccatgatttccccagcttcctcattcatacctcctggcatcagactgacctgggctaatcaccatctctgcctgtcactagttcaagaggcagcttatggggacttgtgggtcatacaggttcccctagaaagatgatgggcagactgacattgggattgaaatgtcttgtctccagcgttcttgaataggggcaacaatgcccactgggtctccaggcatggggtctaaaagtgaatgcaaaatacctgtgatacagtgtggatgttttatccccaccaagtctcatgttgaaatgtgatcctcggtgttggaggtgaggcctcgtgggaggtgcttgggccatttttgggtcatggggcagacacctcatgcctggcttggtgcactccatgtcacctaaacgagttctcgctccatgttcactagagatctggttgtttaaaagagtctggcacctcccctctctcattcttgttcccgctcctaccatgtgatacacgggctcccctttctccttgtaccatgattggaagcttcctgagtccctcaccagaagtggatgccagcaccatgcttcctggacagcctacagaaccatgaacaaaaataaacctcttttctttataaagtacccagcctcaggtattccttgagagcaacgcaaacggatgaacacagcctatttccatagccttgctattggtgagtcttgggcccgtggtgcatgcacaggggccagatccagcccttaccccaagagcagattcaaacgtgtctttccctgattatttatggccactaaaatggaaggtgatggttgtggtgggtgtctatgatcagggctcaataaatatttgttgaaaacaaaaatgtaaacaagaaaaagacaggaccttgtcaacaagtgttatatagttgcagatctttatcttggattgttcagactctgcccttctctggcaggcacacttttgggaatgggaagggccaacagtgcttctttggtcccattagatccccatgtcagccctatgaaataatactatcccatacttactactatttcagctttacagaagggaaaaatgcagctcagagaggtgaattcacttgcccaaagtcccatcgctagggagcgatgggatttgaattaaaaatgcagatgtgattgattctaaacgcaggctgttaatgcatagctttcctggggaacaaaaagagctttcctttcatacctcattcattcattcattcacttattctttaatctcttctgtatgggaggtcatttgctagatactggatggctgtaggaatgaatatgattctttacacgctgagtatttcatagccctactaagagagaagaagagagagctcactataaaaggggggattggtgaagagataatggagtaggaagcacatgctgtgggaggtgccaggggatgagaggttaattccaacccatggggttgtgataggcttcacagaggcaaaggcagtggacttagttctggatggggcagagatctaacgcttattgatggcttgccccttgctaggactcagctcggtgggcgctttgtctattttctactttgaaagatgaatagaaactttgacggtcttttgccctctgaaatccactcttcacacccagccacaggaatctttctaaaatgtaaatcaggccatgtcacccccctgcttaaatgattccaagccttctcagagcttccaactgaaacctaaactcctcactcctgctctaagagcctgcagattctgcttccttcagcctctttccaaccttgtttgttcttttcccatgatagccacatctctgagccaacaaatatttttccttccttcttgcacttgctcttccctcagcttgggttgcttttccttgggctctatgtgttgccaactttccagtagccttcagtcatcactaaatgtcaccttctcagaaagcccgcctctgagtcttatctgaagaaacccctcccagtcactccctatcccattactctgtttgcatttgtttatttatttgcttcttgcctgtttctctccactggatggagagcaagaaccttccttattttttatgccactttgtgctagtgcagtgcacaattgacatgtacagatgcacaattagagtttgctgagtaaatggctaaataggttaaaaaaaaaaaccaaaaacggtgggctgctaggcagaagtgtaaccacacaagtgaaccttgaaagttaccatgaaacgtaaccttcatgccctgtgaaggtgccttaggtttctggtgtgtttggaccatagattgtagctatgaagtctgattaatgcctgaatcagacattgaatgacctgaataaatagttaaaaagttggacttctaggctgaagtgtaaccacatgagagaagcatgaatgttaccatgaaggtgcctagggtttctggtgtgttcagaccatagattgtagctatgaagtctgattaatgccagctcacagaagagcttgctcaagcatgctagggatttggtgagccattgtaggtggtaatgacctgatctagttaccatgggtgacaattaaaaagaaggattaaagatgtaagggactagagctgtagagacccatccaggagctattgatccctgtaggatggaggagatgaaacatacatgaattaaggaagtggaaggataagaataaattgatgtagaggatcagggagaggatggaggagtcaggactaacagagatttctgactcaggaagacatgtggatagtgagcgtgatagccaattagggttagaagtcacagaagcttaccagaagggaaaggtaatcatcttgctttagtatatgttgagatgtttttgggttgcatgggtgactgtgtccagtaggcagatgaatctgtatatccagagatccgattggaaaaacagagccaacagtatggatgcaggggtcaccggccctaacagtggaagctgaattctttgagtgggtcaggaattagtgcagcactgtaagagcaggaaggttcaggctctgggaaatggagccacttcagtcatcagtggagcaagaggagccagtgaaggagaatttaaaaataatgcttttaagtccaggtgcagtggctcatgtctgtaatcccagcactttgggagtctgaggcagaaggatcgcttgagcccaggagttcaagaccatcctggatgataaagggagactccatttctacaaaaaaaaattttttttttttaatgtagccagtgtggtggtgcatgcctgtggtccaagccactggggaggctaaggtggaaggagcccttgagcccagaagtttgaggctgcagtaagctatgatcacagcactgcactccagcctgagtgacagagtgacaccctatctcgaataataattattattagtagtaataattatagtgcttttagagaatgaaggggaaccagccgagtaaatggtcatagaagccaagggaagagagaattcaagaaagtggatatggccaacaccttagatgctgccaactggtaatgataaacacgaggctaagaattgaacagagtcactggatttggtcatttaacttagggacttgggaagtgctctttcagtggcatagtaggagttaagaggcaggatgccggaaagcctggatgctggatgttgaggagggaattgaaggaggggatgtggaaagaggagtgtagacaactcatgagaatttgggttgtggaagaaaggggccagggaaggcgtcttagaaggaagttatttctgagaggcatctgagcaggtttatagcatgaatggaagaaagcaaggtgcctgggaatagggataggaattaagcagaagcggtcctaggctttgtcttcaggaagataggtgttcaagtcccagctctgccacatgctggctgtgggactttgggcaagttaatgaagccccatgagtctcagtgtcctcatctggcgagcagagagagtagcctgtaccttgcagagtcatggcaaggatgaaacaagaatgtctctcagggccttcacagcgcttagtgcataatgaggggttagttagtgaactcctaccaagctcctttgtacagggcatttagcaaagacgtcagtgaccctgagaatccctagtctaaggtaggtaccccttccctaagcgctgaacttcctcccttatgcatgtatcacatctacaatgtttccttgtgtagtggatactgtggtgtgccaccaggatccctctctcagcacagaggcactcctgccccaagccacgcagagtattggctctgaccactcacggcttcagtatttccgtaggatttgccctgagggagctgcagtgcccaaggttatgccctcttccaggggcagctcacagtctatgattggttgctggtggggaatgggcttataaatgctcttccccagcctcagtagggaacaagtctaaggggccatcccagctacagagctccctcatggatcaggtgacacctctgttgcagctacattgcagttcagtttctcgatttcatcctgcttcccccattccttgcaggagttcctcccaaggttattccctgagaagccgcctgcatacaatatccagatcagtcttttttcagggaacccgacttaagatgccttgtttaatgtttgtatcttttctctaaaatataagctttttgtagggactgactattctgtcttgttcattttgtgtcaccatgtctaggtacataataggtgcttgttaataatttttaatctttttttttttgagacagggtcttgctctgttgctcaggctggagtgcagtggcatgatcttggctcactgcaacctccgcctcccgaattcaagcaattcttatgcctcagcctcccaagtagctgggattacaggtgtgcatcaccacacccagctaatttttgtatttttagtagagacggggttttgccatgttggccaggctgatctcaaactcctgagctcaagtgatctgcccactttggccccgcaaagtgctgggattacaggcatgagccaccacatgcggccattaattgaataagtgaatgaacaggtttcctaaacacacacacaggagtgccctgatatatacagtttttcagagttgtgattagagaataggttatctggaagtgccttcctgtgggagtgtgagcttgcataggctcccccagcatggagccatcactagcaatggctgtgtcttccacgagctatttccagggttccatcagcaaacagtggtcacgatttataaaacgttcacacaagaacatttgggctgcattctacatcattttagtacagagaggttgttccttggggcctttaattttctagctttcattattgagagagtaaaatgtatcacttgcattccaaaattgatttttatttcccaaaagaagcccataaaaataaataacttcccgggagggaaaacagaaaagcactctatacactgggcaatttgttaaaaaagaaaagaaaaggaaaggaagcctggagcgacaaagcaatctaaacatttagattgtatctcttgtattcccccactccccctgcaccttaaataaataaaaaaaaaaaaaaaaaaaaaaacttgaggcctgctggactttgaaaatgcccatgttgttgagaaaactctgttgggcagcttcatgggacagcatcctttggagcactgcctcatggttcacacccctggtatcccaacccactgctatgttgttattagcaagatacgtttccagtatctcattactaattgtatcagtaagcatttgctgtgtaacaaattgctgcaagggtagtgggcttaaaacaacattctttctctcaattttgtgggtcttctgggaggttcttgtgatctgggccagcttgtctggggctggagggtctgtgaggccctcactctcacatctggtggttggctcagtgtcagctggagggacagggatgccttggccattgcctgccaccacccagcaggctagcctttgcctgctcactggcatctcaagagcagtaagtgagggcatttcaatccaagccccaattcccaagcacttttgaggattctgtttgcatcgcattggctaatgtcccagtcacatgaccaaacccagatgcagggaatggagaaacgaattgttgttctttccttgacattttactttctcaagtataaaggggggtttgtaggcaaggaagatgccaagtagtcccattttatagctaataaactgagaaccagagaggttgagcaactggtctgaagtcacgcagcaagcccagaacacactgggtaaccaatccactgggggtgagttcaccctgtgcagccacatttgatctccccttgcttcattccctccagcactctggcagccaggaggacagctccctgtggggactgtgacattactggcccctcactcagctcttcttgtgccaattagaatgcatacttatttttttttgcaggttgtcctttgcttgcatccctcacctcccccatccactctgtgatcttctctgtggctcaagagcctgactccttcagagtgcatgacatgggctcttttcctttttagtttctgattgagttcaagcagtaagaggcattgattggcaagagattgtaggatggtaggaatgagaagatgcggcatttctgtcccaattcctctgctcttggctgtgtgtccagcagtatcagaaggccccttctctgtgtctccagatttcactgggctctggtaacactacttccttctttggcctcttcaggcctaggggtagcaatgacatctcaatgctgctactctctggatgtctcaccatgcgttgttgatccctttaaccctgtcttcacatttgtgagtagtaccttaattaaaatctctagagccttctgaattggattctgttttctgcttgcgcctatcctgatacactttttttttttttttgagatggagtctcactctgttgcccaggctggagtgcagtggcatgatcttggctctctacaacctccgcctcctgagttcaagcgattctcctgcctcagcctctcaagtagctgggattacaggcgtgtgccaccatgtctgcctaatttttgtatttttaggagagacagagtttcatcatgttggccaggctggcctcgaactcctgacctcatgtgatccgcccgccttggcctctcagagtgctgggattacaggcgtgagtcaccatgcctggccactgatgtactttcactgggttccattttttttataaggggagaaagaatggagtttgcagcatgcgcttagggaacccagtatcatgatgatagaggagtgagtagcctgcatgaatgctgctgtggcaggaagaatgtttgagaacttgagcactagagtgtgagatttctggttgtcttggctccattcagggaattcttaggactctgggaaggacataccaggatatttatggcatcactgtttgtggtggcaaaaagctaatagcctcctgaatgcccgtttttgaaggctgaacatgttgtagtctgtccatgctgtggtataacttgcagttgaaaaagaatgagtttcaaactgactgacatattgttgggtgggaaaagcattttgcagagcagcgtgtatagtgtgattccgtttttgtacagtaaccctcccagtccatttgtttctaggtgattgtctcagccaggagaaaggtaggaaagagtaaacaccaggttgccgtccttcttacctggcagttggggaggaggagaaagatagaatgggaaagcaagtaggtaaagggagcttgaaaaaaaaatcatagcaaatgggaacatacacatagatttaatttggtgtcccttttctaactttttgagatagatatagcattgatttttcagcctatcttctttcctaatatgtacattaaggctacacattttcctttaagcacagctttagttgactctcacaagttttgaatatttttgaattttcatgatgatttttcctatgatttattcaaaagtgtatgtttaattttcaagcatttgtaaatattctagttatctttttgttattgatagtttgtttccaccacagtctgaaaacatacataatttcattcatttgacatttgggtaaatattccatgtgcacttacaaagaatatgtatcctgtgtttgttggatgccatattgtgtgtgtgtaaattagtttcgttagttgtgttgttcatattttctatatcttgtttgatttttattttgcttgcttgttctgttactgaaagaattggatttaagtctcctattatgattctgggtttttttcctttcagttttatcaatttttggtttgtatattttgaagcaatgttattattataaaatataattgatatctcctcggtgaattgatccttttatcattctgaaaggtatctgtttatctcaaataatgcttcttgccttaaagcctactttgcctcttgtaaatataccagttttcttttggttgatgttttatgatgtgtgtgtttatatgtatatacatatatacatatatatagaccgaatatatgtattatatatgttttatataatgttttatggtgtgtgtgtatatatatatataaaaagactgaaagggaaaagggggaaatatatctatatataaaataatataaatatatatatatttttcccccttttccctttcagtctttctgtagccttacatttagagtgtgtcttttataagcacaatttttaatacagtctgacaatagttgattttaattggagcatttagaccatttacattttatataattgctgatatatttgagtctatatctaccacttcctatgatttttcgtttgtcccatgtgttttacattcctttttctctttattattgccttttggggatcacttaagtatattttattatttcatattcctttctattaactaattagtcatgtattgtttttattatttttatattgattctagagattgcaatatgcatctttggattttagaatttaatatattagtacttttattacgttccaaatgatcctaggttctttaacattttagtcctgtttaccccatcctaccatacacattgtaattttacatgtgatttaaactacattatgataatgcttcatataatcagcatttacttggatttaataatatatttaccctttctgttagttttcattctttcttacattttcacatttccatctgggatcattttctttctctctaaagaacgtcttttattatttagtttaggcctgctgcaaatacatcttaagatacttgtatttcaagctgggcacagtggcacatgcctgtagtcccagctattcaggagtctgagacaggaggattgcttgagctcaagacttcaagtccagtctgggcaacatcgtgagatcccatctctggggaaaaaaaatctttatttcacattcacccttggatagaatttgaaactggctgttattttctttcggcactttaaatataccatcccgttgttcttcttccatcatttttgttgattttgtcagtcttattgtggctcttttgaagtcctattgttgcctttatgcaatctgtatgattttagattttctctctctctttgattttcagcaatgtgactgtgatgttcctgtgtgtgtgtgtgtgtgtgtgtgtgtgtgtgtgtgtttgtatgtgtttatcttggttggtgtttctttacttcttgcctctttaacttgatgtttttcattagtattttcttgtccattgtctgccctatccttttctctccttttcatgcttgactttgattatatgtatgttagaccttggtactgtgtcctctgtctctgacactctcttctgtactctctgtctcttttaatctttatgccatagtctgatttttcttaataatctgtttttcagctcactgatttgccttctaactgcttccaatctgctgctaagccatgcattgagttattaattttaagtattgcattttaaataaactttttattttagaatagttttagatgtacagaaaagttgcagaggatagacttcccgtatacctttcactcagttttccattattaacacgttacatgaccatgacacatccgtcaaaatgaagatgttaacactaattagtactgtattgttaactaaactccaaactttatttggattttccttttttttttcacgatattcttagtgtattccaggatctcatgtaggataccaaattacattaagttgtcatgtttcctaagtgtcctctggtttatgacaatttctcaatcgtttcttatttttcatgaccttgacagttttgagaagtactggtcaagtatctggtagaatgtccatccacttgggaattattgtatgtttaattctaaagctttcatttgctttatttagttattttgagacaagggtcttgctctgtcacccaagctggagtgcagtggcacaatcatcactcattgcagccttgaactcctggcctcaagcaatcttcccacctcagcctcctgagaagctgggaccacaggtgcatgccactgagcttggctaatttttaaaaatttttgtagagatgaggtctcgctgtgttgccccaggctggtcttgaactcctggcctcaagtgatcacccctcctcagcctcctaaagtgttgggattacaggtgtgagccactgtacccagtcagtttcttttttgtaaccaatagttctctggtgaaactttccacattgtcatcctttctcccttcttttaaacatcttaataagttattttaaagttcatgtttgataattccagtgtctgaatcacccatggatctgccctcttgtctgtttttttaaaattttttagacgggatcttattctgtcacctaggctggagtgcagtggtgcaatcatagctcgctgcagcctctacctcctgggctcaagcaatcctcccacctcagactcctgagtagctgggactatagatgtgtatcaccacaccccactaatgtttgtatttttgtagagatggggttttactatgttgtccaggctggtcttgaattcctgagctcaagccgtctgcccatgtttgcctgtcaaagtgctgagattacaggcatgcatcaccacgcctaggtgttttttgcttctggtcctatttcttggcatgtttggaagttttgtttgaatttcagatgattccttgctaaattagaaagctgttggacaggtgtggtggctcatgcctgtaatctcagcactttgggaggacaaggtgggtggatcatctgagatcaggagtttgagatcatcctggccaacatagtgaagccccatctctaccaaaaatacaaaaattagcctggcatggtggcacatgcctgtaatcccagctactggggaggctgaggcacgagaatcacttgaacctgggaggcggaggttacagtgagcctgggtgacagagcgagactccgtctcaaaaaaaaaaaaaaaaaagagagagagagagagctgaggaagaggttattttccatgcaggttggggtcacccttctggtggtgatcgagctcactgtgtgctggtttatagccttcgtaaggtttgttctatttctggttcatttccactcctatggtgtagaggtttccaactctgaggctgaagacttgccagggccctccttttaactgggtcctgaaccccaatttttgtttctctagcaccataagcctgacaaaacctctcagctgatttctgttttgtgtctcaacctctgcagtgtgattggtagagactcaagagaaaaatcaatgcctagcgttgagttcacttctctgctcttcccctcccactatgatttggcccctcaagtcctgccttccctggaagctttgattcctagccccaagaataagcttcaagctctggtggcctccctccttcttagcaggtgccctctgtctagcttcttagtcctttgccctgtgttgagaattgatttatggcccaaaggaaaaaaaaaaaaaaaccacacacagaatattggacttatcttaattctaattccttcaaaattccagtttcttgaaaaatattttttatctggcttttatagttgctctcagtgggagagctactttatcattgccccaagtggtatgatattaaataaaaatataaaatacaaaatagatttagagtggtataattatgtaaaaattgaatgttaacatggaaaaagaccagaaggtgaatatacaaatgaaagcatttatttaattttgggataagatctaaggtaatatttgtttggttcagaaaattatttttaaagaagggtgttgtgagcatcagtgatagagtgaggaatcctcatttctttcagatcctggtaggggaccctgagaactttggggagtgaagatagtgaagtaaaggttgctaagcattctgctagaacactatggagacagcgatataaaataagagccaataataacaaagtagcacatagtgaatgtttaccatatgccagacattctattaatttataatgattgtaacattcctatgagccaacatccttatcattagccccattttttaaacaaggagactgagttaccgagaagttaggtaactttcaggtcacaaagctgctctatggcagagctgatctgccaggatctctgggtttaagctcctcaccatcacacttgactaatttggtatagaaagtggctttagatcagataagggtacatgaaatgcaggaggtgccgtgttagaggacagtttggtccagtccccatgtcctggggcaaatgaagcagatggcctcagaacagcctgtttttaaatcatgtaagactgacttctttcagctgctggattcctgcctcccagagtgagacgttgaagtttggcccggaagaggctgagcactggggacgagcagtgctgtgctgtgtatagagtgcttaaaacagtgcctgggtctgagcgtggtggctcatgcctgtaatcccacctctttgggaggccatggtgggaagattgcttgagcccaggagtttgatttcagcctgcaacatagtgagaccccatttctacaaaaaattttaagaagtagtcaggcatggtcgtacacctgtagtcccagctacttgggaggctgaggtgggaggatcacttgaaccccaaaggttgaggctgcagtgagtcgtgattgcactactgtactccagcctgagtaacaaagcaagactttgtatcaaaacaaaacaaacaaaacaaaacagtgcctggcatatagtatgtgctcaataaaagttgtcattgttattgtcatgacatcatcagagcctagaacaaatcacaaaacctgtatattctctctgggctggaggtcttaagattcttctccattcccaacgggtactcccgagatgacgtgattcatggccattccttccttccttcagtgtgtggctcacactgtgctgggctatggcgtcaccactgtcaatacgacaaataaatggataattacagcaaagtgttaggactgctgtgccagacacgagtgcaaggtgtcctgggcaaccagggaagggacgttaacttacactgggattggggccctgtgatggtaagcttttcatcttgcaggaaaccaggggatttttttttttttttttttgagacaaggtcttgctctgtcgtccaggctggagtgcagtggcacgatcttggctcactgcaacctctgcctcctgggttcaagcgattcttgtgcctcagtctcccaagtagctgggattacaggcatgtgccatcactcttggctaatctttgtattttcagtagcgacggatttttgccatcttggccaggctggtctcaaactcctgacctcaagtgattcgcctgcctcagcctcccaaaatgctggaattacaggcatgagccgttgcgcccggccttgaaaccagggaatttaatgacatttaaaaatcatttattaagtatatatgaaatatatagaaaatagtatcccaggcacctaatagaacagaataataataatgactaggagttgttgagtgtaaaataggttgcagtcattacaacgcatataatagcatgaagtatatagctcctcagccctctcagccatcttatgagggaacactgttgctattctcatattacagatgaggaaactgaggctcagagaggttaagtaatcctccaagcctccgcagccaggaagtggtatcactttgaactcaaactcaggtctgtttgatcctgaggccaagcccttggccagaaaaattaggaagtcatagtcccttcccttaaggagctctatttaatatagcagaacaagtaaagcaagtacatatctctctaaagtatactgtgtcactgaagataagaaaggaagaaatcctgtgatgggtcagatgaagtcaggaaaggcttctgggaagaggtggccttatagatctaactagaaggatgaatgagctttgggccaaaggcaagggagggaaccatctggacaaagggtagttagtacacactgtgacctgaagagggagctcaaagcccccctccactccagggctgatgtgaggatgtgagttaaggacttggatgctgctcttggggctttcagagataggggaggagcttaatgacctcgtcttcatgatataccctaagcattctctcttggctttccatttgagacttactctgccttcagacctctcagaactctgcatatctggtatggtaagaggagcctgagctacctcttctctgcattgccttgaaaacaaaacatggccgggcacgatggctgacgtctgtaatcctagcactttgagaggccaaggcgggtggatcgcttgagctcaggagtttgagactagcctgggtaacatggtgagaccctgtctaaaaaaaaaaaaaaaaaaaaaaaaaagacaaacaggactggggaaaaggaataagaggagcccgtccaaccttccaatttccaccaattttaatgtggatccagaattgagaatgctagtctagctcaactcaacagggccagtggttctacttgtgattgggggtaaaggtcctagggtagtaaagagagtgagtacctgcctggcttgtccgctctgcacatgtctctgggcagtagctgtgggatgtggtcctggacactagatcccatctgtctcctcctatggaggcaggatcttacagggaacagccggcagccaaggctagctggagtctggcctacaccatataaggagatggtgcaggaaaggctgaaagttatggtgggggccgaagagggcgttgagttgcagtaaccatgcccaagcctttgtggagttaatgatcacagtggacacattctggaggggtcgtcggcatcactgggccctgctccaggatctcagcaaggatgttattattatcatgagggtgcccaattcagtttgctacttgtttatgggctgattgcaatttggatagagtttaacccccaccccacccccgccttttgtttttaaaaatttgctgaggtgaaattcacatgacttaaaatgatctgttttagagtgaacagttcagcggcatttagtacatgcacagtgttgtgcaaccaccactgctatttagttccaaaacatttccatcattccaaaataaagccccatactgattaagcagtgactacccatccctgccttctcccagcccctggcaaccatcaatctgcttttgtttttaatttttttgagacagggtgtttctctgtcacccaggctggagtgcagtggtacgatcatagctcactgcagcctggaactcctgagctcaagcaatcctcccacatcagcctcctaagtagctgggactgtaggcatgcaccaccatgctcagataattattatttttattttttataaagatgggggtctccaactcctggcctcaagtgatcctcccacctcagcttcccaaagagttgggattacaggtgtaagccaccacaaccagccaatctgctttctttaactctctctttctctctctctctcttttttttttgagatggagtttccctcttgtcacccaggctggagtgcaatggcatgatctctgctcactgcaacctctgcctcctgggttcaagcaattctcctgcctcagcctcccaagtagctgggattacaggcctgtgccaccagaccgagctaatttttgtatttttagtagagacggggtttcaccatgttggccaggctgatatcgacctcctgacctgaggtgatccacccgcctcagcctcccaaagcactgggattacatgtgtgcgccacgcacctggcctaactctctctctctttttaaggctgtttaaaaatgaaactattcagtagctcaagtataccttactgtaaagaggaagtatttatgcagtgctcagtcatcttgatcagagatgattatcaaaacatcaaaatatctctatgccagctggcaactaagaaataccaccagatgtcctctgcctctctggccttgttagtttcttctccaagagcccttggatgtgatctgataatgaaaaggtgaatgtctagttcagtgggagccttcacatctaccccagggctttggctgtctccaatctgatggataaaccgcttgctaaatattttgactatcagccctgtgattaaggtcaggattagaactgttgtatttgtaagaacctctcctaaagatggcctcccattgcccacctgtttgaatcctacctgccttaaacatttttgccatttttatttatttcttagaaacaggatcttgctctgtctcccaggctggagtacggtggtacaatgttggctcattgcagcctcagactcctgggctcaagtgatcctcccgcctcagccccttgagttactgggactacaggcgcatgccaccatgtctggctaatcgtgaaaattgtttttgtagagacaaagtcttgctatgttgcccaggctaatctcaaattcctggcctcaagtgatcctccctccttgacctctcaaattgctgggattacaggtgtgagccattgcgcctggccggttttttaaatgtctcagtctaaagttcaatattcatcccctagcccctaagccatgtttttaacacctcgataaacgatgtgctgactttacctaaaatgtgtccagtattccttctgagatggaaagatgctattttgggggtaaatatgttgatcttttccagaaggagtccaagacagctgatgatagcttttgcttgttctctatagaagagcaagtgatggccgggcgtggtggctcacgcctgtaatcccaacactttgggaggccgaggcaggcggatcacgaggtcaggagatcgagaccatcctggctaacatggtgaaaccccgatacaaaaatattagccgggcgtggttggtggcgggcgcctgtagtaccagctgctggggaggctgaggcaggagaatggcatgaactcaggaggtggagcttgcagtgagccgagatcatgccactgcacttcagtctgggtgacagagcaagactccatctcaaaaaaaaaaaaagaagagcaagtgatgtgtttaagacacacctcgaagctactgccatagaatgtgtgaccatggttatggatttcataaggggcaccctaagagggaaaaataatctgacccagatggatcttccgaggcactgtgatgtcgtgcctaagagtgcagccttgggaggaagacagagagggttcaaatcccgctctactgttatcagctctctgtataccttggacaagtcactcaaccccctcagctgtcaggttccacatcagtaaaatggggaaaacagtaacactcacatcataaggttcttgtaaggattcaatgagataattcatgtgcagtccttagaatagtgcttggctcatatagtaagagctcattcaccgtcaactattattatttaatctattttctatcatattttggaataaaacattttggcttactaaaaaagaacaaaaagaacatgtatttaaaatcagtaggcaacagtgagtcagtgaggatgttctgagagtaggaatgacatgataagatctgcgttctgggaagattaatttgtctgaagcttatagggtgacctgaaaggagacgaggaggggagggaaatctgtaaggaggctgatgcaacggtctaagctgctttgtgcaatatggcagccactagccacgtggggctgtttaaatttaaattaacgagcttggcctggtggctcacacctgtaatcccaaaactttgggaggccaaggtggaaggattgcttgaggccaggagtttgagaccaatctgagcaacatagcaaaaacttgcctctacaaaaaataaagttagccaaatgtggtgggatatgcctatagtcccagctactcgggaggctgaggcagaaggctcacatgagcccaagaggttgagactacagtgagtcatgattgcaccacgcactctagcctgggtgacagaacaagaccctatctcaaaaaaaaaaaaaaaaaatttaattaaagaaaattaaataaaatgcaaaactcaatttttccaacacaatagccacatttcaggtattcagtggcctcatgtggctagtggttactatactggacatcaaacacttccattattttagaaagttctattggacagtgtaactgtaataggttcactgcccaatgcatgcagcaagtcaatacactaagccactgagttgcagcagagaaacaggtttaattgtagggaagagacaggaggaaacctcaaatccatctcccagaggagtctggggctaggatttttaagggttttgcagtgggctgaagtgtggagattgttgattggtggaaaagagcaggatggagtcatgggacagggagataaagaagctgtgttctcttgctgattcagttcctctgtttggggtctttaaactggttggcatcagctattctgctggaattcaggatctgtttaagcaactcttaaacaaaagcctatgattctaatgtcagaaatcctatctgtaggaacaacgaggttgcaaatggtcagtatccagtgttacctgacttttagttgcaaggaagtgggtcaaagttagcctgattaatgctgaattgtaactatatttctgtccagaattcttcctaccctggtgaggctggcttcaacaacactggtcaaaagcagtggttttcatacatgagtgtcacatcagagtcatctggaaagtgtgttaaaatacaggttgctgggttccatcctcaattcagcaggtctgagcagggcctgagatcatgcatttctttttttttgtttgttattatactttaagttctagggtacgtgtgcacaatgtgcaggtttgttacctatgtatacatgtgccatgttggtgtgctgcacccactaactcgtcatttacattaggtgggaggaataacattaggagatcatgcatttctaatgagttcccaggtgatgctgacgctgctagtctgggccacaccctttgagaaccactctctgaaacaggacttctcagtcatggtgtgagggaaaggggagttgtttggagcatgtgaaaagccttatttatatgccccagttaagcccaattgggatttggactcagcctctttccaggattggcagttgttggcagatgtacaggagtgcttttggcttttctggttaaaagaggtgaaaggtggggctaattcagagtatggagatcagaggggtgaatcatggagcaaaaagggggccttatctgcttcttcatccattctctctgtcatcctggagctcagcttttggggcctgatagggagaaagacgagacagaagctttcagaactgagaagtcagaattcactggctttgttcctcactaataccttgacaactttctccctaaggcagtggatgactcacgtctagctgcatggtctggggggaggagcctcagggtacaagtgacagaattcaatgaagtgcaaagtgggagaaacaggcacttcaaacctcaacgtattaccttgctacaagtgtgcctttaactcactgtttgagtcacagaaggaaacagcatagggcttgctctcagggagccggagtatagcatctgctgatggccagggtcactggaatatttgcctctgtctgggcagagtttagaataacaggcagaggcatagggtgggggctgtgccggaactctgtctatctcatctgtgtacccttttatagatggtcatcggatttgtatttgcatctcagtgtagtcagacattcttccagaacactccagcagtgcttctgtgcctgctggaaaatagctgcagctctctcctgaggcagctcttcccacagtcccagctgctcccctgggatcctccttggacctccccatagcctggcaagtaaacttagcacctgggcatatcagggggcctctaggaccctgttccagtactgagcacagcatcagtactggttagcttgtgcttgggctgtgccatttggaagtattttgaagatgcacatgcacgtgtgtgtgtgtctgtgtgtctacggtggtgaagaatggagggatgtgggatggggcagattcagtagatgccttgagatatggatagtttggtaaaattatgataataagaaaatggaaaggatgccagtttccttccagctagttaagacccattactttactcattgacccacctaacccatccatccatccacccatgcattcatctctccatccatccatccatccatccatccatccatccaatccatacattcatccatctaatccatccatccatccacacatgcattcatctctccatccatccatccatccatccatccatccagttcatacattcatccatacattcattcatctgtctaacccatccatccatccactcagccaactcatccatccatgtaatcatatatccgtttaggataaatgtatccagcactctcttttagtgcttctgtgtgactgaggatgtttgacaatgaaaggaggaagcattcatctgctgggaccccttctaacagatgttttcttctcccttcatccctgaacaacagtaggagaaacaggaaacttgtcttcaaatggtagcccttttccctgactgtctgaggatcatggtctgagaatgtgcctctcagtttttaaaaatccttgaattccatgattcagtgatgtagttaatgtagacagggctcttctatcaaagcagggagcctattgaagatatgagaaaatatgcactgtttctctagagaagggaagtaaacccgccttcctcagagctgggaaggcttttgtcccaagcttctgaaaattaaacccatcacttaacgttctcactgagcagattgcggggcttctggccctatgctgcttgggttgtgcagagctgccgacagacagttttgattgaatgtccaaattaagctgccaagcagcgactctgcagctccagggactccatgttagtatttatgtcacatctttagaaataatcacattgcaaagcagcacccagagccatgtctgcagccgctgcagcgtgggagagggggctgttgagcacctcctgcctccatgcttcatgctgcatttactcagcacccaagcaagggtggggccccatggcacgccatcctggttcctgtcccgaggatatgagtgaggaattggtaaacctcgtctgtccttcttgttttcacttaacttgaggcaggaggtggtctccaaacaagaagtaaagctaacttattggatgcctgactcccaaaccatctgtcctaggcagacagaaagaccctcagggccaacctgaggggaacagatgtttatggggggcaggtttactcttgtttttccaagctgggctgaagagctcctcttccatctgcatcaagccctgaaaactctgccgtgcatgagtaaagtagcaagtgctgcatcccccagtgagatccagtggtgacattgtccacaccactggggaatgctagttattaagagactgggcttgtgagagctcaaaggtggactaacccagatcttccctgtcgagggaaatggtctctagacttgtggggttgtggttgtgtggagtcagagtaagtgtggagcaacgctgggaactgtaggaccctgaatgaccagggaaaccgctgtagaaaatagttgacactaaactgggtttagggggtcataaaacctccaagatttcaaagcttctgggtcccaggaggactcagttactgagcacaaaagttgcatggttttggtgtcaggcctctgagcccaagctaagccatcatatcccctgtgacctgcacgtatacatccagatggcctgaagcaacggaagatccacaaaagaagtgaaaatagccttaactaatgacgttccaccattgtgatttgttcctgccccaccctaactgatacgatatattctcccccgcccttaagaaggtactttgtacacctatcccaaacctataagaactaatgataatcccatcatcctttgctgactctcttttcggactcagcctgcctgcacccaggtgaaataaacagccttgctgctcccacaaagcctgtttggtggtctcttcacacggacacacgtgacatttggcagtgttgcaaaaccctcagaagtccgagtatcagctggactgaaccttggggcacccgcgttgtgtctagttccagtttgttaagaattaggtgcacaagaccagccccccttttacacaatgatttctttctctcagatttagagtaacatttttttttctaactaaaaatgtaattaatgctcaactgagaccatatattgaatgtctccttcttccaaattcccactgaagtgacaaagagattaaaaatggaaaaaaattgatcagggtgacaaaccagaaaaatggtatcaatcagatgccagaatctttggggaatttttctaagatacaattcagacaatccaagctgattttgtgttctcttttccaacatctaagcctcttatacaatacttttaaaaaatgtaattgcgttgattggtactttcagaacaatgttaaattatgatagtgatggtgggcattcttaatttgattgtggccttaatagatatgcctctagagttttacccgtaagcataatgaaggctgttggtatatttattacgtcaagaaaagcattcatttatttctatttttccaagtgttaaaaggacgaatggttattgaattttgtcagtcgcctttttcgtcattttttaagataattatatagtttttctcctttgacctagttttatagtgaatcatattattaatagattttctaaaattatgaaagatttttgtttgaagagtgtgcgatcggtttctagcttttgaaagatcactttggtgggggagtgaaggaagggctcaatagaagaccacaggcaggaaaccaatgaggaggatcttaatttcacccagagaggaaaagtgagtggccagggagcaatcatatgagcagctgctgtttatgaatcactcatcacctgcccagcacaataccaggattcaaatataacttaataatcacagtaattctatggcacacttattattgttcagatggcagtgatatgaatagtagggactcaggtacacaaaatgagaaagaggcagatcaaacagcacggggttgtagattgcaccaaagggaggagaccagaatgatttctagattcttactggggcagttgggtggatagttcaacactcactaagactggcattgaaagacagggaggagacatggtggtgtcgggggagcaggaggataatgagcgttgttggacatgttgagtttagcgtacatatgggacatccagtacaagataaccagtggacagttgtacatacagttgtaaaggtcagtaaagaggtgtgggtgggagttgtcagtatttaggtagaagtaaaatcataagagtagagcccctggaaaaatacggaaactaacaaacaaacttccgaataatccatggtttagttcaaagaagaagtctcaagggaaataagaaaatattttgaattgaaagaaaataaaagtataacacatgatactttgtggaatccagattaaaaagtgcttaaaaggaaatttatattggtaaattctaccaacacttaaagatgaaataatactgattctcctaaaaagtagatgagaagggaacatttttcaacctattttatgaggctagcattaccctcataccaaaaccagacaaaaatagtacaagaaaactacaagcaaatatctcaaatattttcttccagttcgtcatttgtgttttgcagaacaaatgtttttaaactttaataaagtacaatttatcatttttttcttttataggtcatgtttttagtgtcatgtgtaagaactctttgtaaacataaatataaaaatcttcatagaaatattagcaaattaaattcagcaatatataaatgaaaaatacactccgtccaaatgagttttatcctgagaatgcaagctggcttaataataaaaaaaaaaatcaaccaatgtaatttaccatattaataatctaaagaaagaaaaaaaattaacatatcaattgatgcagaaaaaattggacaaaactcaatattcatttatgatgaaagttctcagcacactagaaatagaagggaactttcttgatccaataagaagtatctaccaaaaacctgtaacatacttaatgatgaaaaactgcatgctttctcattaagctatgaaacaaaactaaaatgttcatcctccccagtcctattcaacatcatgtcataaccagcacagtaagataaaaaaaatttttaaaggcatgtggggctcggctcggtggctcatgcctgtaatcccagcactttgggagcctgaggtgggtggatcatctgaggtcaggagttcgagaccaacctggccaacatggtgaaacccccacatctactaaaaatacaaaaattagtcgggcgtggtggcagatgcctgtagtctcacctacttgggagtaggcaggagaattgcttgaacctgggaggcagaggttgcagtgagctgagattgcaccactgcactccagcctgggtgacagagcaagactctgtctcaaaaaagtaataataaaataaaaaataaaaaccatatggaatggaaaggaaaaaaagaaaaattgtttctatacacagaaaacagtattgtttatgtagaaaatccacaggaatctaccaagaaattactagaaataatgagtgagtttagctgggttgcagcatacaagtcaacacacaaaaatcaattgtatttctatatattaacaactagaaaccaaaaatttaaaaaatactacttacagcagctgcaaaacaaaggaaatatttaggtataaatctaacaacacatgtctagaatctatatgctaaaaattccaaaacactgaaagaaatcaaagaatacctaaataaatgaagagataacccatgttcatggattgaaagactcagcagagtgaagatagcaagtcttacgattgatttgtaggcttaatgaaattcaagtcaaaatcccagcaggattttttgtatgtttggacacagtgattctaaaacttgtatagaagggcagtgaatccagaatggccaaaacaattcttaagatgaagaataaagttggaagaattactgtacccaatcttaagacttactatataaagcttcagtaatcaaatgtgatattggtgacaggatagatacacaagccattggaacacagtagagaatccagaaatagacccacacaaatacggcctattgattttcaacaaaagtgcgaaaacaatgaaatggaaaaaggacggtctttcaacaaatgatgttggaatgattagacattcatatgaaaacaaaatgaaccttgacctccatctcacaccttttgcaagaattaactcaaaatgggtcatggagcaaaatataaaggtataaaatttcagaaaacacaggagaaaatctttatgacctgtagttatacaaagagttcttagacgtgacacttaaaaacgtgacccataaaagaaaaaaaaaaaagtggtaaattgtactttattaaagtttaaaaacttttattttgcaagaaacaaactataaactggaagaaaatatttgcaaatcacatatctgacaaaggacttgtatccaactcattgtatcagaactctcagactcatttgtatgaagccagccttacttaaaatgtaatctaaaaacctgaacaaacactttaccaaataatacaaggatggccaatacattcatggaaagatattcaatatcactagaaattacagaaatgcaaattaaaaccacaatgagataccattgcacacttactagaatggctaaaataatgatgataatgataataaatactgtcaatatggtgtgctaatgagtatgcagaacaagaggaactctcattcatcactgtgggaatgcaaaatggtacagctgctccgggaaagtgtggcagcttcttataaagctaaacaaacgcatataactgaatgatcccactcctagttatttatcttaaagaagtgaaactttatgctcacacaagaacccgtgagtatatcagctctatttgtaatcactaaaatttgaagaccactgaaatattctttaacagttgaatagataaaccttgatacatccatgcaataaaatactactctgcaataaaaaagaattaactgttcatatacacaacaacatggatgaccctcaaaggccctttgccgagaaagagaaaccaatctcaaaaggttttcttgctgtatgattccatttaggtattattcttgaaaagataaaactgtagtgatgagaaacagatcggtggttgccaggggctgaggatgagaagaggatgtgactatagaggagaagtatgaggaatttttccgaggtgatagaactcttctgtattctgattgtgtgatggttacgtgaatctatacatgcattaaaatgtataaattttttcacaaaactgtgcaccaaaaagtcaattttactgcatgtaattaaacacataaaataaatgttataggcagaaaataagctgataaaagacacaagtacacacagagagagagaagagagagaaaagaaggcaatagtccaagatgaagagggagatggataagaggaatgcagaagaaagaaggttgtcatgttatgatactaaaaagtaatttaaaacagtagactaaatcaaagtgtgtagaagcagtagatagaggagtgcctactgcagaaaatgtaataagtaatatggaaacaagcttaaggagtgctccaatggggatggcaggggaaagggacaaataaataaatataaccactaaataaatgacagatgtagagaacaaatagcatttatccatgggtaaatgagtatcagatactcctagagaaaagaccagagcaaatggaaaagcatctatactgtattcaaagtagagttcaagacaaatatataatatactatataaaatgtgtcttttatttatggtaagtaaagtctggggacaaaaagtaatcatgaacctagggccaaaatgcataaagcaaaaacttgaaatgaaaggagtaatttacagaaataccataatagaagggctttaaaaacacactttgtcagtcttggacagataaaagcggttaagaaaatggatatagataatttaaataatataattagagtgaatataaaatacctctctatcttgaatcctgaacccttcaataaaagaattacattttttccctagtattcacaaaattagtgatatattaacttgttaaggaaacctcattaaattccctccaaaatgcccccagaaattgctcagcccacattttccgataaaaataaaacagaactagaaattaatgacaaaaacatataataccaaagatcaatggatgagtgagatggaggtaggaatcagatgggagcctcaagaattgaaatcttgaaattgcttctgtaaggaatgggaaattaactagggacacccaataggtttgacaagcagtgtgcgggactttgctgtggttggagatcatgggtatatagtggcatgaagcccctatgtgtgacactttcccctggggacactgtctagagcaaatttcactcatggttgagggtatgcacacaggatgttgaagagacaggaaggtaaggacatttaagccactggtcagaagcgattgaatggcttttccatatgggaagtggtagggaggaagtaaaaccgtagcaatgcactgatggaccaggggaaaggaaacagttgaggaactggagggtttgatgaaatgaaaaaaaaaaaaaagccaggtaaagggagtagagacataaaaggataaactaccactggagagtttagaggctatgccatatcaggtgaaactccaaatgcctggactggagtggagaggaggtcataagaagaatggatgatacgtttgacttcacgtcgtctattattctcagacctcctccaagattcatttgtatgaaaatcacattggagggatactcttttagccctggaatttatcttgattgttacataatttggtctaaattctctgaaaggagaaaggaaatcaacatttgttgagcctctgccatgtgccttacattccactttgacactgttatcctctatcattagggtagtcatataatttattgttaaaatttggactctcttaagagtgagaggacaacagttctaaattgaggttgctctgggaaaactgggatggatggtcacccccactattatccaagagcccatttgagttgtctgtgtaggtttatgagaatttgggggtggggagacaaaggctcagagaagccatttgagtgagatcacccagttagtgagagtcatggcagaggtagaattgacaaccgtgtctgcctgactctgaggtctagccattgctaacttagttcctgattcaccacgctagctctccaccattgtttcactagctgtggcttgacaggctctcttcttgacagacaccatgacagtcccagctggaagtctgtctcaacacagataattagatgtgtgataactgtaccactgccagcaatgatgggaagccagctgttctaggagcctttgggaccacgatgtgctcgggaggactttgatgctggatgtgggctgcccaaagaccccacgtttgctggttttgtaatcagagcctatcaggtgaagattatacagcatggccagttacagaggctgggaaggggattctgagggatttcagggctcataaaagccacagcatcagagaaccttggggtcagaaacccccagggttagaagaagtaataagtaaacaggaatcgatgggacacaaatctagattgtagagcaaagggctaaagaagcttccaacttgggaaggtatggcagggcaggggggttcaagcaaaggaccaggtaaactgtcagccaccaacagataactgaaacaggagaggggcagggcaggacagtgaaaataggttgatggatctgaaatgattgacctgtttagtctctccctccaaccctggttagggcatgtgctgaggatgtccagctgacctcaatgagcttatcctgggtctgtgtgttattcaccacggagctcattttctgggttctatgatgcaaaccaaaagtttttaagtatcaccctgcggatccaattaccctataaactctttggaggaataggatggggtctctgaaagccagggcaatagattcttggaaactgtaaaagcacaactgaatttgtaaattgttttaataacacaattaatacaagaatacattctctttgtcagaaatttaaaatgtgatggataaagctaaaatctttattcacaaccctcaaatcaggttcctctacctgttcctcagaggtggacattattttaaatcaattttgggtatatcttttcagactcttttctatatatttacattcatatatgaccttgtagaaaatgcattttactgtacctttcttttaaatatttggagggcctttaaaatttttttattctgacataatctcaaaatgacagaaaattgcaataacagtaaaagaaatttctgtatacactttacctgatgtactaattgtttatattttgctccatttggtttagcattttctctactaatgtatttttatatgtgtgcacattttttttctgatccatctgagagtaagttggggtcatggtttccacttatcctgaaatacttcagttgtatttcccaagaacaaaaatattcttagtacatttattcaaatgaggaaatgcaacattgacccaatgctattatctgacagttcagctccagatttcactaattgaaccactaatgccttcacgcttctttcttaaacaaagaggcattatattgccctcatcttcttttttcaacgtgcttcatcttgcttttttcaacacgtttctgcatatagataacccaatgttatcggcatgggcaaagtgcgtcacagtatgaatgcgccatatattatttactgtttcccccattggtgggcactcaggttatttcctacttttataattgcacacatcctcaggctgaatattagtgggtattactttggattaatgttcttttatttttccttaataaatccttcactggaatgaattactgttttgaggacacacagtgaggacaaagcaagactcacaatattgaggaaagttccttcaaaaggagttaaataagagatgctcctgattcacataatgtgggatcgggatatgaaagcagcacaattattctgagttttctgacagataattgtatcttcttagaaagaaaaaacaattaaggaacttcttggtgaagaacaattcttggaaaaatagttaacatgcatgctatctttttatggattcagtgctgtcttagagaacttggaccagaatgcagaggcctcgcttgctccaaagacccttagacagaaacaggcagacctcaccctgcacccagagccccatgcccacggcaagcagtgttctctggaccaggacacgcttctcctgtactctttgcaaacttccaccagtggggacgtttgctatttctgctctgtgtgaagcatttggtaccatctgggctggctgagtttcaacaaagatagtaaagaaacatttatcaagaaaaatcaaagtcggtctcgccaagtgtggtctagagagatttgcttccgcgatacatatgcggctctcttgctgctgggaaacacgactcaactttgaaacacttcaggagggacagccctttggatcttagcctgcagctactgtcaactgctcatgatagatggttttagtagccagagctcttggagatgtgaatgccagcagtctcaggatgcattccacagcattccgttgcacagaaagttttggcccctttggtagagaataagctcaaaaggacaaaagtagaagaaaggacctataaaggtgagggaagagtcatgcctcagtgagtaatgtttggctctgcaatgattagattcccaagaaaaggtcattcttggctgcacacagtggctcacacctgtaatcccagcactttgggaggccgaagcgggaggatcactcgtggccaggagtttgacaccagcctgggtaacatagtgagactccatctctacaaaaattttttaaaagttagctggatgtagtggcacatgcctgtagtcccagctattcagggtgctgaggtggtagcatcgcttgatcctgggagatcaaggctgcagtgagccgtgatcgcgccaccgcactccagcgagaccctgtgtcaaaaaaaaaaaaaaaaaaaaaaattgctcttaaaccacgagtcttgagattgacagcttcaaaatacaacactcttgtccagcaaagagcactctaaaagagctgtaaattccttaagcttatgatagaagatctttttccagtgactacccttgtggtgtcagttcataagactggggcggaggagggggagtggccttgccagggagaagaaagatgagctgtttcctcttgcctctgtgttaccaatcaaccagacagacaagcttctggcgcatctgagtgtctcaatcctgtgtgtgtgcagctcactatgtgatagatgtgtcactccaagatcccagcctagaaactggtacatgttattttccttggaaggctcaagaaatgaaagtaacagttggatattatattctatggggaaaatgcatgggtattttgagaaattattattctccagaacaatgttacttaatgtgtgtcttatagactggcagcatcagcatcacatggaaatgttttagaaaagcatatggacaggtttcactgcagacttagggaatcagaatctatctgtgggggtgggtgccagatacatgtgtctcatgagtcctctgagtaatttttatgcacactaaggtttaagaagctctcctgtggaagggttcgagtaaacatcgaatgcattgttaagaagaaaaccacaaatggttccatttgatgtcagtacgtgtggaaatggttaactcttcataataaaaatagacaaacaggcaaggcatggtggctcacacttgtaatcctagcactttgggagaccaaggctagaggatcatttgcatccaggagtttgaaaccagtctgggcaacatagagagacccccacctctacaaaaatttttttaaaaattagttaggcataggttggcaagcacctgtagtcccagctacttggaaggctgagttgggaggatcacttgagcccgggaggtcgaggctgcagtgaaccatgatcatgccactgcactccagcctgggtgacagagtgagaccttgtctctctctctctctctctcacacacacacacacaacaaaaacgtagtgaaagagggcattgcatatgaataagaataataatgaaatagcagtaatatatagcagttaacatttattgagtattttttaagttccaggttctgtgctaaacatgtatattctttatccaattttactcttgtaacaacctattttattgatcaagaaattgaggttcatatgtgtgaagtaactgcttggtaagatgcggaccctgggatcttatagccctgtgtccatgacactatatggtctgtcttggggacaagattaacattttattttgtcccctatatccccagggcctagcagaatgcttagcacttagtagggacttgcttgttgaacttaactgatcaaggtcaacatcttgcttttggtgtaaaaatgagatgcagcttgcaagctgagatgggagatgaattcagcctgtggaaaaatagaagacactgccatgttgctggagtgcagaaaaaatgtcagcacagaataagttacagcttgatcctggtagccgattcaatgcttctcccatctcatttattcggtctcaaccccttactagctgtatcattttagggaagtcagtcttatttattttccagcaatggtcagctgtttgagtgtaggaaaaggacagagtaagaaaggacaggtatttgaatttaagtagggctggggtcatgtgagacaagtaaaataaaaagaaagaggggcaagggagttgagggtctttccaaaggagtagctaaaatgcaccataaaattgaatctggatatgaatggagtaaaagcaagagggaatagggagatcaagagaatgtgttgggttcgagggactgattggtggagaatggactgacgaataggggaagatttattgcagtagaataatagaactaatgaattggaaaaatagaaattggtgtaagatagtagggtacttgaaactgagattgagaaagtggtataatttctgggataataggctccagagcgtgaccatggtaggagataactatgattgggggtgagcaaaggttgcaggaaatgagggggtgctttctctcctactttccaatattctttcttctaatctgtttttcttgttatcttgagtttacaaaatttctggttttatttatgctgtggatatttttccagccttttccctatgggctgtctgggtgcaggttatgggtgatacatggataataggtgcatcttggtttagagggtaactctttatttcttactgcacttatggaacacgagaaaaaaaagtattaaataatggctatggtaatggatatctttgtcttattccttactttaatggaattgcatttatcatgaaccatggtgctgttatttcagatagcctttatcctgttaaaattctctgctgtttctagataactacaatgatcttatggttttcttctttgatctataaatatgatgaatatattgaaaatagatttcctaagattgaaccatctttgcattcctgataggagtcattatgtattcaccttttagcagatagttagagtcgatttggattgaatgtattactgtggattgttctactgtaagtgagatgattgacattgtatccttaagagctgtgcaattctcattttctagtctgcttccattgactacctgcattactggtttctgaattgattcctaattaactacttcctgtttctccaagctgatgatttagtctccctcatcctttctatagccagttgcatcttcactgctgattccctgcctccttttctcctgtaagttcatcttttttttttgacggagtctcactctgtcgcccaggctggagtgcagtggcatgatcttggctcactgcaagctctgcctcctgggttcatgccattctcctgcctgggcctcccaagtaggtgggaccacaggcacctgccaccatgcctggctaatttttttgtattgttagtagagacagggtttcaccatgttagccttatagcctctttacctgggtgttctggagtcagggtggagctgagctctaatgctgctgacattgttccagccttctctctatgggctgtctgggtgctggttatgggtgatacatggataataggtgtaccttggtttagagggtaattcttcctttctttagctttttctttttgaatggaggtaaaattaacgtaacataaaattaaccattaactgtttttaaacgtacaattcagtgacatttatagaatattcacagtgttggacaaccatcatctctatctagttctcagaaattttcatcacctctaaaagaaaccctgtactcattaagcagtcactccccatttccctttccctccagcctctggcaactattaatagtagtctactttctgtctctatggatttacctgtttgggatgtttcatgtaaatggaatcatacaatatgtgaccttttgtgttggggtacacaaatgttcatagcagcagtattcacaacagccaaaaagtggaaacaacccaactatgcatcaactgctgaatggataaacaaaatgtgggatatctatacaatggaatattattcagtcatgcaaaaaaatgaagtgctgatacatgctataatgtggtgaactttgaaaacgttatgctaaatgaaagaagccagcctttcctgtgggctttgtggaaaataagcttagaaaacttacagttaatcttggtatgggaagagcagtgtaaaagtcagaaatccatttttaaccaacacagaccagagttgacatcttatcagcccatctcattttgtgcactgcttcagctatggatgttaataaaattaaatttctcactaaacaagtgtgatgccaaagaaccttccacaagttctgcagctgtcactgcttggtgcttaaacatgttggacagtattaatgcaaaaactgctttttctttttcagtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagattgtaagtggaaatgactgcagtgagcatgggtggtggaggttgggttatgtgccacctgaaatcagggagttcctcctcccttagctcctgtttccttccttccctacctccctccttttctgtcttctccatccctcactcctatctttccctcccttcttttccatctgcaattttgtattgtgagccaagaaaaaaaattagagctatttttttaatagagatgagaatgcctgtggtgtgggggagtgggtaggacaggaaatggtgtgatgtgttgctaagtgaaggcaagttgtgggagaaatgatggggctcagcaaataggggaacataacctacagggtgtggtgacagcctctctagagttgggtttatggatgatgcttggcctgcagccttctgggacatctccaccagcctcccttgagggtcttccctggccagggctccaagaatctgggagtctctttcttgtacatctaggcatcaggagttggttataacagccaattcactgagcatatatgatgtgtgacaaacactgggttaagcgatccgacttcatcggctcattttattcccaatgtagcaatagggcttatagaggttaaagagtatgcccaaagtcccatagcaaatatggggtggagtgggattcagcttctggcagtctgactttagcggtcatacttttttagccaccagctagaagcacagttccttgtcctgtctcctcttccctctctcagggcaaagctgggccccttctcagcctcagtcaaggacatgtctcagaacagacaatttccccaggatttttctccatgcatttcctcagcctcattctcaacccacctgtgtgcagatatacacatgtacacacccaattatgcaattgatatctgtatttcttataggcaataggaattcctgaatatcctgaaccctattaagacataagataacaaaagtagttagaactgttcttgtcatagccagtctaagacctctgcctgtttaagccacaggctgtcaaacagaaaaagctctcactccctggagagctagcctgggatggaaactgaatatgtttctttcagcagcttgtaatctttaaaactttctacctccaggtcttgtcctcttgtacatttattctgcttgagaaattactacaacctccactgatgtcttttctttttctctatgcagtcagctgaaagaatcggacaaagacagaagactgtcagtagagatttgggattgggatttgaccagcaggaatgacttcatgggatctttgtcctttgggatttctgaacttcagaaagccagtgttgatggctggtaagtaagattttgccttgaaagctaccatacagcttgctccatcaaacgcggggtcaagtatgttttcctttttctccaaaaattgaaatactaaaacagagtcccaaagtgaagtctggttgattggatctgccttgcagatatgttttgtttggtccttgtactaaaaacaaaaaagaaagaggccaggcctcgtgtctgacacctgtcatcccagcactctgggaggccgaggcaggtagatcacttgagctcaggagtttaagaccagtctgggcaacatggtgaaaccccatctctatcaaaaacatgaaaaattagctgggcatggtggtgtgtgcctgtagttccagctactcaggaggctgagatgggaggatcacttgaaccctggaggcagaggttgcagtgagcaaggtggtcagagattgagccactgcactccagcctgggtgacagagtgataaaaaagaaagagagagagagagaaggaatgaaggaagggagggaggaaggaaggaaggaaggaaggaaggaaggaaggaaggaaggaaaggaagaaaaagggaaagggaaaggaagaagaaagaaagaagaaagaaagacggaaagcaggaaggaaggaagggaggaagggaaggagggacagaaggagggagggagggaattagttctagtattttaaaaatctggggctagaaggcaacaattgagaacagttgaatagttaatgccccctttagacaggacatggattttctatttgtcaccgtcctcaccactccctattttattacatctgggccaatttactaaactacatgatgagactgtaactgcccagtggcttctttgtgcctgctgcccagacagagccgatttatcaagatgggagaattgcaatagggaaagagttttacacacatagagccagctaaatgggagaacagagtttttttatgactcaaatcagcctccctgaaaatttggaagctagggcttttcaaagatagtttggcaaggagtagggtggctagggaatgggtgctgctgactggttggggatgcagtaataggggtgtgaaaaatggtcctcgtgcactgagtccacttctgggtggggccacaggactagttggcaggtccaggtggggcagtctggttgtcaggaaggcaaaagcctgaaaagacatctcaaaaggccaatctcaagttctacagtagtgatgttatctgtaggagtaacttaggaagttggaagtgttgtgagctctgggataaaggctgataataatccatgtctacatcttagcagaattcaggctcctttcattctcctaacttggcaatatttcattagttttacaaaggcagtttagttttgggaaagggctgtcataatttaaaatatacaacaaatttctttcaaagttaggttggcggtctggtcggggtggagccattggttacgagaaatgcaaaaaaacctgaagagacatctcaaaaggccagtctacaatagtgatcttatctgcgggggtcattgggaaagttgcaaatcttgtgacctctggaataatggctggtaatcctttatgtctacaccttagcagaattcaggctcctctcatcctcctaacctcatggtccctcattagctttatgaaggtagtttagttttgggcaagggctattatcatttaaaatgtacactaggccgggcgcagtggctcacccctgtattcccagcactttgggaggccgaggtgggtggatcacgagatcgggagatcgagaccatcctggccaacatggtgaaaccctgtctgtactaaaaatacaaaaattagttgggtgtgctggcatgtgaggatcacttgaaccagggaggcggaggttgcagtgagccgagatcatgccactgcactccagcctgggtgacagagcaagactccatctcaaaataaaatgaaataaaataaaataaacactaaatttgtcacaaagttaacttggcccgagcccaggaaagcgtaagggcagtttggaggttaaaggcaagctgggggttggttagatcaaatctctttcactgacgtcatcattttctccctgttacaatttctgcaaagacagttccatgactggctccatggacactagagtggcttgtacacttcacctgaaagatatgagcaacccactgtcagatggtgtctgagaagctaccgcttccttgggagtccttagcaagtctggccacagatcatagatgtactggggtgttgttttcatagtcagctgctgtgtctcctttgtcctgaagattttattttgctcccttcctatggcaaaaaaaaaaaaaaatatatatatatatatatatatatatatatatatatatatcctccaatgttaccaacagagaggctgggtaagcccccttggcaactgtttcacagttaactgagtcaaggagtcagaagaaatagcttaacctggcactataactttgggagaagtggcaattgggctgctattacttctttaagataaattgtctcatatctgaattgtctcattcaggaccttttcagcttcaagtgaaagaaaataaaaatcaaactggtttagcgagaaagagatgtgtcctttggaccacacacacatctttcctttccattgttcaccttatgacttccttgtcttggctccatgtttcatcttaggccttttttttttttttttttttttgagacggagtcttgctctgtcacccaggctggagtgcagtggtgtgatctcggctcactgcaacctctgcctcctgggttcaagcaattctcctgcctcagcctcccgagtagctgggactacaggtgcccgccaccacgcccagctaattttttgtaattttagtagagatggggtttcaccatgttagccaggatgatctcgatctcctgaccttgtgatctgcctgccttggcctcccaaagtgctgggattgcaggtgtgagcctccgtgcccagcctatcttaggcttttcttgaaacatatattgagtgtccactaggtgctggtcactagaaacacatggaggtataagacagacatgacttcatggagcttagcttatggcagagggtgggttggggagataaacattgaacaaggaattacgcaaatgacaaatcaatgacaacatgatggaagatgtgaagaagacaggagctgagagttttgaacccaaaagtatctgagacagatttcaatcagtttagaaagtttattttgccaaggttaaggatgtgccagtgacacagactcaggagatcctgatgacatgggcccaaggtggatggggtacaacttgcttttatacattttagggagacgtaagacatcaatcaatacatgtgagatttacattggctcaatctggaaaggcaggacaactaaaagtgggacggggaggtgcttccgggtcataggtagattttacaattttctgattggcaattggttgaatgagctgttatcaatagaaaggaatgtctgggttacataaggagttgtggagaccaaagttttatcatgaagatgaagcctccaggtagcaggcttcagagagactagatggtaattgtttcttatcagacttaaggtctgtgttgatgttaatgctggttggcttttcctgaattccaaaaggaaggggatataatgagacatcgtgtctgactctcccttctcatcatggcctgaaacagtttttcaggttaactttggaatgcccttggctgagagaaggggtccatttacatggctagggggcttagaattttattttggtttacagaatgtaccccaaaagagttgtgttaaagcacaattcacaaatggttaaaaacatagttctcataagatagataatgggcattaatgggcattggccaaagatttccttagctcactaaggagaaaagcagcaggatgaatgaatgattccacagaaggtttgataaactgatgttcgtgtagtcagtagaaaaagatatgctgaaataactttgctcagttaaatataaaactgactgatatacaggacaatagaatcataagctttggggttatctactagaatgaaacaaaaaaaagattttggccaggcatggcggctcacacctgtaatcccaacactttgggaggctgaggcgggcggatcacctgaggtcaggagtttgagacgagcctggccaacatagtgaaaccatgtctctactaaaaatacaaaaattagctgggcatggtggcaggtgcctgtattcccagctactcgggaggctgaggcagaagaatcgcttgaacccaggaggcagaggttgcagtgagctgagatggtgccacggcactccagcctgggcaaagatttcacctcagttttctaaaagttaacatgtatctttgcagactagggaggccatctggggctgacctgatggtgaataataaactaaacaaagtaatattactgtgaggaaagaaatagctaattagaaaatgctctagcatgacattaaaagttcacacggtcatctttttggttttctttttcccccaagctttggatatttttccctaacatgcaaatgacttgactttgcagggtgtacatcagttactcacagtggatgtttcattctcattttaaatcaaacttaaagaggttaaagagaaagaatgcatgatcctcagggggtatcagtgtgacaggaggaaacataataataataattataataacaatagctactactcattgactcttaatagatgccaggctctgggttgagcttttccagatgtcgtggagtcacaattttacacagcactgatcaggtgtgcagaaaaaataaagcttatttcttttctataatggacttagactttctcatgcacttttgtgagctcctggtgaccgaggagaagggactctatatgctgcatgtggtactttctgagcttcactgtttcacttttctgactggtcactgttaacagcaaaacccagctctgtaaaatattttaaagaagtttattctgagtcaatataagtgactgtggcctggggaaacacaaacccaagaagctttgaataagtggtcctgaggtggttagattacagtttggttttacatgttctggggaggcagaagttacaggcaaagacataaatcaatacatggagattatacattggtttgggcccaaaaggcaggatagctttaaatggggcttatgggttataggagattctttaatttgcagttggttagagtaagactttgctaaaacttggagttaacagaaagaaatattttatgttggctgggcgtggtggctcatgcctgcaatcccagcactttgggagaccgaggcaggtggatcatttgaagtcaggagttcgagaccagcctggcccacatggtgaaaccccgtctctactaaaaatgcaaaaaaattagcaagttgtggtggcacatgcctgtaatctcagctactctggaggctgaccaggagaattgcttgacgcaggaggcggaggttgcagtgagctgagatcccgccactacacccagcctgggtgacagagtgagactccatctcaaaaaaaaaaaaaaaaaaagagtgtttaagttgaggatgctgtgcagcaagatggcttgcttatggtgcaacttcacctttgcctggcctggcgttagtcctgtttataatctgatattttattgccacaaagagtctgttttgtcagtcttatgatctctactttaacattcatgtcagtccattgttgtatataaactcccaaagaaaggaggcataacaagacgtgtccaatctcctttctctcatggctgataattctgtttttaaggtttttcttagatcctcttggccgaggagggggtctgttctgtcagtggggggccttaagattttatttttagcctacgttcctaaaccagcgcccactgaagtgggactggtcccacctagctttggggcatcattctggctttgtgctgaagatcctggcctgttgcttctccttgtgagttccctccatgcagcaccctctctgtcccactcataggccactgctgggcctggttcagggaggccaggaacctgcctgagtcctccccctgaggagtcttttctgctccttctgctgctgctggaatgatgttgcctggtgcatggataggtctctggccagcgttccagccgaggaggagggaaacccacctctccccaccacctgtcctttctccttcccaaggttctccaagccccaaagggaggggcttctcctacaatcacccaatgagttcatctagagctgattcactgagacggcaatattttagcagagaaagagtttaataaacacagtgccagccaagctgaaggatgggagtttattactcaaatcagcctcctccaaaattcaaagactagggtttttcaaggacagtttagtggtaagtgggggctagggaatggggaatgctgattggtgggttgagagtgaaatcatagggggtcaaagctgtcttctcatgttgagtcagttcctgggtgaggatcacaagaccaggtaagccagtttcgttgtatggattcccagtctgggttgcaccagctggtccatcagaatgcagggtctggaaaatatttcaaacaccaattttaggtctataatagtgattttatctataggagcaattggggagatcctgaatcttgtgacctctggctacatgtctctggagccagaattctaactttgtggctaatatgttagttttacaaaggcagttttagtccccaagcaaggagatggttagttttgggaaggagctgttatcgtctttgttttaaagttaaacgaatggccaggtgtggtggctcatatctgtaatccccgcactttgggagtgccaaggtgggaggattgcttcagttcgggagttagagaccagcttgggcaacaatgagatcctgtctcaacaaaaaatttagccaggcatggcggcatgcacctgtgctcccagctactcaggagcctgaggtgggaggatcacttgggcccaggaggttgaggctgcaatgagctgtgattgtgtcatcgcactccagcctaggcaatggagaaagaccctgtctcaaagtaaataaagaaacaaatacaaataaaaaatgaagttgaactgaaactaacttcttcccatagttagcttggcctaggcccaggaatggacaaggatagcttggagattagaagcagatggagttagttaggtccgatttcttacactgtcatagcttttctatgtcatatttctcttactgtcataatttttgcaaaagtggtttaactcccacacatgccatatccttcttcctgggctagtgcctgccttgtctactcccctaaggctgagagcagggaagaaaaaaacggcttaagaatagggatagtgtatcaggagtaagcccaaaatattactgcatttacacttagatgatcatttaattctccagttattctaggtttcatcatttccaaggctcagaatagttcagcagtgtgttagggatacacagcttgtaagcaacggtgctgggttcaggtccagatttctatgatgccagagcctaagcatatacaaattccattctgcctcctgatacagggttaggtggaaggctagagggtagacagctgggattttatttcggctttcctgactggatggatgctttgtgacctcaggtgagccacttcacctctctgtactacagctttcacagcagatatgccacccatcagattgattacaacaccccctgtcctccatccaccacttaggatagctgtgaagttgatgacataatagttggaagggaacttttccaaaataaaagccctctgcagatttttgcagataaaagtcctcctcagatttacggccaagacatttgcgatgctgtcttgactgtaaatggaccagatcctagacatttggattcttgcccctgggattctttgaacattatgtgatcttgagcaagtctcacaccctttctgaaactcagattcaccatttagaaggggatgggctccatcagctcttctgttgtgctgtaattgaagaccgtgtggcagaaacagcagatgcagctgtggaagctatcagatgtggtgcaccagccccaggccccctgtctgcctcttggccaactgccctgtatctgttgacaaatccgcctctttgtttctaattttgtttatttatactgtctcctttctttccccttcattttccagaggttcatctgttttatttacttatttattttcttcaaggaattaactctgggatttgtgtatcaattttgtttgttttctccttttctgtaggtttattttgtgtttggctttgactttcagttgaacattttactaatttattttttcttctttcgcctgactctgctctttaaaaataatgaatagcttttttgtttgtttgttttgagacggagttttgctctgatgcccaggctggagtgcagtggcacagtctctgcaggttcaagcgactctcctgactgagcctcttgagtagccaggattacaagtgcctgccaccacacccggctaatttttgtatttttagttgagacaaggtttcaccatgttggccaggctggtctcgaactcctgacctcaggtcatcctctcacttcggcctcccaaagtgttgggattacaggtgtgaaccaccgcacgtggccaaaaataatgaacaagcatttaagggaataaatgtttcctctgagttttgatatgctaacattctggcttttgctacttccttgagggcctgcagttgaggttttagtttcttttctaacatgctttaatttaggcattttttttaacccctagaattagatttttgtttaaatttttaatattaatgttaagttactgttttagtgctttcaagttagagaatatggcctgtgcacttttctttttccctcctgttttctttcctttctttcagcatagcttagtatttgttcaatgttgttaaaagttctgtggacttgcaagaaaaagattatattagctattcgtagagtatacttttttgtggagaaagaataaaccttttttcaacttttattttagattcacgggatacatgtacaaatttgttacctgggtatattgcatgatgctgaggtttggggtatgaatgattccgtcacccaggtactgagcatagtacccaacagttagtttttcaatccttgtcttcccctcccctctcccctctacagttcctagtgtctgttgttgtcatctttatgtccatgagtgtagggtatacatttattcattccaatgtattataaggtccagatcttttttttctgaggcggtgtttcactcttgttgcccaggctggagtgcaacgccgcgatcttggctcaccatagcctccgccttccgggttcaagctattctcctgcctcagcctcctgaatagctgggattacaggcatgtgccaccacgctcagctaattttgtatttttagtagagatggggtttctccatgttggtcaggctggtcatgaactcccgacctcaggtgatccgcccgcctcggcctcccaaagtgctgggattacagatgtgagacaccacgcccagctaaggtccagatcttttataccttcatattgtccttttgtttgcttgagctaaatgtgtagtgtttattaagtttcttcaggcaaaatgattcacaaacattctttttatttctaggggtttttgccttatctgtatatggcaatattattaaccacataactctacaagtcttattatattgacatgaagttatctttgttgcagctaatgcgttttctctataattttactttgttgctggcattcattcattcattcattgaatatacacagtgagcacctgctgtgctgaagagacactaatgagcaaaacagacaagaatccgtggcctcatggagttttctttttagttgaagaaaaataaacaacaattgtaaatgaacaaaaataagtaataaaacatggcatgtttgaggctgataagtgtcatagagaaaagtaaacaagaaatggggacaaggaatcttggggagtggagacattcagattttatagggaactcaggaaagaactcactgaaaaggtaacatagagcaaagatctaaagcaggtgaggagggagctgtgtggatatctagggagaggttgtcttaggcagcgaggacggcaagctcaaaggccctggggcaggagtgcacccggcaagttggaagagcagtaaggagactcctgtagctggagctggatccatgaggggagagtggaggaggattaggtcttggaggatatggggagagggttggcggatcctgtcggccttgtcaggactttgtcttctactctgaagaacacggggagccaaggaattaatgagattgaactgacctttgcatatgtcctctagttgtggtgtggtcgatcccttttccctagtaggtcctttcccattcttttatgtctaatctttctaagtcctttggtcttgtgtaacaagcggcacgttgttggatttttttttttttatttttgagacagagtctcactctatcgcccaggctggagtgcagtggcacgatctcagctcactgcaacctctgcctcctggattcaagtgatttttctgcctcagcctcccgagtagcagggattacaggcatgggccaccacacccatctaatttttgtgtttttagtagaggtgggccttcaccatgttggccaggctggtctcgaactcctgacctcatgatctgcccaccttggcctcccaaagtggtgctggggttacaggcgtgagccaccaagcctggcctttttttcttttttttttaaaattttactttaagctctgggatacatgaacagaaagtgcaggtttgttacataggtatacatatgccaggtggtttgctgcacctatcaacctgtcatctagatttcaagccccgcatgcattaggtatttgtcttaatgctctccctccccttgcccctcaccccctaacaggccccggtgtgtaatgttcccttccttgtgtccatgtgttctcattgttcaacttatgagtgagaacatgcagtgtttggttttctgtttctgtgttagtttgctgagaatgatggtttccagctttatccatgtccctgcaaaggacatgaactcatccttttttatggctgcatagtattccatggtgtatatatgccacattttctttatccagtctatcattgatgggcatttgggttggttccaagtctttgctattgtagctagtgctgcaataaacatacatgtgcatgtgtctttatagtaggatgatttataattctgaatctgaagatcttttttccacaggaaaatgttttaatgtttatagctataattgccatgtttcttatggtgtttctaaagttttctttttctttcctatttcattctttttttttcatctccttctaaacagataactattatcttaaatcagtgttatattacttttttttaaaaaaactttctgttattattaataatcacattttggtcttattacaaaaaaaaagcaaaaaacaaaaaacaaaaaaaactaatgctttggaatcagacttcccgggttagaatttctactgtaccacttcctagctgtgtacccttggcaagttacttcgcctctctgtgctgtgtttcctcatttggagataatagtcgtaattatgtcacaggattgttgcagtatcaaattagttaatataagtgaggtgcccaatgtctgctaaatagcactcagtaagtgttagtcattattgttaattgaataattattagaaaaatataagaaattggagaatttcagagaccccagattcccagtgcccataaccactattgaccctatagagagagagagtgaagcaaaaaatgaaatcttactgtgcatactatttggtaccttgcatttttcacctaaaaataatccgcaataaacataattgtggcaaaacttttgtgcccagctttaataatttcctaataaatttctaagcctggaattgatgactttaagcatatacacattattaaagggtttgccaaaatgtcctacaattttaaaaatcaatttacagtcttatcaatcttgtatgaaacttttcagtttattaacattaacatccagtgctataaatttcaaagatatgatacaaagattatacacatattgtattagaaattatgttgaacattttcatttgcatattgccatttgtttatatttatatatgactatgtccttttgcctttttcttattgacttgtaagaactttttatatgagaagaatattaatatgtctttcctgacatatgtatgttgcaacgttcctcctcctccttttcatgttgtaaattaattttggtaatatgcatttttcttatggtatataaagcattcggttcaactccaatctaatatgatagatatcaagccacttgccagaaacatttctcaagtttttcttttcattgactaattgttatctgaattatccatgctgtgttcactgtctcaaatgaattttttaattcagtgattatatttttcttccgaaagtagtctttcccactctcgtatttgttcccttttcacagatgcaccaacctcttgaatctcactgcaaatatgaattaggtagtttctagaatgttctctcttttggcagcagttgtatttcatgggagttactttgattctgcattgtttctttctatttaaatgactaaatttttcacacatcctattgtgcttatttgcctatccttatagaagggtgagcacagacatttctgtgtccttgttctaacatttcatatctggataaagggagacaggagtcttttgtattttttggaattctgttttgtcagatcaggagtcctgttcctgacatttgggcggggctacagtggagacaggtccataacaggcacccctcaagccagatggagagcccatcttcctcacgttggttctgtgcatctcaaagtcagaaggggtcctgctcctctctgagggggcacacgtgtcctatttggaggcagtagtggcagcgtccttcactcactctgtggcgtactggccaccgtgaacacacgctgtggcaccatgcccctgcccgctgcgccaggcactgacatgtctcctcttgcatatgaatgggaatcggcaaccctcacccggtcattgatggtctcagccggggtcattattgggctctgttggggcaccttttatggatgacagctggtcaattcccctttatctgtattttcccaagtgtgagaccccaaatactctagatggttcacagtcagggcataaataatattgaattgtgccccaagaaagcaattattttgtcagtgttctttcagttcttcaaattatggcaaagagaaaatctcagaggtctctgatatatcgttaacactctaacacttgctcttcgctgatctcccattaaaaaggggcaggggcaggctttcgattgagagcctttagtaagcaacaccatctacttgcacgtgcataaccttgatttccttgatttccatttgtttatttttttttctttttttttttattggaacattaattaggttttattttcactttttgtttccacagtaacatgtatgggattaggttacagtgtttatttgtccccaatcttttatttatttattttttttattatttttttttaattgattgactttttattttttattttatttttttttaaatttatttatttatttatttattttttattgataattcttgggtgtttctcacagagggggatttggcagggtcataggacaatagtggagggaaggtcagcagctaaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacggcaaccatccgatttctcaatcttttccccacctttcctgcctttctattccacaaagccgccattgtcatcctggcccgttctcaatgagctgttgggcacacctcccagacggggtggtggccgggcagaggggctcctcacttcccagtaggggcggccgggcagaggcgcccctcacttcccggatgggggggctggccgggcgggggactgacccccccacctccctcccggacggggcggctggccgggcggggggctgacccccccacctctctcccagatggggcggctggccgggcagaggggctcctcacttcccagtaggggcggccgggcagaggcgcccctcacctcccggacggggcggctggccgggcggggggctgacccccccacctccctccccgacggggcggctggccgggcagaggggctcctcgcttcccagtaggggcggccgggcagaggcgcccctcacctcccggacggggcggctggccgggcggggggctgacccccccacctccctcccggatggggtggctgccgggcggagacgctcctcacttcccagacggggcggctgctaggcggaggggctcctcacttctcagacggggcggccgggcagagatgctcctcacctcccagacggggttgcggccgggcagaggtgctcctcacatcccagacggggcggcggggcagaggcgctccccacatctcagacgatgggcggccgggcagagacgctcctcacttcctagatgtgatggccgcccggcagaggtgctcctcacttcctaggtgggatggcggccgggcggagacgctcctcactttccagactgggcagccaggcagaggggctcctcacatcccagatgatgggtggccaggcagagatgctcctcacttcccagacggggtggcggccgggcagaggctgcaatctcggcactttgggaggccaaggcaggcggctgggaggtggaggttgtagcgagccgagatcacgctactgcactccagcctgggcaccattgagcactgagtgaacgagactccatctgcaatcccggcacctcaggaggccgaggctggtggatcacgtgcggttaggggctggagaccggcctggccaacacagcgaaaccccgtctccaccaaaaccagtcaggcgtggcggcacgagtctgcaatcgcaggcactcggcaggctgagtcaggagagtcaggcagggaggttgcagtgagccgagatggcagcagtacagtccagcttcggctcagcatgagagggagaccgtggaaagagagggagagggagaccgtggggagagggagagggagagggagagggagaggagggagaggagggagaggagggagagggagagggagagggagagggagagagcgtccccaatcttttaagtctattttttttttcttgagacggtgtctcgctctgttgcccaggctggagtgcagtggagcaatctcggttcactgcaacctctgcctcccgggttcaagcgattctcctgtctcagcctcccgaatagctgggactacgggcgcgtgccaccatgcccacctaatttttttgtggttttagtacagatggggtttcaccatgttggccaggttgtctcgatctcctgacctggtgatctgcccaccttggtctaccaaagtactgggattacaggcataagccaccatgcccaaccttttttttttttttttttttttgagagacagggtcttgctttgtcacccaggctggagtgcagtggtgcaataatagctcactgcagccttgaccttctggactcaagcgattctcctacctcagccgctcaagtagctgggactactggcatgcgccaccatacctagctaaatttttttaatttttttgtagagacagggtctcgctatgttgcccaggctgatcttggactcctggcctcaggtgatcctccttcctcagcctctctaagtgctaggatgacagacatgagccaccacgacgacctgtttatctttttgtttgttttgttttgtttgtttttaacaattattttctatttgtaacaagtgatattgaatttccttccaaggaagaaataaaaagtgtcctttaaaattaaatttattattaaaaaagtaaaacagatatttcaacgctgatatacaaatctagcaaaatccacaaaggtagcatctgaatggataaagttaaagtttacccaaaatagctctgttttctttctattactttaatttgtaggaatccctggaagtccctgctgtgtggatagcacccttctcgatttccagcaaagatacagatgctctcttgtttttatatttcttttggtaatttccgtggaattttggaagaaaatttggaatattaaatgtggaggcgtagaggctcaaattgtcttctctgctttgaatcacctagcccatttttggaagctgcgtaagaagattcgtgaatggagagaaaacattgtgatgaaaattttaaactttggttaggaatgatctttgagagcgaggagttttggggtcttttttctttcccactgattcaaatgcttttagaatgtcccttttctttcctcacactcatctcatcctcttactagatgaaaaaatctttgtggtcaagaaacaaactgaagcccccatgtttattattatattagtagtagctgggcatggtgggatgtgcctataatctcagctacttgggatgctgaggcaggaggattgcttgagcccaggagttcaagactggcctgagcaacatagcaagaccctatctctgccagaaaagaaaaaaaagaaaaaaaaaacagccaggtgtggtgggatgtgcttttagtctcagctagttgaaagctgaggccggaggattgtttgagcccaggaggtcaaagctgcagtgagctatgattgtgctgctgcactccagccttggtgacagaacaaggccctgtctctaaaataataataatgacattagtcacagtaataataatcatgatgatgccactaattgaatacttgctgaatgccaagtgctgtgcttatcattttacatgcgtcattacatttcaatttcacaagaattctatgaaaaaggaatttgtattccaatttatagatgagaaaaacagaggcccagagaggctaaccagcctgtctaaggttatgagatgagatttgcacccagacatggtttgactccagggcttgtgcgcttaaccactaagggatgccgtttctcaaaaaggctgactacagcacattttgggaaaacttttgcagagaaaatagcatcatgaagtcaagtccatggtcacctaaatgcagttgagtgccaggatggcaaagtggcaccctatgcaccctatgtagggtgaaaggtagaaatgctggaagagcatgacaagagtgtatttacagtcaggcagtgggggttgcaatttgggaggatagggtgagaagatcacttgaggtcaggaattcaagactagtctgagaaacatagccaactcccatctctacaaaaaaatttttttttgtttaattagctgggcatggtggcacatgcctatagtccccagctactcaggaagctgaggcaggaggatcgcttgaacccaggagctcgaggcttcagtgagctgtgattgcactattgcactccagcctgggtgacagagtgagaccctatctctaaaagcaacaacaacaataacaacaacaacaagaaatttacgatgagggatcttcatagcattctttcagaataagaaactacttaatggacaaaaagtaggtaaaaatatacagtaatttaacgatataactaagaaaactgtgtaagtgtgtatagagagagagtgagaactttgcctcctatgtacatgtgatatacattttttttctgctgtccatggaagagttacaaaaatacatagtgtacctggtagtgtaccatgcacactacccccacccaacatactgaaaaacaaaccaaaacaaaccaaaaaaccctcaacgtatattttttcaagtagagctttatataggcctccttttcatatgctgatcaataaaataataccgagtcgagtcatgaaatgtgtcccacccccttgtctcccttcaggtttaagttactgagccaggaggaaggcgagtacttcaatgtgcctgtgccaccagaaggaagtgaggccaatgaagaactgcggcagaaatttgaggtgaggtttcttttctttttctcttctttcttttttctctttcttttttccttctttcctcctgctccctcctctttctttctctttctctcttattcttttttctctccttccttacttccttcttcctctctcttttctttccttctttctcctttctttctttcttgcttacttgcttgctttctcgctttcttcctttctctcttgctttctcttgcttgctttctcgctttcttcctttctgtcttgctttctttcttgcttgctttctttaccccccttttctttgttttttccttccttccttcctgccttccttcctctctctttctctttccctctcattctttcttttctttctctctctgtccttcctttgtttctttctctctccttccttcttcctttcttccttccttcctttcctcccttccttctttccctccttcctccctccctcccccctttcctttctttcttcctccttcctctctcttttcattctttctcccctttctctctctcttcctctctcttgtctctctcttctttcttcatctcctttctttcatcagtgggaaccagttaggtttgctgctgtgctgattttcctgtttatggcatggtttctactaagacttttcatgactctgagcctttgcaaggttgttttatctcctagaaaactctgattaatccttcaagaccccaattaaatgcccttgccttatgaagttattcctgcttccctgtctgcattcaggcttagacatttcttcaaaagtgctcattcactgcccaccattttgatggtgacttggactggaatggtagtcatggtgaatgaaagaagtagacagagggccgggtgcggtggctcacacctgtaattccagcactttgggaagctgaagcaggcagatcacttgaagtcaggagttggacaccagcctggccaatatggttaaacccagtctctactaaaaatacaaaaaaattagctaggcatggtggtgcacgcctgtaataccagctactcggaaggctgaggcacaagaatttctctgggtggcagaggctgcagtgagccaagattgtgccactgcatgatcagtaatgctctgttgcccaggctgcagtgcaatggtgcgatctcggctcactgcagcctgggcaacagagcgagacttcatctcaaaaaaaaaaaaaataagtagacagagaagtgatatattttggaggctgagtcaactaggcttgctgatggatggaatctggattggctctattgacagaatgatgctatatagttaacgaatggaattgattgtgctaatgacttcatgaaataccctgggggtagatcttcccagagaatagttttatcaaatggaaagcccttggctgtgaccttgagttacattgctggctctgctcctacctgaaataaatccctttccttctacggggacaaataaacaccattttcagctacctaagagcagcaggtgtataggacacatccttgctttacaaagaaaatgtttgggggaagataggtttgaatacttacattatatgtgcattgagtgattttagtagtttcctgaggaaaagcacattattttgttcccacaaactcaatacactgagtctggtgggagatgatcaattctagataaaccatgatggcctactaactccccaaaaatgtatataatagcatagctaaaatgaaattaatttttattattgttattcatcaaataatgacacacacaaataaaaaaaaaacgtgtaaagaccatgtaaagtcctgggaaagagaggtcaggtaccttgagaacatgtacaagagaaatgtcacgtagtttgagagaatggggaggtgtcaggaaggaaacagcaatggaagtttaccatgtaaaaagaggggaaaatgtattctgttctgcaaacagcatgtgcaaaggccctgtggttgggggttatatagcagcaatgtgagactgaaagaagaccagcctgggtagagcagagaaagccaaagagagtccaaggaaaggctgaggaagtaggcatgagtcacagtacgtagggctgtgctggccttgacaaggattttagcatttatcccaagagtatttatcccaaggactttagcatttatcccaagagtatttatcccaaggattttagcatttatcccaagagcatttatccaagagcatttatcccaaaagtatttatcccaatgattttagcatttatccaaagagtatttatcccaaggattttagcatttatcccaagaatatttatcccaaggattttagcatttatcccaagagcatttacccaagagcacttatcccaagcgtatttatcccaaggacttgagcatttatccaaagagtatctatcccaaggattttagcatttatcccaagagcatttatccaagagcatttatcccaaaagtatttatcccgatgattttagcatttatccgaagagtatttatcccaaggatagcatttatcccaagagcatttacccaagagcatttttcccaagactatttatcccaaagattttagcatttatcccaagagcatttacccaagagcatttatcccaaggattttgttttgttttgttttgtttttttgagacagagtctttctctgtcacccaggctggagtgcactggtgagatctcggctcactgcaagctccacctcctgggttcacgccattctcctgcctcagcctcccgagtagctgggactacaggtgcccaccaccacgcctgcctaattttttgtatttttagtagagatggggtttcaccatgttagccaggatggtctcgatctcctgacctcgtgatccgtctgcctcggcctcccaagtgctgggattacaggcgtgatatcccaaggattttagcatttatcccaagagcccagttaccacacgtggtatatttcagtacgtcagagttggttgcctctgtttggttacggggctttgagttctagggctctaaattgcagacatgaaaaggcagccattagtgagtgtattcctgtttctgagggcacatcgtacacagcaagataaaggacaagtttgtttgttgaaagaaacaaactatcaagtttgttctcccctcaacttgatagaaatagcgcttaggggccaggcacggtggctcatgcctataatcccagcactttgggaggctgaggcaggaggattgcttgagcccaggagttcgagaccagcctcagcaacatagcgaccctacctctattattaaaaaatatatatttaaaaaaaaataaaaaaagaaatagcacttacgtattcccaaattccttgtcttgagcctatgcccacccgacatgctggaagatagtgatagttctgacccagtggggtcctcccttcctgggaacaagtggaacagacacattggccttgagcttatcagtcattctccagtgaccttgataacagaggcttgttcccaaagtcttggactcaagcccaagtgaactgaaaaaagaaccttccctccaagtagaactaaaaactggatactgtttgataaaaattaagacaggaaggcagtctttccagagaacactttctgtctctttcccccaacttgctgatgaagtggtatcatttgctgctgttatagaaatgtactattacgggtgaaaaacacaaggccagtattttcttgtatataaccaagtctcagttttgcaaaatgatttttttctgtcctggggcagctggggtgacatttcagaacaccaaggaaaagatttgctacacaaacagagcatttgtctgggccagtaattggcttggaataggagactgttttatccgcatgcaagaaattgtgtccctttctttctagcaagagcctgcaaatgcttgtttatgcctgaattataatcgctgcatactgtacttgttgatttaaaaaaatgtttccaacagaccgaaaattgttctcaggctcacagaggaatttcagttgaccttgaacatgagaaatgtaatccctgggcgataaccaattagcacccggaatgactcagaaattactttcaagcctcttatctggaggaattctgagtgacagtaaaatcgagctgctagaattggggtaatagaatttcatggtagtgtgagcttggcgcagttaccacacgtggtatacttcagaacatcagagctggctgtttgcttagggggctttcagtcgaccgtgggctttggaaaagaagactccattttggatggcgcacagtgggatttctcagagtcttaaaatttatttgtataacaaagtgcttactgtgtgccatttatgattctaagtgctttgcaaatattaactcaggtaatttaatccttacaacaacctagaatggtaggtactattatcacgctattttacttttacaaatgaagaaactgaagcccacagaggtttaagtaactttataaggtcccagagccagtcattgtcctgggtttgggttttcccagaaacagactataaggattcaagtgcaagtactttatttgagaggtgatcctggaagcaccataagttaataaggaagcattgccagaaaaggtgggaaaccaggaaagtaagtattatcaagcagactactgctgtgggcagctagggtttaaccctgctggagaactctcaagtcagcgcggaatgcatgcctcagaatttcccaatcaagggacaggaagctgaggggttatccgtcggctccccttccgttgcaggctaagggctgctcccagggaaatccactcacccgcactttcaatgtgccctgtgcgctgtgcccgctcctataaccagaaaataagctacaggcaaagaatcacaggtgtttgctgttagcagccctaggtgtagagagcagcatgctggtggtgtcttggaggaacaccagcgattgtacctgtgcaatgtagcctaatggttaagtgtgattgcttgagagccagactgcctagatttgaatcccagttctgccacctccttgctgagtggctgtaagcaagttgctttgtctctctgagcttctgattccctacctgtaaaatggggaattatagcacttcttacctcatgaggttatgtgaggattgaatgaggtaatgcgtttagcagagtgtctcacatgtcatacatatccagatgttagatgctagcatcatggtggttgttataattattgtctcccccttcgggataaataaagctcagaacatcctctttctgggctttggaagggctgcttggaggttagggaaaatctacagggactcctagcctacagaggtccctgccccactgctgggtagctgggagtgcctgtagtagttccttgtaggggtggagtggcagaggaatctgcagttttagccaggacaggcattcatcatcgggagtggagcccagagtctggctgccagggcttctccactgtcccctcgtgctgtctggaaggtggcttggctctttgctcagaaatgctatttgctttctctcttagcattgagttctagggctctaaatcgcagacatgaaaaggcaaccattagtgtattcctgtttctgaaagcacatcccacacagcaagataaaggacgagtttaatttgtgcctcaattttaaaatgttcgctctttgatgcagtgtgtgctaggcattgtccccttggaacaatgggatatttcaaaggacaaaggacagggctcctgtcctctgaaggctcactgagtaggggccacaaacccaggtgttttcaggagccaggcaaacaacaagaaggcgaaagagcttggcatcacccagtgttagcagatccccttcttcaaaagaagctggggatctgggttttcatatctccaaattttcaacagttggcaactaattaaatattaaaatgacaacaaactctgtgcagaccagaccaacagggttatcagacttctttttttttttttccagggttattagacttctgatctagattctagaagttaaattaacatgcccatgagaaaagttataaaagcaagctgggagggagggaggaaagaggggtgccagccccagattcagaggagagaagggagtttctagtgctgagggatgaggctgttagctgctccttgaaggacaaggaaaaaatcaacccctcttcccacccccccaaaaaagtccttatctgtccactacgcaaagtcaaatgaagaaatcaggaagtttgaggtccgtgctcacgtttcatggggagtgtgtgctgggacccgcaggtggatgggaaagttcccaggatgggaaatgggaactggggcaggcaggacttggatcttcacagtctggagaatggagactgtgaatcagatgggtcctgagccaggattcaaagaaggcaggacacatggtgctaaggtgatggggcagcagggaggggagtagggaaagtgtttgggtcaggccagcttgggggtgatgatttaggagggtgtgaggacatagcccgagaaaggtgagacggcttctgtcctaccctggctcttttgtttgcagtttccattgcaaataagatgaccttgtagttttaactaccccctcgttgcctctacaccccaaatctctgtctccagtccagatatctttgctcaagccccaaacccatgtatacaactgcttactgggtatttacacttgggttaaacctcaacatatcttactgcaaagtaaactgaccaagtatattcacagcagcgttgttagtaggccgaaaggggaaacaactcaaatgcctgtacacaggagacgggataaacatcaacaatgagtgccattcagcaatacaaagagacaaattaccgatttatgcaaaaacatggatgcatttcaagaacattttgatgagtgaaagaagccaggcacaagagtacacactctacaatgctgttcagatgaaattcaagaacagacaaaactgacctatgggatagaaactggaacagagattgccttagtggcgggggttgcggggggcgtcgactgggaacttttggagggtgatggaaatgttccgcgtcttgtttggggtttgggttacatgggtgtgcacatttgtcaaaatctacagaactgtgcacgtgagattggtgcactttgcggtgcccacctcaagtttcaaaacatgaataaagagaaaatggcggatgctttgttagccatggttcctatatggtaacagtggaatatgcaccccatgagggagaaataaaccttgaagttttaagctgctgtggggaagaggggatctcaacatgcctgaaatcacaccggtcatctctgcccaccctcttccccacacttccaaacttgctcctcctccgcttcttctcatctcagtggaaacaaccagcatcctgccagttggtcagaacagaggctggggagctgtccttcatctccaatctcccttctcccttgcccaatctgctacccatctggggtcagtctgtctcccaaatagatccactttgttcagtctacactgcagacaactgagtccatcatttttttttcttttaagacagggtctccctttatcactcaggctggagtgcagtggtgcaatcatggctcactgcaacctccaactcctgggctcaggggatcctcccacctcagcctcccgcgtagctgggactacaggcacacaccaccatgcctggctcatcatttctctccttgataatgcagtgacttcctagtgatcactcagcccacgtgctggggggtctcctctccactcagagtgacctgttaaatatgtatggtcataccatagccctgcttcaaacctttcaaaggctgtctgtcatgctcatagtcagcctgaatttcttaaggtcctttcaacactttgtctgcctcctgtgccatatctgccttgcatttcatgatccagccagacgatgtttcattccttgaatgtgtcttcccctctgttccataaatgctgttcctgctgccaataccagtttatctacttcagcaaccccaacataccttttggacacagtatggaggacccaatcccagctagaatgcacgttttttcagagtatctgtatccattttgccctctgatgtatcctcagcacctagaggagcacttagcatgtagcaggtactcaacaagaatttttgatttgtttgttggtttgtttatgacagagtcttgctctgttgcccagactggagtgcaatacagtgatcagagcttactgcagcttccaactcctgggcttaagggattctcctgccttaagcctcccaagtagctgggactacaggcccactgccaccatgtccagctaattaaactttttttttgagatagggtctggctgtgttgcccaggctggtcttgaactcctggcctcaagcagtcctgcctcagccttccaaagctttgtgattacaggcatcagccaccacatccagcctcaataaatgttttttgaatgaatgaatgaatcttccctgatattcaaaactttggaaagatttattttgcctctttatcttcaaagcaaccaaataatgcaacaataataatagctaccattcactgagcatgtgttgtgtgccaggaatgatactaaggactctgtgatacatcatttcatgtcatcatctccatgtcttgaaaaggtgatgaatgtttaggaagcttcaatcaccaaatgcaaattaagtgccttctctgtgccatactcctctaggtaccagggaaacagtggaaagcaaaacagacaaaatccttgccattggggagcttacattctggtataaggagaaagatgataaattgggaaacaagtaaatatatggtttgtaagatggtgacaagtgttttagagaaaatcaagtaagtaaggcggatggagattgctgagagcaattttatgtagggtgttcagggaagagccctcttatcagaggtgagagagttctggggaaagagtgctctgagcagagggaacagcaggtgcaaaggccctggggtaagagcatgtttggtgcattcagagagcagcaaggaggccagtgcggaagtagaaaggaggctgaaatcagaggggctcagtcatctgtggcctttggcttttactttgagaataatgggatggtatatatattgggcagaggaatgttatgacttaactgatgtattctgggccacacagctgattcatgtcagaggattctaccacgaggctttttttttttttttttttagtgagagagagatgggatctcactctgtcacccaggctggtgggcagtggtgtgattatagctcacagcagcctctaactcctgggctaaagcagtcctcccaccttggcctcccaggtagctgggatgacaggtgcacaccaccttgcctggctaactttctttatttttgtagagacagggtcttgttatgttgcccaggctgttctcaaacttctatcctcaatcgaatctcctgtctcagcatcaaaaagtgttggaattgcaggtgtgagccactgtgcccagccacacatgagcttttaactccacagttttctctctgctaaacgtgaatccagtaacgaagtcctggcagctgcaggtctcccactcatggcttccagtttttgcctcattccaaagcacctgctgccactctgagccccattccacagctcatggcaaggagtccctctcccattgcactgaggacacacgtggccctcactcatccatttatgcaacaaatatttagttgggaactatactagttgtcaggaaaaccatggagaatgagaaatattccgtgtccacaacagtctccaatttattggaaggaaacaagtgaacaggcagttatcctccagtatttatgggaagagaagtggatgaaggaagaaaatcagaggagaacctagtgcagacagagagaatcgatgagggcttccctgagccatgaaaatgtgaaccccaagctgggttgctgaaggggagagaatagccatttgtaccacagtagcagcagcaggtgcaaaggccctgtggttggaggggcctgggacatccaggggagtgaaaggagaatgaagctacattgcagagaagaagcaccctagcaatgatggagctggaaagccaggtagggcctaaacacacaagtccatgaaagcacctcgatctttaccctgaaaatgatgggatgccactgagacattttaagcaggaggggacttggttggatgagaggctcactgtggttgtgtgtgaaacccagtgtaagggaaatcactgtgccttgtgcaggtgagagatgatggcaggtagtgatggttgagatggaaagaagtagatgaattctagagacagctgggaggaaagaaatgacagttctggttatggttgagacatgagggataaaagaaagatggagttgcaaaggatgtccgacaggtttcaggcttgtggagtgatgcatggctatgcttttcatggggacagggtgccggagctgcaggaactacagcttcccattgtgtgcctgtgccttcctacaagatcgtcctcaaaccctgagcatgttttctgtgtgcttcctttttgcagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtatggtatgatttggtggctccacctgctttggaaggaacatctaacaacacaggcacatttgctgttcctatgggacggacgtcctagtgggagagagagtaagaagtaaatagagccacactacactttgtaatgaataccatgaaggaaatgaatggagtgctgtgtcacaaacaaaaaggcgaccctttcagtctgaggaggtgacacatatactgagacctggatgatgagaaagaactagctatgctttcaaagagctaggaaagaatgttctcagaagagagcaagtgcaaaagttccaaggtggggacaggctgggtgcatcctaggaaccatcagaaggtgttggggcaaaatgtcactagcagaaggaggtataggacgtgatgttgcagagataagcagggcccaaggatgcaaaccttataagctacaatgaggagtttgggtttcactcacagtgcagcggggagccattgaacctttttaagcagattagtgacacgatcggatttgccttttggaaaagatcactctgacagccaagaatggaaacggttcctttcaaacagttgcacagtggaaggatgaccctgggactcatacagtgtttctggacgcttttatagatactgcgagatgctgttttactgaagttgagattgtgttataagtatttctgactcatttagtgttgttttggggtttttagtctctttgcgtgccacaaagatgtctagcataaatctcataccatgaactcaggtgtgcaaaaaatataaatttcttttccatctatgtaacgtaagccaaaaacctgggagttatccctgagcttccctctttcctgtattcccactgttcctggccaccgccccccacagccatgtacaatgcattggcgaattctgacagttccttcaaagtatatcatgtattcactaacttctcttcatctctctaataccacccaaatctaatcattaatatcacctggataactgcagaaactcctcagtggtttctcaatcccaatcttgttacctataattaatcccaatcccaatcttttttacctataattaatcgttacctataattaattgcaatcccaatcttgttacctataattaatcgttacctataattaattgcaatcccaatcttgttacctataattaatttactttctacttcgtagccgtaataattttttaaagcttacattaggtcaaggggctcccctgcttaagaccctccaatgactttccatccaattagaagcaattctatgttacatccttagcttgtatcaccctttatcatctggcccttgttctctgtgtgacttcctttcttctttctcctccccatcacccactgtgctctggccacaacatcagctcttgggtcactgaaacacacaaagctccttcctcccttagaggctttgtgattcagctccttttgctgtttgcaaggccggctgcttcctgcaattcacatctcaacttagacgccacttcttctgaaaaatcttccccaactacccactgaaaagttgccgctcattcactgtccattatgtttaactctctcatggcacccatcactgagcaatgcttttcttgtgtccttgttgattttttctctcttccctttctaaggtctaagctccacaagagtagggatcttctccgtcgtggtcgccactgtgatttcagagcctagggatggaattcattcagtgcccagattgaatgcgtggattctctctgtctgtgggtggcaagggcatccactgagatggactaagggatctgaaatgatggctcaaagtctgaagagcttcagcatgggatgggaatagagagtaagggcagccagtaagatggcccatccagtccctaaggttgggaataggcagttggcagtggtccacaacgttgtatggtttttaccagcagctctgagtatccctggggtggagatggagaaggagatggtggatttgaactaagcgtgggattagtagaatcagtgaactagaagattatggaagaaagagagttaaggattctgggaagagagatgtccactgcagatccacagagcctgtaccaagtgctcaagaaaagcatgttgaatacatgaatgaaaatggtatctagattgggttggggaagatgtctagcataaagagggtcatcacctgggtgggaaaaagggagtttagaagtctaaggatgaaaaaaaaatagatgaggtcaagatacgtaaaatgttaggaagaattgaggcattgagatttcaaacatggagcagtttctctgatgatgaggaagaaagtggcctaaataaagaagaggttctaataagctgagtttttacaaattaaatgagcactttttttttctttttgagatagagtctcactctcttgtccaggctggaatgtagtggtgcattacggttcactgcagcctcgacatgctggactcaagcagtccagctcctacccaagttcacatctttctctgacccccaaataactgcatgcaccaccatgcctggctaatttttgtttttgtttttttgaatcagaatcttactctgttgcccaggctggagtgcaatggcgccatctcggctcactgcaacctctacctccagggttcaagtgattctcctgcctcagtctcgcgctcggctaatttttgtagtttttaatagagacagggtttcaccatgttgaccaggctggtcttgaactcctgacctcatgtgatccgttcgcctcggcctcctaaagtgctgggattacagacatgagccaccgcacctgacctaatttttgtatttttttgtagagacatggtctcactatgtttcccaggctgctcaagtacttataagctcaagcaatcatcctgccgtggcctcagaaagtgctaggattacaggtgtgagccaccgcacctgtcctaaattatatatatatatgctttcttttttccttttttttttttttttttgagacggtgtttctctcttgttgcccaggctggagtgcaatggcacaatctcagctcaccgcaacctccgcctcccaggttcaagtgattctcctgcctcagccttttcgagtggctggcattacaggcacgcgccaccacgcccagctaattttccacttttagtagagacggggtttctccatgttggtcaggctggtcttgaactcctgacctcaggtgatctgcctgcctcagcctcccaaagtgctgggattacaggtgtgagccaccacgcccggccatgatattcttaataagcaatgcattcacatgattcatcattaagattatattaaaaggataaacactgagaagtcctgctcctacccaagttcacgtctttctctgaccacttactgctactgctttccctatgtgaacacttttattcagttaatttgcgtctttccagtccccctgagctaatttaacattttttattcttgtccttattaactcaaaagttcatgtactacgcctgtttttgatcacttaacaaaacagacgagaggatgtttgatggaggattggaagttctggagagtcccatggaaaggattggggttggggggtagtgggtggagtcgtaggagaatgaatcactggggagcaatgagagaatagatcatatgtctccatggaaactgttataataattgagaactctgttccagactggagatatagcatcagataaatcatagatgaaaacaacagtaagtcatgaaagcaaagtagaataacaaacacctctatgatcctttaaaacagagtaatcctttgcaactctagtgttgccaactagggttgtaaattaatgcaggttttatatttgaattccaactttgaacattttgcagtctggttaggtatatagatcaatctccataaacagaagaacacagctgcagtgatttgctcttccccttcgaaagatgaaagtgatggggctttggggtaatctgtttccacctcccttaacccaggaaaacaaaacaaaacaaaacaaaacatgtttttaaaccctaatggccaggtgcggtggtttgcgcctgtaatcccagcactttgggaggccaaggtgggcagatcacaaagtcaggagttcgaggccagcctggccaatatggtgaaaccctgtctctactaaaaatacaaaaattagccgggcatggtggcaggcgcctgtattcccagctactcaggaggctgaggcaggagaatcgcttgaaccgaggaggcggaggttgcagtgagccgagatcgtgccactgcactccagcctgggtgacagagcaagacactgtctcaaacaacaacaacaacaacagccccactaataatttgtggggcaactagggaatggcacaagccttttggtaagccctgtaaaaatgaaacaaggcaggaagcaatggtgaaggacattgaatttcaaatgtgtaagcccgtttcaaaatctttcaaaagaagaaaactgtggagagtttgtttttttaaacaggcagaagtgtttacctggaagggctatcttaccaaagcagggcctgttggcatggctggcttactcggaggtagatgccttctaggacttttaatacagagcattcaaacgtgtcattcacgtttaaaaattattttatttctcaacttttattttagatacagagggtacatgcgcaggtttgtcacatgggtatattgtacccaggtagtgagcatagtacccaataggtggtttttcatttagtgcttaatggtgcttagaattttatccttaactgtctgtttttataatgccttgaaactttgagttttgccaacgtctttcaagaattgaactttgaatgattgctggagtcaaaattatgctgcatatatataaattgggcagatttgtaccgtccggattgatgatacaagcttaccttataaagtaaatacagcaaatacttgatcaagtatatacacagcacaaggataactctttatattataaacgtgattcctctaaccctaatgtgctgccataataaacatgcattaaatatttaatgaatgctaatactgtgtgtcttctgagatttcatatgtgctcatggtaatgatttgtatgatccacgtctttaaaaaatagtatgcaggaaagtttgaatggaggctttcttgttctcttatacccctgactcttgcctatggatggaactgagctaatgtacgtgagttgagatgggatcagggggttagaaaggagctgggggaggcagctggtgtgctatagtggacatagatctataaccataaagaagctgaaagaagcttcagcacagaagatctatgtaaaaatggtatttactggaaaacagaaatagcccaaatggtatattcataataaatacaaaaaaaaacgaagtgactctctcctctctctttctgtccctctctcatgcacgtgcatctatctatctatctatctatctatccatctgtctatctaatctatcatctatctacctatcatctttctgttatctatctacccatcatctatctatcatctatcatctatatctatcatctgtttatcatctatcatctatttacctattatctgtctatcttattatctatcatctgtctacgtatcatcaatcaatcaatcatctatctgtcgtcatagaaagattttcataacatatcaaataaaaataaaagcaaattatggaacattatgattggcaatataaaatgtgtatagaccaattccttttatgtaatatactcatggtccctgctttcattaaactttttcttcaacatttcattatgaaaatttaaaaaatggaaaagttgaaatgattgcataatgaacatctataacacccaccacctggattccacaagtaacatttgactgtatttgctttatcatgtatccatctgtctatccgtccatcaacgcttttttaatgcatttcaaagcaagttgcagacatccatacactttacatttgcagataactgcaaatgcactttacattcagcatgtataccatttaaccagaattcaatatttgcaatgattattttaaaggtaaaattacacacactgaaatgcagctatcttaagtatatcattctatgagttttgaaaaacgcatagtttttaaaatgcagtggaggtatacacattcatttaaaaaatcacacaggcatgaaagcaactgtgatgtttagtatgttccatgggcacctgcgggagtgggatttgccctggttgaagccagagaagtcttctgtgagaaagtggctcgagctatagctaaaggacgagttaagttaactatgcaaagaggggaaatagtaaatgaaaatctcagaatgtctctttgttcctggcccccacccccaaaataggcttggttaatctgtgtggctgacagggcacctaaacttttattagggtagattcatctgctgtaacaaatagacccccaaatatatactggctcagacacaatagaagtttaaaattttcattaaacttctaagtttaagacgtttaagacaggcgcgcctggccacacccactctctccatatggtgattggggacaaggtgtctttcgtcctgtatggctccattaatccctagagctttgtttttctctgcagtcagagggtggaggaggcacaagctgcttcttaaaagtctcagcttgggaagtggcaccaatcatttctgcctactctctattagagaaaatatagccacgtggccacacttcagtgcaaaggaggccgggagaacaatttgggtggatgacacgtcgtctcagccacattccctacttttcagtcctggctgcaatttttcacggtgacacacaaaagaccttctgacttttccctttagagctcttgatgtatcacactccacacacaaaaaacttcaagtgcctcttttctgtgacatttctttgtgttcaaatcatggagcacgccaggtgttagtggtgactttcttgaagctagcacgagccaggaataagtcaagtaggaagaagtcagcagcttatgaaattaaaaagaaaaagtgaagttactatagaaactaggtgcccaggtatcacattttttctcttttaaaaatcccatccagctctgttgctgtctatgaatctaagatgatctaaaatcagaagcagagaggtgagagacagaaccattaagcttccccatctagtgcttgacttccctaaaataatcccaggacactgaaccaatgacattaaatgcctgggtgtatcactaaggaggctgtggagggtctggtggtggccccttccactagggtacccctagaaacttggcatttgtgtgacactctccaagatgctggcatcaacttttgtagctcaaaattcagaccgtacaacagagttgactatagtcttggccaagttttccaaatattagtcatttatgcacctgttatgggtttttccttgccattacatgcctcctttattcgatcatatttttctttaaagtgactttaacttgacttccttttcttcttcttaacattgccctaagcaataatatatgtgaaatcacaagtttgatgtaccagttatacatttattttaatgtgtttggtttgatataccagttatatatttattttaatgtgttttaggaaaatatattaaaagaagagtaattttgttcttgtactagtacctgaaccacatttggtgaaaaactgtcataaaatcttacacttacacaatgtaagattgaggtgatttggcagctcgattaccatggtatttctaagaatgtaaagtcttttgttacaattcgtgtgcgtacctggaagttacaaaaagtctctgttcatccccctcctccatatcctttccttcaaataaggaatatgcgcaacactgcctgtatccttaaaaatctttcgtgtgatcttgacctccctctaccctcctttactcactaaatatatccagacagcaaagctactctttggagattttctaccttcatttcctccccacccactccttccttatccttttgtattatgtctcctccccttagcaactttcagaaacatctgtctcccaggttatcagcagtcttgtaactcatatctctccagatctgagcatgaggcatcctggcttgctcaggggagtagggcaggcatgaggggaagggaactggaaataagattggaatccatacattattctgggcagaagtcatcacctttacagtaacttcccactgaaaggcataactaaggattcattcattcaagaagtatttattgagcatctactatatgccaggtacccttgtaggtacagaggcaatgtctatgaacaaaacaaacaaatatatctgcctgccctcatgaaacttatattctagtggtagtgatggtgacgacgaagatgatgataacacctaacattttttgggtccttactatgtgccaggctctgttataagtgcttagtatgtattcattagctcacacttactctatgatgcagctactgttgtccccattttacagatgaggagagtgagatgcagaaagttggaataacttgctgaagtcacacagctagtaaatggcattaaacagatcagctttgatttagatgtgtatgatttggggctttttttttttttttttttttcttctagagacagggtctcactctgtcacccaggctggagggcagtggtgcaatcatagctcactgcagccacgaactccttggctcaagtgatctgcctgcctcagcctcccaaagtgctggcattacaggcatgagccactgtgaccagctgattttgggatcttgattgcttgaaacttaacatgtaatttcctagttttaacagcgattccgtggaatgtcacaaacatattctaggaggttagtcatttttccctcttattttctcatctttccctctaagtgctaagcagagtttatggccaggtgcagtggctcacacctttaatctcagtgctttgggaggccaaggcaggaggatcacttgaacccaggagatggagcaacaaagggagaccccatctctataaaagcaaaaaacaaaaaaaaattgcatgccttattttcagtgtaagttgctgccattagacaaaccacatactcctagtgatggagggctctgggttttctgttcatcctcatcactctgtgcttattggctacctgtccatgtgtaaataacacatgtgccctgtgctcattggaaccgtgagtcatccgcagggattcctaagagggcccatgagaatggctttcactcctccagcctctgcccttctgacctcctccacaggcttcagccttatgggagtccccaagtcttggaagcatctctagtgagtgcagtgactccttagctggttccttttcaaccttcaacctccattttcttaacccttaccaactctactgcccagctgcacccactccaattccactcacaccctgcccattatcgccaacgtttctgagctcatgctcattgacaaggaccatgccatggatttgcatgcattatatcatattaattcacaccataatcctgcaaggtagtcactgataatcactctattatatcatatagaaattgtaaggcagagaggttaagtgacttctccaagaaggaggcgggaccttgaaagctggttttgtgatttcagttgcctcttgccatctcttctccactttggggtccacacatcttcccaaacccctagtttaaattttttttttttttttgacaagagtctcactctgtcacccaggctggagtgcagtgacgtgaccatggttcgctgcagcttcaacctcccaggctcaagcaatcctcccatctcagtctcccaagtagctgggactacaggcacatgccaccacacccagctaatttttttattgtttttgtagagacagggtcccactttgttgcccaggctggtctcgaactcctgggctcagggaatcctcctgccttgacctctcaaagtgctaggattataggagtgaaccaccatgcccagtccaaaccactactctttcctcttccttttttcctttctttcttccttccttccctttctctctttttgacttttttgaaacagcagttacaaaacgattacaagagctacctaatgaggccaggtgtggtggctcatggctataatcccagagcctctagaggccaagcctggaggattgcttgagctcaggagttcaagaccagcccagcctgagcaacatagcaagacctgatctctaaaaatgtgtttaaaaattagccagacacagctggatgcagtgggtcatacctgtaattgcagcactttgggaggctgaggcaggcagatcacgaggtcaggagtttgagaccagcctggccaacatagtgaaaccccatctctactaaaaatacaaataaaaattagccgggcgtggtggcgcatgcctgtaatcccagctactcaagaggctgaggcaggagaatcacctgaacctgggagtcagaggttgcagtgagtcgagatcatgtcactgcactccagcctgggcgacagagcgagactccgtctcaaaggaaaaaaaaaaaagccagacacactggcacacagttgtagtcctagctactctggaggctggggcaggaagagaggttgagcccaggagttcgaggctgaagtggctatgattacaccattgcactccagcctggacagcagagggacaccctgtctcttatatatttagaaagctgcataatgacatttgtgggtttctccttcttccatgaaaaaaaaagcaaaaaatggtatctcatgactgcattggtatgaagacaaatatattaatattacatattaaaacatgtacttccacctaggttcacttttttccttgtgatttaaaaaaaaaaattaaagtgccttatgaaccttgaaaacagcatgggccctgagcactgtgcctggtgggttttgatggagaagtcagccctatgttccagctccagcatctcaatagcacctccctctgcagcctccaaacttttcttcccaaaggccagggtgcttaactaccatgctctgtgagcatgagagagcattccagagttccaggccccagacctcagtgtcccttttttttttttttttttttcctttttgagacagagtcttgctctgttgcccaggctggagtgcagtggggtgatcttgagtcactgcacctcccaggttcaagcaattctcctgcctcagcctcccgagtggctgggattacaaacgcctgccaccacgcccaagtaatttttatgtttttaatagagacagggtttcaccatgttggccaggctggtctcgaactcctggcctcaagtgatccgcctgcctcagcctcccaaagtgatgggattacaggcttgagccaccacacctggcctcacagcatcatctgctggagccaagcccggcaccagattttaacaggaagaaattgcctgaggagattaaaaggcagcttagttcatgccaggaacaaaggccttctctaaagtctgagcttctgttgtgggagtctctactaattttaatctcattagtggtatgtattcacacacagacatatacatacatacattagatgtggttatataatcctacagacaaaagcacttccctgtacttcagcctgctttgctatcttcctgcaccatatggtgagttcctttatcatatggttcacagatagctcaaagtgtttgctacctgtttccttaatcctcttccagagaacctttttgacatttgctgtctgatcttggattcctgccttctctttggttctatcgcaattatgtcacttccctgcccccaccaagccttcaacctttccttctttcatatgcaattctgattgcagcgtgtttttttttttttttttgccaactcatcttcccagatcctcgtgaggcccttcttccaccttcccgaattttccaggtctctcctcaatgaagtgacttactgctcttccgcagcctctgccttcaattctcagaaggtagtatgttacaagacaagataaggttcatttttctcaagaaaataaattatatcaaggaaaatgaaatgtcaggaatttaagttttacaaccttccatctgctgcaagtagattgtcaagccagagtgagtaaagcgggtatttgctgagaagacatggcttgtttctgtgtatctcaagacacccagaggcaagaagtgccacctgaatgagagagcttccagcagtctgataaccatggctccatctggggggttgtaggggggcccccagcctgtcatccctgcttctcgatgacatctctctgcagatacgcatcagcaccacctctctcagccttgttgatgcttctcaagtctccatgtctaattctcacatgtagaatatcctaggaatctaaaatcccgggaaagaaaaactgatgggccagtgtggaccagggatccctaggatccaattcactgtgaccggggaagcggttacttttccaaccatccatcaggaaagatgacaagaaaagcaaataggatgtgggcagttttcctatgagaaagaagaaaacgacgggcctgtctggcacacaggccaaagtgggagtttcctttaaatgtgtattattttttattttaatttttttattttgtttatttatttatttttgagatggagtctcactctgtcgcccaggctggattgcagtagcatgatctcggctcactgcaacctccacctcctgggttcaagcgattctccttcctcagcttcccgagtagctgggattatatgcgcatgccaccatgcccggctaattttttttttttttttgtatttttagtagagacggggtttcaccatgttggccaggctagtcttgaactcctgacctcaaatgatccatctgccttggcctcccaaagtgctgggattacaggtgtgagccactgtgcctggccttttattttaattttttagagacagcatctggctttgttgcctaggctggagtgcagtggcatgatcttagctcactgcagccccgaactcctgggctcaagcgatcctcctgcctcagcctcccgactagctgggactacaagtgcatgccatcgtgcctggctcatttttgttttttttctagagatgggatctcattatgtagaccaggctggtcttaaacttctggccaccagcgatcctcctgcctcagcctcccaaagcagtgggattacaagtgtgagtcacgtcgctgggccctgtgttttctctaaaatgttgcctgattctttgggaaaaatatcgcaaagataaatcaagtcctcttgtagaaggaccagatagagcccattaacatggaaactctgtctcaggtgatcattcatggctactggtccaattattgtgctatcatggtacctgccatcctctgcatatccatctcaactttatctctatgtattatttcagaaatttacagtcctggtaaaatgaatccctggttactaacagcataacccataatcttttctataatacaacaaacataatggcagaaatttgtggattgtaatcatccaacacccatgataaatattttggatgtacaaatgtggatggtacctatgattattcatgccgtagttgtttcaaacccccaccccaccccacagtttcaccttatgtactgacctcattgaacaccactgcggagattgataacatttttggagcactgggaactcatctgagtgttttataggcattgctcatttaatcttcaccatgggtcttgtgaagtgggtgctgttattatctgcatttttaaatctgtagataaagagacagagtctctattttgcagatgagggaatagaggctcagagaggtgagaagcttgcagtcctgaagcggtggaggcaggttcaaaccagggagcctggctgcagaatgtgttgccactcagctccatagtccccttgcatccagtgccccctactcctgctgtgctgaaacccgttctctattagcagtgctctgtaactccaacaacaaaggggggcagtgcttacaaggcagatcagattataaacaagctttcttcctgccacctaattgttgccatgaatgacaggactttaagggtttcatttcattctctttcagtagaagccatcaattattagtttattttcccagcaaccatttaaaaaagagtcaaattaaatctgcttttattttaactatccagctttgtcaaatataacataggattcaaagaaatttgactaagccatatatgtcaccaatgtttattttatttatgtatttttttttggcatttctgttcttttgtgagtgtgagtggtgagaacacttgggatctcctcccttagcatatttcaagtatataacacagtattattaactgaattaccatgccataccttttaaattgctagtacttatttatcttgtaactgaaagtttgtaccctttaatcaacatctccccattttctctactcccagcccctagcaaccaccattctgctctctgtttctttaagtttgactattttagattccacatatgtgagatcatacagtatttgtctttttttttttttttttttttttttgagacacagtcttgctctgtctcccaggctagagtgcaatggcacaatctcggctcactgcaacctcacctcccaggctcaagcgattcttctgcctcagcctcctgagtagctgagattacaggcatgcaccactatgcccggctaaattttatatttttagtagagacagggtttcaccatgttgaccaggctggtctcaaacccctgacctgaggtgatccacctgtctcagcctccccaagtgctgggattacaggcgtgagccaccgtgcctggccccagtatttgtcttttggtgtctggcttattttgcttaggataaggataaggtgctccaagttcatgaacatttatttcagctcaaaagaaccgttcagttactggaattgatcaatatcaattctattggtaaaaatcaattctactggtatcaacaattagacgacacagcccagagtgtgaaaatagtagttctctcgcatttcttgttacaacccaattagacatttcttattagacccaaccacacatcctcatttaaataccagggccaggtatttcaggtttcaatctccttgttccactcctcccctttctagcagtcactgtgagtcatcccttctaggggtgtagtgacatttgcttaacaatagcaagtccacagaaaccagagatgactgggctaaatgcaccttcattctaaacttcgtttcacactttcatggctttctcagctagtgggcaaaaatgctacttgattaaattacaggtgtggcatggcctcattttaaaaggttgaaatcttaatgcaacctgtcaatctgacctctgaaatgaaaaattagcttatctatcacacagatccatgcttttatcatctataaagagatttttaaatacagaaaaccttacgtaataaatcaagaaatagccaagttgtatcatccgagttgatctatacgccggatatcactgctcttcttttcatctggccaacgtgaagactgtattcgaaaagtgctgcagtcctacctacatccacactattaattcccaagcatcttctccccattatatcactttccagtttttcctgaggtacgtcttcacttggcagagtctacccagttgccttctcctaaacagactgttagaagtctgaaatcatttttagactgctggcttcctctttactgctagaggcaagtgcatttgattccttcaaaccacatgacttcgcatcagactgatgtggccactgtcaaatgtaacatttaaacatatgtttgtgtggacatatgtgtttggaacatttcatccgaagtctgacgcttaagaatacactttggaaaatcagaattagggccttcaagataaactagaatgtgataggacatcttcatttctggtcaaagttggaagtttaggagagcctcaaaagtgaagaattcgccaacaaccatggtgaatgcagtgtactgagttcttgtaaccacccggtgggatcttcttgcctgctccccagatagagccgatttctcaagaggggaattataatagggaaagagctttacacacaaagactcaaatcagcctccatgaatatttggaggctagaatttttccaagatagtttggcagggagaggaggtggctagggaatgggtgctgctgattggttggagatgcagtcataggggtgtggaaaatggtccttatgctctgtatccacttctgggtggggtcgcaggactggcttatgggttcacgtcggggctgtccagtagtcagaaagggaaaagactgaaagacatctcaaaaggccaatctgcagttctacaacagtgatgttatctgtgggagtaattgggaaagttgcaagtcttgtgacttctggaataatggctagtaatcctttatgtctacaccttagccgaattcaggctcctttcatcctcctaacttggcagtctttcattagttttacaaaggcagtttagtttgggggaagggctgttaccatgtaaactatacactaaatgtttcccaaatttagcttggcccaagtccagaaatgactaagggcagtttggaagtcaaaagcaagatgaggattggttagatcagatctcttccactgtcatcatttagttataatttttgcaaaggcgatttcattctttgctatatgttaagctgttaacatgccttatgtcatgaaatcatcatcatggccctactaactcttgttaatggactcttgtctatattttaccctgatatccaacctgctgtgagacctcttgcttttgtttgtttgtttttattttttgttttttgagacagagtctccctctgttgcccaggctggagtgcagaggtgagatctcgggtcactgcaacgtccacctcccaggttcaagtgattctcctgcctcagcctcccaagtagctgggattgcaagcatgcaccaccatgcctggctaatttttgtattttttagtagagacggggtttcaccatgttgacaaggctggtctcgaactcctggtctcaagtgatccacctgcctcagcctcccaaagtgctgggattacaggcgtgagccactgtgcccggccaagacctcctgtttggaatggctttcccctccattccaggcctctggttatcagagatgaggtagcttaagcccttcagtgcttaatccctggcccaggcagaaggagggctttggcaaatccgcatgctagaaaagatgagtttggaagggcctggaaaccagggtacatagttccttttcccttgagattttagaagttgacagacggtttgctggttttgtagggaaatcctatctgccacagagcatgtggattacccagggaggatcctggaggtcacgtgcccagtaccacctctaagcacagacagtatgaccttgcctttcactctgggctttgtgtaaggatctcccaggacatagatttcatagcgacattggtcgattgctctgattcactttctgcctttctctttcttgcatatggagaatgtgggaaagaatcccctatacacacccacaggagttagaacatccttcttatcctccataatcgtgccttcaaattaataattatggcttgctgtgtgttgggccctgagcttaacctgcattatgtcacttgatctcacaacaaccttctgagggagaaactgtcattattccccttttatggattggggaactgagactcagagaggttgagtaactcagccaagaacacacagcaaaccatatgatagagtcaggatttgagctcatgattccaaagtctgaacttgaaccttctatgactataattctaattagatataagcttccagatcatcagactctgtcgatgccataatctctttcttacatggcagagatggtcaggatacctgccacgtggtaaagacgtggatgcagaagttaacctccatttgattagcttcggtgcaccaagctgcacccaggtttctctcgaaatcctgctcctgagtgggtgagtgccccgggaagagcaggtggttggcgtttgctcagttttccagcccctgatcaccctgatggcctctagccagcttttctctctgtcctcctccagtgagggccaggcctggcacaggcagcctcccaatgtttagaaggttccgatttaattggtctagagtgtggcccaagcatcggcttctaaaacctccacagggagttctaatatgcagcagggagaagcagcagctcagtgcagcaggcaaggctcgtccacggaagggctgggggaaggaaggagatcatatttgccttaaaacttggagttgagctcatctgacctaccctctgcaggtcttcagggggactgggaagaatccatgcaggagatagccccagagatcaaggggatcctcaaagagatgggatcttaagatagagggagggtacactccttgcaacagatcagcaccctgaccctgtacccagcctcgtccacaaacctgctccctagtgctgggcatgggatacagagctaggggtcgtgtggtcccccggaggcctacagtatatacacatgagctgtaacttgcttgtctgtccctccccaagttgacctcagtttatcacaccttactgatgctcttctgccaatttagtgtttgaggaccctgtgagccctaaaggtctctttctcttattttattattttattttattatttcatttatttattttgagatggagtctcactctgtcatccagtctggtgtgcagtggcatgatctcggctcactgcaacctccacctccttggttcaagcgagtctcctgcctcagcctcccaagtagctgggattacagatgtgcaccaccacacctggctaatttttgtacttttagtagagacggggtttcaccatgttggccaggctgttcttgaactcctaacctcagatgatccacctgccgtggcctccaaggtgctgggactacaggcatgagtcaccgtgcccggccgagataggatcttaagacagagggagggtatagtccttgcaacagatgagtaccctgatcctatacccagtgtcatccacaagcctgctccctagcagggatgggagagggagctagggagggaggggcatgggagagggaactagggatcgtgtgatcccctggaggcctacagtatatacacatgagctgtaacttgcttgtctgtccctccccaagttgacctcagctcaccacaccttactgtgttgaggtataatttacagaagactcacttgtttgtttcatgtaatcttgaatgatgctcttctcccaatttagtgtgtggggacctaagagccctaaaggtctctttgtctattttagatgcaccatctgaattcaagttagaatcttttcccaatcactgtttgttagtcaagcttgcagactgtgacagtgctagatgttttggtctcttcttccttgcctcctcctcctccttttctgattctgttgcagggatgttattaagaacaccatccacagcacagtgtgttcaaacatccatgcaaaacatttctcttagacctaagttctagagaaagcttatttttctcctcaaaaaacgattttcattatagaaaatatgaattttgttatgttgcatatatttctgattgctttggtttccaggaagcagaaagagaaagtaggagagagagaaagagagagagagaaagagagagactgagaagaaaagagggagagaaaaaaaagaaaagagaacgaaggagagagggagatggcaaaggagggaaagagagagtatatatctataaagtatatatgcatacatgtacacatacacgtgtatttactatattctttttttctttttgagaccgagtctcactctgtcacccaggctggagtgcagtggcatgatgatctctcggctcactgcaacctccacctctcgggttcaagtgatactcctgcctcagcctcccaagtaactgggattacaggcgtgtgctatcatgcccagctaattcttttgtatttttagttgagacagggtttcaccatgttggccaggctggtctcgaaatcctgacctcaagtgatccaccctccttggcctcccaaagtgccgggattacaggcatgagccaccaagcccggccactacattcatttttaaccacctgtgttgaggtataatttacagaagattcacttgtttgtttcatgtaatcttgaatgatccctcaaattctttgtgaaatatgagttggatggagccttatgtaaattaaacaatgctgacacccaaggaactgaagatctttagtgaccttgatctgggagatttttaaagcaacttctcctactcatgaaatcctttcattcattgattcaacggatatgtattgagtgtcaactgtgtgctagatgttggggacatgacagtgggcagctcaaagaaaatgcctgccctcatggagcttccactcttgtgagggataaaaataaacagatagatattaatataatgcccgtgtggtaagtgctgtcaagaaaaacaaaggaggggaaggggatggaaagtgacaatggggcctatgagtttagagaaggtggtagggagggtgttggtgacagggtcacattggagtgacctgaacaagatgagggagcaaactgttgagtgtccctaggggaagagtcatgcaggcaggaagagcaaaaggcagtgattctgagaggtgagattgagtcccaagtacagtaggaggacagaggaaagccttaggaaggtggagtgacatgaacaaacttaagtttctaaagcatcgttcaggtgtatagagaatagaatggaccaggtgcagtggttcatgcctgtaatccagcactttgggaggccaaggtaggaggatctcctgaggccaggagttccagacaagctggggcaacagagtgagacctaatgtctaccaaaaaagagagaaaaagagaatagaatgtttatgagagcgagaagaggggaagcagaaaacagggtaggagacaactgcaggaaaccaggctaaggatcaaggtggctcagatcagcaaagaggttgaacttagtatatattttgaatgtagagctgacaaatcttgtgattgtactggatgagagatacaggagagaggaactgagggtgactggatttggctttggacttgtggcaagtgtatgttgaagttgagcagttgggaagcaagatcttgggtccctggctgtctctgcccttgcacactagtgtggccatttgcactgctccctcaggacaaagctcccgggccagttgaaaaccggaggttggtgctttgtacaaagctcaccatcagccccctttgttgtttggtgaaaagatgatgttgacgatcaccactgtaatgggtagaattgtgtcctcgtaaacaatgtatgttcaatttctaatgaaggttgcctcacttggacatagggtctttgcagttataagcaagttaagatgtggtcactctggattagggtgggcctgaatccaatggctggtgtcctcataagaagagggatatttggataccgacagaacacacagggaagaataccaggggaagacagaggcagagattggagtgatgcgcttaaaagccagggagtgccaacggtagctggcagccagcaggacctaggagggaggtgtggatggaacagatcctccctcagaatcttcagaaggaaccaaccctgccagcaccttgatttgggacttccagcctccagaactctgaaataataaattccttttgtgtgaagtcactcaggttttggctcttccttttggtcatgctaggaaactagtagaaccaccaggtattaaatatttataatttgccatgcacagtgctaagttaaggtgtgcactaagatactttatcccataaaactctctcagcagcaccaaaagcaaagtattgttggcatctccattttataagatgaggagaagattgaggttcagaaaacagtgaatttctcaaggtcgtacagcttgtatgtggcaaaacttggacacgtaccaggttttctaactctaaaagtccatgccctaaccattatgcaacgctgggccacagtcaggggccgagattccaggcacgctttgccattgggattcgccagtaaagttcatcaccacaaactttccagccaggaatccctgggctactttcctctgttttatttgctgtcatcagagttctgctatttatcacatctctcccagaagattcttgggggaacagatgtggcttggaatttgataagaacgtcacttcaacacatcctttcagtctgtttggaatcctcaccctggagagagagggacagctgaacaaacagcccacgccctctatgttggtattaaagtttctggaagctccagaaactgcttgagacaattaataagagatcatttccatttaaaggaacatttttgaacgtgggcatcaccagccagggcaatggctacttttctgctcttttcctctcccatggcaaaacttcacagcatatggccgggcgcggtggctcatgcctgtaatcccagcactttgggaggctgaggcgggcggatcacgaggtcaggagattgagaccatcctggctaacacgatgaaaccccgtctctactaaaaatacaaaaaattagccgggcatcgtggcgggcgcctgtagtcccagctactcgggaggctgaggcaggagaatggagtgaactcgggaggcggagcttgcagtgagccgagatcgcaccactgcactccagcctgggcaacagaggagactctgtctcaaaaaaaaaaaaaaaacttcacagcatatgtggaggcagaaaggtctgcccaagccacttgatggaagcagggccgtgtttgtcctgcttattgggcacatcaccagtgcctagcatcatgcctagaacaaaattcccaatagagcttgtagacctgatggaagaactggaatcgtgactgcagcatgaatgcacaccaagctcatctcgccaagcaaatgttagtggttgtataagaaatagaaaaaggaaatgactgttctctctgtggctatgtgcaaggtggataggaaaagaggaataggaccaggatctaaaactgaatttaaaatattccagcactgatttgctcaccactgaacacttggcacttagggcttgatgatgggtgtgtttaagggcatggatttaagggacaggtgactaggtgtcacttcctagtggaatacggacgagtcacctagctttgttaagccctcccttcttcatctgtaaaatagggatagcagcagtttccaccttacgtatttactgtgggaattaaataagataatgcatattggaagtaatcagtgggcatgtacatggttattgttataaagtccaaactgtcccaacgttgccctttttttccttggcacaaacactaggcctttgagtatcacaaattctttgtccagccaccctacttggtggctggatctctgtgattctattagagacaattgtctgctacatctcagagagatgggagtcagcatctgcaatttgatttctgaagcttaagtgctcatatccttataggaatcataggccaaggtttgtagatccagatcgtttaatcctaaggaagcactgttcttttccctttggctgaaatatgcctcctgtgtccccgccttgctagtcctattgatacttcaggtgtcagcttaaccatcacttcccgaagagcatcttttgctgacccactcagcgatgttaagtcttccatttaaacactccaagagcaatgtgtacttctgtttcaggggtctcattatgattgatgttaggtagttatttgtacaggagtgtaagcttcatgagggcaggaaccttgtcgttctgcattcctggtgcctatctcagtgtctgacacatcctagaccctaaattaatgttaactgaaagaattgtctagtcttctaggtgctggataaaactaggaaagttgatgcatttggaaggcccaatgaattccatctctgttgcctctctcagttgaagctttaaacaatattgttattattgattgaaaagagcatgcataaccaaacccaaggtggcagggaccactgctgaccaagctgggttgcaaattaaactgcagccatttttgatcatgtggttactcttcttttccctgatccttcttgaaacacttattctaaaacgagggtcagcagactattggaacccaggctactgcttatttttgtaaataaagttttattagaccatagccacactcattcacttgatccagaccgccctgcaaagcctataatatttcctgcttggccctttatagagaaagagggacttgataaatctgttctagttatctattgctatgtagcaagtcattccaaaacatagaagcttaaaacaacagccatcctatattatctgtcatggtttctgtgggtcaggagattgggaatgatcactggttggttgtggcttgaggtttttcctgcactggctggagcacctggggctgcctggtcatcaagcttatcaggtagtaccagggtttcttcatggggtcttgttccctggtctagcattgtgtcttggggtagaaaggaaagaaactgacagaagctacagcctcagaagtcttgcagggtctcttcaccacattctgttcattaaggcagccgcagtgcctgcccaggttcagagactctggctctgattggaggagtatcaaatatttgtagacatgttttaaaacctctataaagtatcacttccttcgtgctatggggacagctctcaaaatgtaactccaagagaggacagagagatttatatcgaaaatgaaagcttgattagaatattaagaagaaaaggaaagttttctctcatcctattaatgactgctgagaaagtgttaggaaaatcaggatggaaggattctgtcagctttacctactgacatctcctagccaccttattaaatgaatcaattttgataatatctggtgattataatcaacataggaagaatatgtttattaaaatgcagactcccaggtcacagcccagagctcctgaaggagagggagtgcttggaatctatatggtaagcaaagaccctcaagtgattctgacataggcaagaggcactgtcctttataaagactggaatttgccttgttttaggtcacatactgacatgatgctacttggcttcatgtattttaattattagtaagaatttgagctacctatgtaataattttgttttagggatctctaagatacataatccattcaaagtaatataaataaaaataactttattggaggaacataaaggtttcaaacagaaaatggctaagcctcatgagagattggaaactgaaagcaaggcctctgcttgttctcttaccttctttgtttttttccccctgcctcaaacatctattttattcctctttgcctgcacagtggtagaaaaggaccacgctaggctgagtgtggtggcttacgcctgtaatcccagcactttgggagacctagatgggcggatcactgaaggtctggagtttgagaacagctggggcaacatggtgaaaccccatttctactaaaaatacaaaaattaaccaggtgtggtggtggacgcctgtaatcccagctacttgggaggttgaggcaagagaattgcttgaactcgggaggaggtgaacgaagatcatgccactgcaccccagcctgggcaacagggtgagaatctgtctcaaaaacgaaaaacagaaaacaaaacaaaacaaaacaaaaaaggaccactctaggaagatctgtgtattctctgttgagggacccaggactgactcctcagagtaccctaattcaaattcttgggagggggaatccgattggcttggctcaggttgaggaacttacctctgatccaatcagctgtgaccagctgtatccactgcccaatcagaaggttcttctaataacacagagttggaagaagtgaaaggcatgctagggttttcatttccaaattaaactgcagtcattttttatcatgtggttactcttattttccctgatcttcttgaaacacttgttgcaaaacaagggtcagcaaactattggagcccaggctattgcttattgttgtaaataaagttttattagactacggccacactcattctcttgatccagaccgtcccgcaaagcctataatatttcctgtttggccctttatagagaaagtgtcctgactcctgctctagaattcagttcgcttctatgtctaaatttttgctatgccttatgcatgcccgttctgttttccgttaatcagtatagggcatgttgttgagggcagggcaagacactgggaatcttcacacacccctgtttattgatttttaaaactatctgtacaaatgcaatagtatctcctacgatgcggagcacatagcattgctgatttgcaagaagatttcaactgctacttgagattgttttaggtgccgtgtagttgcactatgaaataaaattaaatcacgttatgataaggttatttctgtgtctccttttactctttctaattacttgaacaagcaaatctcatttgatgacaatatgctctctaacaactttctaatacaattttttcctttaacaaggagaagatgcagagcctgactcagaaccttcagcagccagcagtatatagctagaatttactggcaccgctttgcttttatttatttttatgcttatcttccatttatgacttgtgatactggcttgccattaatagtggtgatataaagtttccttttcaaatttagttaagttgaaatgtgactagatttttaaaatgctaagcaaataacagtttaggtggcaggaagaaatgtgaaaaaacggatatgaatgattgaagtgcggaaatgcctgagctacagtaactgacatagttacaaagcagccctggtgcccagaggaggtagtggccgatttggtctgaatggaacctccagattagaggaggagataacagcccagtggaatctcagattttcaaagcagtgcaagagcatggaaggacgtcatagacagtgggagtcgaatgttcaaaggaaaagaaagaacaggatgtggtcatggaattgtttggctttcaagagccactgaagggctttcagcattcaagtggcacagtcagagctgcattttcagaacagtcattagctgaagcaagttaatctccctgagcctcagtgtgtttatctacgaaatgggggtaattgacacagatgtaggatgtccacccctgtccctggtgaagggggaaattcccagccattctgccctgtctctcttccatgtggaaggctaagatgtcctatcatgactgcatctgcactgaaggtgtctagggcccctccttctctcgttttggttgggggaatgggagatagttgcagatattcaggattgttggatggtgccttgaccggtggtgatgggtcagggagagtgtattagtccgttttcatgctgctgataaagacatacccgagactgtgtaatttatgaaaaagaggtttaatggacctggggaggcctcaatcatggtggaaggctaaagtcacgtcttacatggtagcagtcaagagagaatgagagctaagcgaaaggggaaaccccttataaaatcatccgatcttgtgagacttattcactaccactagaacagtaggcaggaaaccgctcccatgattcaattatctcccaccaggtccctcccacaacacgtggaaattacgggagctacaattcaagacgagatttgggtggggacacagccaaaccatatcagagggtgtccactgtcaaggacagctcagcaccaagcccttcttactgggctctggagtttctcagctgagaactcttcttctttccatctccaattcctctgctcacttgtcttccagctaagtcacctccctgccccctccctgcacatgtcccggccccagctctctctggaatccaggagcaggaagtccctgtctccacctgactctacatcttaggaaagtgactcccttgagtcattgtttctgtgttagtaagcattgaggaaggaaaatacatcccttgggtaccagggagagaacagagggaggcaagaaataaactgaaggtgcccatcctagcacttggagccctgtcttgccatgcacgtaagcagagggtctgcaggagccactcagactggcagcttttcttttttattgtgctggggaagaaagaggttaaaaagagttctcttgctgtggaagtgtgtgacagggaccctcttcctaaggtgtcccaaatccctgcatctgcctggcctttgtcactgtggctgtgatgagagagaagatggtgaggacaggagataggaatgctgtgagctggcaagctcagctcggaagcttcagtgcatgggtgcatgatctggaagcttctgtgcatgagtttagccagaccttttgctgctgggataagagctgagtggggtgtgcagagctgccttcctgctgctaagcttattctatatgtcaccccttctagcctgagtcctctgttgcatcctctggtcctccagctgagttgagtgtagcatctaatttcctcaatcacctgaactctggccctgattggttcccttaccctcctgagccttaatttcctgcaatatgggattcacaatggcacctacttcctatgatgttatgcaatacaaatgagtaacaataagtgaaaacctggaattgtttggtcagtagaaaagtgctcaaaaatgtaatggtggttagtattgttgcctgcaaaatatctgacacagtgcatgcagtgaatacttcaatctgattctttcttcctccaggaagccttcctagaagtccccaaaccaggttaggactcttcgtaatggggttctgccttgtgcttcctacagggcttcttgagacaatctgctggtcattgttctgtctggcataatcacaaccaaagaatgttcaaagaatattcccccggttgggagagtgggagagggggtgacacgcagaaaataccgatgtgtctgtgagccacactggttaactggccctgaatatgaccacagcacagctcatagaaggaagccccaagacaacaggagaggctgttaaaatattaaattaatcatctctgtaattaatttgcaaaatatttcttcctctctggagttaagggtcagagaacgtgcttgtttctttattgctgtatccccagtgcttagcaggttcttagtgaacattaaatacttgaattaataaaggaacaagtgccctaattttagttttgtcagtcattcactcattctgtcattcaacaaacatttattgaacatgtactatgagccaggagctattgcaggctcttgggttacaccagtaaaccaaaacagcaaagatacttgccctcatggggcttaccttctagctgggcattgacacattgcctgttacctcagagggatcaatatacaatcatctcccctggaaccatcctctcttgattgagttcagctattcaaagtgcgaggtcagggctggatgcagaatcacccctgtaatcttagcactttgggaagccagggcaggtggattgcttgaggccaggataccagcctgggcaacatagtgagaccttgtctctacaaaaaataaaaaataaaaaaattagccggacatggtggcacttacctgtagccctagctacttgggaggctgaggcaggaggatcactgagcccaggatttcgagtccgcagtgagctatgatcatgttactaccctctaggctgcagtgagtcatgatcatgctattgcaatctaggctgggtggcagagcaagaccctgtgtctgaaaatataaaagtgtgaagtcaatagaaaacattacctgttgtttcagagtcaacagaaggcacctatacaaagctaagtgtggctacaaatgaacaccagctgctcataactggcccccagactccttccaactgccctgacatgcttgctctctttcccaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggtaacttgtcccatggccctgggtattccacctccagggcttcaccaggctttggccaaagctatcttagcagcacccagcacagagatacctgcacccttccctttctagacacagaaagatgtaaggcccagggaagtcagctgagagttctgaggttgctactgagaaacgctctcccctgagacagatgctgtctcaacttagataaaggaattcaggcaactggttttataattaacagagcagggcctttctctgacagcaaggagtgacttggggacaggagctgggtgaaaaggttcacagcttgtggatctagatggttccattcagccctctagacctttggataaatgcacaagtacatctctgcaggttgcctgaggcctttgcatgggcctcattggagggaggatgttgcctgagaacacagccctcgaggactctcagggaaggtacacagtgtcctgggaaggagctagtgagttcagagccatggctgccaaggtgagaagggagcacttgtccatttgtccattttctgctcttgactgtgatttcaaccctatctgcaagagcaagagtccctgctttaagtaacctcttacctttccctgttcaaattagaccttggtttccatacccagggatggagaggccagagcccaaatgcaaaggggtacaaagttaattgatgccttttaggattctcagggccaatgacctggtgacttaagatgttttggggacttttcaagattaattttgactctatccagttctcaacttactgagtagagtgactgattttagagcccaacccatatatgagatgggacactacagtactttgcatctaatttgatgtctttagtgatttccctctcactttaattcttttcttttatctgttctattatctgctgaagatatcctgggctgtgtgacctgtagcattttcacagtctggatttcactgactgtacggtcttggggcacctcaacatgtttcctctgtcttctgtatttcgtgcaattggcagctggttctggaggcttggtcagactcagctaggatctctttggcaagaccatagatggtgacctgttctttcatctgaagtcgtataatggcttgttgtctctcatagtgaagttggcagcgactgatggttggtgcctagatctgttaactcattagggattgtaaaatggtgatatcctaattctatcatttatttttcatttactagtgagaatgcctttataaagaagggcctcccttcacctattacttagttccctagtggtatagttcctgtgagaaaggcaggataaatgcttgattctttctctttatttaatagttctcaagataataaattggttcactgttgtgctccaagggtggctaaagttggcttttttttttctaaatgggtctggctctgtctccccagctagagtgcagtggcatgatcatggctgactgcagcctcgatctcccatgctcaagtgatcttcccacctcaacctccctagtagctaggactacaggcacacaccaccacgcccagctaatttttgaacttttagtagagaccgggtttcaccatgttgtccaggctggtcttgaactcctggactcaagtgattcacctgcttcggcctcccaaggtgctgggattacaggcatgagtcaccatgcccggccaaagttggcttttaaaataaactgttttgagtggaagaagagacaatagaaagaaaaatattaagtgaatgataatttacatcatgcaatggagacttggcaaagaccaggaaaggggtacacctaaccttactagtccaaatctctagtcttaccatggggatttaaggcctaaaggtgttcaagtggtgatagagacaaggctgggatttaaacctctaggctcccctactcccttaccttctcccttttccattggttatccccagatggattcattgacatcatcaggcaaaggacagtctccgtccagtaaatcaactaagtaagaaagggaccttgtgcccagcatagaggctgagcagcagcagttttccattttagttggatatgttgagagtgggagaaatgaatcatgggtgactaatgttcattgtagtgtctttgtggtttattattttaaaaatgattaaatagagtagatttgagattattcttttaatattgaaccaacctactcacctatatttcaatatgctttctggaattagagagtaggggctgggtgtacatggaaattttgcagaagtctgggtcccctccagggattgtcatgtgccagggaagagagactgagaaccaggagagcctagaacacaagagcccagtgggtttgggtcttgcatggtgacatgatttggctgtgtccccacccaaatctcatcttgaattgtagttcccataatccccatatgtcgtgggagggaccaagtgggaggtaattgaatcatgggggcggttacctccatgctagttatgatagtgagtgaattctcacaagatctgatggtttaagagggacttttaccccacttcgctctgcacttctccttgctgctgccacgtgaagaaagacacgtgtgcttccctttctgccatgattgtaagtttcctgaggcctctctagccatgctgaactccgagtcaattaaacccctttcctttataaattatcccatctcaggtatgtctaatggactaatgagaatggactaatacacatgggaatgaaggcctcccatgttggagaccaatgcaagtaattgaatcgtgggggcagtcacctccatgctagtcatgagagtgagtgaattctcacgagatctgatggttttatgagggacttttaccccatttcgctctgcacttctccttgctggtgccatgtgaaggacacgtttgcttccccttctgccgtgattctaagtttcctgaggcctctctagccgtgctgaactccaagtcaattaaacccctttcctttataaattaccgagtctcaggtatgtctaatggactaatgagaatggactaatacacatgggaatgaaggccttcccatgtggagaccaatgcagaatctccccaaccgacaagtccaaggatggaacagattgctttctcagttgttgagggtctgatgaagtctttaacctatctctagggattgtatcgattgaaagaaaaaagtgcttggagagacgcactcactgcaagcaagagaccctgagatgccaagtgcagttggctgaaggaagagcagatccccttccatctcacctgcactctgcgcatatgctcattgagtgaaatgctccaatttaaattattttttctcacttctttgtgggctaagcacatatattttaatgttgcataaattaaatttattttcaaagacttataataatgcctactatatgtgaggcacaaggcaaacaattttaagtctcttgacaacttagataggttctgtcatcattcccattgtgtagaccaggggactgaggccacacagctagtacatttcagggccaggatttgaacccaggcagtctggctttaaggagttttgcatttaattgctatgctctgagatctttttaaaaaaacatgtatatgtataagtatatgtatatgtatatgtatatgtatatgtatatgtatatgtatatgtatatgtgtgtgtatgtgtgtgtgtgtgtatgtgtatgtgtgtgtatgtgtatgtgtgtgtatatgtataagtatatgtatttttagagacagggtcttgctctgtggcccaggcttgagtgcagtgaaacaatcatagctcactgcagccttgggctcctgggctcaatagatcctcctgcctcggcctccctagtagctaggactacaagcatgcatcaccacgcccagttaatatttaaaaatattttgtagaaacagggtcttgctatgttacctaggctggtctcaatcttctaggctcaagcaatcctcttacctcggcctcccaaagtgctgggattacaagtatgagccaccacacccagcctgaagtcttttgagtgtggatcacccaaagaccactccacctgacacccctgggttagaatccctcctgcaggcctgtctccaggctccaccaggagcctgtgctctaatctagccatggtcacctctcacctgttcagtgaagccacactacctccacctcttagcttccctatctctgcataaaacttgatgttccatctgagcctctaccatgcatgggtcttcaacaacgttgcttcattccagcctcacaaaaatcttgcagtgaaagggattatctactctcccattttgcaggtgaaaggattgagaatcagggctgcatggtagttcttcctcgacacagcactgggtcattggctcattgagctcagagcccaagcttttgttagtacatcatgttgagttgccaccaaaatggccttgacaatgatgatacaaacaagaacaaaaagcagcagctaacagtaataggttgggcactctactcagcactctagctgtattatctcattttatcctcctgatacctctattggaaaggtactattactaactttaatttacagacaagaatgctgacattcagagaagttaagtaactggtgcactgtcacacagctgctaagtagtggagctaagatttgctctgcaagactctagaaccccaaacccggaagcctttgctaacctacctgtgccttaacttcacattcctggttttggcttatagaatattttcactttacagccaggcacagtggctcacacctgtaacaccagcactttgggaggtgtaggcaagtggattgcttgaatccaggaggtcaagaccatcctgggcaacatggcaagatcccatctctacaaaaaattagctaggagtgatgcacgcacccgtagtcccacctacccaggaggctgtggtgggagggtcaactgagcctgggaggtcaaggctgcagtgagccatgattgcatcactgcactccagcctgagctacagactgatactttgtctcaaaaaataaaataaaataaaataaaatataaaatattttcactcttacgatcacatctaatcttcacaaaagcactataagtattatggtccacatttctattcaatggaaactgacccccagaaagatgaaatggctcaagttccacaatcagtaagtggcagttccagggcttgagctcaggttttctaatagccctttgggtgtttttttttttttttttttttaatactatggaagttactccgcttatcctacagggatattgcaaggattagataagattttatccatgggaatgattattaaaatttagggagcactgcatatacatgaggcaagccattgttatcatgactaaaatgagcaggaaggtgacacctctttctggggatgtccttgaaaatggtcatctggctcctgctcattttctagcattgcatggcctggatctgcagagcagggcttcagaggaggcagtggagctggaataggccatatccctaaaagggcattactgcctgtatacagagggtattactgcctgtatgctgcctgtatacagagggtactaatgcttattgattatttcaacaaagacttattcattgaaataattgtatcaggccccattgcatcaccatgatgaggtacaaaacagataaagtccctgtttctttggaatttacattctcttgggggagactgataataaactataataatgacacaaagtaaagaggatggagatggatggattggggcagagagatgctatttttgataggatcatcaaggaaggtctctctgataaggatgacatctgagcagagaccagggcaagcaagggagcggggcatgtggctatctgggggcagagtgttccaggcagcaggaagagtgagtgtgaatgcccgcggcatgagcatgctccgcgtgtttgaggaacagcgaggaggccggtgtcgccccggtggattgtcattttgtattttgtgacccagaattctttttgaatcagctacctttaaaaaaaaaagagacaaatccaatataacatgctgtaaatttgatgtttttctttctagagactcagaattttaaagataaaagattcttaataggctcttaaaaaatctcaaaagtggccaaaatactggataaaagtgaaagagacaaccagcaatgtacaaaaccattttttaaaaatcaatttttaaatgatgtaaattcgatttttaaaaacttatttaaaaaagcaaagttacatcagaaataatcttatattggaataaaaatatctttcaaacatatgcacagcacggtgttaacagaaaatgtaggatattaaatcctatttaagatattattttaagtgtgttaaaattgaatattcacatggaaaagaatcagaagggggcataaacaaatcaaaatattgatttgatttagggaggggtctgtggataagtgccttctttttgaacttacatcattgcagaagtagttataatatagttgtttaagttttttttaatgtaccacaagatggcaaagttaatatccaaatagatgcaaaagctcccagaagggggttgagttttcagagatttgctcattagatggtttaggcaaattgtcctagaagcacaaagggataataagcctgtactccacagtcaggtgaatctggatctgtgattgcttgctagatgacctctaggaagtcacttaacagctctgaatatggatttcatcatctttaaagtgggcataatcagggaggattgaaagagatggtgaataaaatataataaacatgaaatggaggttgccggcattattagagctggactggaggtgcaccttgctgcataggtacgaaagaattatgtttcttccattccttttgcagtttttctcagggacaattgtcagcccggcacattcatgcaatttcccaactgccagtgggcacaggcagttaagtttctttagcaaaacatctattttaactgttttcttttcaattgaacatatgcacctctttttttttttaaatagaattagattttatgagtcattgaaggacagaagttacttcctccccaaatttgctgccatggcccagcaataactcagttgcaaggcatgctgggaggaacgtcaattcagaatgcaagagaggacagggatggggtgaggatgattcccacatgtagagtggacccctgatggcccaagaatgagccccgagaatgtcccaggggtcctggtaactcgggctcagctctgggctggcagcagtacccaaggatatggttggacttaagggcattgctgcaggtggctctggctgttgtctcagtcagcagtgatcaagttgtaagaaacagaacaccccttcccctgccccccaccaaactggctccaatagctccaaaaaaacagagaagacttttttttttttttttttttttttgagacaggatctccctttgtcacccaggctggagtgcagtggtataatcatggcttactgcagcctggacctcctgggctcaagcgatccccctgcctcgacttccggagtagctgggaccacaggcatgcaccaccaagcctgactaattttttaaaatttttttgtagagatggggttgagacctatgttgctcaggctgctctcaaactcctaggctcaagtagtccccatacctcagcctcccaaagtgttggaattacaggcatgagccaccgcgcccagcctggagaggattgttgatgagaaattagttaatgcgtgcaatgtaccttattcaggtgatgggtgccctaaaagccctgacttgaccactatgcaatctatgcaggtaaccaaaaaaagaggattttattggaaagaaaccacccaaagacaaaggtgtacctgggcctcatgaggagctagaatctgtaatcctaaagcagtctagaatagatttctaggtttctttgtccttgctttctttgtttctcactgctcctggtaaacatgacttcgttagctccttgcagtttgcctatctggcaaattccctgcatttcagatcatagtcctgggaaagagaatctggttggttcagcttgggtcaggtgtttattcctggcccaatcagctggcaattggttgctactaactcactaggaaccttttaaaaggggttgtatctacagggagggaataattggtgctcatgccaggtgagaggcaccatcttgagtccaaggagactaactggattcaagcaggacatagttataggctagtggtacaaacatggcatcattgcctcccaggggaggaaactggtgagagcttggcaggtgttagtgctttagccaactaaagccatccaaggatcttgagtacaggaaatgaatcagaaatgcaacccaggcaaatagagctggggcaggtgggaatagacacagccttatgctctctgttttcttgatggtggcctttgcatattcattcaataatcaaagatctgtggaattccgaggaagaatagaggtagttctagcctttgaaaactttggcctctatgtggagggacaaggcttagaaagctgaaaacaaacaaacaaaaaagctagaggagcatcaattgcttgattctaacagtgattgcaaggctataaaatacagaggaagggaaagttgtgtgtgaacacatgtcattgagtgcacacttacttgggtaaggctttttgagtttgcatggacttgacatgcgtcatctgatgtatcttggcaacacccctatgaagaacaagctgtcattacccccttttgggaaggtagagactctaagtaactgacccaaagtctcagagcaagtatccagtataactgtgactagaacccaggactagctgataccagaaccagggctcttaaccacagcactacacagcctctctggagagaaacagatggttctgagcaataaagggatcagcttccagacgggatgaatccacagaccagcttggaaaatcattaaagatcattaaatagacaaattcttgcagcaacttcccttggagcatggtacatagagctgcccacgtggtcggttttctctgttcatggtatctgattaaaagtggcaagtgtccccctggcagtcacacaggcatcatgttacactccactttcagctgtcttaggggaagattgtctctttgaattcccttgcttcctctggagacctccaggtgaattctgcacctcccacctagtcatcattttaaatcagactatcctcatactcatgttccaaatttgggaaattctagccaaccattttgcataatgtagtgacagacagacatttagttttatttatttactgattatgagagattaaggagaaagggaattttaaattacctgaaggcacttgaagcttagagggcagcggtaatagtgtaatgaagaatcacaataacaatgacaattttgaagaagccctttaaagtcaagcagactagccagtttgaagagaaagatggtgagtttgcctttccgagcttttaattggagttgacggtggaacacccacgtagaaacgtcctgtagccagctggagctgactggagctcaggagagagggagaggatagaaatataagtcaagactcatcagcccagcgagatgagagttgaaattctgagctgtgacaagttcttcttggaaaattgagtaagtaggagagagccaatctggacttcaagtcgatacgcaagaaatactttttttgattttcatatattagagtccaacaaataagccctaatcaaaaaacactgagtgtggtgataaggaagattttgcaataatttcgtaggaggaatggggaacaaaggcaaatttaagggtgctatggaggggaataatatgtaagaattagaggcagtacgtgaggtccatttagttagccgaagcccccatagttcactctttatgcctctcatgcactttcttttatcgcattctattttatttatttatttacttttatttgaaacagggtctcactctgtcacccaggctggagtgcaatggtgcaatcactgctcattgcagccttgacctcctgggcacaagccgtcctctcacctgagcctcctgagtagctgagactacaggtgtgcgccaccatgcctggctaatttttttattttttgtagagccagggtcttgccatgttgcccaggctgacctggaacttctgggctcaaaagcaatccttccacctcagcctctcaaagtgctgggattgcaggcatgagcccctgtgcccagccacattctattttagattagggtttgaattagttgtatacttgttttaaccaagattctgaattccctgagggcaagcctgaaccttattcatcgttttcatccttttaatgcctgcctaatgccatgacttgcaaaaataagcgctcgatgaaagttctaaaactcacttctctgctccagattggctctggattgcctctgacaatattttccagattttgatgttgcttactgtggagtgggagatgaacctggtggtacatgaacacattgcatttatttttaaaataagtcatttaaaggattgatgtaccagagccagactggatattgcataaagatgatggactccagatatgcacttcttttctacagagaggatgaatttccatttatgactttagtatgaaatttaaaatttttaaaataattgtgtttaagttttttttaagtgagttaataaaaatacttttaaaataagtcaattttagtagaaaaggcagacaaacttagtaaagatttttttcttttctttctttctttttttttttttttttttttttgacacagggtctcactcttccccaggctggagtgcagtggcatgatctgggttcactgcaacctccacatcctgggatcaagccattcttgtgcctcagccttccgaatagctgacattagaggtgtgtgtcaccatacctggctaatttttgtatttttagtagagatagggtttctccatgttggccaggctggtctcaagctcttggccttaagtgatctgtccaccttaacctcccaaagggcttacaggtgggagccactgcacccggtccagatatgtacttgttttctatagaggggatgaatttccatttatgactttggtatgaagttaaaatattttaaaataattgtgtgtaagtttttttaacggagttaataaaaatatttttaaaaaataagtcaattttagtagaggaggcagagaaacttggtaaagatcttaaagctggttgggagacaagtcacgtttgggtggatggtcttaggcagtgcatcataatctggtcttaccctacctttccccttttttcttttatatgactccatgaattttactccccctctccagcaataatagccatcaaatcaggaacgtaagtgcttagttgtattttccacaatatacgttaaaacaaatacaaagccataaaggtgaaaccatcatacatccatggactacctaaaatgatctcctacccattttgggaaacacggccgtttggaaatttatctggcccctgtccctcgcctgggaatccttaacatctggcactgtggattatccacagaaacatctctggcaatagagttgctcctggcatagagtgggcatcattaagtgtttgttcagaaataaaaggacagtgagatgccaaccgtaacatttaatagcttaggcactggtgtgttgaagccacatgctcagtacagttcaaagatgatagatcttagggtttccctgcatatggttagcggtagaaacataccacaaaacacgaccttacctacagtggagcgatcccctgatgtggggattccgactaatgagtctggggggcaagccgagttcttccaagcagaaagcaagcaagtgaaatctctctctcacttacttctctctctgtggccaatgccatctgctagctttaaaaataatttttaaaacaagtgttttggttctcttcaacgtgcagcaaagacagatgctatttttaggcttgttttctattaaaaaaaaaaaaaaagccaaagaaccaggggctgggtgtcggcagttctggcttactgtctgcattttgccaccaacttgtatgtgaccttttggcaaatctcctatgccttggaccctgagaatataagtgatcatttcacctccttttctcattagacatgttgagagggtgaagcagtattggtctgagaaataaaaaccattttctaaaaattagtcagtgtgggcaacatggcaaaaccctgtctctacaaaaaatacaaaaattagccaagtgtggttgtgtgaacctgtagtcccagctactggagaggctgagacaggaggattacttgagcctgggaggttgaggctgcagtgagcagagatcacgccattgtactccagactgggcgacagagtgagaccctgccacagaaaaaaaaaaacaaaaaaattggttaacttgtgctctcctgtaacctgccagcttctgtcttgatgtaccactaaatctccatgttccttctctcccatcctggactggaagctctttgaggggaggacacatccacacatccatacaatgtctagctcagaacctttcacacaagatgtacccactggaggcagcatcatgaggggttgagagtgtagagtctggaacccaatgcctaaggttcagaccctggctttgcagcagcttatcagctgagagaccactggcaagttacttaccctttctgagcttcaactttctcctctttagaagggagagaatgattatacttgtcacattgagttttgtagagggacaagtgagacaaaatatgtaaagcattcagctcatcacgtggtaagtacccaagaaagcttaatttcattattgttgttgttataattattaggcactcccacatttgataaatgcacatatgactgttacatataagataaagttctatgtgctgtatggaagatttttttaaatggtgaattaaatgcttgttatatggccagcatcatgttagacactctacacatgtgtccttgtttaatattctgtgggcaagtgaaaaatgtcccatctacaggtgaagagaaagcccaaaattagattaaataactgctcagtgttgcagttagtaagtagtgcaacaagacttcaaatactgtattgacttaaaaggtgaaatctttgcttcactttcccaccacctcttctcccggttttatagcccctcacaatagctttgcaacttttgacagcaagtcaccttttacgttgtgactcagccatagcaacatataaatataaccaaaacatatattccacaaaaagtacttagtggtgttctgtgcagcatgcactgataatttccatttcatcatttcattatttttctttcttcttctactttttttttttttttttttttttttttttgagacagtttcactctgttgcctgggctggagtgcagtggcaccaccatggctcactatagccttgaactcctgggctcaagcgatcctcttgcctcagcctcccgagtagctgggactacaggtgctcaccaccatgcctggctattttttttttttttttttttttggtagaggcagagtcttgctatgttccccaggctgttctcaaactcctagcctcaagtgattttcctgtctcggccctgccaaagttctgggattacaggagccagccaccatgcctgacctcttttttctattatttttttttaagttgatcatgacccaccaaattgattcaatcatcaattaaagtgagatacaacttgagtttggaaaacacttgtctggcttcaatactcaggcagtattgccaggacatctcattttcatcacatttacagtttgcagccctgtgtatgtttcattccagcccctcagtcagtctgttagagattatcgcatatgttatcctcattttataaatgaagatatcaaggctcagggatgtaaaatggtcttgccaagcctccccagtagtcagaaaacgtggagtcagagctttgattccaaccttctgactgtatgaatgctgctttggagacccagtaactcctgctgcctcgaggatcacccatttattcacttaattaatgtatattgatggctcgctttggtcaggcatggtgctgggctgttggtacacagcggtaaacaaattttacatggctcctggatttgtggaacgttcagtcacatttcgcattagtccatttctttcagagtgagaccccgaacctttgtgttagcctacgtgaccttacatgatgcgtccctcagcaccaccctgggctcatctcctaccctgtcccccttcttctttcttctccaagcacatgaggtgtgctctagcctcagggccttcgcacagcctgtttctccgcctggtaagctctcactctcaatacctgcatagctgctttcgtcatctccttcaagtctttgctgaaggatcgccttctaaataagattatcctgaatactttattgaaactggaactcctttctcccatctcatccagctggtactcccaatcctccatactttgctctgtttttcccccgtggcactttttaatcttttagccttctatttttatttttatttatttatttattttttgagacagagtctcactctgttgcccaggctggagtgcagtggtgtgatcttggctcactgcaacctccacctcccaggttcaagcaactctgctgcaccagcctctcgagtagctgggactacaggcgcacaccatcatgcccagctaatttttgtatttatattttagtagagacagggtttcactatgttagccaggctggtctcgagctcctgacctcaggagatctgcccgcctcagtctcccaaagtgctgggattacaggcacgagccgctgtgcccggctatcttttaatattctatataatttgtttattatgtttagcatttattgccttttctgtgtctacttgctagaatgaaagacaaaggccaggaatttttgttggttttgttcactgctctatcctcagcacccatctataacctggtacctagtaggactctgtaaatttgtttttacttgaatagatagatgaaataaataaccatcaagttcaaaatataattaacaaattatgatgtggtcagagattaaaaaaagaaaagaaaagaaaaaagcccacaggctttcatgaaagagtataacggcagacctaatttagattgggtgggttagaggaagtgacttttttaggctgagaacataagagggacttcagttcccaaattcgttagcgcagactctgccattgcaagccaaaggaacgtagcgtaaaggagagatttcacccaagcagaagtctctaagaagagataaagtgattcattcattcatttagcaaacaccctctgatggaaggagagaaacgagtcacatattggtgttgcccaagggccaaaacacacatctgacttatttaattccagcaacatcactgaggttctactattatctcctcttgacacacaaggaaacccaggtgttgaataacttctccaaatacatccagctattaagagacagagctggatttccaaatgaagtatctttggcaccaaagcttgtgccctttccctctctgggcacctgctatgtgctagttgtgctatcagaaacagggcttacacagccaacaagggcatagcccctgacttgaagaagttcacaatatcccttgaaagacatgctgaaaaacttccctgattaggacacagatttttttttgtccccagttcttttacttctggacatgccttcctagattactgtttttcaaaccttgataattcatctttttgtttttgatagccactatgttatctattggtgagtacctcaaaattcagtggcttaaaacaataagcatttattatctcagtttctgtggggcaggaatttgggaatgctttacctagttgatctggctctgggtctcaaaggaagctgcactcagattgccagctggaattttagtcatctgaagccttgtctcgagtgaaggatctgtttccaaggtgattctctcacaggactggagttggtgctggctgctggcaggaggcctcagttctttgccaaatgtaccttcccatagtactgcttgagcatcctcatggcatggcggcaggcttcccaaaaagcaagtgatctgagagagagcagggtggaagttgtaggtcttttacgcgctactcctggaagtcattcattgtcatttttgcagtatccaatgggttacacaggtcagtcctattcattaggggaaggtactacacaagaacataaataccaagagactgaaaaatcactgtgggtggggggagcatcataaaggctggctactacagctatctatcacctgtaacattatttacttaatattttccactttttgttaaaatcagccttatcctaaacaataatatcagttaagtcacaagattaatatgctaattgtattttccagcaaaaacaaatataaacttgtaattattattattattattatttttgaaatggagtctcactctgtcacccaagctggagtgcagtggcatgatcatggctcactgcaacatccccctcccgggttcaagtgagtctcctgcctcagcctcccgagtagctgggattacaggtgcctgccaccacgattcgctaatttttgtattttgttttttttcagtagagatggagttttgccctgttggccaggctggccttgaactcctgacctcaggtgatctgcccacctcagcctcccaaagtgctgggattacagctgtgagccaccatgcctggccaaagttgtaattattaatgaaaaaaattatctgtgtatcacctatgctcacttgcgtagttccagtgacacaaaccttacccttggggaaacaggaagcccagcaaacagggatctgtcagagagccctggtagttttcatcataaattccagctcttcccccactgtccatttggagccccagaagctacgggatgctaatgttgctgtttgctgtcctcttccaggaccgcctgtactttgtgatggagtacgtgaatgggggcgacctcatgtatcacatccagcaagtcggccggttcaaggagccccatgctgtgtaagtgagaactagtgctgtgctttctccttgggataaatgggtaggttagtggttcctttgagggtgtttttttgccaaagagggatctttaaacacctcgggcatctttttgaaaaaatatttagccagggaagaaaggtgttctgcttaatatgagatacttcttttttttctgacaccagctaagaacctgaagctcagacagacaccatggctcatacctgtaatctcagtgttttgggaggctgaggttggaggatcacttgagctcaggagttagaggccagcctgggcaccatgacgagatctcgtctctataaaaaataaaaaacttagctgggcatggtggcgcacagctgtagtctctcctaaaaataaaacaaaactcaaagctctaaaaccacagctatttatttatttctaattcatgtccctgactgcttagaaaggccctatatcttccttggggattatcattgtagattttatgtgtccatttgctaatatttattgagaacttactataagccaggccctaagtgcttaacaaacatcgtctcacttaaccttgagaataactctgggagggagatgctaccatccctgctttacaaacaaggaaatggagatgcaaggttttgaaagcttgcccaaaatcatggagctagtaagaagcagttcccaaattctgaccccggtttttctttgcccatgttctttatcttacaccactctccgtcttagatgccttcactccatgggggtgaaggatcaaggtgctcggtggcaatggtctgtggttcctgtgatggggagactgattctgggttgttggaaatgtgtttcctctgctgagtcaattccatccccttcggttcaaaaggcagctacagtctcttctttttagaacacagatttcatcatgtcattcccctgcttaggaacatggcaagttataggaattagcaatgataacctctcctggggagttttctaagatcttattgcctctccagagagcccccagagctcatctagaaccccaccttgtcatactagaggcttggtggctcctacccagttcagcttgccccctctcctcccacctggacaggttgtgagcactatgttctgataggatttgcattattcttgtgcttccaaatctagccatttgtatctcctggcatgactctaataggactagctttgcttttacttctaacatctaattgaccacaggctttaattccattgtcacacaagacatgtcaagacactttacatagttccccaaagccctgcccaacctttgtggcataactgggcttcccagttctcttgaaacctctttctttctgtgctgaccttcaataagaggttacactttagacagatgttgtttcttattccagctgcgccattcattcactatataacttgcccaagttaatctctctaaccctcagtttcctcatttgaggaatggggagatactagtaggacctaccttacaggattgttattaggattaagtcaggtaatgcctaaaatggtgctggggagatggtaaaccttcaacagatgttagctgctattgttaagataatttaacttgctatatagtctgaaagtataattctctcttttttgggggggtgggggacagggtctcactctgttgctcagactggaatgcattggtcctgaccatagctcactgcagccttgatcacctgggatcaagcgatcctcttgcctcagccttccgagtagctgggatcacaggcatgtgccaccacacccagttattttttttcttttatttttagtagagacaaggtctcactatgttgcccagctagtgaaactataatccttcatccagttcatcatatcccatgtccccttctccactatacaattgctgaacttctgcctacccccagtttgtccttaaggcaaccccatcaccctctaaaccaccctttgaatccatctgtactttcagcactttatgagctatatagctgaccatccatgggttctttaatgtcctacacctagttcaatattgtattgaattctgagcattgccaagcatatggtgtccttgagtttctccatcgctttttttttttttttaatttcagattttacgctgcagaaattgccatcggtctgttcttcttacagagtaagggcatcatttaccggtaagtgaacactgctgtactttccatctcttcatctccctcagctcctccctgccctgcctctttcttcagctgcttttaaaattagaatccgcggtgggggaggaatcctccagaactaacttgggcatgtgttctgccaggcagcatcgcccactgccctggcaaagtttgggcagctctatatggtggtagaaaatctcggtggactgtgtcaccaatgatggttcagagcctcaaacaggagactgtttgctctaagaggagactcacagagaggacctcagtacttctttctcttgcttgtggaccctacatttgaggagcaggcaaagaattttggctggcagaatgtgatggatcacattattatgaaacattttttatttatttatttttttctgctatgtaagtacaacttggaaatggatctctgagtggctgccctgaaagacaggattaagttcaggacttggcatttgctggtttttggaggagcaaatggatgatcatagctgcatgagtcataccattttatatttcatgcaaggcagacgattgcacccgaggctgctatttgtcagcaagtccagggcgtacaattctccttgtactacattgatgcaaatggcatagccagggcaggcttgggctggtttgttatgcaagagaggctgcaaggtatgaggcctccaaatagcatttggcatgggtgggggtctatttcaaagattatgaagaaccacaagagtctcttccattcatgtgtttgacacacatttatcaaatcctactatattctaggcactcttctgggtggtgggcatacagaagtgaataaaacagatgaaaccccttgcccccgtggagtttatctttctcatggtgggagttagataagtgaatcataaaaacatagtctgccaagtagtgataagtactatggagataaatcaagcaggggagggtgctggtgtacactgggtgttggagggttctctctcattctgtagagagcatgatgatgagggcctggagagttaggggtgacttgagagtcctgggccttttgccttaactgcgggatatgggattaaaaggcatgagggggctgggcacagtagctagcacctgtaatcccaacgctttgggaggctgaggcaggaggggtgcttcaagctaggagctccagaccagcctaagcaacatagtgaggcccacatctctaaaaataaaataaaattagccaggtgtgatggtgcatacctatagacctagctactcaggaggctgaggtgggaggatcaattgagcccaggaattcaaggatgcaatgagctgtgatcatactactgcattccagcctgcgtgacacagcaagaccctgtctcaaaaaaaaaaaaaaaaaaaaaaggcatgttaagattagccctggtaagtacaaggcagatagcggaggccaggctatgggatgctggtaggatggagaaatgggaagtggggaccttgtcagaggctttcagagtcctggggcttttagtcacacctgaagtggtgatatggaatctatagggggaaggatgatcttattctgagggcacaaagtccccgccattcctactttctcctaatgatggagggaagaaggtcaagaagaggagtggttttacttggcatgtgggtgatcctagtgaaaatgtaaaaatagagagaagaagaagaatttagaagctgaggcaagaggatcacttgagcccaggagttcgaaactgcagtgagctatgattgtgccactgcactccagcctgggcaacagagcaagaccatgtctctaaaaaaagaagaatttaaattttaaatagtatgatcattctgcccatgcccatgtttgccctcaatgaacacgttcactatgtgtgcatgaaatggcacatggaaatcctctaattcccttagtttctcttttgactctcatagtgacaacatctttttgtgctgaatattattctggttttgaaaggtgcacatgaggctgggcgcagtggctcatgcctgtaaacccaacacatagggaggccgaggcaggcggattgcctgaggtcaggagttggtgaccagcctggctaacatggtgaaacctcatctctactaaaaaatacgaatattagctgggtgtggttgcacatgtctgtaatcccagccactcgggaggctgaggcaggagaattgcttgaacccgggaggcagaggttgcagtgagctgagatcaccccgttgcactccaacctgggcaacaagaatgaaactccatttcaaaaaaaaaaaaaaaaagtacacatgatccgccatatgacatgatccctaaattcaagccgatgacttcagctggtgcttaaccaaagagacaggcatcatgggtgatttttcactctacatgattttcaacttgggtgctgacattaggacctaactcctatgtgggatgtgcctctactaaaatagaaccaactgggttcttgagaagattaaatatggaactacaagtttattggaagaaaatccactcccattgtaggaaacaggagaggaaataattagtgttccggtcaattgagttgtgattcagggctagtttctaatcaatcaggaagccgcactgggatctgggatccatggatccggctcactggccaggcaggtggtaaaattaaaagattagcatttcaggtgctaagatgatacctattccaaagccccttttcctaaactaactacacactctccctttcatcttccactattaatatggtctttaaaggggtatttatcaatcttttaagccagtctgcatctgaacccttcttttgtgtatgtggaagaacagagtcaatcttctactataaataatgaaaatgacagatactcatttcacagcccacctgtagccagggcaggcacacaacccaagctctgacagttggtcatacttactcaagaccttgaatcagaaactagcggccaaggaagcagaaagcatagaatcaagagtgaccatagtaattatcagcaactactttccagaggcaagagaagagggtcttaatagcaataggcagagtccagcattagggcttcgtggaacaaggggtgatgtgtgtgtcccatggcagcttgggtggtggtgtcactggacaagccctgagttgcagttaggcattgtttcaggctgtatagactcttaatctggttcttcagtctcctcaaagattctatgagctccccaatatcctttgatgaattccttttcaggtaaaaatcatcatagttggtttttgttgctcaccatcgagaacgctgatggaaatagagttcttgaaattgatagtcaaatggaaatggtaaaaaataaattacttgacaaaagatgtatggttttatcatttcacagagattgatttcatagtggtaagatcttttaagatgttacaaatcactacctccttcatctaaatctctacttaattgaacagttcttaagtaaagaggatgaaggattatgttagacttaccatctttaaggaactggagatgttgggttgtggggtgggaagggaaaaagattcttcctatcaaacttagtgtctgatttactgaccactgtctctggaatgtgtgttggttttgcccttgatggttttctgaaaaatgaaaataatttctccatccaccttttgaagcagaaatgcggatttattacacagaacaaaagattagggtgtgatatcaaaacactgtatgtgacagtgaagatgacagaggtgccctccagcctcaggactgcctggctcttggcacctgaaacttcttttctataatagatgaagattttatcacttccctagtctacccagctgcctgcttctgagcatgtggtcgagctgaagggttgtcatttgtcactattagagaaatcacatatatcacatatagacctacctagtaagtttatgaaaagcaaattgctgcaaagcctgggttttctgagttccaaactttcacacaaatcatggtggcttgtagatgagcatgaaggctggatatgagcagcaccacggacagcgccaaaggcatggcgtgttgggattggcaaacatcagtgggcaagtgcaagtggacctccccatccctttgaataaggagaccccacagacacagataggagatgccaggatatagttttcagattgtattcttttagttggaaatgatgacagcaactcaattcaaagtaacttaggttaaaagaggcatttattggtgacataactgaaaaatccaggtgcagatctgactttaggcctggataaatgcagaggctcaagtgacgttatgagggcacattttatcaccctccctctaggctctgctttctctatattagattgcttcttttcatctggtgacccctggagtttctagacttccataataccacctgaacaaccccaatgtaaaatgcacttatccctttcctgattatgccagccaaagtgccagcactaatacttaacagctttgattggcccagattggatcacatgcccattcctgaatcaatcactgtgaccagcaggatggaatatttccattggctgggacaggcccacttgaccactgctggagccatgttacatggaagccatgttacacccatgttacatggaagaattgaaggagggtggttcttctaagaaatattagaatgctgtcatcacaaaacactagaatagacagaaccacagatgcccactacccaatcaagatgaccgaagggaaagatctgaattaaggaatagatccccctacctctcaggaaatcggatttccccatcttctattaggaccgatccatctctcagccttgctcactggtgcagaaatataaagcattgacattggagtaggtgtttagggaggaggaaagtgtgttgatattggagcaatcttgtgtgctaaagacctacaactgttccccaaaatatcaagctcttctcatcaacacagatgaaaataaaagagaatacagcacatatcctttaggttagagctcagatgtcaccgccttagacaggtcttttctgactgacaccctgcttaaagtgacttcctccaatcactatcttatgtcctctttattttcatcataccacttatcagaatctgtaataatcatgcttacagagtaattgttatctttttcccagcactgaaatttaatctgaagaacaggaggcttgcttatcttgtttactgctacatactatacctggctccaggcatagtgcctgtcacatagtaattgtgcaacattttttttttttcaagacggagtctcgctctgtcacccaggctggagtgcagtggcgtgatctcggctcactgcaacctctgcctcccaggttcaagctattctcctgcctcagcttcccgagtagctgggactacaggcgcccacgaccacgcccagctaatttttgtatttttactagagacggggtttcaccatattggccaggctggtcttgagctcctgaccttgtgatccacctgccttggcctcccgaagtgctggaatcgcaggcgtgagccaatgtgccctgccaaatgtattttgattcaaagaattgatggaaactcctgggtcatgtcctagaaggtggcccaagagatcagggaacacttagcattaaatatttctttcaatcagcttctttttttctttgtaatttttagagatattttaaaaaataataattttctgaaaaatgtatcttcttacaaaatataaggagtctttaagtggcaaaggaaaattcttggaattttcctggatccaagaagcgtcatggatgctctgccctttgcttaactttctgtggatctccgtcttttcagaagtgctgtctctttgtgtccttgtgagacacttggcacagttggctgtgtagaaaaagaaaagcacggaggcttgcggacctctttttatctccctgccagactgtaagctgttggaggtcaaaggctggtttctactgacctttgtgcccacacaacacctaacacagtgttttatgcataatgagtggctgttggttggcttgaaatgcatagcgtttaattaaatctctaaattcttgtgtctgccatagtgacctaaaacttgacaacgtgatgctcgattctgagggacacatcaagattgccgattttggcatgtgtaaggaaaacatctgggatggggtgacaaccaagacattctgtggcactccagactacatcgcccccgaggtgagagctgctgggcacacgttcacattgcggtgatgtaccctctgctccccagatggctgtgtgagagctgggaagggttgagggtggtaccttgcaagggaacctcggacagattcttattctatactctaaatcctccctttgagatcacacatgcaaattaatttagcacacatccagaagcccaagcccaaaatacatcaaggtttgggagaaaatttaaataaaacccaaaagaaccatccaacacacatcagtaaaattcttcgtcaaactgttgtggctcacggccatgtgataccgcctaattatgacattgaaatgtttgttgagagaaaaagagcatatcccctgggctggcatatgacatgggatctgtgtcctgtatatgtccctcagcaggaaaatggacaatagcccgtgatttatttatagcatgaaatactaccaggcaccaattcagaagagtgagttagatatatatgtagatgtgaaaagatcttcaagacacattgttagagaaaaaaatcaaggtacagaatgacaaatacaaggccaggtgtggcagctcgcgcctgtaatcccagcactttgggaggcagaggcaggtggatcacttgagcccaggagttccagaccagcctggccaacatggcgagacctcgtctctacaaaaaatacaaaaattagccgggtgtggtggcacatgcctgtagtcccagctacttgggaggctgaggtaagagaatcacctgagccccaggaggtccaggctgcagtgagccgtgattatgccactgcactccagcctgcctgggtgacacagtaagaccctgtctcaaaaaaaaaaaaaaaaaaaagaagaagaatgacaaataacactatgatactatttatggatgaaacagaaatacacagaacactgttctgttttcaatgagtaaaagcatacaaaaatctggaagatttcaaactgattttataacactggttacctctgaggataagggaattgtaaagagaaatttagctatttctgtatactgctgacattttttacaaggtaaatgtatttgggtattacttgagtaataaagtaattctttaaaaataataaggctttactcggacccagtgaagttttccctatgtgatatgctttggtctattatcattttgttaattaattagataggacacaatccataacacaacttcctgataggccaggggttccataatctctggttctcaactctaactgcagtttagagtcgtgagggagcttttacaatgtaggatgcagctggggcatggtggctcactcctgtaatctcagcactttgggagcctgaggcaagaagatcgcttgagggtagaagtttgagaccagactggacaacatagtgagaccctaatctctacaaaaaaaattaaaaattcgccaggtgcactaggtcacccctgctgtcctgactactcaggaggctaaggtgggaggatcacttgagcccagcaggtagaggctgcagtaagcagtgatcatgccactgcaccccaccctgggcgactgagcgagactctgtctcaaaaaaagaaagaaagaaagaaagaaagtgtttccacacttttaaagtacttcaagtcttatttgatcctcatgacaagccaacaagttaatccttttacaaaggaaactagagcctgggatgtgacagcagttgccgaaggtgatgtggttagctcatgacaaagcctgacctgctgcttatccctcccatctgtgggctggaggggaggcaacttcaccagccacacagttgagggtttcttgtgcttgcctgaatcacgaccagcgaggaacttctgagaaccacagatcctgggcctccacctgcagagattctaatgggatgatgcttgggcatcccacattgtttcttgtgtgtgtgtgtgtgtgtgtgtgtgtgtttgagacagggtctcactctgtctactcactgcaagctctgcctcctggattcatgccattctcctgcctcagcctcccgagtagctgggactacaggtgcccatcaccacgcccagctaattttttttgtatttttttagtagagacggggtttcaccgtgttagccaggatggtcgcgatctcctgacctcgtgatccgcccgcctcggcctcccaaagtggaaaacacgttcaatgagaagtgttctcctggaatgctttcccttccttgtcttgagggttacttctcagaatgcatttcattcattcataattgaccagtaaaattgtatacatttatcatgtgcaacatgttgttctgaaatatgcatacattgtggaatggctaagttgagttaattaacatatttattgtctcacatacttatttttttatggtaaaaacacttaaaaatccctcttagcaattttcaagaatacaatagattgttattaactatggttactgtgttacacgataagtctcttgaatttattcctgctacttaactgaaattttgtatcctgtaatcaacatctctgcatttctgattttggaatagaaatcaaagtgggagatagagatcaagaaacaaacattcactttatagccaagtttgctcaaataccctttttgagttaaacaagcaataactgaattataaaacattctaggattagttaacattttgagggcataatatgtgaaagccaccgagtatctcattcatcctcacataacttcatgatatagagattatagaagttaagtaacttctcctgtggtcagacagccaaccggtagacagcagtcaggattcaaagtcagactgcctaaccctcagacctcagcctttagcctttgctgtattacctcttaacctctgacatggttagttttacatccctgcatactgaaagatggacaatcacatagctcttctagacttttccatgttcttgcagtttgggaatatgaattaaaaacttcacaaccatatataccatatgatacaccaattctacatctaggagtttatcttaaggaaatacttggacagatgtccaaatgtctaattacaagaatatatgttacagcattggaagaaacctaatcaactggaaatttataagatagattttggtatatccattcaacggaatgctatgcacagataaaaattgattatgttcatatacaaatattaaattagcaaggaaaacttaagtgaataactggctttattaaagatctattgcccataatcccagtgctttgggaggccaagatgggagctttgcttgagtttgagatcagtctgggcaatatagagagaccccatccctacaaaaaattaaataattagcatggtggtgagcacctgtagtcccaactacacaggaggctgaggtgcgaggattgcttgagcccaggaggccaaggctgtgagctgtgagctatgatctcaccactgcactccagcctgggtgacaaaaagagacactatctcaaaaaaaaaagaaaagaaaaaaagaaaaaaaatcgtccaaatactaaagtgtttatgtaaagcacacacatacacacagagtttaatatgtattcagagaaaagagtatggaatgaagtagaccaaatattagtcataatttttctcttaataaaggattatgggtgattttcatgttattatctcagctgagctatcttttataaagaaatattaaaatagtgacaaatgttgttatctcttaaacgtttttatgtttaattatgttttaaaaacatgtaacgtaaaatttactattttaaccagttctaagtatacaatttagtagtgttaagtatatttacattattgtgtaaatgttgtaacttttacagaggagtaaagacagtttttccttttaaaaattccatgctcactgttttgaaaataataataacaatacaccttacttagtgcttcgaaaaggcaatgtgacagccacaggtgtttgcccagctgcaggtgcctctgcaaagcatgtctgtcattccctgaatagctaatataaagaaacagttcaggtgggcactggccttcttgtaaaagaagagtgaaatctgtctccagaagaaacatgaactgcaaacctccctgatagggtgccttctcttttctagataattgcttatcagccctatgggaagtccgtggattggtgggcatttggagtcctgctgtatgaaatgttggctgggcaggtaattgaattttaagtgatcgataagagaagtcctccctacccccatccacatggtttctttaggagaatgcatgtttggtaacagctcataaattggaacctctatgactttcccggccttggggtcatacaagtctgtggtcatttgaaagcctgggtgtgtggcttcactgtgggccccagggaggagggtctgccagttgaggggagctagggggagggttcaagcagggattcttctcctcccaccctcccctgtcatacaggcaccctttgaaggggaggatgaagatgaactcttccaatccatcatggaacacaacgtagcctatcccaagtctatgtccaaggaagctgtggccatctgcaaaggggtaagtgcatctcttaaagctgtgaccaggaccaccacataaaggcatgtgggctgtaccttgcccaagaacaccccaccaggggggaacacagcctgaactccacccttcactccatttgccaatatgagaaccctgatgtggagctgctacctcccggaggagagagagctttttttctgatttgcacagaagtgctgtagagagctgcctgcagctgcgtcttgctgctggctgggctgcagtctctgaaccagcacaggggaatgcttattgaatgaatgaggtagaaagcacagagattttgtcaaagagctggaagtcatgggaaagggcacaagaggtcttttgcacaactcaggctatcttgccctgctctgctgtatgtgtttagttaatactaagagcgtgcaacttttgttctaaaaaataccacgccgtgttgaggttaaggaattctctagataagcagactgaaattcaatgtactcaaaatcccactgtctcctctccccagacacacacacaaatggctaaaagggcatgcacgcttggacatctacggtttatgcacagggcacctgtgaagaaagcaggatgtgtgtttatggggaaggattgtttgttttgcatcttgtgttggaccagggcatactcacagtgacttctgtgagatcctaaagatcagcgaccctcacctttggagccatcagaataacccgaagtgccttaccagaatgcacatgcttctgccttaccccagagattaagtctgggtatgagtattttggaaaagtctccatttggcttgcagaccactgcctttaaaaatactgtccaaatgaagtgatttttcaactctgatggaagcctgaaagcaatagaattagacgcccagaaaatatgttctacacataatatactaataaaggatttgctctccctccacccagtggtacaggttagaacatggccgtgccttaatcagtgggttcccacctgtgtgtctgaataaaccagggctgccagtcctagatctgtgggatgcttgcagacttttcatgccctactttgttcttcctgaccccagccagatgctggatgcactgtcttgggtgaaggaaagctgggaaactcaggcaggccaatctgaggcttggcccagtttggaatagctgggccagcctctcagcctaaaagcgccttgtcacactgcctaaattcccactctcaatgaatcacctaaggtttgcacctcagctgcataggctaagatgcatgtatccctggggaaaccacctgtgaattagtctcaatcccgaacatctaaagtgaattgcttgaaaatattttctttgagggtgtgaggcagggagaaagaaagtgaagaatagagaggggagtcccagaggtgcattaggaacccaagcaaagcccataaagaaaaaaaaggcacacacgaaggcctccacaggcccccgtagacaagttattgaagggtgggggcgggtagagagaaggtggtacctggagcttttagtttgtttaataattaccagcatataaggatccagagatttctcaaaaacattcagctttcaggtttctcttgaaaaatcagatcttgccacattggcctgtcattcttacaaagcaccagtcagctggattggaaaccatggccctctgtagttggagcttgccctctgtaattctcagacgttctcatttggccaattctctccaagttcaaatcctggttcaggcattaattgccgcaggaccttggggaagttgtttgacggcatctgcagattggggataataatagcactccacattgggttctttgatgactaaacagctgaatactgtaaatcacttagaatagaggctggcactctgctccaagccccttggaagttattattactattactagtgctgacgctattgtgttatctgccaggttcctcttggcatttgagtttgcatcccctggaattgcaacttttaaagtaggggattttggagatcaagggaccctttgcaaatcttgacccttctactttctaggcacaaggtgtttttgttttgttttgttttgttttgttttgttttgttttgttttatcaatgtctcgctctgtcgcccaggctagagtgccgtggagtgatcatggctcactgcagccttgatctcccaggctcaagggatcctcctgcctctgcctcccaaagtgctgggattacaggcatgggccactgcacccagcctaggtgcaagatcttaagccacttcctttgcatctctgggcttctgtttattttaaaaaatggaatagtagtactcattgaaaagagtttttgagagcattaaatgagataacataagagaaagctccttgcatgatgtgggcacatagtaggtgtttaatacatccacagggtcctccccttcacacgcccgccctgcctggacagctgggggttctaaatgggtcatggaggaaagagcattttccaggtcagctgccttcagctcctgctccaattagcagtttccctggtagagccgttttctattaattcaggacccataaccttcatgattaactggggtgactctcttactattgagtttggggaccattattaattgagtgggctgagtccaatggggctcttccttcaaggagggtactccaaaaacgagtgatgctcaagcaaacagccaaatgcttcctctggaacagcgagccccaggggatacgtctgggaggtgatcagagattggaacagtgattaaatccagctgtctacatggcttcgggcacattagagcagagtgcgggaactgggcagagactccgaattaatgctggatgtttttgcagtaccttttctttgcttggcatcctcctgcttagacagaaattcagttgagcttttgaaaacagtcacctgtttaattgaagcagtgtcctttatatgtccattcccttaaaggcccgattttctactaaaaaaaaaaaattagtaaaaccttactcagatggctattcccactttgaacaaacttgaagcaaacagaagcccaaatagacaggaccttagggtgaaaaccagcagacactgaacagctgagactgaacataaagctataagagtcctgagccaggcagagctgttcaaagccttgccctgctccttagctgtttgaccttaggcagatgactttacttctctgcacccacatcctttacctggaaaatgggggataatagttgctgaggccttagagtattgttgcaaagtttaaagagtaatgggtaatggccgggaagcctttagcacggagcctgaacgcatatgatgttgtcatactcagtacacggaagccgttattgatgttattatcagtgtgaaccaaaacctcactgccctttctttcctcccatcctaatcttacacaaatgtcaagccttggctcaatttcctcaccctccataaacctctcctgacaaagccaggccacaaaaattcctgagaaaaccacgtgtgaaatgcactcccatttttcttaaaagcccaagttttagagctaggcagaggtggagtctgcacccagctcttactgactctaccacttcctctctggagtccttactgttcctcaacttctctgagtgttcattgcctttttattcaaatgggaaaaatagtatactcacctcattgggttattatgatgatcagggaagctcatgcatgtaaataaagaagtagcagctcggcgcggtggctcttgcctgtaatcccagcactttgggaggctgaggcaggcagatcatgaggtcaggagatcgagaccatcctggctaacatggtgaaaccccgtctctactaaaaatacaagaaaattattagctgggcatggtggtgggcgcctgtaatcccagctactcgggaggctgaggcaggagaatggcgtgaacccgggaggtggagcttgcagtgacccgagatcgcgcctctgcactccagcctgggtgacagagtgagactccgtctcaaaaaaaaaaaaaaaaaaaaagaagtagctagcttagaatgtaagtgctcagttaatttccccaccctggaggatacactttatatgacaagtacatgcttgtgtgtgagaccacaaattatcttgcgagggggcaacaggctgagtgactgtccaacagtgtaggaatgaatttctgggttcattccttccccatcatcagcaagtcctgggcagaagattctgccatcatgggcttctcaatgtgatgtcaactctggaaagcttttggacttgtatgcttctttctttttttttaattaatcaccaactcttctgtctttactccctgtgcatttgctcaagtcttgagatcagagatattttcatgctgctttggactcatttacaagaggaagcctgtctggtttcatcttggcgcatctattcatcttgttatttagcactcagagacccaaagatggagggttttgataattaagtaatttaaacggaacaccaaagaaacctcagcggctttgtgtgtaatgtatgatacaagggaaatgagctgggctaggttttgactatttaatgggctttcagaaagtaattacttgaaacttgggcccctttgactaatactttttcttctgttttgtcatttttgcaagtgctttactgagaaatgcaaatggtatctgaatgaatgtagcctttgcttttgtcaaactccagttttcttgttgtgggaggagggaagtttgaagatattgaaactgtcctaattaaatgcactggtaattgcacaaaacttattcttaaaccaaaatggataaatggatcatgtggcatttatttttttctttctgtttttttttttttggttgtttttttggttttgttttttttttttgagatggagtctctctctgtcgccagactgtagagtgcagtggcgcgatctcagctcactgcaacctccgcttcccgggttcaacaattctcctgcctcagcctcccaagtagctgggactacaggtgtgtgccaccatacccagctaatttttgtatttttagtagagacagggtttcaccatgttggccaggatggtctcaatctcttgaccttgtgattcgcccgcctaggcctcccaaagtgctgggattacaggtgtgagccactgtgcctggccctcatgtggcatttctaacttgaagttcacggccacattcaggcttcgttttgattaaccataacagatgattggcagtgggtcctattatcaggtcctctcctgcaaattcctggctgggattttttgctgggataaaaagcaaaaaacaaaaatgagttgagattcttcatttgcgctttctttcctaatgcattggagtaataatttctgagtgtcttacatttcctcttctgaaactcagcaaattcaatgtttttctttctctcgaagctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctgtaagtagcccattctctctgactgccgggtattcacacacaaggtattcttgcctgtgcctcatgttttccaaatgctccctgaggggtagacgtcaatgtgtctactggaacatgggtgtatgtattcacacatatgcacaaaatcactggttactaagatggacattttccattggcccagcttagtctctataaagatggaaacgacgatgcctattgaatttttgtttcttcgattcaattattgtaactgtcttagctgacaactttctgagaatggttcttgggtgagcagagttcagatccatttttggactgtgataaaggatctaattttgccctcattctttctcttggttcaactgtgtcattttttcttcatactgacattgaaaaggtcatgttgtttatctcaacagtatttaaatttaattctgaaacatacactatgtctgagtcagtaaataagatggcagttcagcagccagctcccacccaaggcaaaacagagtgaagcagagactgaagtcctcttgaactgaagaccccctccgggagggtttgggtgtggagatggctttgacataagttttataatgcaagaataaaactctcacatttcccacagtccatgtaccaacaggaaggttttctatccccaaagactcagcaggaagtacttgtcggcatcaggaaagaagagtttacacctgaattaatcaaactgttattctgctgggaggatatttccttgtgaaattaaatagagggcagacttggtgactcaatgatgggttgtaaaactactgactgaggctgaagagtgaacataaacaccatcattgaaacctaacgttgtaagggtttgagtgttaagatgaagaagataataatggtagttattttgatactagtattgttattcatttcttgagcacttacgtgctaggcacgtaatgataatagttttgacatcagagggttgttatgatgcataaagcactttgtacaagcctggtacagaggaggcactcacagagagctgatcatggttttcgttagctgtgtcatacattaattaatgtcccggtgtagagtctttgaggggcagaatcctgctgctgctattccttaagataacatctgtgtgtacattggggtcgaagagggccccacatgtcatgagcagcatcacagcttttatgggaccatttggaaaaagatgaaaaggtaacctggaaaggaagagtgagctctttgttcaggaaacagggaactcagaggtgagatgcataactcatatggtttttgtggggttatttatgagatcttgaaatgtggacctccctttcctctcttggccagatgcacacgctcccatccccaccagcatagaacccagcggacatctgggggtcatgttatagctgtagtgcagtggtttgcaaagtgtgctgtctatcagtatgcagtatcagtatgcagtgtcagagccagcggtattgacatctcctgagcactttaggaatgaagttcttggtctccaccccagacctcctgaatcagacactctaggtgtggggcccagtgttctgtgtttaataggctctccaggtgacttgatgagctctcaaggttgagaatcactgctgtggagtttggcattaggagctcagccagggaagctaggcagagaccagagggaggtagcatggagaatcatctccttttttttctttttttaaagacagggtcttcttctgttacccaggttggagtgcagtagcgcgatcatagcttactgcaacctcgacctccagggctcatgcgatgctctcacctcagcctcctgagtagctgggactacaggagtgtaccaccatgtctgcctaattttttatttttatttttaaataaatggggtcttggccgggtgcggtgcctcacgcctataatctcagcactttgggaagccgaggtgggtggatcacctgagctcaggagttcgagatcagcctggccaacgtggtaaaaccccatctctactaaaaaagtacaaaaaatagctaggtgtgatggtgggtgcctataatcccagctatttgtgaggctgaggcaggagaatcacttgaaccgaggaggtggaggttgcagtgagctgagattgcgccactgcactccagcctgggcgacagagtgagactccatctcaaataaataaataaataaataaataaataaataaataaataaataaataaataaatgtggtcttgccatgttgcccaggctagtctcaaattcctgggctcaagtgatcctccaaaaacctcagcctcccaaagtactaggattacaggtgtgagccactgcacccagccaagagaatcatctctttaagtggaagacactggtcctccttctagtcagggcatggggtgatggcttccagaagaggtcacagactcagatgcctacagaggccaagcagataatatgaatgagggaagagggctggtgagatagaagagaaagtgttggagatcgatgcaagccagagagcaggtgatctacctaacaggctcagctgatgttcacctcccgatggcctgccccgcaggatgcagcctcctcagggctgctccatcttcatggtatttggggctagaactcggtgctgtgggatgcagcagacctgtgagttgattgacagatcctgttacagtcagtgtagtatgtaggccctgtgtagtaagggcttagtgaaagggtgtataaagttaagatgtttatataaaatctcacaattttggctgggtatagtggctcacacccgtaatcccagcactttgggaggctgagccgggcagatcacctgaggtcaggagttcgagaccagcctggccaacatagtgaaaccccatctgtactaaaaatacaaaaattagctagatgcgatggcatgcacctgtagtcccaactacttgggaggctgaggatagagaatcgcttgaacctggaggcagaggttgcagtgagctgagattgtgccattgcactctagcctgggtgacagagcaagactccgtctcaaaaacaaacaaacaaacaaaaaaacaaaaaacaacaaaaaaaaaacctcacaatttcttttatatatcagaacaaatttttgaaaattaaacacagtttggggcaaataaaacacacccacacccatatgtatcccatgcattgttggtttatagcctcaggggtagtgatggttcaaagtcaggttgctatttagccagcatctgttagcaatggttatttacaaccagagtccattttgaccggttaaatattttgaatagccctgctaagcagtaatgaatataagaggtctagcctcgtgcctggctcatagaaagcactcaggaaaaggtagctgttattatcattgataatataaaaagattacaatacttagtcattatcaacgagatccctcaactgttctgcatttgatatgatttcccactgacctgtgtcttgaattcctccatgtgggtttaacaatgactttcaaagtacagtgatcaggctgtgctacatacttcaaagtgttctggtaccagctctaaaggagcaggtgctaccttcagtctccttagactgaattagaaataataataaatgatacattatccaggtacagtggctcatgcctgtaatccccacactttggaaggctgaggcaggcaaattgcttgagcccaggaatttgagaccagtctgggcaacatggcaaaaccccgtctctacaaaaaatacaaacgttggtgggcgtgatagcatccacctgtagtcccagctactcaggaggctgaggtgggaggatcttgatcctgggaggttgaggctgcagtgagccatgatcatgccactgcactctagcctgggcaacagagcaagaccctgtctcagaaaaaaaaaaaaagatacatcacctacccatttgatccagcctgcctgtatgccttttacattgcaaatgcattgcatgagagccctcctccccccaatcccaggattttatatttctccttcctcaccccttcttaactgtctgccacttccaaaaggcccatggtgagcgtgtgcagagttccatgtgccttgtgggatgtgaaaaggcatgcatgtatctgtcagcgtttctgattcatgcatgctattaaatagagtgtggtgagagaaaaaacaaggaacaataacagaggattatgttcaaacatcagtgaagggtgctattattggaggttcattaaaataactttaaatgggtttttctaagttgttctcaatgccatcttttattgtggcaaggagctgttcacagagcattgtttgaaactgtattgaaatacactagatttggtgtattgttgcagggaacaagagtcatttcttttttaatgttcgcctggttgtgtgttgcttttgctttaaaacacccaaatggctctctgttgccccagtctcgtatctattgctccttggcatatatggcttttgaggtcttccagtgctagatctctgtcctcttcctagctttagctcctgactccaagaacagcattcctgggcttctttcagtccctcaaacatgcagtgccttgttttcccttgcctgcttcatctgtgcagagccatgcacctgggatgcccgaagccctttcctatgctctcaccagccccctgatccccaccgtgccttgccttttccccctcatcaaatcagtagaacatcaaccgctcagggaggctcttgttgattcctgagtagatatctgctactgtcccatcaagaaattcatcacaggctgtaataacatgttcaatctcatgcctgtctttttgactactttaagattgtgactttctctgtgtcaaatcccagtgcctagcatagggtttagcacattataggtgctcaggaattcttactgaatgagtgaatggccatagaacaagatgctgtaacacagtgtgctgtggaacataaaggagtcttttgggatatatattagagtgcatggtgtttttcttatgtacagcagggtatcgcaaataaattggttgttgtgtaagttactaccctatttataaaggactataatttggctgctgattttgcaaactgtcatggcatcgtgtggttttgcagtgtgtgctgggagagggtgctggtgaaggatctgaagaggcaatgcattgaatcacaggactttgggtagagagatctgcagcttcctgcagcctaaccttgcacagtccaatccagtgttacagatgccatgatgtagccctgcagagtgtcttaaattttaatgtgcatgcacgagtcacctgggtatctggctaaaattcttactcagccagtctgcggtggggtttcagattctgcatttctcacaagctcccaggggataggacactgtggggccagggactccacctttatgtagcaggggctagaactcagtgctgcagggtgcagcaggcctgtgagttgattggcagaacctgttgtagcagtgcagtaggtagaccctgtgtagtaaggactgtagtgaaggggtatatacagttaagtatagaatgttctggtgaagttattgttcagggcacacagcaggctgttgctggccagcatgtggtaggaggaaggtggtggtttgggtactaaagggcagactctgtcgctgagtgcatgatggagcagtggcttgggaagaagcgtgtgctggttctgtcctctggtggggatgttgtcagatattgagttatccattcagtgggtgatgaggttaggtaatgttctaggtgatggaaacatagcactaaaaataattaacatccctgccttcatggagcttatattctagggagagtgggcaaaataataaacatagaaacaagtaaaatatacgatgtgtcagaagttgataaacattatgcaggaagctgaagtagggatggagattggaagagccaggtcagggagatgtccttatgatagagtaggtggagaaaatgacgtttcagcaaatacaggaagaagatgagggaggtgggagccatgtatatatctgggtgaggggggagagtgatttggttggtagtagcagatgcaaaggccctgaggcaggagcttgcctggcatggtcaagggagagcaaggagtgcaggtgcctgagccaaggggttgagggagaaaggaaaagggggtgtgagatcagagaggccaaaggaaagcacaggccactgaaggatctttggcttttacaccaactcatgagccaagaaataacatgttctgactttgggtttttaaaggatccctctgagtgctgcagggacaagggtgaaatcagggagactggttgagactcttgccataatccaggcaaaaggtgataggagcttgggcaggttggggctgtttgagaacccccaagttggcatcctcaggtcctccccagttcctggcatcttgtaggcactcagtcattgtctcatggagacatgaaggcgctgatgaacatgagtccctgcagactgcccacatgattgctcctcaagtataaaacatggtagccaagagtttggtcccagtagcaataggatgaatgaatgaaatagatggtcaggaaagcttctgtgatacagagcgctggcttgcagggcatagagcaggaggacatggttgtgctcttggttggacttcctcctgtccatcctgttgcaaagaatgtagtgatatcggagggtgcagtggctgagggctgtacccagggagttgctttgtgtctgggtgatccagctcagaattttgctgacttgtagcaaaaggtgcattgagcctttggcatggatgagcatattttattgcagaagtggtagtacatggagctataatgtcacaggacaagatatgctaggtaatatgttcacattgaaatgcctaatggagagtttggtggcattcatgtattgtcacgaattggcttaatgaagtcctgtcactcttcctctgaaaggctcccatagtgtccataacacctaatgaagggcttactgtgaaaactgggtagggggatgagcccagggtacaaggattcagccgcctcagaagacaacccaggtagcagcatagaagcagtgaggtgaagaggaagagaaagctaagtaggcttcattagagtccttggagtcttttctgctttttatttatttgttttttcattgtttttaattaattgcccaggctggtgtcaaaatcctggcctcaagtgatcctcccacctctgcctctgaaagtgctgggggttacaggcgtgagccactgtgcctggcacctgtggagtcttaagcgctaaagtgtgtgtacaatgatctgcccagtagtaaacatggctctagtattcttttaaaatattatcaatcagatcatcaattgttctaaaatatggtcaaccagattgtcaagtgttctaaaatatgatgcatctgatcgtcaatgctctctgggcagggcttgaggagtacaacctgatgagaagcagacgttaagatcccctttcctccactcctgacattggagcaaccatccagtcctgtctagacatcactacaatgctcattccctccttccttccattctagcctgtgtcaggcctcactaactccaaacccacttgtatgacagactgattccaatcatttctgctcttgttaccgattcttatctgcactttacttaaagccccataattttgaggcatctggacagtaggaaaggctgaaaacctggcaagcttttatagcttgcaaaggtccttgtcctatgctctgttagtatcatttccaaaatactacttgggctatctgatcacatcccattgcccgtatcctctgagagtctaaatgctgaactgcttcagaaactaaatcatactcacaggacttggtttctcagcaattttatcatctgaaaacattgtttatgtagctgaggtcaaaagcttcaagtactgctttaatgagctgcgaatctgttcatgtgacattctcttccaaacccaattgccctttacactgtatgagtaagtgcctctgtgtgtgtgtgtctgaatgtgtgtgtttgatgtgctgacatttctgaattgaatccagaaagtgtaacctttgtatgtttgctgttaaaactccaaattcaagccttaagaaaaggatctaacacttactcaatgtgatttatttaagcacagaacctaactcccccaaagtatcaaatactcaagagaacaattcatttttgaaaattgtgatttaaaataattctcataaaacctttactgttcaaatatattagaaaatatattgcatttttgtctgcatcaggcactgttttaactgccttccatgaattgcctcatttaattctctcaaccctgtaaggtagggttatcaccacagtatagatgaggaactagagcttggaaaagttaaggcatttgcccaaggtccagcaactagaaagcagaggagccaggacttgatccctggactgtacactgcacaagacccttgtaaagattattagaagcacttggagcccctggtaaggtttgtgattgtgctaccaggagagtcatgataacaccatcgaatggtgtctgttacataatagaaaaagactgagtattcttacaattcaaatgatttaaatttattttaaaatattgcaacaaataagtagcatcttcacagcttttataattcgttgtcaggattttaaaagatgcaaatcttatttgttccttagggctttgattttgaggctgacaaagacggcatgcattgactaacctctgaaagaagggcatggcagcattgaaatgaggcagccgagacaggctcattaaggagtagaggtttccctgctcatttctggttgttcttttggggtatccactgtgtggagtttgcagagatcttaataaaaatatcaacctacatttatatactgacaaacaaatagccaagagccatttaggacacacagcttggagtctgtttatctctctccacctatctacacacccatggagaacccatttaaacttcagatcaaaccaggctccctttagatggttggaattgtcaggttcctgagccaggtgaagttcctaaatcagtttctgtcttagtccatgttgtgttgctatgactgaataccacagactagataatttataaagaaaagaaatttatttcttacagttctggaggctgggaagtccaagggtgaggggcttgcatctggtgagagacttcttgctgtgtcatcccatggcagaaggtgaagggcaagagagagtatgcgtgcatgtgtgtgcatatatatgcatatgcatacatgtgtgtgcacatgcaggggaaagatacggagccaaactcatcccttttattaggatcccactaccaagataatgttgttaagttctcatgaggtgccacctctcaacactgttgcattggagattcagtttctaacacatgaactttggcggggcaagtcaaccatagaacctaccagatacatgactttgagtcatgtactattatattattatttattattattattgttattttgatactggtccatggcccagggattggggatccctgccctaaatcgtgaggaagattgaggcccatgggtgccactggttggtagccgtcagcttcttaccacctaccggcacctccatagtcatcttgacctccttgcccagcttccatctctgtcttagcaaatatgttttccctcccccaactcatgtgagacttaccctcactcctgctctggactccagcctcttgatccttcatgcttatctcccctgtttagtctgtctacagcttctctctgtatcaacaaaactcctatggtttcaaataggaatctgatttaaactgacttttaagcaaaaaataatgatagttagtattcagatgtagatggatcatctacatctggtcccaaacaatgccagcagggaaacatttatctatatcccttaggattactttccccactgtgttgacttcattcttcattctcagaaggctttcttgggcacatagcaactcccaatttatgtcccattatctctgcaacttctaccaaagaaaagggcttcctttttataaaatcccagcagcctaggactcaatctttttggaagattattgggtcatatgcccatctctaagggaattgctcactgcaccagggggatggaatgtgctgattgaccgggcctgggtcaccagcccctcttagccagagagctggatctaatccagacattttgaaaaaagagaaggaatgtcctatctaaatcagacattttgaaagaagagaaggaatatctcctttaagaaaaaaaagccactgtcatggccgggtgtggtggctcacgcctataatcccagcactttgggaggctgaggcgggtggatcatgaggtcaggagatcgagaccatcttggctaacacggtgaaaccccatctccactaaaaaatacaaaaaattagctgggcgcggtggcgggcacctgtagtcccagctactcgggaggctgaggcaggagaatggcgtgaacccaggaggcggagcttgcagtgagctgagatagcgccactgcagtccagcctgggcaaaagagcgagactccgtctcaaaaaaaaaaaaaaagaaaaaaagaaaaataaagccactgtcactagaagaaaagacaatgcctgctggctgggcaaaaacagcagctgtcctttctgactctatcctggccttctcctttgtgcataaacctgctatgtctttttcatgttaaaaatcccctacctcaaacctgggaatcctccttactactactcttactactgctatgattactaccctaccttactttgcatacaaacacacttttgaaagagttgccagttcctgctatttccacttgatgacaatttattgtttcctcagtttggtgcaatctggcttctgctcccgccatcctattgatatttttctcattgagtcatcaatgacctgaaaactgcctcttctcataagcttgtctcatctttcttgacctcaccatattattaggtgctctaatcctttctcctttaaaaaaatgtgaaaaaataaaatattcaagcagcatcagaagctacaaagtgaaattaagattcccctcacccatggctcctagctaggcttcctggttctccttcccagagacacccattgcaaccaggttcttgtgtgaccttctagagaagatgtgttcaggcccagaaatagtctacatcacacacaaggatgttagcatgctgtgtacaatttctgtatcttgcattattcccctctgtcttggagattgtttcttatctgcttatctaactctacatcaccctttgaataacttcctagtttcctatataagtgagtttatctgtaggaaaagttcagagtgccttctttctttttaagcccctcttctccttcatttttatgacattgtgtgtctgtcttagtctgttttgtgctgctataagaatacctgaaactggggcctggtgcagtggctcatgcctgtaattccagcactttgggaggttaacatgggcagatcacttgagcttgagcccaggagtttgagaccagcttggggaacatggcaaaatctgtctttacacacacaaaaattacaaaaatcaaccaggtggggtggcacatgcctgtagtcccagctacttgggtgactaaggcaggattgcttgagcctgggaggtcaaggctgcagtgtcgtggtcacagcttgctgcagactcgacctcccaggcttaagcaatcctcctgctcgagtgacagagtgagaccctgtctcaaaaaaaaaaaagtggataacttacaatgaaaagaaatttatttggctcatggttctggagggtgggaagtacaagatcaggggctgtatctggggaggaccttcttgctgcatagtaacctgatagaaggcatcacatggcaagagaacacatgagggagggtaacttactttttaaataaattcactcccacaataataacatcaatccagtcacctccaaaagttcccacctctcaacactgttgcattggggattaagtgtccagcacaagaactttgggagaacacattcaaaccatatcaccacatttgctgatgttcttcctaccttcacagccactcccaatagaaattccaactccacaaagacttccagtgacagttgaatttggagggttgagaccagctcatgacccagaaaggaaaacagaaagcttactttttgttttgttacaagtgcagtctcttaaaaataaccacaaaatgcccccccaaatggcatatggaaaacagcacagagatggtgtgttaatctacctgaaatgtctttctaaggaagtgaggcttggatgggaacggaaatgcatccctttttcttcccagggtacacgtctttttctcacttcctctaactgggagccccagggcctggctttgtcttgtagcttcctgccgtgatgcaccaggctaagtgggaaggtttctgttctatgtctaaagtagcactggcaggtcctcattctgcttgtaattgggatgggaatatgggtaggaatttagggtttggcagagcgtacaggacctctttcaagccagagcacagccctgtcagacttactcactggacatgaatgggtcagtcagccctcagcagtaaccaccagctaccatgttaagtatttgatgtgaattttatcaagtcattctcgccacaccctacaagaaacttgagcttaggggacttagctaacttgcttgaaggttgtatagctgggaattgttggagccaggattggtacccaggttagcttaacttttaagtccgtgccacacaatcagatacatagtatgaggcaatgggatgtaatggaaagcccatgggctttggaattgaacagatgggctctggatcttggctctcctacttgaccctatatgaccctgaacaaactgttaactcttaaaattatctgttaagtagagataatccttttcctgcctatctcacagccttgtgggaatcaaagctataaaaagataggcaaatagaagggataattactatttgagggtgagtttacttgaagccaacaatgtgggtttaggatgaatggtgaagaatagataagaaaaaaaatgatattctgttgacatgggaagatgtttagagtgtatttcatctagtttcttttaaaaagcaagcaaaagaacagagtcatgattccacctttgtctaaaaactaaaaaacatccattcatctattcatccagccatctaggatacaaaccaagatgttaacataatacagagatttggggtggcgggattaagaaggattcttttgtgtgttttaaaattttttatggccaggcacagaggctcatgcctgtaatcctagcactttgggaggccaaggcgtgcagatcacgaggtcaggagttcgagaccagcctagccaacatagtgaaaccccgtctctactaaaaatacaaaaattagctgggcatggtgatgggtgcctgtagtcccagctacttgggaggctgaggcaggagaatcgcttgaacccgggaggtggaggttgcagtgagccgagatcgtgccactgcacaccagcctgggcgacaaagtgagacttcatctcaaaaaaaaaattattattataattccttttttttttttttttttttttagagacagggtcttactctgttacccaggctgaagtgaagtggaacagtcatagctcactgcagcctccagttcctgggctcaagggattccccgtgcctcagcctcttgaacagctgggaccacaggcatgcaccaccatgcctggccaatttttaaaaaattctttgtagagacaggttctctctatgttgcccaggctggtctcaaactcctgatctcaagtgatccttccacctgggcctcccaaagtgctggtattataggcatggcaccaccatgcctggcatcttggtgctttttaatagcttgtttgtttctgcgataaatgtaggagactgatagaagagtctggatctcttgtcaaatctaggatcaaatcgtggtcagatacttaaactaaacccattttctcattgcacagcaaggacttcatagagcttttggggggattaaaggaggtaaagcttgcaaaacacttaacacagtatctggctcatagttagtgcttaacatacactattatttgtccatttgattttttttcatccctgggttctagaaacgcagtggtgaataaaacagatgtgattttgctctcatgtggcttacagtctagatgagaacatagacaatcaacagagaatgaacatgtattaataattatagactgagatataccagattttatttctgttaaagaaatgaacaggatatcttgacagagaataacaggagggaagaatgagaatcctctttatttgaaggtggtctggaacagcttctctgacagggtgccatttaaactgagatctggaggaaatcaaaacactggatgttattttttaatgaaaattaagaaaagcaagagcaaaacaaaacagacttagtatcaaacacaaaagacccctctcctactgacttcctccctaaataaacataagagataaaagatccctgattgtaagggaccttcattattagcagaaaaaggagacttaaatctctctttttttctgccaaaacccagaccacaaatgactttttaaaatgatcaaatatgtatgcagctttgagcatctgattctccctggagtgggtccctcctgtattcggctgtgggaaactggaaggcataggaacgaccctgcatttcactggatgtgcacatgtgaaaaagaaagatgcgcttgtctttttgcctaggctatgtagcttggatgtcttttcatcgtgaccttctggtcttgttaacctgaaggtgtcctggtgtcttgatggaggctgggcaggtagctcccctgagccactagcctcatgttatcaaagtcggctaggcaacagacagcagggaggagccttatcctctcctccaccatcttaccttgtccatgccctctttttacctccatttcttctccaggctctttcctttcctcctccaaagaagcaatgtctctcttgcaggtcccactcaagtgagatgtcactccctccagacagagttcctggcccttcttgggttcctttcctctgtgctcaatggcagcacctgtcccatggtcccatgcagtggcctgtgtgtgcatctgtgtcctctgctagatcttaagctcaacggggacaagaacaggtaccctcttatgtatcgccagagtccagcatgctgctcggcagaggatctacaacagccaaatattagccttccttattatcccttagcaccaaaatacacgtcaaagcagccacttgttttagagtttttttgcttcattttgttttgagacagggtctcactctgtcacccaggctgaagtgcagaggcacgatcatagcttgctgcagtctaaacctcctgggctcaagtaatcctccaacttcagccttccaagtagctgggactacaggcatgtggcgtcatgccctgagaagttttaaatttttgtagagacagggtcttgctatgttgcccaggctggtctcacactcctagcctcaagcgatcctcctgctgccttagagtgttttactaagatgaagcatgttaaagtagcatcaggctaaccttaacaatttacccaaatactcccattctctttatttctatttttcaatttcttccatgataattgctgtctcatttaaaatagctttcacagcttcttttcttattacaaaataataataacaatacctgattgttatgtaaatttttaaaatataatcaagcataaaggggaaaaggaaaaaattaaaaccatctgtaattcttcgaatctccataagcctgtgtataaaatgtgtacagatattacgtatacatttgtgtatataatttatagaatgggaagatattgtacacactgttagtaattatataactatgtcatttaatattcttctacatcttcttttaatttttaagaatgttttgcatggtaatacatcaaatagatgtatcattatttatttaactgttttccctattggcccatagtagattcccaatttttctttcctctgacgattctttgatgaacaccctgtattttgatggggtaaatccaggagtatagaggacaggtcagggaaaacctcgtggaggaagtgacactgctctggagacagaaaggatgcacaggagatagctggatgagtggagaaggagtggaaggcaagtgttcctggcagaggaggcagcctgtgcaagggcctggagtcacctccaagagttcatgagtgttctaggaactggaaatacttcagtatggctggagggtgtctcagggggtgggggacacaggcagggaaggggccattgaccaagtgtccaggaacaggtcctaaatggccccttaagccatgctaaggagtgtgggctttgggcaatggggagctattgcagataagagcagggaaatggcatactccagtcagcgtctttaaaagatccctttagctggccatggtggtgtgcagctgtggtcccaagctactcacaaggccaaggcaagaggatcccttgagccttggaattcaaggtggcagtgagctatgatcacgccactgcaccccaacctgggtaagagagcaagaccttgtctcaaaaaacaaaacaaaacaaaacaaaaaagagatccctgtggcagtggtgaccaagccaactccacattcaacagcaagactctgttattaattcaatgaaacagaaattaaaagagaagagaaaaagaaaaagagcttacgtgtaacaggtcacagataagcttttcaaactgtctagattcttaaattcaggagcgtaattcaacaaatcaaccttcttactcctctccttaatcctgaaagaggtgcttgtggtttaaataacccagttggtttctggcccccattcctgttccaggagccccattgatgtaccctgatgacaagggagtcggattttctttttttttttaagctgagtgaggctgaagtgttcacccaagacaagccagagaggcaggtgcaatccatggtgcgtttttaattagatcccagccactgagctgcccatacttcaaggacacagcaggcaggaaactgatctgggctgtgtctcccaagggctgacgtctccatttagggagcgctcctgaagctaatggtcagtgacagctccatttgaaaaacacagaaacacttaacagggaggctgtgatctgccagccctgtaagctgctgattagcagggaaatcacgctccctctgtatcgcacccccttggttaatccctgttcttgtgtctcctctgtgctatctcacttaaagatttcattgttctctgaggcaggagggagtggggagagggagggggaggttgtggagctgccagaagctgtttcactgtctcccatcacagcctctggggaggcccaggcgaagaaacagccttctggtgtggatgggaaattgatggtttttaaagaaaaatggtccctgaagatgctctgtgtctcagcaaatgtgcttcctagactggctggcttgggttccaacacccaggccaaagaaaaacacgcacgggtctgccttatagtcacaccaggatgccataccagcagtccctgccaccatcacctctttgttgtctgctctgcctcccctttctacagtcctaagccaccattcctctcctgtggatgactgcggcagtctctccccgatgccacggccaccaatctagctccccaaacctctgcaatccccacactgcagctgaggggactccttgacgtgtcctctggaattttgaacttatcaaaaaggaaagcaaatactaaatttcccccctcaaataggatctcctcctcgtgttcctctcttactaaatagctcaggccaaaaatgccagggtcaccaacaatgcctctcttcctcacataccccacacccaatccatcagcaaatcttgtcaactctgaattcagaatataccccacatccgaatgcatctttccatccctccaccaatcaccttccttcaagcccccatcattcttaactggattatcataaccacctcctcactggttgtactgtttccactattgtcccccgctcatttaatctatccttgtacaccacaccagtgatcctgtttaaatgtaaatcagggccagtcttggtggctgacacctggaattccagaactttgggaggctgaggtgggaggatcacttgaggataggagttcgagaccagcctgggcaacatagcaagaccccacacacacaccctgtgtctacaaaaaaaaaaaaattagtcctgcgtggtggtgcacacctgtagtcctagctactcatgaggctaaagtgggaggattgcttgagcccaggagtttgaggctgcagtgagctgtgatcatgcctctgactcaagcatgggcaacagagcaagaccatgtctctaaaacaatgaaatattataaaaacaaaacatacgtcatcatatcattcagggctcaacattctccagcagtttctcatctagctgagatgaaaatccactgtccttacatggccatcaaggaccctgctctggctcgtggcccgctgtgtggccccttggtcactctgctctggccataccatactgacctcattgctgcttggtgactgtgccaggtgagctctgtcttggggcctttgcacttgctgctccctctgcctagcatgcctttcctcccgacatccaaagggcaccctctctcacttcactgaggtcttgctcaaaggccatttcctccaagctgaaaatggcatcactctcactccatcccctggactttcttcttcttttttttttttttgagacagagtctcattctgtcgcccaggctggagtgcagtggcttgatctccgctcactgcaacctctgcctcctgggctcaagtgatccccccaccacagtcctcctgagtagctgggaccacaggtgtgcaccaccacacccagctaatatttgtatttttggtagagacggggtttcaccatgttgcccaggctggtcatgaattcctgagctcaagtgatccaccatcctcggcctctcaaagtgctgggattataggcgtgagctaccctgcccggccttggctttatttttcttcacatcacttatctccctctggcactaaaacatatattcacatttacagttacagtctcgtttgttgcttctcttccccagtaaaatgtaagttccatgaagcatggattttgtatcattttctactagcacagagcctggcatgtagtgggtgctcagtaaatccgtcttgaatgagaaaatgaataaacaaatgaatgaatctggacaacaattctaaccacagtgagtttaccgaggggtcatccttctgtgggagcttccctccactggccagcagaaaagaccccaggtcttcatactatgtcagagagttctcattttctgagacctgaagccaagataacaaaaacagcagaaacaatttagcttggaatgacaaataggtttccttaagtctgacaagagtcttttaaaaattcaagactgtttccttagtatttaaaacttaaacaccatgcaaatgccctattataggaaacatacgctgtctgtctgtagggatttgtagtagaaaatgggaactaaataatacttggagccatgatgcgttgatcacatactcagtacctgttacttgcattctctcattttatcctcatatcacaaccccagtgtgataggaattaaaattgctcccattttacaaaagaggaaactgaaactttaaggaacttgcccagagttgcacagatagtgggtagcataatgccagggtttgaattcagtctacagactcacttttttttttttttttttgcgatggagtttcccttttgttgcccaggctggagtgcaatggtgccatctcagctcactgtaacctctgcctcctgggtttaagtgattctcctgcctcagcctcccgagtagctgggattacaggcacctgacaccacgcctggctaattttttgtatttttagtagagatgggatttcaccatgttggccaggctggtctcgaactcttgatctcaggtgatccacccgcctcggcttcccaaagttcagggattacaggcatgagccaccgcgcccggccccagactcacttttactcagataagaagtgagcaggaggcagaggctcttggagacctaagtcccttgcatgcacagcaaatacttctgcttccctcaacaaaaaggctttgaagaagagcgtgcacctcttgactttctcaatgtaccttcactcctccagcaactgaagttcagtggcagccctccatttctcatcagtatcaccccagttgccaattgcaatgatcctttttcggcaactctcctatttgacctctgaaagatattttagttataccaatgcccttcacctggggtttctcccagtccttagcttggctgatactgttctctcctggttctcctcctgctgtcctaagacactttaaggagcatttttatcatgggcaaatggaaataaaacacctatttcacagagtttttacatgaatgaaaaaggtcatatattcaaaaacacttggcaaatgtctgtttcattgaaagtgctcactggtttttattactcttgttatctctttccactccccatattctgtgctttaaaaaaaaaaaaaaaaaaaaggtttttcaagacctctctcctcctgtgcttttttttccttttttttttttttttttttttttttcctttttggagtcaaggtctcaatcactgcccaggctggagtgcagtggtacaatccctgctcactgcaacctctacctcgctggctcaagcaattctctcacctcagtttcctgagtagctgggactacaggcatgcaccaccatgcccagctaattttttaaagacagggttttgccatgttggtcaggctggtctcaaactcatgacctcaggtgatctgcccacctcggcctcccaaagtgctgggattacaggtgtgaaccaccacgcctggcccagaacctgtgcttctgactccctctggtcatcaccaggactctcattggcctctcaaagtcgttatccaaaatggaattaatcatctttctcagttttcacactttctctgtctcagttcatacaaccacagtctctgtcattcaaaccagagacttcatcatccccatccttgtcttcccgctggccccttccccacttcattagttagtcagccaccaggctgccaccgtacttgtatatttatttatttatttatttatttatttatttatttatttattttgagagagagtctcgctctgtcacccaggctggagtgcagtggcgcgatctcagccgactgcaacctccgcctcccgggttcaagctattctcctgcttcagcctcctgagtagctgggactacaggtgcccatcaccacgcctggctaatttttatatttttagtagagacggggtttcatcatgttggctaggatggtctcgatctcctgactttgtgatccacccgcctcctcctcccaaagtgctgggattacaggcgtgagccactgcgcccagtcactgtacttgtaaaaatggagccaggaacttgggctctgatgtcagatggacctggttcatcttgctctgctattggtttgctgagattatgaacaaattacatagtctccgtggtctcagttccgtcatctataaaatggagatcataataatgcccacttcatagggccattgggaagattaaataaggtaatgcaagtaaagaactttccagtaaacagcattttgcactggtatatagcaaatgcataataaatatcagcagtcataattgttattactcctactactattatactattaggttgtggttacctcgtagagatactgtgttgaaaacacatagagcttttgtgcaaatgggttttgctggcaaagaacaaggaaccccaaattagcggtttgccccttctcattaggtgggaattagcatgtacaggtgtgagcacccatgcatgcatgcacacatttgcagacatgtacatacacatatgtgttataactctgcctcagatgggggcctttttaatatagaaacaccagcaggatgggtgagaaatggcaatggttttctctctagaacctgattgcttcaccaaacaatggtttgtatttcctcccacatccctccttcctaattgaagagggaatggctgaatttacctcctggcaccttgcatttgatgttcagtgactgatccagctaaccaggggcctcgtggttgcccaggcgttgcaagcatcaaacccagatcttcactgggatcttcctccagtggctggagtttataaattgtattctgttgagttggaaaacatccactgctcctgattgagagctggaggacagcactttgaggggtctgctgctataaatactgggatctcccaggtgatgtataaatgggtcactactttgcatcttgcaccacctgaaacatctcaggtgccttaatcccatgttttccaacagatgagcttggctgacttctcggggtgggttggggggacatgccacatgcctctggccccaccatctcatgcctttgccatccatctcctgactggccagaaggacaccaggagcagctcatgagctacaaaaactgaaggtcgggaacccaaggtcgtgcaccaaaggtcatgagaattttgcattttatgttgctctcatttctgatcatttgaaacaacctctctgagtttctgaaagggaagggaatggagaaaagcacacccaattatgctaggttctgttttattttggcttttgtttttgttttttttcccacccaccacaagttcttttcttcccctctcatagtgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaagaaaagaagaagaaatactatttcaaggaaaactgctctttttgagaaacgtggacctaaactacaaagtgggaactgaggagggaactcaggagaaaggaactaactgcggagctttaatcttggccccagtgttcagccactcggaggggcgggggctgtggcccattcaggggctgctggtgggctgtagtggggtgggatgacctggccagagccaacgaggatactggagcccaaagtcaagtttagagaccagctgggaacgtgaatggggctcttgattttcttatcaaaatcaccactcctcccagcttggactaaatattctttctagcaagcagctttgtgagctccctgaagcccaaggaaacccttcggtgggagaaatttcatttctgtctgagaggattaaggcagcaggtgactccccctcctcgcctgccgtgtcctgctattctcaggcagctctaaggagaattcttatcacagttcaagtgatttccagaagttccagggcttctgagagaccatcaagggaactttaacaacttgacaaatgtccttgaagtaagatgcctcatctttagggaaaaatggggtttggatttctgcttaggcaaagtctcctgcagttcatccttctctgtcctcttcttgcttcaggcttggggaccgtccctgctgtccccactgtggtggcaatcaggacctaaggtgaagcaaacttgaagttctatctgacaagtttaggcagtaagagaaggagggaaatcggagcaaagctccctcactttattgttgagaaactggcatctggaaagaggaaggaatttgcccaaagtcagtcagctgggataaaaacctgggtgtcctgtccagaaagtgcagggtgctttctgctctgtagcaaggcagcagacatctctgagccaggcccaccaacaggcccttatctggtggttggatcatgatcccattttgcttggacatgctctcaggaagataaaaaccatggagaaacactaggccattgacaaatgatctgagacaactttagaaaacaatgtaggatgaatggaaagagaaagaaaggaaagaaagaagaaaaagaaagaaggaaagaaagaaagagaaaggaaggaaggaaagaaggaaggaaaagaaggaaggaaggaaggaatatagtgttataaatactgcactcaacattttccaaattcttgccattatttttcaaaagtttaatagtttgcagaaatagatactcaagccaaagtctgttttagagaaactttccatggaaagtcagaatttctaccacttccttttctatccacatttccagtgcagaagaaactgagaaacagagctttttgaagagaggacagggccatagcaacaaggaccttcttgggggattaatgggaggtcagtagaattaataaccctccttggatgagtgctactgttttcacatggcttcagatgctatcaacctcaaagaaatgatctcaacagagaagcttattctctcccaacttctacggtaaaatccaggagtattttctctggggatctgcccacaggacaaagtccataaaagcaagtcctgtctggaccatgtggttatctgaagcattagccatcaccagcacaacaaacggggcagggctttccaaggtggggctggtcagaagggaatctttgataagaggcccacaggcagggaaagcgaaatagggttgatgagaccaggggagacctaaaaaaaaggcagctttgtgtcttctagctccaaatatacctgccttttagctcacacactgtcctggagttctcagacctttaggggccctaacacagttcagttcatacaggggttcaaaagggacagtggcccatttgggagacctttaggatcaatgggaatcaattccattgttttgcctcagagtaaagtttctggctcggggacaattataagttgcaaaaaggatagaggcatatcccaagtcttccttcattccacaaataattacaaacaacctactgtgtgccaggcactattcttagcactggaaatacactagtgaagaagcagatgaggaccctgtttattgtttctctccaagaaattctccaagaatattgtttcttggagagaaataataaataaacaagacaatttctgaaagcaataagtgcaatcaagataattaaaggatgctaaagtgtgacttgtggggattgggagagagatgcacagacaatattaaagaggaggcattcgagctttgttgtgaacaccggaagtaacatgccgagcgcctgggggatggaaactcctatagcaccccacaggctaacagcaagcaggacaagacaaaaagggcaggtgggacatggtagagatggaccctacccaggaaacagctccatcagcatcttagcctgccccactctagccacacatacccacgtgtgctcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtaaaaatcaggaacccactgaaatcttgggcaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagtttcttttgttttgttttgttttgttttgttttaaggctccccttacacaccctcctttaagctttgggttttctctcttatagtttgttgacacatgctaaaaatgtctttggagagaacttctgcctgataaacacccaattctagactgtgggtggattttcgagctgacggtggtcaattcctttcattaagcagtgatctgatttctccacatggccattctgccttcttgggggcagagtagatgggcagcagttcaccttttcagagaaagaggtcttctagccacctgggctgctactgaatggttttctccaggacgctctacctaatgattatttctataacattaagcatggtaataagtagcttccaattcaattcatcctaaagccaaagaaaatacagcaacacacacacacacacacacacacacacacacacacacacacacacaccactttatggcaattcttaactgacattcaatgacttacttcttttcttagaaaatttccaccacatttctatccccaagccaacatacaatgtgaaatgaaagccagtgcgtggagtgcagctgctaaaaattttcagcacagggctctttctgactctgctcatgagatggtatcagccacccaatgactggcgtatcttggtcctgtgtctttcttcttacgctgtgttaatgtgtttactttccatttggcagagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaa

SEQ ID NO: 352 - DNA, 384633 bp, Homo sapiens; identical to SEQ ID NO: 351

SEQ ID NO: 353 - DNA, 25680 bp, Homo sapiens
aaagagcccgctccgccgagcgccgggcgacggcaggtacgtcagtccgcgagggtcgccgcagcgccccttgcgccccttgcgccccttgcgccccctcagctttccggtgcaccctccctgactgggagcaccgagtcgacccgcgggccgcccgggtcctgacagggaagagtccccgggagctctgcggtgccccgggagcccacaggtgtttctacgctcccgcgtccatttggcctgggtcttccaaggggagccccgcgacccggctggtgcggccggacctgctggcagctgggaccgggagggatgcgggcctcagaggatcctcaccctgaggcaggtggggccctggatgccggcgctgctctgattttactttgaggccgcttctcctctctcagtttacccggccagggctcagtattatgcacaaatctcaatgatgtgctcttgggtaatttacaaaacgattttactcccaagtaacttctttcggtctgttatttagaaggcagcaagtcagagtcctccgtgagcctttttttcctctttaaagttctaaaatgtgcagtccctgacccacctgtcttcaaaaggttcatatgaagagttcttagtactttattctatctctggctccccaaccctatcccagtcttggacagcgtggggctgaggacactaaaaaatatttcaacttgatctcagcagatgaggctgtattgaaagtgggtagaggctgggcgccaaggctcatgcctgtaatcccagctacttgggaggctgaggcgagggaatcgcttgaactcaggagatggaggttgcagtgagccaagatcacgccactgcactccaccctgggcgacagagcgagactacgtctcaaaaacaaaacaaaacaaaccaacaacaacaacaacaaaagaaccttagggccttagggcacactttctcaggacctcttgagattgtgtaactccagcaaactattaattaaaaaaaaaaaaaaggccgggcgaggtggctcacgcctgtaatcccagcactgtgggaggcggaagcaggtagatcacctatggtcaggagtttgagaccagcgtggccaacatggcaaaaccccctctctactaataatacaaaaattagctgggcgtggtggtgcacgtctgtaatcccagctacttgggaggctgaggcaggagaatcactttaacctgggaggcggagattgcagtgagccgagatcgcgccattgcactccagcctgacgacagagggagactgtctcaaaaaaaaaaaaagccaggcatggtggcttacacctgtaatcccaacacttaggaaggccaaggcgggaggattacttgagtccgggagttgtaggtcagcctgggcaacaaagggaggccccatctcaacaaaaaataaaaaactagcaggactcatgcatagtcccagctacttgggaggctgggatgggaggatcgctggagcccgggagtttgaggctgcagtgagctgtgatcacatcactgcgttccgccctctggtgacagagccggaccctgtttctcaaaaacaaaacaaaacaaaacaaaagcctagcctgcctgtgctattaaagcaatggcaaaagccaaaattacttttgcaccaacctaatagctatgtttctgctttttaaactacagttttcttgtctagagcttcagtgagataagaaccaattcttaggactgttgggtgggtcatatgaagtgacactgatgtgcctttgccatagtgcctgaaaaagcactccatatgtattagctacttgtatcattttaccttttttgttaatctctcaggggatgtccctcagccttgcttgattcccgaggccttccctgatttttttcttcttcaggacagtctttaactcagagaatgtttgagagcttccagtccttcctccttcagggacaggttaaactctcctgcttccttgcctggctggaaggattatcattcattgagccactggtgtgtgccacatactttacattgtatttcatgctgaaaacagtcctgggaggttgatgtctttggccttaaatttcagattaggaaactgaggcttagagaggttaagtaactgctgggcatggtggctcacgcctgtaatcccagcactttgggaggccgaggcaggcggatcccaaggtcaggagtttgagaccagcctggccagcatggtgaaaccccgtctctactaaaaatacaaaaaattatccaggcatggtggtgcgcgcctgtagtcccagttactcgggaggctgaggcaggagaatggcttgaacctgggaggcggaggttgcagtgagccaagattgcgccactgcactccagcctgggtgacagagcgagactccatcttaaaaaaaaaaatagattaagtaacttgctcaggatcctacaggaagcaggaagaggtagagatggggacagagccttttgggactgatacgcaacccaggactgttcctctgcccctgtcattagtaagggatactctccccactctggccatgacctgtcacctgcccatgtctctctatcactatgctgagatgaagactgggctcagaacttctgggccattggactctctggggcatttcttttttttcttgagacagagtcgctctgttgcccaggctagagtgcagtggcgtgatcttggctcactgcagcctccgtctcctgggttcaagtgattctcctgcctcagcctcctgagtagctgggactacaagcgcgcatcactacacccggctaatttttgtacttttaaaagagatggggttttggcatgttggccaggctggccttgaactcctgaactcaagtgatctgcccactttggcctcccgaagtgctgggattccggatgtgagctaccacatctggccatttcaagggtttctttctttctttctttctttcttttttcctcagacagggtctggctttgttacccagggtggaatgtattggtgccagtttactgcaacctctgcccccagggctgaaacaatgcttccgcctcagcctcctgagtagctgtgactataggcacattcactgtgcctggctaatttttgtatgtgtgtggttttttgtttttttttttttggtagagatggggtttgccatgttgctcaggctggtctcaaactcctgggctcaagccatccgcctgtcttggcctcccaaagtgctggaattacaggtgtgaaccactgcacctggcctcttgctgtctttcagtgcctttgcttgggaccagatatcattatcactatcacctgaataaggatccaaaagacccaggtgtgttgcaactttgactatagcgtctcctggcctctgtgaagtggagataataggagataataatacttatcttgcagggtctaagggtgttgtcaagataaaaaaaaaaaatcacagcaccttaactgtggtccagagtgctcagtcctagtggctattattaattttttttctttctttctttcttttttttttttttgagacaaagtctcactctgtcacccaggctggagtgcagtggaacaatctctgctcactgcaaccaccgcttcccaggttcaagcgattctcctgcctcagcctcctgagtagctgggattacaggcacccgccaccatgcctggctaatttttgaatttttggtagagatggggtttcaccatgctggccaggctggtctcaaactcctgacctcaggtgatccacccgcctcggcctcccaaagtgctgagattataggcgtgagccaccatgcccggcctattaattttaattttattttttttgagacggaatctcactctgtcgcccaggctggagtgcagtggcgtgatcttggctcactgcaacctccacctcccaggttcagcctcccgagtaactgggattacaggtgcctgccaccatgcctggctaatttttgtatttttagtagagacagggtttaccatgttggcgaggctggtctcgaactcctgacctcaggtaatcttcctgccttggccttccaaagtgctgggattacaggcataagccaccatgcctggcatcctagtggctattattactaaaatcatccctcccttgtatttgtttaggctttgtcataattataatagataatacatactgagtgctttacatatatttcctccttttgtacttcagctctacaaagtaggtttattgtagtggttaagcaagtggaccctgtagtggggagcatgaatttaaaaattaattaattaaatttaaaaataaattaataaaaaaaaaggctgaggcaggaggattgcttgagtccaggagtttgagaccagcttgggcaatgtggcaagacccaatctcttaaaaagaaaacaaacagtgaaaaccttagctaggcatggtggcatgtgcctatggtcccagctatacaggaggctgaggtagcaggattgcttgggcctgggaggtcgaggctgcagtgagttatgattgcaccactacactccagtctgggtgacagattgagaccctgtctttaaaaaaaaaaaaaaaagtaaaaaagacaataaaaaaagaggccgggcatggtggctcattcccagcattttgggaagccgaggcaggtggatcacctgaggtcaaaagtttgagaccagcctggccaacatggtgaaaccctgtctttactaaaaatacaaaaattagtcaggcgtggtggcacatgcctgtaatcctagctactcgggaggctgaggcagggagaattgcttgaacccaggaggtggagattacagtgagctgagattgtaccactgcactccagcctgggggatacagtaagactccatctcagaaagaaaaaaaggtaataaaatagatactctggaaaaaaagtttagtttcaaacttcactctgccacttgctagctttggcaagttacttcatctctctgtgcctcatttctccgtctttttttttttttttttttgtagagtccaggtctctgtatgttgcccaggctggtttctaactcttgggctcaagcgatcctcctgacatggcctcccaaaatgctggaattatagacatgagccaccacacccagcagtttcttcatcttttttttttttcgagatagatttttgctcttcttgcccaggctggagtgcaatggtatggtctcggctcactgcaatctctgtctcccaggttgaagtgattctcctgtctcagcctcccaagtagctggaattacaggtgcccaccaccacatctggctaatttttgtatttttagtagagatggggtttcaccatgttggccaggctggtctcaaactcctgacctcaggcagtcctgcccctgtctcccaaagtgctcggattataggcgtgagccgccaaccacgtctagcctcttttttttttttttttttttgagacggtgtctcgctctgtcgcccaggctggagtggagtgcagtggcgtgatctctgctcactgcaagctccgcctcccgggttcatgccattctcttgcctcagcctcccgagtagctgggactacaggcacccgccaccacgcccagctaattttttgtatttttagtagagacggggtttcactgcattagccaggatggtctcgatctcctgaccttgtgatccaccctcctcggcctcccaaagtgctgggattacaggcgtgagccaccgtgcctggacttctttttttttgagacagaatctcgctctgtcgcccaggctggagtgcagtggtgtgatcttggctcactgcaacctttgcctcctgggttcaagtgattattctgactcagcctcctgagtagctgggactacaggcacgtgccaccacatctggctaatttttgtatttttattagagacggggtttcaccatattggccaggctggtctcaaactcctgacctcgtgatctgcccgccttggcctcccaaagtgctgggattacagatgtgagccactgcgcccaggtggcagtgcagttctaagctgcctgccagaggagtctggaatttcacaggaataggtctgtttcagtgtcccagctgtgctcagtcactggttgtgagaaggttcgttcaaagcgtggcctccatgtaaacaaggtgggagattcagatcgtagcagctgggggcgtctgttagttacactccctgctgcagctgacctgagggttagacgtgcctacggccatacagtaaattggtggcaaagttggagggagggcttggtgggcatcctgggaggagccttcaccctcaagtgcctggctgggatctctagctggaatttcccctctggatttccctgctgggctgagtagggaatggagcaatttctgacagaggcttttcctgaaggcgtgggtgttgctgagtggtggtgtcctgtcagcctcttctcttctggtggcagcagagcctggcactggaatagcctgtggctgagcttcaggtttcctgtcactttggctggggtgtgggctgaccaccagatgtgtgctcagggcgcagctcagccagtggtgagcagcttacttgcatgggcttttcccatgctgagttttgaggggtggagggaggaaatgggggtgctgctttgtgggacagcagtgggagccctgccagaggtgaatgtgtgggtactcctgggggactcggtctcggggaggccaggggctcaggagtcagattggttttccatctggcaggagtgctggcaggttgggggagacaggggtgggggtgaagccaaatctttggccttgctttccccctacttgctgagagtgccctggaggaagatggcgggcaggtagggctgcagcccccgctgggctggctgagacccctgggaagggaggtctccaagtgcctgctcctgcagctctgagtgcatatgcgctccccacagctgcccccttctccggggaacccccatcagcttgaggagcctggggggtggggttaggcatttgctctcgccttcctttcccccttgctttgggtggccccaactcttaccccatcctgctgccctcccttcctccttcctgggcacactccctggggaaatcacacccatccacattttggaatgtcagcagacatgctgaccacgtgacccagccatccgccttggtgtccacctggggagatgaaatcttctgttcacacgaacctatctccggaggttcatagcaggactattcacatctgccaaaaactggagatggcccagatgctcttcagtgggtaaatggagaaacagatgcggcccatccatgcgagggatcactgctcctccgaaaaaaggcttgggccacagatatgtacaatgacttggatacatctcagaggcatcatgttggatgaaagaagctaatctcaaaagattatattccattttatttgacttttttttgttttgttttgttttgagggtcttgctgtgtcagccaggctggagtgcagtggagtgatcatggctcactgcagccttaacctcctgggctcaagcagtcctcccaccttggtcttccaaagtgctgggattatagacgtgagccactacacctgtcctggcctttattttattttagttaattaattagagatagggtcttattctgtgacccaggctggagtgcagtgatacagtcatagcccactacagccataatctcccaggctcaagcagtcctcccaccttagcttcctgagtagctggaactacaggcacacgccaccacgcctgcctaatttttgtatttttagtagtgaagaggttttgccatgttggccaggctggtctcgaactcctgacctcaggtgatctgtccacctcggcctcccaaagtgctggaattacagatgtaagctactatacctggcctgttcgacattttttcttttatttatttattttttttgagacggagtctccctttgtcgcccaggttggagtgcagtggcgcgatcttggcccactgcagcctccgcctcctgggttcaagcgattctcctgcttcagcctcccgagtagctgggattacaggcatgccccgccacacccggctaatttttgtatttttagtagagacggggtttcaccatgttggccaggctggtctccaactcctgacctcaggtgatccccccacctcagcctcccaaagtgctaggattgcaggcatgagcctctgcacccggccgacattttctaagttgatgaaactatagctttagagagcaaatcagtggttgtcagggcgtaggcggggaggagaggttgcatgaggaagtttttttgagtgtagatggtgataccaacacgaatctatacacatgttaaaatcatagaattgtatataaaattaattacttttagttatgatggtttaaaaaatagtcacatctacccatattgctgtctcaggaagcccctccgcttggccagaatggagcagccgaagggagttgattggacagtcatcatcctgacctgccagtacaaggacagtgtccaggtctttcagagaggtaggggactccccttcccaccttgcccctaatggagaacctccctccccttcctggctatgtccctccaacaccaggtgccaggccaacctgggttcaaacccagattgcacttctccctagccatgtgacagcatacgtggcatgtcattccttgtgccttagttttctcatctgtaagatgggagtaatatgacttctctcactaagttgggtgaagatctagtggcctcctacatggaaagctaagtcaaggaagatcaaacactgatgatcagtaggcttgcttacgtgctttgggccagggcagagagctggggggcaggtcccagtgtctcttctgaccctagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcactgtgagtgctcaccagggccacctccctggtctgtgtccctgctggaaccaggtcatttctgagatccccagctcctctggctccatcgccttggccaactcagcattggtctcagtttttgtttctgtaaattgggcggactcatctctgccttgccgttcaagtgagggcagaaggcagggccagcttttgcagtgtttttagagagttgtagccaatatctcaaagtgaggctttctggcttctcttgaaacattcaaaggtcttgctagcctgggctgtcatccccatatggcaacgaactgttcgctggacctgagctgcggctgcctgctttgggcaggccatgtgagtcagcatccctgctggtcccgtgtctcccatgcaaccagccacttcacccggtcaccttgtctgcatagcatctttgtgtgcagagtgagggcgagcacagacttggacatgctctgcagagggagatggcaccagcaggggaggggaccactgtagctgccatggcgctgactcccctaagtcacccagccagcccccaactcttgttgcctgtaacctccccttcaaaacagacagcagaggccgggcgcggtggctcatgcctttaatcccagcactttgggaggccgaggtgggtggatcacctgaggtcaggagttggagaccagcctgaccaacgtgatgaaaccccgtctctactaaaaatacaaaaattagctgggcctggttgcacacacctgtaatcccagctactcgggaggctgaggcaggagagtcgcttgaacccaggaggtggaggttgcagtgagctgagatcatgccattgcagtgagctgagatcatgccattgcagtgagctgagatcatgccattgcactccattctgggcaacagagcgagactgcatctcaaaaaaaaaaaaaaaaaaaaatttaagaggtagccaggcgtggcagtgcacacctgtagtcccagctagttaagaggctgaggtgggaggctcgcttgagcccaagagaccaaggctgcagtgagctgggatcataccactgcactccagactgggtgacagagtgagaccctgtctcaaaacaacaacaacaacagcaacaaaccagccagcaagaaggtggcccaggtggagggccctgggatcccttatccaggagggaccagggctgccccttgtctgcctgtggccattggtttgaccttgccttttgtcccttgggtacctgagtggatttgtgttggagtctctctctggattcgagggtgccatcctccagggcgtctgcctgaggcctctgttcacagggctttcccactcctgcaggtggtcacatccgatgtcctgcactcggcctggatcctcattctgcacatggtaaatgaactttggggcaggggccaagcagaaggccagaatcccagttcgtggagttgagcaggacttcaggggtgttctgccactgtgtgtgtgcaagatgaaatctgaaagattctaaatgtccaaaaattgggaaatggctaaatatataccacatattttcccagcagaatattagattgaaaggtccatctagggccgggcgcagtggctcatgcctgtaaatctcagcactttgggaggccaaggcgggaggattgcttgagcccaggagatcgagaccagcctgggcaacatggtgaaacctcatctctataagaaatacaaaaattagccgccatggtggtgcacacctgtagtcccagctactcaggaggctgaggtgggaggatcacttgagcctgggaggttgaggctgcagtgagttatgattacaccactgcactccagcctgtgtgaccctttctcaaaaaataaaattataggctgggcgcagtggctcacatctgtaaagtggctcacacagcgctttgggaggttgaggcgggcagatcacaaggtcaggagtttgagatcagcctggccagcatggtgaaactctgtctttactaaaaatacaaaaaattagccaggcatggtggtgcatgcctgtagtcccagctacttgggaggctgaggcatgagaattgcttgaacccaggaggcggaggttgcagtgagccaagatcgcactactgcactacagcctgggcaacagagcaagacttagtctaaaaaattgcagtgcaatgcaatgcaatgcaatgcataatataaaaatatattgtaggagaaaatatcaagagaacattttttatcagccctccactggatggctttctgcctgcacagctgatgaggtggccttgggctctgtgcactgaggcttcctcaccagtcccccgacttccagggtcgagacttcccctttgatgactgtggcagggctttcacctgcctccccgtggagaaccccgaggcccccgtggaagccttggtctgcaacctggactgcctgctggacatcatgacctatcgggtgaggctgggtggtggcccgtggtgcctcgtcccagatagagccacttccctcccactgttcccccaggtatgatctatgctggctcagctgggagaaggaatggttttgagggtgcctaatgttagttaagagcttcaagaagttagttgtgtctgggggcagtggctcatgcctataatttcagcactttgagaagccaaagtgggaggatcgcttgaggccaagagttcatgaccagcctgggcaacacagcaagaccccatctctacaaaaaaatttttaaaaaattacctgggcatgatggcatgcacttgtagtcccagctactcaagaggctgaggcaggaagatcgcttgagcccaggagtttgaggctgcagtgagctacgatcgcactactgcactccagcctgggtgacagtgagaccctgtcgcaataacaacaaataagttagtcttggtcacatggggaaagttgtaaacccaggtcagagagtgggtgggggcagaccaggtcttggaggcccttgttacttcaacagcacagtatccttgggcaaggagggggcaggtgaaggcctgggccaggcaccagctgtgttctgtctccttccccccacagctgggcccgggctccccgccaggcgtgtgggtctgcagcaccgacatgctgctgtctgttcctgcaaatcctggtgagcctgagactacctgggactgccttccttcgtcacagccacagcaagaagccagctctgcccttcttgcccaccctgcctctgggcctgccccgctgccctattagacgggaagctggagggtgtggagaatgaagcctggtggaggcagggcttctcctgctgtgcctcagtctgtctgtctataggatggacagaagcagccctgccccttctgtcccacagggctctgcggaagaactttgggagaggagggttgtcattctcccaggcgaatgtccatttggcttggaaaccgtatttcccttttagaggtgcccaggtgccgcagccctgggctcttgcttccacctggtggggaaatccgtgccttgggtggaggcccctgggagcctcctgactgccccaccccacaggtatcagctgggacagcttccggggagccagagtgatcgccctcccagggagcccggcctacgctcagaatcatggcgtctacctaactgacccccaggtagtgcccctggggacagtggagccggctggggcagccttcctcctgtcagtgggcagcctcctccctgtcagtgggcagcctctcatcctggatttcctcgcatgttcctgaatccaaggagtttcctccgtggcagtggcaccagtgctcccttactctcgccaaaaatacatttcacaccgaccgcctgtccagtctctgtgcccaggctcagggctgcaaagacctttaaagcctgccctctgccatcatggagtagaaatctcaggccccccctgagaatgccagcaactgccagccttgcgtcctcagctttcctttggagaatgcccttgctgccacctgtggctgtggcctccttccagatcccttcctgctccctccgctgattctgtttctccctgcacatagggccttgttttggacatttactaccagggcactgaggcagagattcagcggtgtgtcaggcctgatgggcgggtgccactggtatggctgctgggcccaggttgcggggctttggggaccttatgggacagggagggagggtctgacttccttcgattccttctagaagcctccaggacaagctagagctagaatctgaggacagggtagccttggaattcagggtcttgtcctgagccagaaagcctagaaccaggcgggcacggtggctaacgcctgtaatcccagcactttaggaggctgaggcgggtggatcagttgaggtcaggagttcgagaccagtctgggcaacgtggtgaaaccctgtctctactaaatacaacaattagctgagcatggtggtgtgtgcctgtaatcccaactacttgagaggtagaggctcgagaatcgcttgaacccaggaggcggaggttgcggtgagcagagatcgtgccactgcacttcagccagggtgacagagcgagactctgaatcaatcccctgcccgctgtaaaacaaaacaaagcaaacctcaaaaactcaaacgaaaaaagaaagcctagaaccagaatgtgagcaagttagggagtgcggttgggaggaggcctagagccagactccgggaatgcttccatcatgaggggcaaggattggagaggcatggagatctgggagtggaccatggcgagggtggagaactgggttcaggagaaggcctgacagttgagggtgtcccagaaggtgtcttggtgggagctaccccaagtaagcctggagtctggctgctggagtggtcagaaggtgacactccctgcctggtatggcactcagcttcatgtggcccatctgcatgtgccctccctgacttgtaccagggcctggtccagggccctccatctctgatccttttggggtcccttccaggtctctggggttgtcttcttctctgtggagactgccgagcgcctcctagccacccacgtgagcccgcccctggatgcctgcacctacctaggcttggactccggagcccggcctgtccaggtgactgggggagggcagctaggtggggcctggcttgggggcgaggcactgtgtgacctcaggccagccacttcccctctctggggcagagtctccgcagacgggactgccctggttcagcctcagaacttgggggctgaacccctgccatgccaatagctgtgcttcttccccttcccctagctgtctctgttttttgacattctccactgcatggctgagaacgtgaccagggaggacttcctggtggggaggcccccagagttggggcaaggcgatgcagatgtagcgggttatctgcagagcgcccgggcccagctgtggagggagcttcgcgatcagccccttaccatgggtgggtactgcctctcagctccctggggtggggagaccatgggagtgaggaccccaagaatggagctgctcactgcatgctgggccaggcagcccagcacagggactgggcagttctcctgtcctgtgccagagccccccactgagctacctccttccccttcttgtcttccttttgtctcattcctgggctctcccagcctgtccacttttgtttctgtttttttttgtttgtttgttttgttttttgagacggactctctctttgtcgccccggctagagtgaggtggtgcgatctcagctcactgcaacctccgcctcctgggttcaagcaattctcctgcctcagcctcctgcgtacctgggataatagccatgcatcatcacacttggctaatttttctatttttagttggtcaggctggtcttgaactcctggcctcaggtgacccgcctgccttggcctcccgaagtgctgggcttacaggcatgagccaccatgcccggccctaacctgtctgctttctttttttttttttgagacagagtatggctctgttgcccaggctggagtgcagtggcgtaatttcggctcactgcaacctctgcgtctcaggttcaagcgattctcctgcctcagctgcctgagtagctgggattacaggtgcgtggcaccatgcctggctaatttttgtatttttagtaaagatgggatttcaccatgttggtcaggctggtctcgaactcctgacctcgtgatctgcctgcctcggcctcccaaagtgctgggattacaggcgtgagccactgtgcccggccaacctgtctactttctagctgtgttgtgtggctttgggcaggttcctgactcagcttcccctaacaggctcatggccacacctgcccccatgtgtctctgctgctgggaggcagcctggcccctgagtcgcagcaggcatggggttgggttcagtacttatgtctttacagcctatgtctccagcggcagctacagctacatgacctcctcagccagtgagttcctgctcagcctcacactccccggggctcctggggcccagattgtgcactcccaggtggaggtgagacctccctgcccctccggtgcctgctggttgtctggggtcaggtgggatgtggattcccgggaagaaaatagccggcacttggaacagatgacccgagtgcaggtgttaccctggtttacacatgaagtgctggaggctcagagaggctaagtaacttgcctaaggccacagagccagtaagtggccaactcaggattctgcattgagcttgcctgattgagaagctaaaggagacctttatttggggtctgcctggggtgacagtggtgggcctgggtcagtgccgtgctgctgaggaaggggacaggtagggttcagaggtggcccccagggtggcaaggttgggcgtagttggacaggtgggatggaaataggtctcaggctggggccaaggcaggtccagagaggagtctagggtgctgcagggcaggggagcagtaggcctggacgctttgcccctggatgcttggcttgggaggagagctggggcagccctgggcctcgacccccctcatgctcctcctacctggctgcacaggagcagcagcttctggcggccgggagctctgtggtcagctgcctgctggagggccctgtccagctgggtcctgggagcgtcctgcagcactgccacctgcaggtgaggcctgagcgtgtgggcagattggggcgagggtgctggcatcccgcatgtgttggggggtgttgggtgcctgcccacccaggatgcctgccctgtcccccaccagggccccattcacataggcgctggctgcttggtgactggcctggatacagcccactccaaggccctgcatggccgggagctgcgtgaccttgtcctgcagggacaccacacgcggctacacggctccccgggccacgccttcaccctcgttggccgtctggacagctgggaggtaggcagtcaccctgcattccctcacccccatcttcaggctttggggagcccaaggagtcctggcccccaccccactgcggggttctctgagcactggcccgtgggacaggctgtgaggagggtcggatgtagggaggagagaatgagggaggagatagggtgaagataggctgtgagaccagcagagtctccacaggcctttacctccctccttgcatctgctctgccaggtgggctgggtggggattttgttttttttctggagatagagtcttgctctatcaccaaggctggagtgcagtggcccaatctcagctcactgcaatctctgcctcccaggttcaagcgattctcctgcctcagcctcacgaatagctgggactaccagcgtgcaccaccacgcccagcttagtagagatggggtttcgccatgctagtctggttgggtggggttgttgtttttttttttttttttgagactcactctgtctcccaggccggagtgcagtggcgcaatcttggctcactgcaagctctgcctcccgggttcacgccattttcctgcctcagcctcctgagtagctgggagtacaggcgcccaccaccacgcctggcaaatttttttgtattttttagtagagatgaggtttcaccgcgttagccaggatggtctcaatctcccgacctcaactgatctgcctgcctcggcctcccaaagtgctgggattataggtgtgagccaccgcgcacggctgggtgggggtttttatccttatttgacaggctagagactgggattcagagagggaggtaacccgccttgggctgcagcctgttgtggtgggctgggcctggaacccagggttctgctccagatttcaggcaccttggcgggagtgttggggctgcagggctgaaaacaatttcagaaattgctccatggctgggtgtagtggctcatgcctgtaatctcaacactctgggaggccgaggtgggaggccaggagttcatacctgcagtgagctgaccacaccactgcactccagcctgggtgggtcaagtatgttctttgtctgtcttcctgccctcatgtgagcacttgagcagctcctggccccctggccgagtgtctctaaccctttcctgtggcccctgcagccctgactgcttcttcctctcccccagagacagggggcaggcacatatctcaacgtgccctggagtgaattcttcaagaggacaggtgttcggtaaggtggacacccctagggcctctgtgggcctgggcagctggggtggctgctgctctttgaggtgtgtccctcccctgccccagagcagcacgggccgtgttaccatccaggggcctgggtggttttgggcagccggattctctccagtactttcccccgggcagctcccagtctctggctgtgctgactttggctttcttgttcaatggtctgggaaaggatgccaggcagcctggcccccgacctgaattgcccacttatgctacctcggaggagtctgtcctgtccccatgaactgacaggcggctcagggcttggggaagagactggagcttttgcttccctcctgggaatgtgccttctccccacatcagagcctgggacctgtgggaccctgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccagggtgagtgtgcaggctggtagtgctgcagaatcaggccaggggcacctgccctccctgtcctctgggccatcccctgaggggactaggggaccatgaggtgctcaagcagggaaggggcatgctggagtttacttttaggattctggaaggcctcatccttgtcaatggggtttggtctgaggttgaggcatgttcatccttgtcagtggggtttggtcagaggttgaggcctggcagctgagctctaggtcctaggcacatcggcaaaccctgcgtgttctgtactgggtgccaggatgtgggtgcagagcgtggcgaggggacagagcccccaggggacatggtcatctctgcatgaggtcccaagcacacttccgggggctcacagccttagcctcctaggctgaacctcatggaaggtcccagggaccgtggacatgaatggtattgaagccactcacccagagccacacggctagctggtggtgaggctgagacctgagcccaggtggtttgagcccagagcctgagctcttcaccactatgggtgtcctgggtgggggtgaagagacacctatgggctgggactggcaagacgagatgatctctgccaggcagagagcaggagtgcagttacagtcaaagatacattgtgggcaaaagccaggaggtgtgaggggtctggcgcatttagggactgttgagtagcctctcgtgaaagaggattttgaagacaggcctcctcccctgccacccccaactccttgtccctcagttgcagctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggtgtgtactaatggaggtcagatcccttggataagccccttgctgtctgggaagtggaccctgatggaggaaacccagagagaggtggggctcccttgggtaccccgggacagtcaggtccccaaagccaggcaatctgcccccagcttggggctgcatgccaccatccctcccccttctcttggcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctggtgagccccttgtggcaggtggggttgagggtagctgccccagagccaggctggcagcttctgtgaccagcttgagtcttgccacactgccatagggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccaggtcaggcaccctgggacctctgcaggtggggctggccagctgggggctcggggcagaagctagagactgcaggccagtggggtctggcctgagggccagccagtctggctgaggagcctgaagggaaggaaggggctgggagtcaacctgcaaagatgacacgtgtccctgtctgggagcccagaggcccttttgtggcttggggatggggccagtactgctgctgggcttttgtcccaccggatgagtcccgcactgggctgggaagtccagggtgggtgggtgcctgcgtctgcccatcgagactgaattcctttctcatgcctgtccttctgcaggggccctgctgaaggcggccttcatctgtgcagggatcgtgcatgtccactcggaactccagctgagtgagcagctgctccgcaccttcgggggcggctttgagctgcacacctggtctgagctgccccacggctctggcctgggtgagcgggccctgcctcctgctacccaccgactgttacagccctccagccttgcctgtgatcccccttcctggcctctgcccttagacggagtcaggcaggcctgggcagggtggaggtgtttcatgtctgctctctcctctccgccctgcaggcaccagcagcatcctggcaggcactgccctggctgccttgcagcgagccgcaggccgggtggtgggcacggaagccctgatccacgcagtgctgcacctggagcaggtgctcaccactggtatgtgactgccctggagttggaggaggtcactgacactttcccaagggcccgcggggggagtggggctcccctggatttgcatgtgattggccaacagccacaagactgtgctgctgttggaaatactttccttctagtcactttgaccttctctggtcgttttcaacctgaaatgttctacctcccaacgagccgtttcacaagcatctactgagtgccagattctgtgctgtgccctttttttttttttgagacggagtcttgctctgtcgcccaggctggagtgcagtggtgcgatctcagctcgctgcaagctctgcctcccgggttcacgccattctcctgcctcagcctcccgagtagctgggactacaggcgcctgccaccacgcccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggcctgtgctgtgcctctcatgcttgttggaaccaggtgctgtgcttcgtgactgtgcctttccagggctgtgctggggtagggctgggcagagctgctttggaccttccgcctgtcctggcatcgtgcccttacttgagatatgatcacctgtgcccccgcccccaccccctggccatatggtgggacagcaagagcccaacaatgactatgatctaatgaatgtcaccagcgccaggcttctcactcctcctggccaccgagccccctggaacccatggccagtgtagagcagctacagcttgtctggtttcaggtccacctcagggtgtcaggtcccgtctccagcacacccctggaaagaaactgctgcaaaggcctactgaagcctgactgtggtgttttctgtcactctgcagctcaagcctcacatttcactgtagtgactcatatcccataatcggtagtcattagcaaaaggagcagatggggaagcattttcagttttcttttgaggtgtaccattcaagttctacatttggccaacggaaaactatttgttgagaacccactctgtggggccccagggataaaatgagcaaaaatggggtccctgccctcaaaagtcctgtggtctcctggagacagacattaatcaataactactcaggtgcatgtgtattacaaactgtgccaagtgctttgaagcagaggggcacagttaagtcttgacatttcaagacttagccactttgcaactaccaggttttggctgcaaagttccagatggcttctgtcttttgcatttcatactttaaacccttgcaggcccttccctaactatcaagggcctgtcccagaagcaactcaagttttgttatttttaatttttttttatttttgagatggagtctagctctgtcacccagattggagtgcagtggtgcgatctcagcccactgcaacctctacctcccgggttcaagagattctcctgcctcagcctcccaggtagctgggattacaggtgcctgccaccatgcccagctaattttttgtatttttagtagagatggggtttcactgtgttggccaggctcgtcttgaactcctgacctcatgatccgcctgccttggcctcccaaagtgctgggattacaagcgtgagccaccatgcccggactagttttgttatttttatgcagctacaaggaggaaaatgatacatacctttcattactgaagatggaaagatgtgtaagttagataagagaaaaacagatcctgatgaccttccttccaacataaaccacctgtcagaagacggtgcagggagactcaggccaaagggaaggtatctgtcagcctctcctctgactaaaactcccctaggaggggcagaggtcagtgtaaaatatgtattttttgagacagagtctcacattgtcacccaggctggagtgcagtggtgcgatctcagctcactgcaacctttgcctcagcctccctagaagctgggattacagggcatgcaccaccatgcctggctaatttttgtatttttggtagagactagatttcaccatgttggccaggttggtctcaaactcctgacctcaaatgatctgcccgccttagcctcccaaagtgctgtgattacaggcgtgtgccaccgtgcccggccatagtgtaaaatctttattcttcagtgtggtttatcccaattccaattatacattaggtctaaaacaaaactcaggccttgggaattccaagctttgccctagagtgaagcccattcccttgctgggattgttctggggacagaagctgcatagctcactgtcctgtggagttgagggaagctatctttccacactggtcccagcaaggggtgcagggccgggagcctaggctgggagagtgaagctgggccagatagactccaacagtgacagtccctgggctcacaggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggtgagctctggccccagcatgagggaggcaggcagggggcctgccagctgggcctgggtcctcaccaccccttctcctgccccgtccgcaggatgtgctgaggagctggtatgcccgacttcctgctgtggtgcagaatgcccacagcctggtacggcaaactgaggagtgtgctgaaggcttccgccaaggtgaggggcttcctctgggggggtcagggcactgggagcgagtattctgtcacttgtgggtttgaggccagggtcatctgcaggcttggcacaagctccagatattcggcctctgggaacagaagcctactgtctgtcctctccagggtctcacatttaggggagagctacatctgaggacaaaattttcatcatgggaaaggccctccagccctaacaggaagcagagaggggaagggactcaacccatggctgagttccaaggaagtctgagctgggcagggtccccagtgtgtggcttcacagctccctagatgccgactatgctgggtgtggtgttggttgcttcctgcacattggtcctcaggcagtcctgggaagtgggttactcctggctccagccggcactggaatccggcttctttaccatgacactggctcagcagcacgtcttggcacttcatgcaatctccagatgggtgctgagtatcttggcccaggcacgtcactcccctctgccccacctcaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgaggtactgatggggctggggttggtaaagagacctctgggggcaagagacctcactgtggcccaccagttaaccaggggctatatctgtaagtccccctggtcctgcaggcccagtccagcctccagaaggcctgagatttgtccagagccttctaaatacttcctgtcttgtccagggccttgggaattacagcatccacctggttgaagtggacactcagggcctgagcctgaagctgctggggaccgaggcctcaacctgttgccctttcccatgaagctggcttctctctgcaacaggagaaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtatcccacgtggcctttacaaatcctatggctggccttctcattccacaagggccctggaaagggttgacagccagccttggcatatggctgggagtcccttagcaaggccaaccctgaagaggccctttgaggcattccctatggcttagagttgtagacttacactcaaccctcatgtgagcgtgggagtgagggtggcggtcccttgccaagttggtagcagtgacccagtgattcactgccatcccaggccttaactagcaaaactacggagcgtgccaagtgacctggtgcctgtgggaagtgggttctcaggactggcattcttggaataaattcactctgtccttgca

SEQ ID NO: 354 - DNA, 42986 bp, Homo sapiens
tctctccaaggagtagctttattcagggatcataaacatcacagcctctcctcaaagtcaagcctaactgctaggtccccagatgtacccaagttgtctaggactggcaggggtagcttgtttgctgtagtgtttgagggcaagagactgaccatccatgcagaaagctggcctgggctgctcgctgcctgccgtggctttcccacctcattaggagcccgcttctctcggtggggagatgctgcccccagagcatcacctggccaggtctgagggcagagcatggagtgggtccagactttgtttctctgctgccagccgtagaaaggtctgggctgtcagatctcccccaagccagacagcctcgctcagctccttggctggggccccttagggaacaggcctgcaagtgtgatgagccaggtgtgctcatccaggcagctacaggcgcagcctcttgatatcttcactgcggaagtctatccgcagggccagcacctggcgcacttcagcaggggtgaggcgccacgtcaatgggccggaattgggtccccagtaatcgaggatctcggtcacctgtggggaaggacatagagaccagtcagcaaggtggggttattctgaaagagggctctggcctctaccaggggcagagcaggggcacccgggaaggggaaggtgtcctatagagctggctgctggcagacatggtttagagggaagtggcggggatccatctttgcctctttcagtcacccctccctggctgggccaagggtgccccacctacccgctccagattgaggatggtggccatctgggagagccgggcaaacttgtctcggatggtccaggtggtcaccgtggtaaggtaggcaatgagcgacctcagctccttgtcaaactgcagaccacccagctgcaggagaacccaagcccagtcactacttaggcctggccaagcagaactggcctccagttgcccccagagctgggtggcaaggcccgccaggcctcaggtggtgccctgtggtttgtttgctctacggcttcagaagccagagcaggactggacccagacatgcagggcctgtgggcagcagacagaggggatgcaagtcctgggggtggtggcatgacatgtcttcctcagaggagaaacgagagccgcagacccatgacccctttaccttacccggttaaaggtggatttcagcaccactttctccaactcgacggcaacaaggctagtcatgaggccggttaggctgtcgtagatgaccggggacaggctggcctgcacacagagggttgacatcagccgagccccacctaactcctctgcctctatgctggagtcttaggtggtgaggatagtagcgtgaggccacgggggagtttctacaggtgagggttggaagggctttcagggtccccagaaggaatgtgatgagaccctgcaggctgctggtttgggctgacgtgggtaattccctaagtggatccctagggcccctgctcaccttgaactctgccatttgctgctccaggttaaggatgaactgttgtacccaagggtcgttggcctcatagtcattgaattcttcctgttgtcaggaagcagggctggtcaccatgggcctcataagaagtaccattcattgccacccacctctatccctctaagaaaataatgtaaaacattcttccttccctgtgccttctgactcatctagtttaaaaccagctcagacacccaggctggcagaaactgaccagcaaacagcccagggctgtagcagtggcccacataacatggtaaagttcctggcattttattccttcttggatctcttgttctacaggaatgaaatcactacgccaggaggaaaaaaacgcttctaagtctatcataggcggggcaaaaagagctccaataagggaataagttaggtcaaggcaaactccatgtctttctgagcccttctgactagggacaaactgtttcctgggaggaacctagtcttcatgggtcagggtgggggaagtgggcctgggaagcatggaaggtctagtctgttcagatggctctgctccctctagctggggctagggatgaggggtcatcggggcttgatggctgcctgtggccaggctaacctcctcgatgttgtgggagacggagaaaaagctgttgatccaaggctgcacctgtggcttgatggctgtgctgttgagctccgtcagcccttcctgcacaaggacaaggtggagacatgtgacacagaaggcacgactcatcccttccctctctcttctccccatcccttccctctatcctctccccatccctttcctctcctctccccatcccttccttctctcctctccccatttcttccttctctcctctccccaccccttccctctcctctccctaccccttccctctcctctccccaccccttccctctcctctccccactccttccctctcttctccccaccccatccctcttttctccctaccccatccctctctcctctccccaccacatccctctctcgtctccccaccccttccctctctcctctccccaccccttccctctctcctctccccaccccatccctctcatctccccaccccttccctctctcctctccccaccgcatccccttctcctctccccatcccttccttctctcctctccccaccccatcctcctctcctctccccatcccttccctctctcctctccccatcccttgactgcagggcgttcttccagccctgaggctttctgcaggccctgttggaggttataacagagctagtgctaatgaaaggaggagccaggaacatgcccctttccagatctcagctgattcaggtccagggtaacgatgaggccttgagactgttctgataaactctcacaagagatttcagaatgctcaatgttaggcagcacctgcggctaggtcagaacaaccatgtggctccacttcctctgagcatcttctgagagctcttgtcattgtggggccaagtgcaaagtctagagcaccagatgttggcttgtcagtgtgacaacttcactgctgagaaaccaacagggcctttagtctcaagggacctgcacaactccaggctccagggcttgcgtgctgctccctcacccgtcctcctggcttccttgcacacgatgagccagctaacaatcttctcagagcaacacacaggcacaggattcagtcagcagttgaacctggggcttacctgcaagaggtctcggaatttgttggacacggcggccaagtcagaaaggcagctgtcaaacttggcctgggcctgctcccctccaatgccctggctgaagagcttggtgcagtcactctaggggagaacactgctgtaagaccaccgagcacgcgtgggccatgggagtgtgaggagccaccagccagttctactcctccagccagctatggcctgtcaagagcccggatgggtttcagaaaacctggattctatcctggtggttatccacttggctcccacttccccctctgtaatatgggggtaccaatgtcggggaagtgagtaagaaacagaaataccagaaagtttttcctgtctttagagtcagacattcctaggttcaagtcctggctcagtcatgtattagttgagtgaccttgggcaaatgatttaaagtttctgagcttcaattttcctgtctataaaatgggaacaccaattcctgctcctcatgtatgagatgaagcacaacgtgcctagctcaatgcctggcacaggagacactagctattattgctatagttcctcctttcccccccttttatatttatttacttcttcttaaattttatttaaatttaccaaaaaaccacaaaagtcagtttctgcttcttaaatattttggtatggctaccaaaggggatggtcaagatcatagctaaggtttaagggcgtactgtatacctggctttgttctaagcatttcacttttattaaagtaccaggctgggcgaggtggctcatgcgggtaattctagcactttgggaggccaaggtgcaaggaccacttgcggccagagtttaagaacagcagggaaacatagtgagaagccgtctccacagaaaattaaagaattagctggatgtagtggtgcgcccctgcatccctagctactcaggaggctgaggcgagaggatcccttgagcccaagggttcaaggttgcagagagctatgactgccactgcactccagcccgggcagcagagtgagaacaaagtacctattctacttaaaaacaaaacaaaatgaaaaccaaaaaacccccacaactattgtaagttactttgaccttcataaaaaaaagtatctcctttatgaaataggtaaaattattatccccattgtacagatgagaaaactgaggcacagaagttaataatttattcaaagccatggcaataagtcaggaaaggctgagcatggtggctcactattgtaatcctaggactttgtgaggccaaggtaggaggattgctggagcccaggagttcaagaccagcctgggcaacaaagtgagaccctgtctctcttttttttttttttttttgagacagtctcactctgtcgccctggctggagtgcagtggcatgatctcggctcactgcaacctccgcctcctgggttcaagcgattctcgtgcctcagcctcccgagtagctgggactacaggcgcctgccaccacacccaactaatttttctatttttagtagagacagggtttcaccatgttggccaggctggtctcgaactcctgacctcaggtgatccacccgcctcagcctcccaaagtgctggatttacaggtgtgagccatcgcgcctggcagagaccctgtcttttaacatagataaatcatggagctgggactctaggccaggtattctgactccaaaaatcctgttttttttgttttttttttttttttgagacagagtcttgctgtgtcacccaggctggagtgcaacgacatgatcttggctgactgcaacctctgtctcccgggttcaagtgactctcccacctcagcctccggagtagctgggattacgggcacccaccatcatgcccagctaattattgtatttttgtagagatggggtttcaccatgttggccaggctggtcttgaactcctgactgcaggtgatctgcccgcctgagcctcccaaagtgctgagattacaggcgtgaaccaccgtgtacggcccagaatgcctgtctttttttttttcttttgagacggagtcttgctctataacccaggctggagtgcagtggcttgatctcggttcactgcaagctccgcctcctgggttcacgccattctcctgcctcagtctcccaagtagctgggactacaggcgcccaccaccacgctctgctaattttttgtatttttagtagagatggggtttcaccgtgttagccaggatggtctcgatctcctgaccttgtgatccgcccgccttggcctcccaaagtgctaggattacaggcgtgagccaccgcgcccagcccagaatgcctgtttctaatcaccacactacagcgtaggtgtagagacctctccagggggaactgcctgaaactcatgttttgggttgccaggagctgccgcattgctcgtagccttcttagaaagttcatgctgttttggctccagaggggaagcagagtggaagaactaagagggactctcctagcagacaaaggcccttcactcccacagtattcctgacacttactgtctttgagtagtcttgtaaccttccctgtaagctgaacgtcatgccacctgatctgcctatctcaaagggctgctgatggggctaagaaagaacatctgtgaaatgcaaatctaagggcagctgggatttacgggaataggtttttcagctattttacttggctaattctaccagctcacttatgaatttctaatatttccccaaattttacttccaaaacccaacagactcatgttaaggatgaggtcagaaatagtctaaagtgccatgacttacaaacaatgatgtcggccgggcgccgtggctcacgcctgtaatcccagcactttgggaggccgaggcgggcagatcacgaggtgaagagatcaagaccatcctggccaaaatggtgaaaccctgtctctactaaaaaatacaaaaattagctaggtgtggtggcgcacacctgtagtctcagctacttgggagctgaggcaggagaatcgcttgaatccgggaggtggaggttgcagtaagccgagactgcgccactgcactccagcctgggcaacaagagcgaaacttcatctcaaaaaaaaaaaaaagtcaggcatggtggctcacacctgtaatcccagcactatgggaggctgaggtgggcggatcgcctgaggtcgggaatttgagaccagcctagacagcatggtgaaacctcgtttctactaaaaatacaaaaatcagctgggcatggtgtcaggtgcctgtaatcccagcaacttaggaagctgaggcaggagaatcgcagaggttgcagtgagccaagatcatgccactgcactacagcctgggcaacagagtgagaatcggtctcaaaaaataaaaaaataaaaataaaaaaaaaaaaagacaaggccaggcgaggtggttcatgcctgtaatcccagcacttcgggatgccaaggcgggtggatcacttgaggccaggagttcgagaccagcctggccaacatggcaaaaccccatccctactaaaaatacaaaaattagctgggcgtggtggcaggtgcttataatcccagctactccagagcctgaggcaggagaatcacagaagttgcagtgagctgagatcgcgccattgcactctagcctgggcgacagagcgagactccgtctcaaaaaaaaaccaacaatgatgacagccaacttgttgaacacatacgatgtgacagatactatgttatgttgtacaagtgttcactgtggaggcagggccctggcctcacttctttcccagaggctgagtttgggagtggggaagaactgggcccccctcattttccaatagttcacaaagtgatccctccatgctgttatttttattttgttaattttaaatttatttttactatttttacttttttttttatgtttttttgagacggagtcttactctgttgcctaggctggagtgcaggtgcacgatctcggcttgctgcaacctctgcctcccaggttcaagcgattctcctgtctcagcttcctgagtagccaggattacaggtgtgcaccaccacaaccggctaatttttgtatttttagtagagatggggtttcactatgtttgccaggctggtctcaaactcctgacctcaggtaatcctcccgccttggcatcccaaagtgctggggttataggtgtgagccaccacacctggctattatttttaccttttttttttcttttgagatggagtctttctctgttgcccaggctagagtgaagtggcgtgatctcgactcactgcaacctccgcctcctgggttcaagcaattctcctgcctcagcctcctgagtagctggtattacaggcgcccgccaccatgcccagctaatttttgtatttttagtagagacaggacttcaccatcttggccaggcttgaatgcctgatcttgtgatccacctgccttggcctcccaaagtgctgggattataggcgtgagccactgcgcccagcctattattgctttttaagtgatggggtctcattatgttgcccaggctggcctcgaactcctggcctcaagcaatcctcctgactcagggtcccaagtagctgagactacaggcacgagccacccagctattgttattttgagatggagtttcgctcttgttgcccaggctggagtgcagtgacgcaatctcggctcactgcaacctccacctccggggttcaaacaattctcctgcctcagcctcccgagtagctgggattatgggcacatgccaccacacccagctaattttttttgtatttttagtagagacagggtttcatcatgttggccagaccggtctcgaattcctgacctcaggtgatccacctgcctcggcctcccaaagtgctgggattataggcatgagccaccacacccggcccagctactgttatttttaactgttaatacaactaataagtaccactgcatgcctctcatgtactaagtggttcatattaccacattcctctcataacagtcatgtggcacagaggtcattatccctgctttatgaatgacaagactgaggttacagaacttttgcctaaggtcacacagctgggcagtggtcaagtgaagatttgaacttggggtatctggcttcaaagcccaagcaatttccactatactctgcttccttcctctaaaaataacagctactagctttgtataggattaggcaaaccttatcttaatctcctacatttatacagggatttgtcatttttataaggtgcttttgatcctgattttttttttttttttgagacagaatctccctctgtcgcccaggctggagtgcagtggcgtgatctcggctcactgcaacctctgcctcccaggttcaagcagttctctgcctcagcctcccgagtagctgggattacaggcgcctgccaccatggctggctcattttttgtatttttagtagagatggggtttcaccatcttggccaggctggtcttgaagtcctgacctcatgatccacccgcctcagcctcccaaagtgttaggattacaggcatgagccacctcacctggccttgatcctgatttaaaaaaaaaaaaagttttttttttttttgtagagatgaggtctcaccacattgcccaggctggtctcaaactcctggcctcaagtaatcctcctgccttggcctcccaaaatgttaagcttacaggtatgagccacttggcctcaatcctgttttttcattaggctacccaagaaacacaagctagggctggatggagctatgcatctcatttcgtagatgagaggactgaggctcagagggctaagggacttgtccaaggtcacacgccaactatgtgctggaagatctaatttgtgtgttattttgagatagagtctgctctgtcgcccaggctggagtgcagtggcacgatctcagctcactgcaacctctgcctcccgggttcaagtgattctcctgcctcagtttcccaagcagctgggattacaggtgtctgccaccatgcccagctaatttttgtatttttagtagagatggggtttcgccatgttggctaggctggtctcgaactcctgacctcaagtgatccacccgccttggcctccgaaagtgctgggattacaggaatgtgccaccgtgccttgcctggaagatctaatttgaattctgatcttccaactcctgagcttttctccctggtccaaggatgccttgctatcatgtcagtcaccaaagaatcccctcaagtgtggctcaatgtcaccaagataagtgtcttcaccatgatgtttgtatagggctctatctcaacatgggaaaagatggctgctgaccactgataggcaatttccctcgtacctccagtgtcttcttcagagtggagatgttttcactgcagacttccacgttgttcagagtcacctgggagatgaggaaggaagaacgtgacttcctgctgactgtgcctgccacccactccaatgccagactggctgacagctgtgctccatgaagctcagagaagggctggctggagttcagacttgcgctaatgaaaacccacactgctacatctgagcaggacgctcagatcttggattgggcagaatggggaagcaggctcgccctttcttctgtgcctgatgacagggagcctaaagctatcaggacctcagaggtagtgagctcaggtttcaggtcttctttttttgtttgtttttttgtttttttgagatggagtctggctctgtcacccaggctggactgcaagctctgcctcccgggttcatgccattctcctgcctcagccacccgagtagctgggacaacaggcgcccgccactacgccaggctaattttttgtatttttagtagagacggggtttcaccatgttagccaggatggtcttgatctcctgacctcatgatctgcccacctcggcctcccaaagtgctgggattacaggcgtgagccactgcgcccggcgaggtttcaggtcttcttgtactgtgttacctacagagcagaaatgactcaggcatacaggtccaggataagttctgaggctccaaacggtcaagccccaggtcagtgatacaaagcctgacattcattaaagaaaagcttccagagagcctgccacctatgaggtattttctcattctttatctcatggagtctgctaaatacccccatagaacacgtattatcaagcccagtgcacgggaggaaatgagactcctcagaaggtaaaatgatttggccaggcacggtggctcacgcctgtaatcccagcactttggaaggccaaggcgggtggatcacctgaggtcaggagttcaagaacagcctggccaacatggtgaaaccctgtctctaataaaaatacacacaaaaaaattagccaggcgtggtggtgcacatctgtagacccagctaccaggaggctgaggcaggagaatcgcttgaacctgggagatgagaggttgcagtgagctgaaattgtgtcactgcactccagcctgtatgacagagcaagactctgtctcaaaaaaaaaaaaaaaaaaaaaagctggggcagggtagctcatgcctgtaatcccagcactttgggaggccgaagcaggtggatcaagaggtcaggagtttgagaccagcctgcccaacatggcgaaaccccgtctctactaaaaatacaaaaaattagccaggcgtggtggcgggtgcctgtaatcccagctactcgggaggctgaggcaggagaattgcttgaacttgggaggcgtaggttgcagtgagctgagatcacgccactgcactctagcctcggtgacaagaacaaaactacgtctcaaaaaaaaaaaaaaaaaaaaaaagtaaaatgattcacgaaggtctgacagcaactgattcagcaaatatttactgagcacctggatgtgccaggcacagttctaggcactgagagaaagcaattaacaaaaaagacatggtccactcctcacagagctgacattccagaagggaagccagatagtaaacaaatgcattatataatgccaggaagaataataaagcaggaaaagggacagacactcagagtgacaaggccacaaagctggagccaggcttagaattcgggtctctgagcttccagatggataaacaggtggaggttcctggacagtggccacctggggagggcatggaagctccataccccttcccccataatttgccctattcatctcttcatctgtatcctatataatatcctttataataaacaaataaactaaaaaaatgaattcaggtctccctactctggtccaaagatgacttttttcataacacgactgtcttacagactaggtgcagaaataccaatgataaaagtagcatggaggccaggcgcagtggctcatgcctgtaatcacagcagtttgggaggccgatgcgggcagatcacctgaggttgggagttcgggactagcctgaccaacatggagaaaccccgtctctactaaaaaaaatacaaaattagccgggcgtggtggtgcatgcctgtaatcccagctacttgggaggctgagacagaagaatcacttgaacccagcgggcagaggttgcagtgagccaagatcgcgccattgcactccagcctgtgcaacaacagcaaaactccgtctcaaaaaaaaaaaaaaaggtagcatgggcacggtggctcacacctgtaatcccagcactttgggaggctgagacgggtggatcacctgaggtcaggagttcgagaccatcctggccaacatggcaaaaccccgtctctactaaaaatacaaaaattagtcgggtgtggtggcaggtgcctgtaatcccagctacttggggggctgaggcaggagaatcgcttgaacctatgaggcggaggttgcagtgagccaagatcgcgccattgcaccccagctggggcaacaagaacgaaactccatctccaaaaaaaaaagtagcatggggcaaaattattaaggcactaattgctctggccattcagaggaaagaacaaactgtttcggtgtaaggcattcaaggaaggttccatgacagggttggtagctgagctgaacataaaagggtagaacataattctgacaggagatgaaggtgagaacatttctccacccccagcagcctctctccagctcactgtcctatttgatattttcttaatggtccttaggatttcctgacattctctggtttatctatttcttgtctgcatggatctagcctgttttcttcaccactgcgtctctatacagcactgtctacctttctgcttgatggaaatattctaactgcactgtctggtatggtagccctcagccatgtgtggctattgagcacctgaagcatagctagtacaactcaggaagtggatttttaatttaaatgtaaatttcaatagccacctgtggctggtgactaccatgttgggcagtgtagctctagaacccagaacagtgcctgatatttagaagtttctcaataaatatttgtgcaatgagtaagagagtgaatgaacatattctggaaaggggataatataagcaagtgcagaatggcacaaaacccaaaaaggtatttgagaaatagcagagtcagttcacagacacgtgcagggaagtggcaggaggtagagctgcgaggggcagagactgacggggacttgggtgctctgctgcagagttagccctgtgacctgtggacagtgggctggcactgaggatttttaaagcaggtgaatgccacatgagcacagctgtggttcaggaatactcatctagaggccgtgggagggaggaaatagagggcctggggatcccactgcctgtaaactggtctgctggtggcatgatgaggaaggcaggggtgaggtaaggaggagccagtcttcgagacatgagtcaggagcttcaggatttcagggtaaaaggaggatctcagaaccccaggggctgtgattaggaagtccctctcatcttgcccagagtgcttcccttgtcggtgtcctgcagccagtgctgaaagtcatgatgctgacagtgctgcttaggccactctgattgtggacagataagcctaaaggtctttctttaatatgccacaacatgaggcctctaatgtcacaagtttccaaataactgtcctgtcctgacagctgaaggatgaaggccataagtgtttccaaggcatttaagagcaccaagaataactgtcatgaggacttctggatttgagttcaaatggtattgatttcaaagtttcccctgtactgacagccctagtaagcgtggattcactgggtttattccctgcccacagtgcatgatgtcagtaaatttggagaattcatctagacagccaaatgaatcaaggtgacataaaaaataggccctgcaatgggagtgatgacattttaaatacttggtgtcaggaaaaccagaaacctgtcaccaagcatttagcatcgcctctctttttggtcttatcttctggggcctcaaacaatgaaactgtgttaatgggaggtcctcacagagcgaatatgcactggccggttttggagacatgtagtcaagtggtggaaaacggaactggaaaggtggtatgggttagagttaggaggcttaaacaaagacatctagctttgatgtggtaggcagcaagcagccaatgattatttctgagcacagaaatgaaagtaagttctgtaaaaaaaatcacaaacaaaataaaaatttaagttggttcatgatgtgatgctggttgctgggcattttggcaaagttctccaaaggtaacaactttcacaggcaacagttttttggatctgatctttttttggcagcaaccatgatatcctagattgacagaaaccatacacagggcaaatattttctatgacaggaagagagtggggctgcctaaacagctttcacattggatctgtctcataactagttactatgggttcctctgcacagggcttggtagatattagcaagtttaggcttctctctctgcaagtaacagctctgaactcttttgggggtcacagatccttttaagaatatgataaccaggcacggtagctcatgcctgtaatcccaacactttgggaggccaagacgggtggatcacttgaggtcagaagttcgagaccagcctggccaacatggcaaaacccagtctttactaaaaaaaaaaaaaaaaaaattagccaggtatggtggcgcatgcctgtaatcccagctactcgggaggctaaagcaggagaatcgcttgaacctgtgaggcggaggttgcagtgagccaaggtcatgccattgcactccagcctggggaacaagagcaagactccatctcaaaaaaaaaaaaaaaagaatctgataaaagctaaggaaggaccctgtgacccaaaaatgcatgtgaacatttttgcgtccaaccccacttgtgggctacagatgctactagatgtttctttcaggctctgagcctcaggagtcaagactcagggtgcggccaatgtgggggatggagcagaatggacctcggactgtgctactcccatgcgtgctaagacagcgtgtgccagagaggcctgatcttgagcttaggattcatctgtggtctttctggctcatcacaaactggttgttgctttgtacaaatcctttcatccttctgtgctcctcctttccaagctgtcacacaatggaaggcttgctgctttatcacatctgtcattctgggtagcaaagggctttaataaagcctcctttccagaggaagttgaaagcctaagacatgtactagcagagcagtgatggcaggcccgaaggactggcgcctgcccatgctgcgggcctctcctcagagaagcagtctggtggtctggcacagatggtagagctggttctgtggcagatgcaagccaagcttggcactcagtgggctcctgagcagctggccagtgctctggggaatgaattctaggtgacagctggacagcccagcctctatcgtggctcaggtgactcagaatatgtccctgagtaagaaatagtttcagaaccttctgggaggaaattcccttaaaggaggaattttccttctatatagacactggaggaaaagtctctagctagaggccaattatactgtggcttagcagtgatagcgtaacctctcgagataaaccaacccagctcgtgagctgtggggtacctaccaggaaggacatcttcgcctcgtcagtactctcgatgccttttgtgtcaaatttgccttgctggaggctgctgtgcatgatgttcacggcacttgtcaccccgcgctggatgtcctggaaggtggtggcaggaaagcccatccgcagcttattacacagaacatccctggggggcaggattgcatagaggaattgacagtgctcaacttggccaccaggacagaagggccagtcttcaccactctgacccagcagcacaaggtgctcttttagggggaataaccagtccttaagaccactgtaggagacctgaggagccagggtatgaaagtaaccagcaccccgtcaaggacactgatgtgacaagaacatacaggggagactggccaatctctactgttcatgaggcttttagccatcaccactgcactcccaacaaagctgtgcggcttagtgaacgcagtaccatgtaggagttgagaacaggttttgagtcactcagttctggattccaccactgactcctaagtggtggatctttgacgaggacggaatctccctaaagcacagtttcttcatctataaaacagagctaacagttcctacttcatagggttgttattaggacctcaaaagcgcaggagattagcatagtgctgggcctgtagcaatggtacctattggtggtattattcatctgaactgcctgttctctttcctacgtctaagggcccatagctccttcagtctagtccagggaacagaaatttggcccatgagatatatggctgaccaacagcttcctggagccaaggatactatcttagggataggagctgatgtcctgtatagaacttaactagaatcatgaggacaaagggcagaaacaaatgggcctcaggaatcaacaggaagggcctttctgcctagaaaggagaaagggagtcaactgtacctgaagtcagactccagctctgtggtggcgaggttgatcatggcacagagacagtcaatgctggagctggacagagcccgcccaatgcacttcttaacaatgtagaagacatcatccaccatgctggatgtcagctggcccttctcataggtgtccagagccacagcctacccaaaaggcaaagccaacactgagggtcccagttgtgcatgtcatgttctagatgattctgggtacactggccctagctctgctcccttttctgtaccttgtccatgtttctcccaacatggcgtgcatcctccttgtcaaaatagcttacttccctattgatcactaggtgaacaaattaaatatttcgggccttagccctgcagagatccattacctggggagtgtaagatatctgcaggggccctacttccctgaggctccttacccacaaaccttcagggaggtagggaacaagtgggctccctgaagagctgagctgagctgttcttttttaattcttgggaaggaagtcctagctgggtatacaaagaacacaacgactccaaagatgctctctaaacatacaaagtggtaccactcaatctgcatgcaagagtattctcaaagcaggaccaataaatatgacatgcctcagccatttccctcagcctggcttcttggaccggaagccccatttccaagagatgcgtcctatgtcctaccttattgacagtctccctcatgaagtactcctccatggtaacatataagccaattagctcctgcatggtacagctcaaaaggcagttattgaggagtttgtccagacacttctggtgctctaggggacagccaagaaaggaatactcattttttttccccaagggaaacagagcaacttttttcattttttcaggttcctttatagtctttctttgaaatatgtacatattttacatcgttacaatcatgatacagatagcaattttgaattctgttttaaaaaagtatatcataaatattttccatgttttcacctaccttatttttcatgactatgtggcatttcatcaggtgcataatccacattttaaaaactactttttttatttttaactattttttttttttgagacggagtttcactcttgttgcccaggctggagtgcaatggcgtgatcttggctcaccgcaacccctgcctcccaggttcaaacaattctcctgcctcagcctcccgagtagctgggattacaggcatgcaccaccacgcccggcaaattttgtatttttagtagagacagggtttctccatgttgaggttggtcttgaactcctgaccttaggtgatccgcctgcctcagcctcccaaattgctgggattacaggcgtgagccaccatgcccggccttatttttaactttcatgttgtttcatgtgaaattgagaaaataaccactctatttttagacacctggttatttccaaatgttttgccattactggagataacagaatatcacaataattggagattatagtgaatacttttgtatgaaaaactttttactccttttccattattcccttaggattaattaataggagtcaaaagatgtaagtttccatggcaaagataaaaatatattggatatagaatatttcattctctacaccagtactgtccagtagaatttctgtgataatgaaaatattctggtcaggtgtggtggctcacacctgtaatcccagcactttgggaggccaaggcgcgaggatcgcttgggtccaggagttttgagaccagcctgggcaacacagcaatactctgtctctacaaaaaataaacaaacaacaagaaaagagaaaatattccgtatctgttatctgatatagtagccattagccatgttagcgattgagcacttgaaatgtgatgaacataacttaggaactgaatatttttttttttattaaatttttttttctcagaatccagctgagaaagatgaatttaaaattttatttaattgtaattaaatttgaatttgaatttgaattcatgaatggctacgtattgggcagcacagctctgaatagtgatagtcatcattattgcttttcagtcttttggctaagatcaagtgatagtcatcactgacattgacaagcgaactccaaatgagcacacaatttcctttatacactgattctgtaatgcccctgccacatattattggcacaagccatgcagaatgccacagatgctgggtgggtctcaagtcccagcccaaagaaccctgcatatatttgcccagcaggatttttatttttttaaatttttttcctttaattcttactttagtagccagcaggaattaaatggtcatcttaaaaacctagcgagtcaatctgtaaatgaaattggactctggcatgccttttaaacaatttatttatttttgagacagagtctcgcttgtcgcccaggctggagtgcagtggcgcgatcttggctcactgcaagctccgcctcccgggttcacgccattctcctgcctcagcctccagagtagctgggactgcagacacccgccaccacgcccggctaatttttttgtatttttagtagagacggagtttcaccacgttagccaggacggtcttgatctcctgaccttgtgatccgcctgcctcggcctcccaaagtgctgggattacaggcgtgagccaccgcgcccgacctaaaaatttttttaaatgtttatcttttattatttaatttaatttaatttaattttttagagatggggtttcactatgttgaccaggctggtctcaaactcctgggctcaagcatccttcctcctcggcctcccaaagttttgggattatgcgtgagccaccatacccagtcaaaatttttatcttttaatatagtgacagggtcttgtcatgttgcccagactggtcttgaactcttgagctcaagcgattctcctgcctcagcctcccaaagtgttgggattacaggtgtgagccactgcacccagccccctttcttatcaatgtcaattattccttgaaaaattgtgactgggggaactgggagactgagagggatgagaggattcctgtacattatatactctttttttttttttttttttttgagacagagtctggctctgtcacccaggctggagtgcagtggcgtgatcttggccctatgccccccagggttcaagcaattctcccgtctcaacctcccgagtagctgggactgcaggtgtattgcaccacgctcagctaatttttgtatttttaatagagatggggtttcaccatattggtcaggctggtctcgaactcctgacctccggtaatccacccgcctcagtctcccaaagtgctgggattacagatgtgagccaccgtacctggcctatgtactctttaaaaacaaaaaaagaacacttcattgaagtataatttatatcccataaaatttaaaacagggcaccagtgtcctcatctgtaaagtgattagatggcctcaaagatctagtccaattctaaaatccagtaaatttagatttcttcctgggagtcaatttgcctacagaccaccaggggctaataagttccaattgtttccttaataagagatttgtggcttaactattaagaaacactgccaattatacctcaaccctccccaaaaatatgggaaacgtttttaccttgctttacttcctctgaggccatggagtctcccacctcaaaatcagagctaatcctcttcttgaggaagcgtaagtatagctcactgcgggcattcatcagggtgacctcagtcaggatggggtccagttctctgagacacatggagcagaaggaataggacgacaatggattaccttagacacaagagctacagggcaaagagagtcccaaattccccctccccactgggcccataaggaaaagctctgccagatggccctcctagctctgctggcccaattagaatcagagatagctgtcaatcacattttccatttacctgcttcacctaaatcattcactccctaaaattctgccagacctaaataaaaggttgggagatgtgtcttcttttctttacttttttttttgagatggagtcttgctctgttgcccaggctggagtgcagtggctcgatctcagctccctgcaagctccgcctcctgggttcacgccatttctcctgcctcagcctcctgagtagctgggactacaggtgcccaccaccatgcccggctaattttttgtatttttagtagagacggggtttcactgtattagcgaggatggtctcgatctcctgacctcgtgatccgcccgcctcaacctcccaaagtgctggaattacaggtgtgagccactgcgcccggcctattttcttttctttttgagacagagtcttgctctgttgcccaggctggagtgcagtggtgcaatcttggctcactgcaacctccgcctctaggttgaagtgagtctcatgccttggccacatgagtagctgggattacaggagtgtgccaccccacctggcagattttttttttttttttcagatttttgtatctttagtagaattgggattttgccatgttggctaggccagtctcgaactcctggcctcaagtgatcctcctgccttggcctcttgaagtgctgggattacaggcatgagctacagtgcctggcctcttttgtggtttgaataaagattacctatgaccaggcatggtggctcacgcctgtaatcccaacactttgggaggctgaggcgggcggatcatgaggtcaagagattgagaccatcccggccaacatggtgaaaccccatttctactaaaaatacaaaaattagctgggtgtggtggcgcatgcctgtagtcccagctactcgggaggccaaggcaggagaatcgcttgaacccgggaggcggaggttgcagtgagccaagatcgcgccactgcactccagcctggagacacagcaagactccgtctcaaaaaaaaaaaaaaaaaaaaaaaaaaaaaagaggccgggcgcagtggctcacgcctgtaatcccagcactttgggaggctgaggtgggcggatcacctgaggtcgggagttcgagaccagcctaacctaaccaaaacatggagaaaccccgtctccactaaaaatacaaaattagccaggcatggtggcacatgcctgtgatcccagctactagggaggctgaggcgggagagtcgcttgaacccgagaggcggaggttgcagtgagctgagatcacgccattgcactccagcctgggcaacaagagtgaaactccgtcttaaaaaaaaaaaaaaattatcagtgtctcatgtgaaagaaaactctccaatctctaatttagccctggcaggatgttaggaaataccattaaactgccctacacccattcatttatcctgatgaatagccaaaataatcttgaaaaatacaaagttggaggaatcccactttctaatttcaaaactaactacaaagccacagcaatcaagactatgtggtactggcatatgaatagatatatggattaatggaacagaactgtgagtccagatggttgactgattttcaatgagcgctaggacaattcaataaacaacgaagggtcttttcatcaaattgtgctaggacaactgagatccacatgaaaaagaatcaagttgaacccctacctcacataatataaaaaaattaacttcctttgcacactgaagtccaagaggtcttttctttctttctttttttgttttgagatagggtcactgtctgtctcccaggctggagtacagtggcacaatcacagctcactgcaggctcagcttccctgggatcaggcaatcctcccacctcagcctcccaagtagctgggattatagacatgtgccaccatgtctggctaatttttgtatttttggtaaagacggggtttccccatgttgtccaggctggtctcaaactcctgggctcaagtgatctgcccacctctgcgtcccaaagtgctggggctacaggtgtgagccaccttggcacctgaccccaagacatctttacaaacataaatctggtcatatcatatagtttccatacctctcagaatacaagactcttaacagcctgactctaatgatctctccatatccaccatttcaggctctcctctactctttgaacttcagctacactggccttctttcagtttttaaaatacacatgacctttgcacatgctttccttgctctatctggaatactcctcacatcttaactcctacttactctttttttttttttttttgagacggagtctcactctgtcgcccaggctggagtgcagtggcgctatcccggctcactgcaagctccgcctcttgggttcatgccattctcctgcctcagcctcccgagtagctgggactacaggcgcccaccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaactcctacttactcttaaggtctcagatctaaggtcatttcctcaggaattatttcttcaactttcccatactaggctacatctctttatgacatgctgtcctgcaccctacactcagtatatcacagtggctgacagcatccactctagagtcagactgcttggattccatttctcaccgccattttctagctgcatgaccttgggcaagtcatctgacctctccagccttcagtttcttcctctggaaagtgtttatggattaaatcagtgattttctactgagggcgattttattcccagctcccccattcccctacccatacccccctggggtattttagcatctagtggatagaggccagggatgctgctaaccatcttacaatgcgtagaacagtccccacctaacaaaaaattatccagtcaaggctgggtgcagtcgttcacgactgtaatcccactactttgggaggctgaggcgggcagatcacctgaggttaggagttcaagacctgcctagacaacacggtgaaaccccctctccactaaaaatataaaaattagccagacatagtggtgagtgcctgtaagctcagctactcaggaggcagaggcacgagaactgcttgatcctgggaggcggagattgcagtgagccaaaattgagccactgcactccagcctgggtgacggagtgagtgagattctatttaaaaaaaaaaaaaaaaaaagaggccgggcatggtggctcactcctgtaatcccagcacttgggaggccaaggcgggtggatcacaaggtcaggagtttgagaccagcctggccaagatggtgaaaccccatctctactaaaaatacaaaaatttgccaggcacactggtggggcgcctgtaatcccagctacttgggaggttgaggcaggagaattgcttgaacccgggaggcgtaggttgcagtgagctgagatcatgccactgtactctagcttgggtgacagagcaagactgtctcaaaaaaaaaaaaaaaaaatccagtcaaaatgccgttagtgcagaagttaagaaaccttggattaaatgatttaatatttgttaagtgttcagaatagtgtctggcatacagttgacattacatatgtattagctattgctattatctactttatagaccatagatgccacgaagaaaaaattatgtttgcttgctcactttgcttgttgccatatcaaggactagtatctggcacatgtgtactcagtaaaactttggttgaatgaatatattttacgtttggattttcttttttttttttttttttgagacagagtctcgctctgtcacccaggctggagtgcagtggcacgatattggctcactgcaacctccacctcccgggttcacgccattctcctgcctcagcctcccaagtagctgggactacaggcacccgccaacacacccagctaattttttgtattttttttttagtagagacagggtttcaccgtgttagccaggatggtcttgatttcctgacctcgtgatccacccgccttgggctcccaaagtgctaggattacaggcgtgagccaccgcacccactggattttcttctaagaagcacatgttatttttattgtaaaaaagtaggctgggtgcggtggctcacacctgtaatcccagcactttgggaggctgaaggcgggcagatcatgaggtcaggagatcgagaccatcctggctaacacggtgaaaccccgtctctactaaaaatacaaaaaattagccgggcgtggtggcagacgcctgtagtcccagctactcaggaggctgaggcaggagaatggcgtgaacccgggaggtggagcttgcagtgagccgagatagcgccactgcacttcagcctgggcgaaagagtgagactctgtctcaaaaaaagaaaataaatgaaataaataaaagtttggctggatacaggggctcatgcctgtaattccagtgctttgggaggctgaggcagggggaatcacttgagatctggggttcaagaccatcctgggcaacatagcaagccctcatctctaccaaaaattaaaaaattggccgggtatggtggctcatgcctgtaattccagcactttgggaggccgaggtgggtggatcacctgaggtcaggagtttgagaccagcctggccaaaatggcaaaacctcatctcagccgggtgcggtggctcatgcctgtaatcccagcattttgggaggctgaggtgggtggatcatgagggtcaggagatcgagtccgtcctggctaacacagtaaaaccctgtctctactaaaaatacaaaaaaaaaaaattagctgggcatggtggtgggcgactgtagtcccagctacacgggaggctgaggcaggagaatggcgtgaatccaggaggcggagcttgcagggagccgagatcgtgccactgcactccagcctgggtgacagagcgagactccgtctaaattaaaaaaaacctcatctttactaaaaatacaaaaaaattaaccgagcgtggtggcacctgcctacagtcccagctacttgggaggctgaggcaggagaatcgctaaacctagcaggtggaggttttggtgagtcgatatcacaccatgccactgcactccagcctgggcaacagagcgagactgcctcaaaaaaaaaaaaaaaaaaaaaaaacaaaaaaaaaaacatttagctgggagtggtgactgtaatcctagctagtcaggagctactcgggaggctgaggctggaggatcgcctgagtccacgagttggtggttacagtgtgctgtgattgtgtcactgtaccacttcactccagcctgggaaacagagaccctgtttctaatttaaaaaaaaaaagtaaaagtttaaaattttaggatagtagttacctttgtgggaagggaagaggagagtcactctgggggcttcaaaagtgtagtcatgctacataagaatattttggtcagaaatgaactgctgggctgggcatggtggctcatgcctgtaatcccatcactttgggaagactttgggaggtgagaggatcacttgagcccaggagttcgagaccagcctaggcaacatggcaaaacctcgtctctacaaaaaatacaaaaattagcccagcatggtggtgtacaatatgtgtacaccagctactgatatgtgtcccagctactcgggaggccgaggtgggaggattgcttgagcccagaaggtcaaggctgcagtgagccaggatcataccaccgtactgcagtctggcctgggcaacaaaataagaccctatctcaaaaaagcaaaaaaaccccaaaacaacaacaaaaaaaaactgtatcggtatacacaagagggttcccataatattataccttttctatgtttctatggtacagtacataatactgtacctcttctatgtttagatatgtttagatatacaagtacttaccatcgtgttataattgtctatggtattcagtatagtaatatgccatgcaggtttataccctaggagtaatagtttgtatcatatagcctaggtgtgtagtaggctaagtacaccctacgatgttgacacaatggaaatcgtctaatgatgtatttctcagaatgtactccagttgttggcagggtatggtggctcatgcctataatctcagcattttgggaggctgaggtgggcggatcacttaaggtcaggagttcgagactaacctggccatcatggcaaaaccctgtctctactaaaattataaaaaattagctgggaatggtggtgcacgcctgtagttccagctacttgggaggctgagggaggagaatcgcttgaacctgggaggcaggggctgtagtgagccaagataatgctactgcactccagcgtgggtgacagagtgagactctgtctcaaaaaaaaaaaaaagtattccagtcattaaatgacacgtgattgtactgattataatttattatttatttattttttgagacagagtctcgctctgtaacccaggctggagtgcagtggtgcaatcttggctcactgcaacctccgcctcctgggttgaagtgattctcctgcctcagcctcccgagtagctgggactacaggcacgcaccaccatgcccagctaatttttgtatttttagtagagacggggtttcaccatattggccaggctggtctcgaactcccgaccttgtgatccgcctgccttggtctcccaaagtgctgggattacaggtgtgagccaccgcgcccggctgattatgactgattacacaatttatttatatatacttttgttcatatgatacattgcactgaaaaataagagtaattgataaaatattttaaaaacatagaccacattgtaacagagtagtctgaattatattacatgattaccaattcaaactcctgtgggctgaagaagagagaaggattattaccttggttcgattttttctgttgtagaatttctcatcaggttgttctgaacatgccggaactgcaacataccacaggaatgagaatattcttccccacccccacatctattggcctcttgctggtcactccaaacttttggcatacaagaacatttagatttagtttgtttaccaggtttaccttcccttcaagccagcagtgggctttcaggatgacaggccaaagatttgtttttgggttggatgctaataatactcacctctattactgtgcttaaaagtcatgctaatggtgttccaatagactactgtttatagtctcctagtctggagttctagaaatacaattgtatgaggccactcctatttctatgtcgtacttttactttctctgctcaaaagaaggaaaaaacaaagttctgaaaaagcaaacgttatctttaacatcttaggaatgaaggggaaattggagacaattacttggacacttaataggacctcaagaaatagaattgtcattatatcattagagggcactgttgcacattttgtgatagagaactggtttactacttctgctgtgttcttttcaggaagctctttttatttccgttttggtcttgaactgaggccatcatcatctcgacaacacctcaagtccaaagtaagctgtcaatgggcaagatgcaggccagtgtgcgcttagcatttatttttctcctgtctgcaccttttttttcactttttcaaaccctacaatttattctactcagtgttcctcgctaaagctgctaccaaaccctacctgtagcttcccctgctcacctgctggtggtagtccctttgcttgatgaacttgtctaccaccttctccacctgtctgtcacattccacctgcagatatttgatcagggtatagagtctccctggcccataataggtctccactattggctggtgggtctccacaatgcgggcaatccctagaagggaggaagcaatagggttatattccaagtattcttcctacaaaataaacttgctcccatccaggactaaccgaaggtctagctcaatccttttggctgcttcactttctaaaatgaacacaaataggcctagtcaatgctaggggttgctaggcaaatatgttaaatatgtacagtgcttggtacaccagcaggcatttggtaagttacattgatactgttttctacagcagcatctttggaaatcagcatcactcgctttccagtaatttattttagggttaaatttattcgtacagagtttggggtttgagggttaggtaggatcaaaacactggagagactctaatctttgctaatcaggcactgaatctggaagttatttaattctccaatcaattaatacacaataaactacatgattaaattaaagtcatcaggctagaagggtgagaagaaaggctaggatgcaggtgtcatatacagtctccagtctctctagagcggagaaagaggctcaccttcaaacagaagagtaagtgtatctgcaaagatgactgcagctctccgatcactcatgtctgtccccagcaccatgagcagattctcctcagctttactggccacctaaaaaaggagaaaacccacacacattcctcagaaaggtcaccctcataccaggtatatctcagttttccaaaaatcctcccattgactttcttttttttcacatttcccttgatgtctggaagcccaggcagcacagaggaaactcccttgagggacagtctgagcctcaggcaggacaaggaaagtgagcatggtgtagctcctcttccattattttcttctcttggaaaatatggactgccattagccaagggagagagtccccagtttcaacaatcttctcaaagggtaactttctattattttttaaaataagacagaaactcactctgttgctcaggctggagtacaagggagccacagtcatagttcactgtggccttgaactcctggactcaagtgatcctctcacctcagcctcctgagtagctggaactataggcgagagccaccatgcccggctaattttttaaaaatttctgtagagatggggtcctgctatgttgcccagactggtctggaactcctggcctcaagcaatcctcttgcctcagcatcccaaagtgttggaattacaggcgtgagccattatgcctggcatgttatcattaacagtgctttctcaagcacgacaaaacctgggtactgcagaagggacttttactggattaaaggtagaagccatttctaggtcccagatgtcaaagtatactgataaaaaaagtaccatagagcaggtttcctttttttttttttttgaaatggaatttcgctggtcgcccaggctggagtgcagtggcacaatcttggctcactgcaacctctgcctccccggctcaagcgattctcctgtctcagcttcccgagtggttgggcttacaggcacccgccaacatgcccggctaatttttgtattttttagtagacacagggtttcaccatgttggccaggctggtcctgaacctctgatctgaggtgatccacccgcctcagcctcccaaagtgctgggattacaggcgtgagtcaccgcgcctggcctgtattttgtttttaattaactttttagaatgagtaaaatgcacacttaaacattccaaaggaacaaaggaatattcagtgaaaagtggttcttcttctaacctgtgtctcttaatttcccaattttcttcagaggtgaccattgttaacccttccaaaagaaatcctctgcttatacaaatatatcttgattgctaactccctcattttaaacaggaatgacaacatattgttttgtgccgtttaacaaaccacatgttacagaataaaatatgtcagcacttagggaacggtatcatttttcttaacggcataataatggtctgataatttttttgtgggaggggagtgacacacacagacatatagctaaaaaacggccaggtggggtggtagtcccaggactttgggaggctgaggtgggaggactgcttgaggccaggagttcgagaccagcctgggtaacacagtgagaccgtttctataaaaaaaaaaaaaaattgcaacgcatggtggcatgtgcctgcagtctcaactgcttgggaggctgaggcaggaggattgcttgagctttaagagtgattcagactgggcgtggtggctcacacctgtaatcccatcactttgggaggccgaggtgggcggatcacctgacgttgggagttcgagactagcctgaccaacatggagaaacccagtctctactaaaaatacaaaattagctgggcgtggtagcatatgcctgtaatcccagctactcgggaggctgaggcaggagaatagcttgaaccagggaggtggaggttgcagtgagctgacatcatgccattgtactccagcctgagcaacaagagtgaaactccatctcaaaaaaaaaaaaagagtgattcaacttgtcagagaacttgcattttaatttcacatgctttcgcctggtctgttggaaatgaatgtgcactggcagatgtcttggccatgcctggtacacagtaggctggcaacaggtgtgttgaatgaacacatgcatccagtcctgcatggctacacagcaagggcaggaaggggagtcatatccagaagagagaaagtatccacagaaactggatccatccagtgccccaatctgcaggcagacagccacacaattatcctgccaagcaatcagggtccatacctgcttgcaaaggtactccgagaactttcttaatccctcctcatgcaaacccagcagtgggaagatcttgaagaagcgctccacctggggcagatcaccttccttggtggcaatggcaaacttctctgccacaatggctttgagacgttgctcagcttcctgcagcaatttcaggttggcatcaatcatgctccctgctcaacagggagaaaatgaaaattcaagtaaagaatagtactgtggcaggtccatgccactttgtgtaatactattcatccagcaaatacgtattaagcacttaccatgtgcaagatgctgtgctagtaatatgcatgattacaagatgaatcagccctgatcctaccatcacagaagttaggatcaggtagaagagatagtttgtgcacaaatcaagatgatgaaatacagtacatgatgtgtcataagaaaggtgccaaagtccgggcacggtggctcatgcctgtaatcccagcactttggaaggccgagatggctgaatcacaaggtcaagggattgagaccatcctggccaacatggtgaaaccctgcctctactaaaaatagaaaaattagctgggcatggtggcatgcgcctgtagtcccagttactcaggaggctgaggcagaagaatcccttgaacctgggaggcagaggttgcagtgagccaagatcatgccactgcactccagccggcaaaagagtgagactccgtctcaaaaaaaagaaaggtgtcaaaaagtcacatttctggttaaagtaatcagaaaaggcttcctagagaaggtgacatcccacctctcaaagatgggcaggattctgatacctgcacaggagaacaaacattccaggcaaagggaatgaaagacatgaatagaagcagaaagatgaaaagaatatttgcagagtattccaagtagcatattccttggcatatggaggagcttgagaaatacttgcacaatgagtggatgcataagtgaataacattaaacaagtctagaaaaacagagtgtgtaaagatcatggaagatctaaaatatcaggctaagaatttcattttatgagtaggcaatatggccaagtgcaaagaacccgctggccagagaatcagtagatctggattcagtttccttttccataaaatgggaatacagtagtctcttcttatctgtaggggatccattccaagaccgttatggatgcctgaaaccatcgacagtactgaaccttaaatatactatgttttctcccatacatacatacctacgataaagtttaatttgtaaattagacatagtaagagattaacaataatatataataagatataacaacataccatgataaagttatgcaaatgtggcctctctcttaaaatatcttactgtactgtacttacccttcttgtgatgaagggacagacagggtggtacaagattttatcacactacttagaacagcaagcaatttaaaactagtaagatgtttatttctggaatttttccttaatatttttggactaaggttgaccatgaataactgaagctgcaggtaactgaaatggcagaaagtgaaaccacacataggggagactgctttaacaaagcctgccccaggatggtacaggacctacgtatggcctattaccagacaagaaaacttcctggctgggcgcagtagcttacacctgtaatcccagcactttgggaggccaaggcgggcagatcaccagagatcaggagttcaagaccactctgtccacatggtgaaaccccatctctactaaaaatacaaaaaacattagtgaggtgtggtggtgtgcacctgtagtcccagctactcaggaggctgaggcaggagaatcgcttgaacccagaaggcggaggttgcagtaagccaagatggcaccactgcaccctatcctgacaagagcaagactccgtctcaaaaaaaaagaagaaaaagaaaaaagaaaacttcctaaaaactgatgtgtttttattggtcgagtctgcttacttcagattacagatgattttaactaaactaaaaaccaacagtttcggatgctgaccctctttgccctgtcggctgagctcaatgaccgacttgtccaggcacaagtagcgatgagtatgtgctgcagcctgctcataatcttcactcctcaaagcagtctgaactccatccatgcagaacttcaggtccaagatgtcatcagctctctgaatggcctgatagaggcggttctgcaaaaagatttggtacttacaaacaatgtcctattctttcaaaaacacccctcaagaaggtagggagattcaggagctgaatctgatcaaccatatgtcaatagcaatctcacaaacaccaccactactgttaacgcaactgttattgatgatgatcaagaccattgacagatatcatacaatgttaataacgtgatcaaatcattctctctttttttttagacagagtctcactctgttacccaggctggagtgcagtggcgcaatcatggctcactgtaacctctgcctcctgggcctaagctatcctccacctcagcctcccaactagctgggatcacaggcatgtgccaccatgcctggctagtttttgtattttttgtagaggcagggtttcatcaatgtttcccaggctggtctcaaactcctgagctcaagctatccgcctgccttggcttcccaaagtgctgggattacaggtctgagtcacagagcccaactttttttttttttttcttcttgagacagagtctcactctgttgcccaggctagagtacagtggtgcaatcttggctcactgcaacctctgcctcctgggttcaagcaatcctcccacctcagcctcccaaatacctgggattacatgtgcacacaaccacaacctgctaatttttgtaatttttgtagagacaaggttttgccatgttgcccaaacccaggctggccctgaactcttgagctcaagcaattcattctcctcggcctcccaaagtgctgagattacaggagtaagccagcacgcctggcctacttcattttcttacctaattgccctggatagaaccatacagccaccaactcactattaaggtttttttagaacatgcttgcgccaggcgtggtggctcacgcctgtaatcccagcactttcggaagccgaggtgggtggatcacgaggtcaggagtttgagaccagcctgaccaacatggtgaaaccccatctctactaaaaatacaaaaattagccaggcctggtggcgcatgcctgtaatcccagctactcgggaggctgagacaggagaattgcttgaacccaggaggtggaggttgcacacgctgagatcaagccattgcactccagcctgggcaacagagtgagactctgtctcaaaatcaatcaatcaatcaatcaataaataaataaaacatgcttgcttgttctagagacatagtaagagaagacacccttgtcttgttcctcatcttagggggaaagaatcacacgtttcaccagtaagtatgatattagctgagggttgtttttttaaaaaatttttgtaggacagggtcttactgtgttccaaggtttggtctccaacttctggcctcaagagatcctactgctttggtctcccaaagtgttaggattgcaggcatgagccaccacacctggccagctgtggtttttcacagatgctctttatcaggctgagaagttcccctctattccaaatttgttgagtgtttctaccacgaaaggatattgaattttgttaaatgttttcttctgagtctatgaggtgatcatgtgttttttgtccttttttctattaatatggtgtattattaggatggtgcaaaagtaattgcggtcttggccactacttttaattgattttcagatgttaaatcaaccttgtgttcctaggataaattccacttggtcatagtatataatcctctttatatattgctagacttgctttactagggttttgttgagttaaatttttttttttttttgagacagaatctctctgtcgcccaggctggagtgcagaggcgccatctcggctcactgtaagctctgccttctgggttcacgctattctcctgcctcagactcctgagtagctgggactacaggagcctgtcaccaccactggctaattttttgtatttttagtacagatggggtttcacggtgttagccaggatggtctcgatctcctgaccttgtgatctgtccgccttggcctcccaaagtgctgggactacaggcgtgagccaccgcgcccagccttgttgagtacctttatgtctatattcataagagctactggtctgaagttttctgtgatatttttgtctggctttgttatctcacattagatttctattgaatggtgctcttctaatctctaatgtggtagcttttttttttaaatagaagctggtatttattaacttatttatttatttatttttaatttgcaactccactctgcaactcaggctggagtacagtggcatgaccttggctcactgcaatctctgcctcttggggttaagcgatcctcctgccttagcctcccaagtagctggaattacaggtgtgcattaccacacctggctaatttttgtattttttagtagagacacggcttcgccatgttgcctaggctggtctcaaactcctggactcaagcaattagcctgcctcagtctcccaaagtgctgggatacaggtgtgcaccaccatgtccagctaatttttgtattttttgtagagatggggttttcccatgttgcccaggctggttttgaacttctgggctcaagcaatcctcctgttctggcctcctaaagtgatgggattgtaggtgttagtcaccacgcaaagccccatagacattttgatgttgtagttagtagagggcagtaaagaagctattggccaggcaaggtggttcacacctgtaatcccagcatgttgggaggccgaggcgggcagatcacctgaggtcaggagtttgaggccagcctggctaacatggcgaaaggtggaaggataacttgagcccaggagttcaggaccagcccggggaacatggcaaaaccccatctctacaaaaaatacaaaaactagctgggcatagtggtggatgcccgtagtcctagctcctcaggaggctgaggtgggagaattgcttgagcccagggagttggggctgtagtgagctgtcattgtaccactgtactccagcctaggtgacagagcaagaccctgtctcaaaaaaaaaaaaaaaaaaaaaaaagcttgatgtattaccttggccaggtcaagctgacgaactttgctggacacattctcagccaggttgcaggtaaaggtgatcattccagccagctgctttgcatctccctcaatcagctgcagattaggactggagaaatacattgttagcatacacataacgatagggcagagaagagacagaaacttttttttgcatatggacactatgtcttctacttctttcatacctacctgtaactcttagctcagtttgctctatactcagctttttctcaagaacgtttgactgtaaactcagacctatacctgataaaaaattaactcttttttttttttgagacggagtcttgctttgtcgccaggctggagtgcactggcgcaatctcagctcactgcaacctccgcctcccgggttcaagcgattctcctgcctcagcctcctgagtagctgggactacaggcgcgtgccaccaagcccagataatttttgtatttgtagtagagacggggtttcaccacgttggccaggagatggtcttgaactcttgaccttgtgattcagcctcccaaagtgctgggattataggcgtgagctactgcgcctggccaaaattaacttctaaaaccaataaagacacacctaaataggtacagtcaaagaactagagaacaaattctctcaattgctaagtgagcataagatgcactaaccagtaccatgtgagaggatggtgagatcaaggaacaatttttgtttttgtttgagacaggttctcactctgccactcaggctagaatgcagtggcacgatcatagctcactgcagtttccaacttctgggctcaaatgatcctcctgtcttagcctcctgagtagctgagactacaggcgcacaccaccatgcccaactaatttatttatttatttatttttatttttttgtttttgagacagggtcaaaagtgatcctctagatgaggcctcccacagtgctggaattacaagcatgagccactacacgcagccagggaacaatttttatgactaacaaatatacccagtctgtaaaaatggtggttctcggccgggcatggtggcttactcctgtaatactaacactttgggaggccaggcgggcggatcacttgaggtcaggagtttgagaccagcctggccaacatggtgaaaccctgtctctactaaaaatacaaaaattagctgggcgtggtggcacatgcctggaatcccagctactcgagaggctgaggcaggagaatcgcttgaacctgggaggcagaggttgcagtgagccgagatcatgccactgcactccagcctgggggacaaaaacgaagctccatctcaaaaaaaaaaaaaaaggtggttctcaaacttgagctgtgcattagaatcacttggtaggcttgtcaaaacacatcttcctggaccccacccctagactttctgattttgtaagtttggagtggggccctaggatttgcatttctttttttttttttttttgagacggagtctcgctctgttgcccaggccagactgcggactgcagtggcgcaatctcggctcattgcaagctccgcttccccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccgcccgcctcggcctcccaaagtgctgggattacaggcgtgagccaccgcgcccggccaggatttgcatttctaacaaggtgtgatgctggtacaactggtccaaggactgtttgaaaaccatcaaactaatacccttaggtgttcactttatcttgagataataccctttacatttcaagctgaactggtgtttataacagaaagtttaaaaaatggtcacttgtccaattgaccctgttggaatttacattagctcttgctgagatgcacagactcaccccattcggtggagagtgaccatcttactttcaatggtgttttgctgttccaaaagagcatccagctctctctccaccactttctgaaacacagagaaacatcctgtcagcagaatgatcagaaggaaccttaagagttatctaatccaatcacttagctgaagggtgaatctcatttccaagtccttttttccttccactatgttctccttagactttaacaatgcttcattttgcacttatgttgcatgattgttatcttacgtatatcttattccacctggcagatgagcaccataataggaagaaataaacttttaatcagtatcattagcatagtgcctaatacaggaaggcatttaaaatacaatgcctggccagcactggatcccaaagtaatcccagctctttgggaggcccaggtgggtggatcacctgaggtcaggagttcatgaccagcctggccacatggtgaaaccccatctctactaaaaatacaaaattaggctgggcgcggcggcttacgtcggtaatcccagcactttgggaggccaaggcaggcggatcacgaggtcaggagatcgaaaccatcctggataacacggtgaaaccctgtctctactaaaaatataaaaatacaaaaaattagccgggtgtggtggcgggcgcctgtagcccaagctgctcaggaggctgaggcaggagaatgacatgaacccggggggtgggggggggggggggcggagcttgcagtgagccgagatcatgccactgcactccagcttgggcaacaaagtgagactccgtctcaaaaacaaaaaacaaaaaacaaaattagctgggtgtggtggcgggggcctgtaatcccagctacacaggaggctgaggtaggagaatcacttgaacccgggaagtggaggttgcagtgagccgagatcgtgccatttcactccaacctgggtaacaagagtgaaacgctgtctcaaaaaaaaaaaaaagaaaatacaatgcctaaacaaaaaacaccacacacatcttgctgaaatgaaatttccagtgacagttaccaaaatttttcttcttggtgcatagtcagtagccaggggttataaatataattatctctcattcaagccatttattgtgcaacctcaatttatgtaacatttttatgcttcggttttttcatctgtaaaactaggatagcaataccaatctcactgggctgttgaatgagtcaaacaggaaaccacacaaagtgcttaacatggtatgtggcatatagttcaacaacagccattaaaattaaccatacatttttattttttgcgggggctcaagtgctcttcctaccccagccccccaaatatctgtgactataggcgtgcacaaccctggtccactgtttaatttttttgtagccacgaggtctcactatattgcccaggctggtccccaactatctgctattgcccaggctggtctccaactatagctcaagctatctgcccatctcagcctcccaaagaactgcgattagaggcatgagccacttgtgcccaggcagctatacttttttttttttttgagacgagtttcgctctttcacccaggctggagtgaagtggcctgatcttggctcactgcaacctccctgccctggggttcaagcgattttcatgcctctgcctcccaattagctgggattatagacgcccaccatcacacccggctaacttttgcatttttagtagagactaacatggtttcgccacgttggccaggttggtctcgaactcctgacctcgggtgatccacccgcctcggcctcccaaactgctggtattacaggcatgagacaccaagcccggccatatacatttttattaaaatcgttctgtaggttccagaggaaaacgtcctcttgacagtcatggaatacaaatacagtacttatatcattttgtctgtaagatttccataattttccacccaacatattaaatgactgaatgaatgcgagcttaggaatgttaagtcaagatactaaattttttttttttttttttttgagacagagtctcactctgtcgccgaggctggagtgcagtggtgcgatctcggctcactgcaagctccttctccctggttcacgccattctcctgcctcagcctcccgagtagctgggactacaggcgcccgccaccacgcccggctaattttttgtatttttagtagagacggggtttcactgtgttagccaggatggtctcgatttcctgacctcgtgatccatctgcctcagcctcccaaagtgctggggttacaggagtgagccaccgcgccaggctttttttttttttaagagacacaattttgctcttgttgcccaggctagagtgtaatggcgctatcttggttcactgcaacctccgcctcccaggttcaagcaattctcctgcctcagcctcccgagtagctgggattacaggcatgcgtcaccacacccggctagttttgtatttttagtagtgatggttttcaccattttggtcatgctggtctcgaactcctgactcaggtgatcctcccgtcttggcctcccaaagtgctgggatggcaggcgtgagccaccgcgccccgcaagatactaaattttaaaacacatcttgctgaggccagacaaaaaaagccccacacactaaactagccaggcacggtggtgtgcgcctctggtttcatccattctgattgcagcacaacagcactccagcctgcgcaacagagagcggccctgtttctaaaaataacaaaacaaaacaaaaaacaccacacacatcttgctgaaaaacgtatcagaaactgctagagttagtgcaagtttatacttgaaaatactcaaagatatcaacgatcacctctccctcaggctgaaactgccttttgtgctcaactttgctagaagtttggtctgggaaacagctgacaagcttagagcttagatctcttttgactagcaaggaacccaactgacattcgaaagtgaattgacagcatcgagttgccactgaaaattaaaggaggcaggaaatagaacgttatgaactgaaaggaattggagaatagtccacacccctcatttgataaaatatcaagggtaccagagatgaagtgacttgtccaagattagagaattgtgtctgagtcttaaaagctaaacctctacaaagatgtgcatttgaccaaaacgctaaaatcacacccccaaatcactccccacaagaggaagtcttaaaacgcttcaagaagttaatctgcaaaggcttccctcttaaataacaggatgagagcgtttcataatttgtaaattaagccaatgcaaaagggcgcttattattttgagaaccaagcaatttggcaaatactctcagactaactttactcccgtggagaaactggtgatcatggatcagggaaatcaacgggggtctagggaggagaggctgcagatcgcccaggtatcagggaagacaagctcggcgcgtccgacagcgtgaaaagagttgacaggactactcatatacccgactagcttccgcttctttgttttcccgcttttttgtatcccccagcaaggagagtttcccacagcccggatttcccgactgaaggctcccactctccctagatcctccatgaaaaagaagaggctcgaccccgcacctcctcgccgcagagccgttcgtatacagcctccagctcctgcagctctgtcagggagcgaatgagctcagcggagatttcggagcagcggccacctcccaccccctcagacggctgctgcacccctgacagcttcggaggcgaatcaaggtccgccatcttggtccccattcggcacttcc

SEQ ID NO: 355 - DNA, 42986 bp, Homo sapiens; identical to SEQ ID NO: 354

SEQ ID NO: 356 - DNA, 14021 bp, Homo sapiens
actgctcttccagaggcaagaccaaccaagatgaggtgggtccacagctttccctcctgcctttcctctggttctttatttcagtcttttttgcatacattggtacagatgcagaaatagaacaaagaaacagggcaaatgggctaaattatagtgaaccaaagggcttagtgtgttaaatcttctccttttctgcatccatagaagacagtgctgctgtctttcccaggagataagatttactctcaggagtgtctttttccttgaggttacgtttttgtctttgtagggtatgtcatcagctcccgtggtaggcttcctggcattcggaatatatttactagcagatattttcctctttaaaaatgtataataagaaagactaatagtaacacatttgaatgacacaattaattgactagtacttgggatacacactagtacctgggatacatctaattaagacacttagatcttaaaaaataaaaagactttttgaaatgttgaaataataagactagaaacttttttttttgtgagacagagtctcactctgtcaccaggatggagtgagtggcgcgatctcagctcatcgcaacctccccctccccggttcaagcaattctcctgcctcagcctcccaagtagctaggactacaggcgtgtgccaccacgcccagctaatttttgtatttttagtagcgatgtggttcaccatgttggcccggatgatctcgatctcttgacctcgtgatccacctgtctcggcctcccaaagtgttgggattacaggtgtgagccaccgcaccctgcctagaaactattttaatagaagcaaatagtgcctgaatggtgggcgtctgttagcgagatggtgaactggcagatggcgcctgtgtgtcaatgcccatggccaccgtcctgctttcagacaccagttctcttccaggtaaccttctggcattttggggtttgagataccatttcctaaaggtgaattatcacaaaatactagaaataaccacataagtgtttaaaattattgttaaatacagtaagaaattcttcttcaaaagtttagcctgcttaagtttccttgtcctttgtttcctgctttcaaggccagacttccttactctctgtgtttcccctaccctggtaaacaaccttcctgccagtccttacccatacagcccacattccacatctgctacccactctgtgatttacctctcccgtcgcaatagcctctcccaccaaaactgatcttcccgccttcccaccagtgcaaccacattcctgcactttgcaagttagccaaccgggttcggattgtgcagtccaactccagccaatggagtcaggacacagtagcagggacaagctgcgttagacataaaaacctctgctttcctttgtttagggtgctctcgtggcaaccagacttaccaggagctctattctgcaaaagtaaatttgccttgctgagagaccctttgtcctttggctcagtgttggttcttctttgcagcaccgagcatttgtttccaacaaatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgagtaactggagcagaacatgcactctaattccattggctatccctttcaccctggcatttcatcaaccagaaaagacagaaaccaaacactgtaaaacaagagaggcccctcatgggtctgttgactcccacatttatatagattccactggagtccaacgaggagtgccagatgaatttaaggcccaaaatcagacaactgcaggatttgaatccacgttcttctggtggttaactataaataaaaatgtgaattagataaactacatttattacaaccaatgatgatttttttttttttgacggagttttgctcttgttgcccaggctggaatgcaatggcatgatctcggctcaccacaacttctgcctcctgggtccaagcaattcttctgcctcggcctcccgagtagctgggattataaacatgtgccaccacgcctggctaattttgtatttttagtagagacagggtttctccatgatggtcaggctggtctcaaactcccgacctcaggttatctgcctgcctcggcctcccaaagtgctgggattacaggcatcagccactgtgcccagcctatgatttgttaattatactagagatgctcttaaagggacagctgaacaattaagacccaccagtcaaatggcctgggaaaataaaatagcattagacatgataccagcgaaagagggtggagattgtgtcattatcggaacccgatgctatacttttatccctaataatactactccaggtgggatcacaccaaaagcactacaaggtcttactgccttatcaaatgagctagccaaaaattctggactaaacgaccccttcacaaatttaatgggaaattctttggcaaatggaagggatttatgtcctcaatcctcatgtctcttgccatcagaatagggttgcttattcttgtaggatgctgtgtcataccctgtgccctaggattaatacaaaagctcattgaaacagctctccccaaaacctccctcaatcctcctcctcctcgttccagtgagctttttcttttagaagacccaagtagaataacagagccaaattatgttaaaagggtttaaagaaaaaatactgtaaaatatttaacagggggattgttaaatacagtaagaaattcttcttcaaaggttcagcttgcttaagtttccttgttctttgctccctgctttcaaggccagacttccttactctctgtgttctccctgcgctggtaaacaaccttcccgccagtcgttatctatagagcccacattccacatctgctacccactctgtgaattacccctcccatcacaatggcttctcccggcaaaactgatcttcctgccttcccagcagtgtaatcacattcctgcacttttcaagttagccaaccgggttcagcttagattgtacggtccaactctagccaatggagtcaggatacagtagcagggacaagctgcgttagacataaaaacctctgctttcctttgttcggggtgctctcgtggcaaccgaacctatgaggagcaaccttatgcaaaagtaaatttgccttgctgagagaccctttgtcctttgtctcagtgctagttcttctttgcagcaccaagcatttgttttcaacaattatatatttaaggaatctttgattatggaaaatttcaagaagtagagggaatagcatactaagccctctgttcccatctttgagttatctacattttattagaagtatctttggggtgactgagggaggtttctctttcctggagggcttctgaattattgccaatgtaccttcctgactgcagccagaaactgaggcccctatacctatgtacctttctatccctctctgaagcttctgcagaattcccagcaagacagagcttgctggaagcttggtatgctcagaagcagctaaagcgtgtatgtggggcggagggtgggggcaacttcttggtcctagcacttccatatattgattttcttttctggctgcttagtgggaggagtgtgtgtgtatgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcacggatatttcaggtcagtctttgagttgggtaggagcatgcatccctggcactgccacatcccactctgactctctcgggtctgcattctttctttgagaacacacagttccccattcttatcctgacctctgggctttcaggactgccaagaacattggggatcctgccagaaatgaggggagcttgagctttcgttggcttctatttggggtagaaggagattgatgtgcagagcagcttccactcatctgacttttcatgggtctctgggaacaatttccaaatggtaaactctctggcttctctctctttgcagatgaccgcttcccgaagccccctgagattgcaaatggctatgtggagcacttgtttcgctaccagtgtaagaactactacagactgcgcacagaaggagatggtaagacctggacaactatctctgtgctctacctacaacccctgctctgacatttccatgatgggtggtgctgaggtgatttgccagaaagttcgttgctctccttggagccaggagatttagattctgataagcgttttgtcgccagtagccatggccctttgggcagactaacttttgtcagcctcaggttttctgttttgttaaggggaggtgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatatttatttgctcacttagtccttacagtttcccactgaatagaggttattattctcactttgctgataaggaaacagaggcaccgacaggttgagtatcttgcccaaattcaggtggcctgtaagaggcagagtcaggatttgaaccctgagccctccctgtactgcctggctgtgaccgccatcaccacagtgtgttctgctgggcttaactggtgtccaggcacttggcttccagcacagcactctttcccttcctccttctcgtattctctctcctttctcccttcctgtctgcctcctttcttcttcttctttttaattcttctccttaaatgccttctcactctgctctgggtgcagacttgacttttcctttggctcatttcttgccttttgtttcaggagtatacaccttaaatgataagaagcagtggataaataaggctgttggagataaacttcctgaatgtgaagcaggtgggtgctgagcactgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaaggatcaccagggtcttgttcattggggcctgaagggcactggctgaatccactgtcggcattgcccacagatcaggagagcctgtgcatacagagagcctgctagagagccctgggtctaaggagaagcaagctccagggagaacaagtcaagggataacataaaatcttaatccatggaagcctagcaggaggctggacatgggctggaactcctgcttctcgttattaggaggaactgttgctctctcctttccgtctcagaaccagaggcaaaggcccagcctcttctgctgtgagtggtgtggaactaccaacctgcctcgtattaactgcaacatctataaagtatgagctccagccaatgctgctctagattcctctttcttcagagatgatgaattattgtagctcctagccctttcttttttctttctttctttttttttttttttgagacagagttttgctctcgtcgcctaggctggagtgcagtggtgctaattcctgacctcaggtgatccaactgcctcagcctcccaaagtgctgggattacaggcgtgagccaccgcatctggcccctagccctttcaatgaatttcagggaattgtgaaaattcctttgttgagataattgtttaaatataatatagttcaccagccaggcctcaaaaaactcagtatttctcatttccttatttagaaatagagctttttgtaatgtaaacaattaaaaaaattattttaaaactgcaactattggaaatgagatcagcaggtggtaaggacaaagcatttaaatctttccagtttatgcagcagtgacagccgccaatgctttcacccctttctcagatggaaaggctcttgcacatttccactcacgagtgtcttgctctccttgacagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 357 - DNA, 6225 bp, Homo sapiens
gcccggaaacggaagtctcgttctttttcgtccttttccccggttgctgcttgctgtgagtgtctctagggtgatacgtgggtgagaaaggtaatctggggcaatccactgccaggtgaaatctggggaccccaggtccgcgtggagggtgtcggggaggagaaggggagtgcgatggggccgatatttcgggggagagcgggaaaacggggttcgctgccagcccccgcgccgtgttaacgccgaggactgtttcccgcaggtcctggtccgcgccagagcccagcgcgcctcgtcgccatggtgagtacagtccctgcctggcgccttcccggggtgggctcgtggggccccggggcgagggcgagagagcctcccaaggatctcctgaggccgggagaagctggtggactgggccatcgccgggagacgtgtctctttcctctctgttcacccgcttcctttgtgttgcagcctcggaaaattgaggaaatcaaggacttcctgctcacagcccgacgaaaggatgccaaatgtaagtggttgctccgaaggttcaagaagagcggtgcctagcctggcaccgctccgggagcgtcttccccggaatgtcaggcaggagacggttaggccgtctgggtgtgtgcctggccctctgggagcagtggtttcatcctgtttcccatgagaaagacctgtggggggcacgttgaggccctggaatttctaggaccatctttagctaatcgcgatcatctcagaggccgccctgagttcagttttctttcgtataatatagtaaattgtcggaacggaatctccactccgcgaaagcctcaaaacacacgtcccataaacactgtttaggttctctgcagttgtgcaaaatcttaacacaaaatccattttgtaataaagtgctggatatttgcatgtaatgtatcgagcacggcacactgtgtagtatggtcgtttacctcgtgatcctgtggtcgctggccagtgtcagaaggtatcatacctatctaatccagaaaaatatttaaaaaaatttttttttttctttgagacagtctggctctgtcgcccaggctggattgcagtggtgcgatcttggctcactgcaattaccgcctcccaggttcaagcgatccccctgcctcaaagtagctgggcgcgccaccatgcctagctgatttttgtgtttttggtagagacagagtttcaccatgttggccaggctggtctcgaactcctaacctcagatgatccacctgcctccgcctcccagagtgctgggattacaggtgtgagccactgtgccccgccaagatcaaaatttgaagcagggcttctactgaatgtatatcgcattaccaccattgtaaagtcacagagtttaagttggactgtcataggtctgtttcccagcttgtacatacaggggaaagaaggtgattaatgaaaaaccttaaacagcaggttttcgatggataggtgccaatctctgctgcccacttacttaaatttttacaccaagtgtgagaggtagttgtgttactcctttgtgatacttgaaggagattgggggggcttgtgtttgatacaagctaggtcttgagttatgttgttactttaacccagtcatcttttttcagctgactgagaatcaggtcacatgtggaagtgaggttgcatgggacaggcctgttaaggtgggctaagacaccagccgtctctaatgctctgccagccgtggtgccagacggtggttggtgtacagggagagtctttcaatgagttgggggtaggcagagatgggggtcatatttgtgtccccattacccaaaacaggctgtcacctttgaggtagtgaccacctgtggggacaaatagcatctggtgggaatgatgactgttggctagtgttttgtgtaaagagatgaggttatcaggtcagttttatttcagaccatatggggtcactgcctagtttgaagcccaactctacctgcaggtaacttacccttctcagcaagttaaacacgacaccaccgtttgattgtgttttaaaagggtggtggtccgggcgtggtggctcatgcctataattccagcactttgggaggccaaagcggacagatcgcttgaaccaggagttcaagaccaacctgggcgacatggcaaaaccccatttctactaaaaataaaaaaattagccaggcatggtggcacacgcctgcagtcccagctactcaggaggctgaggcaggagaatcagttgaaccaaggagacggaggttgcagtgagctgagattgtctcactgcactccagcctgggtgacagagcgagactgtctcacaaaaaaaattgggaaccttcattttagatgatgtggctttaaaggtagtggtcacagtcccctggggacagtaaagtgtcagtagctgtttgttgaaaaaactttttaaaatggttgtattaatttttaacgtgtaataggcatagcgtaaaagttaccatttacactgggtatggtggttcccatctgtaatcccagcactttgggagactgaggcagatggatgagactagcctgggcatcatagtgagaccctgtctctataaaagaaaaaagttagccgggcgtgtgctggtggtcctagctactcaggaggctgaggtaggattgcttgaatccaggaaattgaggctatagtgagccacgattatgctactgcactccgggctgggcaacaaagcataattgtacagttcagtggcattcagtaaatacacattgttgagcagctgccaccatcaccgcccatctccagaactttatcttcccaaactgaaactccctctgttaaacaccagctccccattcttccccagcccctggcaaccaccttccaatttgtccctgaatgtgactgctctggataccccatacaagtgggtctgctattgcatatttgaccttttgtgactggcttctcttcacatgtcctcaagcatgtgtcagaattgccttctgttttttctttcttttttttttttttttttttttgacatggaatgtcactctgttgcccagactggagagcagtggcggaatctcagctcactgcaagctccgcctcccaggttcatgccattctcctgcctcagcctcccaagtagctgggactacaggcgcctgtcaccatgccgggctaattttttttttttttttaaagtagagacggggtttcaccgagtgagccaggatggtctctatctcctgacctcatgatccacctgccttggcctcccaaagtgctgggattacaggcgtgagccactgtgcccggcctgcaatttgctttttttaaacagggtctcactcctgcccaggctggagtgcagtggtgtgatcatggctcactacatccttgatctcctgggcgcaagtgatcctcccaccttagcctccagagtctctgggactacaggcatgcgccaccacacctggctaatttttggtgttttagagatggatctgtgttggccaggctagtctccaactcctggcctcaagcagtcctcccaccttagcctcccaaagtgctgagattacaggcaggagccaccacacccagaccggagttttcttttgaaggccgagttttccattgtgtgggtaggccacggtttgtttattcgtctattgatggacattgggttgcttctacattttcgctagtgtgaataatgctctgaacatgtgtgtgcaaatattcttctgtggttgctatctgttctttggggtatatacctagaaatggaattgctgcacatatggcaatgttgagtaaactttttttttatttattttttttttgagatggagtttcgctcttgttgcccaggctggagtacagtggcggaattttggctcactgcaaactctgcctcccatgttctcctgcctcagcctcctgagtagctgggattacaggcgcctggctaatttttgtatttttaggagagacggggtttctccatgttggtcaggctggtctcgaactcccgacctcaggtgatccacccacctcagcctcccaaagtgctgggattacaggcgtgaaccaccgcacccaactgaataaacattttgaagagctccatatgtctttacaagtggtgttcagcttagttcagctgctaggggcagtgttatactgaaataggttagtttggatgaatatccaggtgtctggatgtattaagaacgagagtccaggcagcccgtgccttgggcaggctctgagtcacagtgctgcttcctctgatgtgccccattcctatagtagttactggcagaaatggagttgccgaattgctaggacaagatcatcttgtgtgcgtctgccaggttaagtgctgtgtgctgtgtctggccaggtgctttcgttgaagtgttagagcccatgttcagccctcagccacctgcttcttgattggcacatcactgctattataacaaatcctgggagtatctctgagcagtttttaaagagttggaacaaggcattcagtgaatacatggagtggtaactactcctgggaaggggttgtctcacagcagccagatggccatgcattgatactgctagtacataaccagagtggtgcacgattcaaaccccacacagctgaatttgaggtacacagtagctgtttcttgtctgagccatgatcctgaaatagaacttggcagcaggaaagaacccagaaaatggattccacataaattcaaggaaaaccctgggtgcgtgttgtgcgcagtggctggaggcatcctgaagaacgagctcttactggcccagaatgtcatctcacatgcggaggcctgatttccgggagtggagtgctgaaaagcgctcagtcccagcagacagcccgtctccttactttatcactgcttctatccctttttaaaaagataataggccaggtgcggtggctcatgcctggaatcccagcactttgggaggccgaggccagcggatcacgaggtccagagattaagaccatcctggcaaacatggtgaaaccccatctctactaaaaatacaaaaaattagctgggtgtggtggtgcacgcctgtaatcccagctactccaggaggcttaggcaggagaatcgcttgaacctgggaggcggaggttgcagggagccaagattgcgccactacactccagcctggcaacagaccgagactctgtctcaaaaaacaaagtagaaataagaaagataataaggttgatagaagatattctgtaatgttgtgttcagtgtacccaataaaagtcccaagttggaggaacgggtaatagtgttttctgtttgcacagagggatggtactggaggtgggtgctgtctcctgcatgctgcttactgcttgagtgtatttgcacatggactgtgtcacatctgttttctgtgatacaatttaattcctgattctggtctccggtagctgtcaagatcaagaaaaataaggacaacgtgaagtttaaagttcgatgcagcagatacctttacaccctggtcatcactgacaaagagaaggcagagaaactgaagcagtccctgccccccggtgagtgagcctgaagtcacttcaggggcgggtggggtttggaaggttgctgtgtgtggccatgttgtatcttgttttgaatccctctcagatttcagagcccattttatggtctaagaatctgctcttgctgttgggagtgtgaggaatagttgtgattctcagattatatacagtaccagaaatcatttccttagccagaagagcggttagagctcatttaatcctgttcacgacccttcgaggttggtgctagtactgatagtccccattttttacaggggaacagatgaaatataatagaccaagtctttttatcgaatataatagaccaagtctttttatcaaacactaaatattttaaccgaaacttcgctggtggatctaatttctgaaccttgtgtgctctctttagcttaagtacaaaatttagacaagcagcagcaactcagatgtgtcttctggatggcttacttttgtctctttccctctaggtttggcagtgaaggaactgaaatgaaccagacacactgattggaactgtattatattaaaatactaaaaatcctaa

SEQ ID NO: 358 - DNA, 6225 bp, Homo sapiens; identical to SEQ ID NO: 357

SEQ ID NO: 359 - DNA, 3326 bp, Homo sapiens
ttctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccgaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctggggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcaggcctccagccttctggggctcccttgccccgggttcaaagtcagtcctcggtgaccacccactgcctaggaggcaggcccttcccacctggggggcctctgagggcaggggctgtaaaagcagctaccagaagagtccactttccccagcaactgcagggactgagtcagagaccaagaccttttaaaaggaggttttcacccaaagaagttccctcccctgccgcagtctccaagctgatcgcctggctcctgcagttctccggctccctgtcctgttctggaacttgcttgcttccccttccactggccttagtccctgatctcacagggtcctgttccttctgcacagaggcctcccccagcacccccctctttgactcccgatcatccttcagctcatgtcactgtcctttgggaaacaaccctgacgcccaccttccatcccctctccctacagcagggactctgacatttcacaaggcctgcaatcgctgtttgcaggatacaagtccacctcacctcgcctactaggctgtagacgccatgcaggcgggaacgtgtgttttatccattactgtatcctctagaacagagaacgtgctcaagaaaatttgttgaaagacaccccaatgagagaagaatggctgtttccagccttccgggcccctcagctttgggctcctgcagggccccagaaccgtgggatcacggccacgaggagaggccccgaggccaggacttcctctaatggacacagggcctttgagcaccgggtgactggggccccactccccagcagccatatgtgtttgcgagcgttttcagtcggtccgcatccacccggtcccttcagccagaaccctaggagccccgccccgtcctcccggggctcctttctcacccgcgtccctgccgcggtggatacgcacccctcaggctggctgcccagcgcggtttccacgcccaatctgccgcgaccccatcactccaccgcacctacccctgactcctgcttgtcctgcagcctgggctcctccctccgctggccaagtcacgccaagcagtttgcggttacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgatctgatcataaataagaagcagccc

SEQ ID NO: 360 - DNA, 48462 bp, Homo sapiens
ttcagcttgtgggtagcactcgggccgagccatgcaggcggcgcgcgtggactacatcgctccctggtgggtcgtgtggctgcacagcgtcccgcacgtcggcctgcgcctgcagcccgtgaacagcaccttcagccccggcgacgagagttaccaggaggtaagtttacgccgccccagaccgcagccacgcgcgccccaagtccccgcactaccccctctcccctcgagagcctgcactttcccacgtgcctctcagaccccttctctccccgcgcagccctttcccgtctcccctctccccttttcccccaccctcccaggcccgtggcccgcgtcccctcctgtctgggaacctgggggccgggaaaactgaagagatcagagtgaagcgagcgtggggaaggggaggaagggcgcaagaccgcctgcggggtgaggggctgaacgctgagcgggcagggcggcgcgggggaggggtaaggacaggggcattcgtctcggggtaatcctggcgcgcgaggtgcggggatgctgaggggtgccccgaagttttcgaccgtctgagattccaagatggggcgctctctttccggggctgagtggcctaggaaagtttggcagaaactgagtagagtctcccgagtcggtcttcgcagcacccctcctccccagccccggcctgcagggtgggagtctcagctggaaggctgcagggcttggggaagcggtgtgggtcacttcccctctagcgcagagaacccacagctgcttgcgcttgttccagggaaggaaggtggcctccgtcagcccatctcacactgttgtcctgaggacccccttgcattgacagtcagcttctctgtgtcccctggtcctagactggcccattcctgttcccccacgcccctctctctacctcacacctttaagccctgaatttctggcctagggcagtcactcccggcttccccgccctttccctactctgctgacccttggcaggattctgcaccccacaaacagggccagggctccccagacctccctgcccagacaaacaaagctgcagaatctcccagcccgtctcaggtctggtcacgcctgctctggccccgggagcccacctgtatcagttccttgtgttgggtcaaagattctggggccagtggaccaggatgaggtccatttattcagagccaggcgcccatctcaggactttggcccccggcggcctctccctgtgtcaagttctccagatatgggacagatcagggcaaagcagggcctcttggagggaatcctgatccagtgtgaggtgcccaagcgccagtgacagggagtctaataataacccctgacgacccggctgccatcaggcccaggcagatggtgcctgccctaccagagggaggggagcatcaggaccccttcctggggttcagtgggcactcaggagcaagacggcagtcggtggacccacccccctcccccagagcccagcctgtgggagtctgtgttccctgagaatgtggctgcctggggatagctccagggaatcttcctctcccagagaatgcatgaaaagaggcggatatgatttcagaaacagccgtgtgtgtgtgtgtgtgtgtgtgtgtgtgtgtgtccccatcccaaaccctgtgccccacatcccacacccggggtctccagccatagttttctcctctccactggaggaaatctaaacttttcattgggtcaagaagacccctaggtgggggtagggatggtaaggggactccctcaccctgatggccccagagacagttcctatcagcccaacagctgtggctggtggatcctgggcctgcccacagccccctcagtcccatgggcaggtggcagttgagccagatgaacctacctccagcctctgcccctcctcccaggattctggccccggctcactttgtgctgggcatcaaatggttccagagggtgtcccttcccatcggccactgctcctgggcagctgacaccagccctgcccactggctcctggtcccgctcaccccctcaccaccactcagatcgctgagtaggagatgagcgtggtgggccaggaccggaagtctggctctgggtgttatttaaggtggctcctgtttttggtaagttcccctgttgtgaccacaggtctctcctggatgtcttctttcctcctgagcaccagtcactaacagagtcaggtggaccgtcggtcatcccagtcttcagcaagcttgactggagcaagtgctatgccaggcgtggggtgaccgtggtaaccaaggcagcaggtcttcaggagaaattgctggggattttctgcggctgggctctgggcgcagtgctatggcagacaccaagcagtttgaggtggggctctgccctccagttggctggggtggattcccagttctttccatgtgtgaccacgggtaggtgtcttaacctctctgagccttgttcccttcatctgcaagaattagatgagatattccacatatcatgcctagtacagagagtcccatagcacataacaggagccagtgacacagatcattcaatggagtggctgagaggttcaggagtgtgtctcaggacagtaccctgctggggaatggagaggaaggagatctcttccacagactctgattgggggagactgaacaaaacgcctgcagaaagggcttcagctcatgccccacatgttcaaatgcacagtgctggctgtgtggggtgtggggggtgggtgcgtgtgcatcagagactaagcaaggatggaaacaggcaggtgctggccttaggatgtgggtggtgcgggggatctcaaaggcaagggggttcttggaagtgcagagatggtgaagagcaggtcacctggtgagctgggatttcctgagcaagttcagtgttccagaaccttcctgaggaagtaggggctctcactcactttctggggtgtttgggagccgtgaaagcccccagtcctcctgatagttgatcctcacccctctccccccagtgaacttgagcccaagtcctcgcaaaggccacttggcctgtgtcaccagccttgtggggaggctaccctccagtgagtagaggcatgagaggtgagcaccaaggcagggctgtggacgagggcaccttggccctggcgggcacccagctctgggctgccagatgtggctgtatgtctggaaggaaatcagcctagacctgcagcccaagtcttctcacctttgacagatgagggggattggatttggagacgattcctactctaaagagatgataaaagaactaatgagttcatggattatgaagcctgtggccagtgcctggcacactggaaactgctacaatcactgcttaggaaggagaagactgcagccagccggtgtccactgggcagtgttggggagaagggaatgggcacctggcactgaatccagcaatgtctctctgagcaaatgaacgaggcacttcggtgtccctgcctgagcgtgagtgccaccatcaccatccagccagcccctcaggggagaccagacactgatgagctcagttcttgaaacatcttagtaagctcccaaaggctgtgcaaatgttagttattgctactgtcaacaggcaggtggccacatgtgtgcttcctgttccagcttcccttgcccaggatcagccgaccagctgctctttggggacatgtgttaggaggcagaggagatgttgttaattttttttgtatttaggcatgtatttccacgtgttctctcattggttggttccgttcatagattcgccaaagtacaaagtggagggtacacagttggggactggaccggaactacaggacttcctgcttctgacctgggggcaggtctgaggaagaaggaccaggcagcaagcccatcccagccgagatctgagaagagctgaggttgggatgaggaagccccattcatccagtgtgaaattgagtcacggtcatcagacagtcatgccgcgcctgggagagggcttaatctttcccagtgggcctgggagggagactctccctctaggtgctcctagtttccctctcccagcctccccctgagaccggcacacctctctctatgtcttctggggccagggctgttgccccctcccctgcccagtgcagaagccccttgggtcccgctgccatggtcactgcggcccccaacttgggtcccagcttggcactctccgctctgggtttttcatgacacagtgacaaatcagaaataattgaagtccctttgatgaggggagaggcagagtctgagcaccagtgtgggagctgggggcctggtgttgctgtgggacaaggaggtggctgcagggcacagtgggaggcgtggggaggcgtgggaaattgtcttggcaaagctctgtccatctgagcaggggggcctggaagcagaactcttggctccctcctccattcccctccacctccatgcacatggggacatgcagtgttaattaggagcaagaaaataattgcccattaggagcagcaggtgccaccaagctggccctggaagagggtgctgctggttagggggaggggggtgggctcctacctgctcctcttttccctcctccttcctcctcccttgcccaccttccctcttctttcttcttcccttcccaattccttttccccctacaccctctcaccctgtcccacccaccacccccagttttttcccagcacctaggtagggttcccaggagggtttgggaagtaactccctaacaaaaggcttccaaaggctgggcagggtggctcatgcctgtaatcccagcagtttgggaggccaaggaaggaggatcacatgagcccaggagttgaagactagcctggccaacatagtgagagcctgtctgtatttttttttaaaaaaaggaaatcaaaaaaaaaaaaaaatgcctccgagtttgggtttctcaggcctcgctttcactggagctggacagcattatcagaaacctaattgaggccagctgcccagcttggagaggccccaggccacaggggctcagcggctgccgaagggggagaccgggaggctggaggaggcttgagagagtgaaacgggggagcaggctacatcacccacagcctgatccttctcggacgagccttccttgctgggtggggacattggtagattcaggagcttttcccactggggataaaatgatagtgggactgttcaggaggcaaactcaaagggtagctgggggcaggctggatggtaactgggcttcaggctacacaggtttgtctggggctcccttacatttttgtgttattaggaataacttggttgggcgtcgtggctcacgcccgtaatcccagcactttggggagccgaggcaggtggatcacttgaggtcaggagttcgagaccagcctggtccttttgtagtaaaagtacaaaaaaattagctgagcatggtggcacatgcctgtaatcccagctactcaggaggctgaggcaggagaatcacttgaacctgggaggcggaggttatagtcagccgagatcacgctgctgcactccagcctggtgagagagcaagactccgtctcaaaaaaaaaaaaagtacaaaaaaattagctgggcctggtagcacatgcctgtaatcccagatactcaggaggctgaggcaggagaatcccttgcacctgggaggcggaggttgcagtgagccgagattgtaccactgcactccagcctggcgacagagcaagactccgtgtcaaaaaaaaaaaaaaaagaataacttacaggaaagagtgcagtcttaagtgtgcagttcagttcaatgaatttataccctcgagcacctgcgtgcgtggtatgtgtgtgtgtgagcaacaccatcccaatcagatcgtattcctgaccccctagaagcccccttcgtgctctcttgaaatccgcaccctcccaaaggtagcaatgattcggtgattcacatttctctggctactcatgagtatctctgactttgaacttcatataaattaatccatacagttctctgctgttccatgtctggctttctctctcaacctgacttctgggaaattcatcccagaaataccgtcatgtgtggctggtttccttttcatggctgtatagtattctaagactataacacatgttctatatcttttctcttgttggtggacgtttgtgtctttttgggtgtaggctgtgactgctgtgtgaagctgctgtgaacatttgtgtatcttctgagggacacagccctcctttctgtaaagcagaattgctgggtcatggcatgcatgttacacaatgatttgcaatttttttttttttttggcttggttggggttttttttgggaggttgggttactttttttttaagaaatgggatctcagcatgttgcctagcccaggctagactcaaactcctgggctcaagtgatcctcccatcccagcatccccagtagctgggattgcaagtgcatgccaccaggcctcgctggtttgcaaatgattaagaggatccctgggctttagcagagaggcctcaggggctgccaaggggcggccaggacagaacgtggcatttctatccactcctcactcagatggagctctgtgttgcagggctctgctaagcaagtcagtttgaagaaaaagttaagctactggaaaaagtttgagaacttctgttgacactaatccagtgctgcccagactttaatggaatatatgttgcctgggatcatctctagaggcaggtctgattcactagctccagggcggggctagagattctgcacctctaacaagctcccagaagatgtcagggccacaggtcacagggtggtaaactttacttcaaggaaagaggctctcaactcccagctgtcttggcctcctctgcctgggcctgggctgcagggccctctggtgaaggggcatggactgaggaccagaagaggggcagtgactttccaccatctctttctatccctgggcttgctggggtcagtcccggggacaggccatgctaatgagtggtccaggtggggagagccccagccccagccccctgccacactgtgaggtctttgggagagggaggtgcccagatctactgggccctggcttcccagctgccactttttttttttttctagaagggatctccctctgtcacccaggccggagtgcagtggtgcaatcatggttcactgcagcctcaacctcccagtctcaagcgatcttcccacctcagcctcctgagtagctgagactacaggcagatgccaccatgcccagctaattttttattttttatttttttgtagagacagggtctccctgtattgcccagactggtcctgaactcctgggctcgagcaatcctctcaccttggcctcccaaagtgctgggatataggcgtgagccaccacacctggcggaaagccacattttccaaagtcaaatccatctgttcccctcccaagtgagccatctctcctgcctttttctgggctgcccccatcacttcagctgagaagtctgtcagccaagagtgaccagcagagcagtccatgtcagaggcccgaagacctgcccgcatctcacagggctggcagcgtggcctccagcaggtgtctgtccccctggaaaatggccccaaagccccagactgcagagcccggccttggtttgtcaggtctatctctgtgtgtgcctgtccctgcacaagtctcgtctcccccttagaccgcagggtcctggagtacccccttcctgctgattgccaccccctgcataggactccctgaaacaggctttccccagcagcacccccagagcactagggattcgggactgggaacccctattgggggtgcatgggaagcaggggcggctgtcagctcaggagcctgacttagagccaggtccagccctggctggcggccgccaatcccggtgccatctggtgcctatctggcaaaatcaagagatgaatgagcagagagtggcaccaggcctcctgacagactggctcccattgcagggccccgaggtgctaggcaggcctcaggcccctccggccccctcagaattctggctttgctgctgcctctggcactggaggttcagctgtccctggtggggtgcagtggaagggactccagaagttgcatatcctgactatcccgccccctcacacatcccccaagcatggagctggcttctcgattctcaggatggaccccaacacctagaacaagctcttcacattctggtagaggatgatgcccagcctgggacagcggggtccttgcatggaagaggcaacagatacacagggctgtccttccaggccctgcctcagtggcactcagcgcccgaggcctctgggtactctggtcttggacggtatccctctccttgcctttttcccttggccatggagctcaccacccacagccctccctgctagctggggattcctgccttgtctcctgagtggctcggactcttcatcagcagggcctggtccgtatcttcatccagggtctgaaccagaaaccggagaccagctctggcacccctccctcactgaccacgaggcccaccacttggcctcatgccctgtaagctccatcactcccacccaagtgcctcagcgccgggccctctgtttacagagtaggagcttgaaccctaggtggagcttggaaggatggacgagagatgcagctcaggcagtggggcactcagggcccaagggcagggcacttccagagccccgcactgcagggatgaagagtgacaacaggcctctgctctcttccagtcgctgctgttcctggggctggtggccgccgtctgcctgggcctgaacctcatcttccttgtggcttacctggtctgtgcatgccactgccggcgggacgatgcggtgcagaccaagcagcaccactcctgctgcatcacctggacggccgtggtggccgggctcatctgctggtgagtgtccctggacgctgggcttggggtgtgtgactcagtctgcaaggggccagggactgtttgaccatgttctgacggagctccagctaccttgatggaaaagcttgtccccagatgaatgttgtccctttttttttttttaccaagcatcaggaatcagatgcctggggtggtgatggggtctccagaaaggtctcccaagtggccccccacaaaccctgccccaatgtgggtttgtcctgtgcccagcagctgtgcaggcagcatttctgcaccgacactgggcatctccagtctctgtccctggcccctgccagctgctgccctgggtctgtgaggtcagaagaaagtttgactccagcacaaatcaattccatcttcttgtgagatcaatagcttttagtgccgttagccagttctttggtttggatgaggaagggagaatttcttttatttatttattttaaagatggggtctcactctgttacccaggctagagtgcagtggtgcgatcacagctcactgcagccacaaactcctaggcttaagcaatcctcccacctcagcctcccaagtggctgggactacaggtgcacaccaccatgcctgcctggctttttttttggggggcggggggtgggcggggaagagacaggctttcatcaagttccccaggctgatctcaaactgctgagctcaagtgatccacctgcctcagcctccaaaagtgctgggattacaggcgtgaggcactacacctgggctgagactatgttgctcaggctggtcttcaacttctggcctcagacattgctcccccctcagcttcccaaagcactgggattacaggcatgagccaccatgctgggccttaaagtgaggatttataactcccgtgcaggagtccatacccagcccaccacactgcctggccactccaccccagctggcgtccacatgcatgctggctgttttcaggagttgttgcgtttttcttgtttttaaatctataatgatttttccaaaagcctctagtgtccacgcagagacgcttctggggtgtggtcaccccagagagtagagtctcccactacctggcagcaggctggcagccaggcaggtcctggtcagcctgggggtgaggatgcctgggctctcatacccaggcagctcaccttgccactgcgagtttcttctctgttggaagatgttcttgatctcgtcctgcctgtagtgggaggctcacctaagccaaaacgcaggcgagacgctaaagcagccttgtggggcggacaaagctctgagcacaaggaaggggaccaaggctgctgcaatacatggccggggctgaaataagagactcagaggacagagttctggacaggccgggaggtcacagtcgagtgcggttcccagtacagtggaagagctttgagaagtgactggtgttaaaaatcctcctgcatggccgggcgcggtgactcatgcctgtaatcccagcactttgggaggccaaggcgggtggatcgcctgagctcaggagttcgagatcaccttgggcaatgtagtgagacctcacctctacaaaaatgagccaggcatggtagtgcatgcttgtagtcctgactgaggcaggaggatgatgagcccaggaggcagaggctacagtgagccatgatcgctccatcgcactctagcctgggtgatgtgagaccctgtctcttacacacacacacacacacagatacacacatacatgcacacacacagatacccacacgacaaacttgttttggaagaatactttggaacagtaagaatggcatgaggagtcaattcttctaatatggaagaattatctgcagtgtagggaaaactcaaggtggaaggaatgtgcgtggcagaatccatcccacaacattctgggcgtgacttgtaccaggcaagagggcaccagcagtaagaaaacaggcaccaagtctgctttcatgatctgtcagcagaggctgagaactgtgtaccagtttgctttgaatcattgcaactaaagagagagggctgggcgtggtggctcacgcctataatcccagcactttgggaggccaaggtgggtggatcacttgaggtcaggagttcgacaccagcctgaccaacatggtgaaaccctgtctctactaaaaatacaaaattagctgggcgtggtggcgagtgcctgtaacctcagctacttgggaggctgaggcaggagtatcatttgaacccgggaggcaggggttgcagtgagccgagattgcgccattgcattctagcctgggctacagagtcagactccgtctcaaaaaaaaaaaaaacaaccaaaaaactaaggagagagctctgaaggaaaggagcaggcatagaagtggatggcccacctgagtccaggcgttcctgggtgacatgggcacccaaacccataggatgagaaggcgttaacttggcaaaggtgggggcaggggaggcggagacacctccaggcagagggaagaggaacgtgcaaaggcccagaggcaggagcgagcatggggctaaaggaagccaatgtggccagagcagagggagcagatgagggggttgggggcactgtcgagggtcggggtgagcaatgagtggcagtgggatggggaaagtgtcacggggtcagaagacacagggggcagatgggattcaaaccatgaagcaactcataggctttgtgaggggtcggggtctttattctaagagccaggggagccactgcaggggctctgcaaagaggtagcgtgacccgataactcaagttgaatgtaacccaggccggcgggagtattcggaacagtgggacttgaatgtgaagaagtggccaccgggtgaccgaagagctcagaggcctaatgagggcagtgagcgaccttgggattagcaatagcaggagccaccaccacctgcaggccagagggacacagggagaggctatgtcaccagggaagctggagccacacagcctgcctatcagcggctgcagaacgaggggagcagggccctggctgccttaccaccacctccagtctcctaccagcacctccatcggcagaagccagctggcaggggagcccgagacattccgtgtgagggatcaacccctgtaatggagaacagggcaggggacagaggagggacaggtccaggcagagggtcgcatagatgcgggcaagagtaaaatcaggccatcagggaggcccagctggagagcagcgggcttacacctgggcgtgggcagtgaccagaggggagtgcccagaggaagagtcagctagggaggtttggggaggagctgctgaagttcatctgcaggtttctggcttaagcccccggatggggtggcagtgctatcctccaaggcaagggacattggcagggaaccgggaagagaagcagacagtcagtttggttgtacacagattgagtttaaggtgcctttgaaccatccaagtgcagttggagttataaagccagggtcatgagggtggccagtgtggaagtcacacacatgggtgacctgccataggaagcacagagtgagaagagaagggggctggggccaagcctggaggaagcacagtgtttaacagctaggacgcaaaaggtgcctgtgaaggagaccaggaaagagtgtcccacaaggaagggctgggaatgccacaagggcacaggagtcactgggcagcgtgttccaggaagaggaaccaagctgaccactgcacgtgggaggggggttgggaaaaacccttgggttaagtgggaggtcattggtcgccttccttggagctgcgtccactgggacacaggaacagccagattggtgtgagttatgggaggggcaggaaggagagtcgggacagcagcaggagaagggatggaggtaaaggttggggcactgaggtgggaggacacatgagctctgctgatgtgattccacctgaaagcgggggattgaatccgcagaagaaaagaccaacaaggggttcctgaaaaagcaaaagggataggaggatatacctctttgttctcctctattatgggggaagggtagtgattttatatttgggaaagagtagtgtgaacacaccagggggaaagcaacaccaccaactcgcttattctccctcaagcagaacagtttttcctatggcccaggtgggatcaatgaccccaggagagaccaggagaacctcattaaacagccaaggcgatttttctttctttcctttcttttctcttcctttcctttcctttttcctttcctttcctttttgacagagtctcactctgtcgcccaggctggagtgcagtggcacgatctcagctcactgcaacctctgcctcccaggttcaagagattctcctgcctcagcctcctgagtagctgggattacaggcactcgccaccatgccccgctaatttttttatttttagtagagatggggttttgccatgttggccaggctggtctcaaactcttgacctcaggtgatctgcctgcctcagcctcccaaagtgctgggattacaggcttgagccccaaggcgatttctgatccccaaagatgaggtgtaatttcacagcccctcctggcccatcgctgataaacccacagggcccgagagaatagaaggatgggaaaatgctggcttcatattgaatccctggaaaacactaaatcgtgactcagagagctagaaaaggatgaacacaaggagtcgacaaaagggcttctcagagcacaatacaattggttcattttcttttaaataaagttacaaattggagggtcacgggaagacaattcatttaatgtataaatatctcagctgagcacttggtgaagctcctcccctctgtgtggatacagttgcattttctatgatggtgcatttaactgggttcaaagctagttacacaactctggttgaacccaatgaatattgacttatgcagtggatttctaaactgtagagggggtgtgtgtaagagagagacagagatacgtaaagcatgcaggaaccttgtttttttttttgttttttttttaatgtctcctgcccccccatcttggatgatacaggaacctcattttaaaaggcacattcccagaccacactgatggaatgggccgggctgcttatctgcacttaacaggctccccaggtgattctgttcccgtggtctgaggaccacatcctgaaaaacactaaattaggagttgagggcgccctggaaggaggtttcttttcttttctttcttttttttttttttttttgagatagagtcttgctctgtctcccaggctggagtgaaatggtgcaatcgttgctccctgcaacctcctcctcctgggttctagcgattctcctgcctcagtctcccgagtagctgggattacaggcatgcgccaccacgcccagctaatttttgcatttttagtagagatggggtttcgccatgttggccaggctggtcttgaactcctgacctcagatgatctgcctgcctcagcctcccaaagtgctaggattacaggcatgagccactgcgcctggtaggaggtttctatcacagtcctccagggggttccgtcctagatcctgtgttgtttaaagaacaacagaacaaatataagtgtggacgtgtacattcatctccccccaccccaacccaaatgagcattttggatgaaaactcaggaggctgcttaatcaatcttcagatggtctcaagtggtgcaggtcagatggaatatgatggatgacaagagtcaagatttgaaatgatttgttcatgctggaatgttggactaaaaccaactagatgagatttcacagggatagatttaaagttctgcttttggttaaaacaacacaaaaatcaatacagcactataggaaggaggagagactgggcttaacagcaattcttgggaagaaattcaggggctgtttgtagaccacaagatcagtggggggcggggggaaccagggcgggtgcaagttcaggtcagtgccctgggaagtggaggacctaaggcatgacccctgctgcgctcagagctgatgaacaacctggacttgagtgactcactcaggccacatttaagagtgacattaaccaattagactttcatttggaggacagtgatggcatgggcaagggtctgaaaccttagtcccaagaaggacacctgcccacttggagagcatgaggtgagagggttatgaggaagccaggttcagctgtctgatggggcacggtgcagaactggaaacttcttccaggctgccctagaagacaaatgaagatccagggggtgagtggtttaaggaggcaggtgtcagctcagtagaagaaggaacattctataagttgggagttcacagtggaagaacagactgtgacatgggtggcctgaggatgttgggggaaagggtggaggatgtcgagagagtccacaattcctggaggtgtcaagagagacccaaggttggcaatgagtatgtgatctcagtagacctcagcgattcccaggcccacctgtgtcagaatcccctgggggctggtaaaagtgcaggtaacctaggccctccccagatctactgcatcagcatcccttgggctggctacagtctcccaacttttggagtcttaggactagaggacagtattttcctattgcccaaataaaatgtcctgtagaaccagcctgccagggaccctgaaccttcacctccccacccccagccccacctgccagaatgtgagatgtcatccacctactcaccgcagcccccaggaaagagttcctcagctcaagtcaaaaacctgctctccatagatgttcacagcagctgtattcagaattgccagaacttggaagcaacgaagatgtctttaacaggtgaatggataagctgtggtccatccagacaatgaaatattattcagcactgaaaaaaatgagttttcaagctggaataagtcatggaagaatcttaaatccatattactaagcgaaagaagccagtccgaaaatgctccacactgtatcgtttcaactctatgacattctgaaaaaggcaaaactaaggagaaagtgaaaaggtcaagggttaaggccaggtgcagtggctcacgcctgtaatcccagcactttgggaggccaaggcaggtggatcacctgaggtcaggagttcaagaccagcctggccaacatggtgaaacctcctttctactaataatacaaaaattagccaggcgtggtggcggacacctgtaatctcagctactcaggaggctgaggcaggagaatcacttaaacccaggagtcgggggttacagtgagctgagatagcgccattgcactccagcctgggcaacagagcgaaactctgtctcaaaaaaataaaaataaaaataaaggggttagaggggagggggtacttaatgggcagagcacagaggaattttagggcagtgaaactaccctgtatgatatggtaatggtggacacgtcattttttcatttttttttttaatttttgcagagatagggtctcactacgttgcgcaggctggtctccaactcctgggctcaagcgacctatccgcctcagcctcccaaagtgttgggatcacaggcgtgagccaccacacccagccaacacatgtcattatccatatgtccaaacctatagaatgtgcaacgctgagaatgaaccctagtggaagctgtgggctctgggtgatgatgtgtgcatctgggctcatcagttgtaatggatgtaccactctggtgcagggttttagggtggagtaagaggctgtgcgtgtgtggggcagcagatatatgggaactctctactgtccacttaattttgctgtgaacctaaaactgctctaaaaacaagcttttttttttttttggagacagagtctagctctgtcacccaggagggagtgcagtgccatgatcttggctcactgcaacctccacctcctgggttcaagcaattctatgcctcaactcaacctcctgagtagctgggattacaggcatgagccaccgcacccaaccctaagcttattttttaatataagcaaacattctcctctgtgtatcacctctaacctctgtttgggatcttgcttatagtgctgcggtgggcgttggtttctatggaaacagcgagaccaacgatggggcgtaccagctgatgtactccttggacgatgccaaccacaccttctctgggatcgatgctctggtaaggctcccgggcagctggccgggtacaggcacagcccacaaggtcagcgtggtcagagcaagggcccccgtcagatcccagctagctcagctgcacacggaggggctgtgtgacgcctgagggctggacccccgcctgcgctgcagttgcctctgctggggcaaatgggcaattgtgcgttccaagcctgcaggggtggcagggatgggggtgaggactaaaggaggcagctgtgggatcaaaccccattttccaacaagccgaacactttctgatttgtcaaaggagaccttgaacatggaaaatcagccccactgcattttttgttttcattttaagtgctgcatatggagtattgcaaggtccaggagatgccaagaggaaaaaactctcttcagagacaactgagggctgggcgtggtggctcactcctgtcttcccagcactttgagggaggccaaggcatgtggagctcaggagtttgagaccagcctgggcaacatggcaaaaccctgtctgtaccaaaaatacaaaaattagccagttgtggtgtggttccagctacttgggaggctgaggcagggagatcacttgagcctgggaagcggaggttgcagtgagccaagatcacgccaccacactccagcctgggcaacagaatgagactccatctcaaaaattaaagaaaaaaaaaaaattgaagagccccgtgatgtaaggtagtggagacctgccccagctcctcggagctctggcttccaggcagtgactccaggtgggggctcacagtgaaggatgctctggcctggccagaggaggtgtcagactcttaggggaaggggaaggctactctgccaagccagggctggattttgtggcagacgctgcctgatacacacgagccttttgctggggctgccacccctctgctggggacctggcccagggaggagcacgacaagggtggacatctgaggacttggttccctgaaaactgcctctgccttttctaccccagctgcctggaattggagttttcccacagtttgaccttggcccccacacacgtcattctcactctaagcaccagaccttttcagctgcttatccgagcagcctctgccacaaaatccagccccaacaggagaatttggccattgccccggcatcctccagaagaggattggaccccatttgcccccctcctgctcccttaagctcctctaaggctttaatccctcagtcaacaaggggggtcgggggtgtcaccttaaagagacagctgtgctgctcctccgtgcccaagtcaattgtgggaggaggccctggcctccagaaaggggctgagggtggctacaaaaccaggggccctggtcctttgcagagttcattccaccgcccgtgtccactgggacccatccccttagctgagcgctgagtcccagtgcggagatgctagtctggaacagccttgcgcggtgagctggggcggctgggttggaggagctgagggacagccagctcaggcctgggaggcagaggtgtggcctgcctggggagaactctccctctgggcacccacccttgccccaggccctggtggggaagggccccatggtcactgccctctaggctctctctgcccctccctgccatcctgctgcctgcctcctcttcacccaccagcaccaggatcactggaggaggaacctagccccgagaggaaaatcccctgccctgcccaggaaggcaccagggccatgaccttcacgggtttagagaaactcccagaactcccttatgggaaaacatcaagtcctagaagtccctatcccacaggacgagagctgccagggaggggagctggaacgggcccccaggctggggcctcccaccccatggcctgatggtgctccagggccaggtttggacatttcacagcaggttccactctctgaaatccctgctccagggccaggtttggacatttcacagcaggccccactctctgaaatcccctgtgttcccaaagagaagggttctgtatccctggagatcagcccctcgtcctctccgttgttaccgagaagtgaggtcaggagtcccagggcttcacactggtccagccagcccatagctgcctccagcctgtgggtggtcacctccccctctggcgtgaacccctagggcccaggtgtagctgctgccttgcctccaggtggaaaggtggcactgggtccttactaggacctgtgaggctggtttgggcctcagagtggacacccagcacaccagtcctcagggctccaggggaggcagcagatcttagaagacttcccagatccaaggggagaagtccggatatcagataaatgactagtgagataatgtcagtgaaagtgctggtagactgtaaagtacactcagctgtatgactgtgattatgagtgctattaattactgtaatcaccttggggtcagcgggaggctgggatccaggacgctgtgggcggcagaggcagatgggggactcgtcgacaggtcaggcaggacctggatctgggccttgccagaggccagatcatgcagctgagtggccaacaagaagccctctagggatgcacccacagagtggggtgggccctgctccaagtcctcctttcctggactggaagccccatacctatgcacgtccaactagagggacacctgtgccttggtgggtaggggcggtggttcagggatcaggcggtcctgggagggctgcacgccccagtctaggggagtagagaggagtcgttttgggataccaaaacttcctgtacctggtagccagcacggcccctccaggctctctcatgtgagtctgcagcaggctgatgggcagccctcagatgtagaaactgaggcacagggaggttgcattgctgacccgaggttgaaaatgtgtatgtttcagagcagaaaccagaacccaggcctcctggtcttagccccttacctccactgacctggcccatccacacttccagataagctcactgagcgctggagagtcctccctcccagaagttttcatacttgagcttgcatcagaatcacctggaagggttggtaaacactgattgcagggccctgcccccagaggttccgcttcagcggtcctggggcagggctgagagcttttgcttttgtgagtgagttcccagggggtgcatcttacgcccctagtcccgggaccacacttgagaactgctctttcctctagaccgtggtctccgccacctgtagctcgtccctaagtctgcccagcctggaaaactgacctgtccctcctgttctcagagctttccgtgagagagagcctgattccatctctgggtcatcccacctgtccctgcggggagtattatgtcctgaaactttaaggaattggggatggtatagagaagtggggagttgtaagtaggtcactgctgtcattcttattttttaaaattttaggatcttttgagcctaggagttcaagaacagcctgggcagcatagcgagaccccatctcaaaaaaacaattttttagttttgtttcctgtgggaaaatatcaggaagaaagagaaggcatgacaaatacaaatactgccttctttttttttccccctaaggaggagtttaagaaatagagaagttaactgtgagagagtagaactgtgagggagaaaacaagtggcctcacagaaaaagtttacagataattttttaacagccctttactctgaagtttgtttgatttatagaaatatagaaatatagaaatgtcacctattactgggtttgttcagaatggcactattctttgatgatagtgccatttgtataaatgtttccaaagtggttgtacatttatcttattaaattgaacagccaagtgtactagcatgacatttagttactgaatgtacttttacatggtttggggtcttttcccctgtgcttcgggctgtcgaatctgcacatggtagagtgtctccgtactctggtatctcttagtccttaaccaactcgtaagaaccaagcataagccagaaaacggaacaagccgctgacactgaaaaaataaaacaaaatgaaacaaagagagccattctcttttctggaactaggaactcccagcgtagcgcagatgtaaaaggccacacagctgatgtgaagtccccataacacagagaacaccgttggcctccgagagtggaatctaatcggccttgctgatctcactgtgggaagtttctgcctcttcttctgtgtcgtttttatctcccagacccgtgggagctgaaggctgccgagtgtggattagtgcacactgccccactcccggcccgttgtgcttcttggtttagtgtgacagtttcagaacaacaaagccctttctccgctcgctgccagcaagggcgtgcttggggctgccaagctgcaccccggggttctgcaggcaccctgggtctgggctgtgggaaagtcccgctaaccagtacgagccctgcctgtgctcttcaaaagccagctagggttgaccacttggaccattagaaatggatgcacatggccgggcgtggtggctcatgcttgcaatcccagcattttgggaggccgaggtgggtggatcacttgaggccaggagctcgagagaccagcctggccaacatggtgaaactgtctccactaaaaatacaaaaattagccgggcatggtggtgcacacctgtagtcctagctacttgggagggaggctgaggcaggagaatcacttgaacccgggaggcggaggttgcagtgagccaagattgcaccactgcactccagcctgggtgacacagagcgagactccatctcaaaaaaaaaaaaaaaacaaaaaagagaaagaaagaaatggatgaacgggctactctggcacactgcctagagggtagccctgctctgcaaggagcagtacctttaaatataaataaataaataatgtttttaactggatggccagccgtcaactttctatttctgtcttgcattggcagatgtttccttcagggtccactcaaccccaggcccttagggctcagccaagggacaggagcctgtctgcccacccagcaggacacacatccaggggaggatgtgaatacaaggagaaggcgccggtttcctcctcctgcctcatgtccaggctcctcagagacaggatcgcagctgtttttgtttttgcaaagtcccattgtcctgccttcactcagcgttcaggacccggtgtgctgcggctagtgccacaacaaagcttttctcttatagaacaattagaaatcctattgtggggatacaaggtcaaggtagcaacatagagtctgtttctctaaaagagaatttgtaagccaaagtgctgaaagttttaagagaatcttcaaagaataatggattattttgttggtttctccatctgggtgtctctgtatatagtaaggtatagtaatgaatgcatacgtttattccagccctttacagcaggggccacgtggtgggcacacaggatagcctccttagtagagagcaacagaggctccagagggcagggatgtgcccacactcccagcgccagaggctagacctggcctcagcctgcaacacataatggtgtgctcctttggcgccagcattctctctctcggagcccagatcctgtttaaggccaggtcagggactgccccctggtttgagggacatgaggactgggtgggtagtggcggcctctgtcttcagtccttcctccaggggcacaggctcgagatcttcaggcctggggcagcatggtgtgttcattcatgcctaagcaggccaggccagctttttttttttttttttcgacacagagtatcactcttgtcgcccaggctggagtgcaatggtgcgatcttgactcattgcagactccgcctcccgggtccaagtgattgtcctgcctcaacctcccaagtagctaggactataggtacatgccaccacacctggctaatttttatatatttttttgtagagacagggtctcactgtgttgcccaggctggtctcaaactcctgggttcaagcaatccgcctgcctcagcctcccgaagtgctgggatgacaggcatgagcgtaattatcgcacctggccaggccaccttctgctgcctgcaaagacctcttccgggatgagaatcagaagctctacctccatggcttttgccccctgctcctccctaggtttccggaactacccagaagatgaaggtggacctagagcagcacctggcccggctcagtgagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtgaaggaccggtgggaggcagagggaggggcagcagcggctacatcagctttgtttatccaaacctgcatgttgagctccaggtggagaagggccactggaaagtattttttttttgttttgtttttttaagacagagtcttgctctgttgcccaggctggagtgaagtggcacgatctcagctcactacaatctctacctccggggttcaagagattctcttgcctcagcctccctcccaagtagctgggactacaggtgtgtgccgccacgccagactaatttttgtatttttagtagagacagagtttcaccatgttggccaggctagtctctcgagctcctggcctcaagtgatccactggcctcagcctcccaaagtgctgggattacaggcgtgagccaccatgcccagcccaccagaaagtcttgataagccattggccaaaatcaggagaacatgggggcttacaggggccacgtggtgagcatgcaggatagcctccttaatagataggcagcagaggctacagaggacagggatgtgctcacactccccgcgccaaaggctggacctggcctcagcctcccgcacacggtggggtgcttctctgggactagcattcttcgtggctggtgcagggtggaaacgccacatgcttcataggttcctcgcctgccagagttcatgggacaggatttcttgtatccacagacacagccacagggttatggggggttgaggagatgagcacccggctaagggtgctaagaagttgccatcaggggaggctctgacctacaagtcattgtgctcccagggcctgggcctaagcgtggaggaggcacaagggaggaatgaggctgtgtccccagactcactttttttttctttctttttaagacagtatctcactctgtcacccaggctggagtgcagtggtgtgatcatggctcattgtagccttgaactcctgggctcaagtgatcctcccgcctcagcctcctgagtagctgggactacaggcatacaaccacacctggctagtttaaaaaaatttttttttgcagctgggactggtggctcacacctataatcccagcactttgggaggccaaggcaggcagatcgcctgaggtcgggagtccgagaccagcctgaccaacatggagaaaccctgtctctactaaaaaatacaaaattagctgggcgtggtggcgcatgcctgtaatcccagctacttgggaggctgaggcagcagaattgcttgaacccaggaggtggaggttgcagtgagccaagatcatgccatcacactccagcctcagcaacaagagggaaactccatctcaaaaaaaaaaaaaaaatttttttttagaaataggggtcttgctttgttgcccaggctggtctcaaactcctggcctcaagcaatcctcccacctcagcctcccaaagtccaaggattacagacatgagccaccatgcccagaccagcctcacttatgtagaacctgagtgatggggactgaggggcaccaccctcacttaggtgtacaaactcatgcccgtgtcatctgacctctggggctttgtttacatctcccctgcctccccatttgccaaatcccagcctagccagaggcactggacacaatcggcggagcagggacctgctgcccctctccaggtgcagggtccagcgaagtttgctccgtggaaagcacaggaaggaggcagcagccccagcctttggagggctcccggctgaatgatggcctgggcttgtgctcccagggcccgggcctagcatggaggaggcacgtggggaggggaagcatgagtcaggaggagcgagtgtcagttctttggatccctccccgcaccctccatttgttggctcctcttcaagccattgatgaacgtcagagcctttagctcagggttgcacaacttacttctgttttctggatttgtgtccccttgtgtcataaagccccactccaggaggtcactgctggactgagtccaggggcctctccccttcccaaaaataggaggtggcaggtccctgagcagagggagctcatgaagtccccagctctgggggtcctccccacaccttgcctccccagcccgtccagtccctgcatctccgccatgtcctggatgctctggattgaagggaccttggccccactccccagcagatggatgctcatgggcaaaagagcctccctcccaagggacagaaggaaactgccagctctaaggactgtctgtgacctcctgtggccccaaaacaggggtgtctgatgattctcctgatgcatgggccattcattgcctgagccttcgaaatcttatgtcaggcaggggcaggacccattttaacgtcactcttctctgagcacacctagcagaggactgtgtatgtttaagggcctcatgtgggcattttgttaatgacactgatggaattaagtcagaatttacatatcaaaggcggcttattgttaaggcgatggtattaaaatagtggaaggatggtgtcaactgcacatcagctatttcagcgtgggtgattgacaggaccccctgtgagtccatccccaactccccactgcttattcgggttgaggcagaagaggtttggctcatgctgtaatcccagcactttgggaggctgaggtgggtggatcacctgaggccagtaattcgagaccagcctgggcaacatggagaaacctcatctctactaaaaatacaaaaattagctggacgtggtggcgcacgcctgtagtcccagctacttgggaggctgaggcaggaaaattgcttgaacccaggaagcggaggctgcagtgagccgagattgcgccactgcactccagtcagggcaatagagtgagactctgtctcaaaaaaaaaaaaaaagcagaggtctagtccaaggttggcacctatggcgcctgaacatcagtgatattctaccccttctcctgtctttgcttccatctgtggcttctcctctcacctgagctgctctgcaaaaaaagccctcccctgaagggcccctgtctttgcttttgggatagtccttgagcataaccatgcagcaaagcagatatttcctagcatttttatacaaggcggggcgaagtattggaggagataaaaagccaaggggctcctctctttgagaggctacggttgagggaagagggagccggggtgggagtggctctggcaggcagagccgagttcttggttaggaatacatcccccagtcctcgcccagctcctctgggaaaacacatccgcctagaggagatgtttccaggaacccctgacaacatgaggcgtggaggcagggaaaatacattgaatcacagccacagagagtgggttagaagcacccctaactggatttcctgctgctctgcagagcggaggcgagtggtgagaagaaatctttaagtttgaaacatgaactgggtatttcgagaggtgccctgtagctggctgtgtcccttgcaggaagcttgatgtagacaatgtggaatttctgggccaggctctccccaccaggggccttggctttctaatctgtactaatctgtagaatgggatccagctcacacctatgatcccagcactttgggaggctgaggcaggaggatctcttgagtccaggagtttgagaccagcctggacaacatagacagacccggtatttataatacgtgtgtgtgtgtgtgtgtgtgtgtgtgtgtgtgtgcgtgtaaaaataagaatgtgatccaaacactagatggtttgcgaggttccttccagctctgagctaagtctaaggaaactggcttcttggtggcagcaggctctgcccactccccaaagcccccggctccattccggggaaccccagagacctagtgtgtgctgccccctgctcgtgcagagacaaggactttgattagtccccttcttttggcagtaagcctcaattcggggagtcagaaagaacctcccttggctgccaggcctccagcttgctccctcccctctctccctcggagcctctttgccactttctgccagctccagggcactccctgcccacgctccaaactccgtcttcccctttatgatgtcagtgaagcagaaaaccattgctggagaggagaggtcagcgactttacttggctcttgcagcaagagaaataatgatccaaatacttccctctttggggacggggaagcccctgtctctgtgcccgcccctcctctgtccactctcccgctggtgcccagcacagggtaaagggcatggctgccaggggagaccactgggccttgtgaggaccaccttggggacctgtgtggaagggaaaggaacgagggcactttgtttggggtcttctcagtgtccgttggcttaagatactttgattcttcagcctgttctctggagaagcaggagggcagggcctttgaagtccttggctgccttgccccatcaacctttatatttagcaagcacttaatccttcctctggccctgtgagatgaggggttccagctccctctacagatatggaaaccaaggtctcaaggggtgaagtggcttaccaaggtctcccagctggggtgtgactgcctttccccatcagtccagccctggggacaaaaaggccagaggaatgaagggcttggaggaggctggaggtctgcagggctgtaggtaccctgacctggactcccgggttccacactgagccctctgatggtcagaaacgagcccactcacctgggtatccctggtgccaagctcagtgcctggcacaaatgttgtttaaaaatgaacctgaagttttttgttgttgttgtttttgagatggagtctcactctgtggcccaggctggagtgcaatggcgccatctcagctcactgcaacctctgcctcctggtttcaagtgattctcctgcatcagcctcccgagtagctgggactacaggtgcccgccaccacacctggctaatttttgtatattttgtagagatgaggtttcaccacgttggccaggctggtctcgaactcctggcctcaagtgatctgcccgtcttggcctcccaaagtgctgggattacaggcgtgagccactgcgcctgtcctgaacctaaaagtcttaagttatggatcccatccagcaagggggcaagatgggaggccttggggagccaggctgagtgtttgtcaaagaggcaggcaccttaggggctgtgttagatctgtggctataaacatcaggccttggctggtctgatgctgtctgagagttctagaagcaaagggaagcagggtcctaggcgatgcctgctgggaggccgcagaaagacacttcagagctgtgctgtccagggtggtagccccagccatgtgtggctattgaaattaattaaaattaagtaaagtttaaaatgtatttcttcagttgcacaagccatatttcaagttctcggtagccacctgtgggtagtggcaaagaagagagtggacagcagggatttagaacagctcctccactggggaaagttctagtgcacagtgctggttttgacactcagcctagaggtgaaggcagggggtgtgaattgacagctttgtccaggcagcagtgggggtgcagctcccgaggcttcagcccacgcatgctgggtgcttgctggctctgggcagcatgtccatagtagagggtccagtgtgtcccagggctgccgtgcaggcctctcacgtggccagcaggtcagaagttccaccctgctgctcctgaccatccctgcccctctacccaggtggctctcctacctcctgctctttatcctggacctggtcatctgcctcattgcctgcctgggactggccaagcgctccaagtgtctcctggcctcgtgagtatccctacccgtggacctgggacaaagagctgggcaggatgccatcatcagagagagacgagggcctggccagctccagagtgtggggaaaatagccaggctgcctgaggccaccttctgccccgtcctcagcactcagcagaggagacagacagcagccaccaactcaccatctggtcaccaaacgagcaagcattaggctttcctccttctctgggcctgactctgttgagcagctaagaaacatgggtccgtgcatgaaagcctctggccgtcttagccaacactgcccccttagcctgtgctctcacgcctgggtctctttagcctcaaggacctgggctccatggtcctttcctagtagtgagcagggcccacgtcagggcagggactgaggctgcctttggatccattgcaagggtctgggggcagggtgggtggggtgatggctgagaggaaggggaccccgcctgccaacgttgtcgcctgcctctctcctaggatgctgtgctgtggggcactgagcctgctcctcagttgggcatccctggccgctgatggctctgcggcagtggtgagttgggggagggagtgggtggtgggtggtggttggtctgccaggacactctggtgtgtctccaagcagggccagcttccggtcccagctcctaacctagaatcccagaatctcagaaccaaagggacttgcgtcatctgaaccggcccctctcgttacagatggggaaacaggcccagagaaaggaaggggactgcccagggtcagagccaggataagacactcatgcttcatacccagagagaagcccccggctgcccaggcatgcttaggcttacacgtgcttaggcttaggcgtgcctgggtgaccagggcgcttctctctgggtgtgaagaactgaccgggtctcctgagaatgggtaggggtccaagcctcagactggggaatccctcccgcatcagaagctgctgctttgccagctccccaggccctgggactgtagaatgtggtgtctgacttgccttccatcccaatgtcccaggactcccgcggtctgaagcacacatgctgtatgtttctggatgtgatgtctcaaaatggcttaaaaaaaaaaagttgggggcttcctatgcgggtccacatgatctttaaaggacctaacactggcgctaagctgtgtgcatgaggctgttcattcactcagctgacattgtttgctgggtggcactcgatggtacaagttgcctggggttgcggaagccaagaggacgtgatgtttgctgttgacaaagttccagcctttggaagcaagactcataggcagatcactgcaaccccaggctttgatacagtggaggtgcagtgtgtgtgtgtgtgtgtgtgtgtgtgtttgtgtgtgtgtgttcatgcacatgcacgtgatagaagagaacacagtttaccaggggaattcaaggaacccctcactgattcaaagtccacagactaaccctgggacatgcatctgttctgccatagtgacctgaggcttgataggataagatgggggtggcttgtacaagaagctccctaaccacactcacacctcgtccagtgacttgggggctggccactagctctgggcgtggacacaatgccctcagggactctggcactgcctgacttagcaccttaggcagaggcttgtgcagaagggagaagagggggcattttctgtctttgcctcctgccaccccagtgcagtgaccacggaccaaggaatggtcgagaaaaggcccaagtcatgtttgaaagcatgcaggagctgggacggctgtaaacagtgccactgctggccagggtgatgcaggcagctgcctggcctccagcctctcctctggggccagggccacgcacagggaagctgcagggagcacacggcgaactcctccagggccccatcccgctttctgggcagcctctgccttctggaggcagcggtggcttccagcttgccgctgtgagctgccctgtggtggccgcccctcccagtgggggctcctccctctcaccaggcttcagtgttcacgaaaaccagaggccatttaatctcccagctgggcgccctggaatgcggggagctggggagaaaggccatttccctaattcctctagtcaggcccctgagtgcgagatggggagcaggcggtggagctgaatgggcttttgacgggctggagatgctgctgcattttaataggaagccgggtgaggaggagccaggagggcggggagggcggccggctgtcccggggttgttgtggagagcttttgtgtggcctcccaatgccaccctgctctctgaggcctgttttgacagccatggggccagaggattgacaaggcctcccttccccacccccgacccctacccctccctgtccctagaaaggactccatgaggacagagcactgccctggagatctgctctgggtgaggcagggagaggagggagcagcggagctccaagcttccaggccctggggccacccctcgtggtcagcactgcgagtcaggaggtgtctggggtgaggggctagagcaggcagagaggctgggaagccctggaagaaggaaggggaaggaaatgggttcagctgtgagggaggaggcaatggctgtcacaagtgctttggccaccgagcctggggacagagaacttcaggggattcctccagctaaggggcagccaggcctgcccctgagtcagagggtgggagtgtggcctctgcagccaccctgtctgggcccacatcctcccttcaccccttcccagcagtggaaacccaggaaagttcctgaggttttctgtgcctcagcttcctcctaggtgaacacagagaataacaggacttacctcaaagggctgttgctagggaaagatgagtgggttcatcctgggaggcacacagaaaatgtccaataaacagtggccaccactggcttcctgtgcattcatcgtcatcatgctagggtcacgggggtcccttcagacccacacctccattctcaggagctgcctgcaggctcagccatcacctgggctggttactgggcagcctctcccacctgccccaactatgctcagtgacctccttcctgtcccctctcctgccatccctatcaccatggcatgagtaatgcacacgtgtattagtccattttcacactgctgataaagacatacccaagactgggcaatttacaaaagaaagaggtttgattggactcacagttccacatggctgaggaagccccacaatcatggtggaaggcaaggaggagcaagtcacgtcttacatggatggcagcaggcaaagagagaggacgtatgcagggaaactcctgtttttaaaaccatcagatctgccaggtgtggtggctcacacctgtaatcccagcactttgggaggctgaggcagggggatcacctgaggtcaggagttcaaaaccagcctgaccaacatgccagaaccccatctctagtaaaaatacaaaattagccaggcatagtggtgcattcctataatctcagctactcgggagactgaggcaggaggattgcttgaacccgggaggtggacgttgcagtgagccaagatcacgccactgcactccagcctgggcgacagagtgagactctgtctcaaaaaaaaaaaaaaaaaaaaatcaggtcttgtgagacttattcattatcaaaagaacagcgtgagaaagacttgcccccgtgactcagttacctcccaccaggtccctcccataacatgtgggaattcaagatgagatctgggtggaccatttcgacatgcacacacacaagggcatcacacacatacatgcacacgcacacaggtgcttgtcttcattaataggagagttgactcctcactgagtcccacaccccaaaccatcctatgcacctatcccaggagatggaggctccagggtggccaaggggtgtgaagagcaggcctggcctgggaggggaaggaggagagaggcaggaggaagaccatgtcactgtggagccttggactggagcctcctgtccctctcctttcttggttcccaaacttcttgggggtgacccaaactgagatggtggcctcgctctttatttccccaaggcttccccatcctccacttgggcctggctgcactctctgtcactccagccagggggtgggggcacaccaccaggcctgctggcgccgcagctctgataggtaataataggccaggttgatgtattatgaatgctggtggtttgtgtataaagcatttctcccagggtcttaagtgcgtgcgtgcgtgcgtgcatgcgtgtgtgtgtgtgtgcgcgtgcgtgcatgtggggctctcgggaagctctgtatctggaggggtgtgttattccgcaccctcgctatacacacattttctagaccgtaagtgctgtgatgcactaacctctaggtgctagaaccctgcacggcactgagtaagtactccataaatgtctatcaacttagcaagttagtgagtgatgctctattgtggacccctgaggcagtggctcctgaaggaggacggggccaccggcagagcagggcactcagaggggtcccctgcccggggagcatgtgccagaggagggggacatccctaaggaacaggccagaggacctgagctctccctggctgctctggaaggcggaggccccccagtttatccagtccctagagcaccccaggccagatctggggtgcgcctggcttggaggccatgtccttgctgccgcctctcctggggcctgcgtctgctcccaccctgccgcatgggccttagcaatcacttagccaggccgtgctgtggggccaggtcctccagctcataagtggcagccgcctctcagctccatgcccttcccaccccatgtcttggcaggtgagcacctgcacccaaggctcacagatgcttcagcaccaacctcattctttagaaagagtttgggggaggcttcatagattgaacacccgtccctgtagcacttgatcatagcaagacaaaatgtaaaacagcagatgaggccatggtgtaacgaactcccacacacacagcctgcagctgccctggggcccaggatgctggcccccaaaggtctgtcccagaagaggcattcgggaataagagtaacagcatgcgctctgccccagtcacttttctgagcactttacttgcattgggtgaatagcattatcatctccatgtcacagatgaggcaaccggggcacaggaagaataagtaacttgtccaaggcaacagagctaggaaggggcagagccaggtttgaacccaggaggctggctccagactgtcctttgccacctgggagggagctcaaggggctggggtgatgggctcccggctcctcccagggccccgctgtcctgatacctgattttcctccaccccgtccctctctccctcactcaggccaccagtgacttctgtgtggctcctgacaccttcatcctgaacgtcacggagggccagatcagcacaggtaactacacactctcaggctgctgctgtggatgcataggtggccggactctgtgcccctacttacctctttcagccctgtagccatccaacccctcctcaaccctgaacttcaagtccagctcatgctctaggccatttcctagaaagtgcctcccttgggagctcagggacggggagggaggtctggcttggccaccaaggatgatagagatctcatctggtcatttgtgagctgcctaacgttatgccgttgccctgcagaggtgactcgctactacctgtattgcagccagagtggaagcagccccttccagcaggtatggccccccgaggcctgccctcaccctgcccacagccgctcccccttgaccctaagcctcaccactgaccaagatggcggaggtggcagggccttgcttgcctcactgtggtcctctccttagctgcttctgtgaggggggcgtgcttttggtcgtgggttctagattggtggttaacacatatgcagctcaatgcgggagctagttcccatgcagatgctgtccaggagctctggggtggggccgagattctgtactactcacaagctcccaggtgaggccagggctgctggtccaaagaccacatctgagctgcaagcagggagaagactgtgcagctctcaagaagccagaggagtagggggagacttcctgcaagtggaggggcctgtgcagctgcagccaggtgggggggtgggaggggcaggagcataggcccctcagccactgtggggctcctgggagacggagcctcactgtggggctcctgggagacggagcctcactgtggggctgtgtctttcctggctcagaccctgaccaccttccagcgcgcacttaccaccatgcagatccaggtcgcggggctgctgcagtttgccgtgcccctcttctccactgcagaggtaaggcagctgtgcaggaagaggggagccccagatgaaccctgacagccctttcccctgccccggccccagggccaggctgtgcacagcttgctgctggctctctgttctcccgcccccgtgactcggctccctcccttggctctagaggcccctgagcacagctgctgtggtggttttctccgccagctctcctccacagcccctcggcctctctcgctctcttcccgcttcaggaagacctgcttgcaatccagctcctgctgaactcctcagagtccagccttcaccagctgaccgccatggtggactgccgagggctgcacaaggtgcatggggaccctggggtcacgtggagagtgtgagggcacccagcaggccacaccttccagagaaaagccggtagaggccgaggggagcgatggcctgggtccccttccggcccaggaatggaactgaagccagataatgggaagggagggggtgcctggcttctccaggggctgagacagggagactcagtacaagggaccaggggttcgggatgggagggttggatgcggttggctctgggtcactgggggaccctgaacaatgcaagggaggctgttccccattgtccagactcctagccatttcctcaacacatctgtctccctgggttgcaagtggatgtcccaatcccattgccagagtcttctttccaggaacttggaatatcagacagacacaatgatgcagggaacacatggggagcacgtgagagccccccacccaaaagcagtgagccagtgtatggcgacagctttcacatcccagatggatttagtgcagacagtctttgtcatcatcacagctgtcagctccatgcttggccctgttctgtgcattttatatccagtatgtcattcagttctcacagttatactgtgaaccacacgttatttcctaggaaattgacttgcttgtgcgtgtgtatggatagatccatagatacagctatgtgtgtgtgcacgtgcgtgtgtctgtgtgtgtgtgcgtgtgtgtgcacttgtggtgtatatgtctgtgcgtgtgtggtgtgtttctgcggttgtgtgggtgcacatatgtgatgtgtgtatgtatgtgtgtggtatgtgcatgcttgtgcgcatgtgtgctgtgcatgcgtgtgtgtggtgcatgtgtatgtgcctgtatgtgtgtgtggggtgtgtggtgtgtgcgtgtgtgtggtgtgtgcatgtctgtgatgtgtgtggtgtgtgtgcatgtgtgttgtgtgcacatgtgtgcacatgtatgtggtgtgtgtggtgcatgtgtgtgtgcatgtggggggtgcatgtgtgtggggggtgtgtgtgcgtgtatttataaagtggcttactgaagagtcccgagttggcacatcaggggcttgggtttagatcctggtagtctgacctcagagctaagaacatggcagtcacccctgtctcctctcttcttccccttctacatctaatccccagcaagtcttggcagctctcctctcagctgtaccctgaatccatccatttctctttctctccatggcttccaccacgatccggtcctgcccctccagcagacagtggcctcttcccactttctcttgccccctcaccacccatgagctttcacacatgcaaccagagcagtccttttgcagactaggttggatcacatcccttccactcccacaccctccaatgtctttctgactccttttaaaagtccgtactcctctcccgcattgcaaggcccagcacgacccagcccctgctggcctatgttctctctctttcctgaacaggccaagcctgtcccctttgccccctcttctcaaggtgtgctgcttcttgccatcctggcctcagcttcagtgcccccgtctctggttccccaccctgcaacctcctccgccctgttcagagccagcttcttagtgcccagctcacagtaagtgctcagcaaatgtttccagcgtgaacccaagaagccccattgtgttaggctccagagtgtggacctttaatggtgctgcaaggcgctcgggatggggagcagccaggagaccccaggtccaggctcgggggagagggacttccagaggagagctcggcccgcaggctttgcccccgctccttcactagctgcatgtccctcctcttcctccaggattatctggacgctcttgctggcatctgctacgacggcctccagggcttgctgtaccttggcctcttctccttcctggccgccctcgccttctccaccatgatctgtgcagggccaagggcctggaagcacttcaccaccaggtgggctgcctagtaaggaggggagcctcccacagcctggagttctgggagagcagcagacaggggcctctgctctacgatttagctgataacccaggactgaggagggcagcagagggcccgggcattcagcccaacaggctggctgacttctacagaagcttccccaagagtccacacagaccctccaaaggagttcggtggggcccagagcaagagctggggcccagggtggtgacagccctcaggccacagtctggcctcccttctcctctcttctcaccaggactttgcgatctggaatgaggagagttcttggtgctgggaggggtgccccaggaatagcaagaaggatacatggggtcactgttttcagggagcctgcagtccccttgaggagatgggcagggacacatggtgtacaggcacctggtgagcggattaggcaagaggacgcagggtagtggggacccacatgcgcatggtcagcgtggtggggagcctggaagagctggtcgtgaagctgggaatgggccagaatgatctgcaggaggcaggctggggaccgcgttttagaggagtctcaaggagacacgcgtggccagagagtcctgggaggaaaggcagggaagtaggacaggacctggctgcctcggagcctccttcacccttcacagccggccatcttctacccattgttctagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgtacggcctgcacacacacccaggctgggtagcactgcccggacagcatgttgggtggggtccacagtgccgggtgtggggaggaaggcatccaaggccacccgtggtccccactacagccacagggtgcctggagggaaggcccccggggagcatctagtcacccctccacacccacatgtgctgggggaagaaaccactgatgtcagcagcctctgccacaagctggtgggacaggtctcaggcccaaaaagctgcatttctccaggccatgctgctcccagcctccgttgcccatcagccacttgtccccaggcttcccaaggtgctcttctccatatctgcccactgcaccccctccactctatctgtggtttggttccatcccccacctcccatgtgctcacccatgggaccctcctgtagaaatctacacacacccccactcccacaccatcccctcctgagctctcctctcatccccgcaggaaccaagccatgctctttggtaggaacccacgctacgagaacgtgccactaatcgggagagcctcccctccgcctacggtaattggggctctggcccttccttgttggggtaatacataaagacaaaacctcctgccaacccagtgaatcctgtccacaaaggcagaaaagaatgaaactgttctgttattgaatatgcactaaaccagaccgtcgtgggtatcccaggcagtccgctaaggagattgcaaagatgcaagaaatctcactccttcccctagccaggcaggaacaagacacagcccactgcatacctgtcatccagcaagaggacttgacggcactgtttgtcacagtagtccaccttaatccacttgctaattggggtggccatcctggttaagtaattgcctttatttatttatttatttattttttgaggcagaatctcactctattgcccaggctggggtgcagtggcgcaatatcggcttactgcaacccaggtttcaagcaattatcctgcctcagcctcccaagtaggtgggactacaggtgcgtgccacaacgccaggctaatttttgtatttttagtagagatggggtttctccatgatggccaggctggtctcaaacttctgacctcaggtgatccacccgcctcggcctcccaaagtgctgggattacaggcatgagccaccgcgcccggccagctaattgcctttatccagaggaaaaataaaactcctatttccgtgacaatcagatagctacaacttggagccaggcccctaagtgaactgtcactgagaaggagatgaggtgctgtcttcctgatgtttgtacttccaagagatggctcccagacctgaaaaaaccatacctggattgtaacactggcaagggccatattcagcctttaagaaggtttgcagacatctcaaaagacagaaattatttacaatgataagttttctaaaggaaatactgcaagaagagagggggtctctttccctttttgctccagagaaaattaaggaattttttttctttttagatttctgtttaccttaatccttggtctcttttgggctggacggtgggttggctgtggtggcgggtctgggagggctgaacccaaacacagccttcctcaatccgtctcagctccccatgtccctaggactgtgcccaagtagggccagtgcctcttgtccaccccaccacctccagccagagtacctgagatacagcctcaggggagtagctcagggtgggcaggttgagaaggaaagactatgctgtctcatcccagagaagtatccaaaggacacagaaatactggctgagacaaagaaagctgtaaacagacagtgaagtgaccgccaaggttcagggacacggactccagtgccaaaggcctgggttcaaatcccagctcatggcttatggcctctgtgactttggacaagcactttgctgctctgtgcctcagtttccccatctatagaatgagtatgggaatactagcacattcctcctcggtggtgtgtgcaatgggcaaattgattgttatcagagcgtacgtgcgaagcatccagtgagtgccgtaggacagtgagctgttatttgtgactttcttccaccccaccttctccacagagctgtggcatttatcaattttattttattttttattttttatttttttttgagacggagtctcactcttctgcccaggctggagtgcagtgatgtcatctcagctcactacaacctccacctcccaggttcaagtgattctcctgcctcagcctccctactagctgggattacaggcatgcaccaccacacctggctaatttttgtatttttagcagagacagggctggctggtcttgaactcctgacctcaggtgatccacccatcttggcctcccaaagtgctgggattacaggcatgagccaccgtgcccggccagagctgtggcatttataagaaaggacaaggggaatgaaaggccagaagtctgccatggggtgggcagaagggtcctggagccaggcatctcccttcattgggcctggcgaggcatttcagtgccccgacccagatagtttggaaggggacatccaacaggaaagcagaagcactggggcccaaatacctgggaccagcgtgatagacctgggccctgaggacccaggaagtgcacgcacaggcacccagggagtcagcttcccggtcatggcgcttggtgaaaatcatagtgtcagacccgagaaaagagcaagtggaacccagtccctgtcttcaggaagttccagtctatagaaggggcactcaagaaggctgcctgtagaaagtgctacaaggtactttgggaccagaaagaaggagccatctttgctgctgctctaggggattccagaaggttctatttaataggtggcgtttgagccacagtgtagagcaggggctcacccaggggcagttttcccccctggggacatttggcaatgtctggaggcattttcattaccacgcttggaggctggggatgggggctggatgctattgacatctagggagtggagcacccaccacaaagcacggtgcagccccaaatgcccataggttatggggcctgtcctctgcgtgtgggatgttcagcagcatccctggcctctacctgctagcaagcctgctggaaccaatccccctgtcattcactcctgtgccaccaccttggtgcttttgcctggagcacctcacctgctgtcccatcccacagctttacaaacacaagccccagcctcatgtcgttctttcttcctggggtccccgggagtgggctggttgaacctgtattcaaagtcagcaccatttattatttatgtttatttttttgagacagagtatcactctgtgacctaggctggagtacgtggtgcaatctcagctcactgcatcctccacctcctgagttcaagcaattctcatgcctcagcctcccaagtacttgggactataggcacgtgccatcacacccagctaatctttgcattttcagtagagacggggtttcgccatgcaggccaggctagtctctaactcctggcctcaagtgatgcacctgccttggcctcccaaagtgctggggttacaggcatgagccaccacgcccagcctaaaagtcagcaccttttaaatgccagcctagcttctctcactaatcagaagcctcccgggttcctttttccaaccaccagctgccgtggccccaggaatgcagattgactttaatattaatctaagcacaacgtaattaggggaaatctgctgtgaaaaaagaattactctatgcactgtgatgccaaataaaaatgattttcagattcccttctgtttgaaagatccaggccactcatcctgccgttagcagagataatcagcaactgaccttatttgcaaggctcaaggacagaaaacccttcctccctagatttaagacctgcccagaaacacttattgctttggccaagttgactgcccagtcccacctagcccagcctgccctgggaagacccttccacctccatgcccggtaagggacctagagagacatctaatgatgccgcagaccaaggaaccccacagcatggagggtgtgggtgtctgccccagtaaagacagcacagctggctgcgccccaccctccccggggcgcctgctctaaacactccttagcaccgagcaagttcgagaggtggataaactcctccctctgccgagcaccctctctgggacagtcaggggacctcactgggtgggtgatgtcacgcctggtgatcgggatatacagcctgtcccttgctggaaatgtttcttcccccagctctgccttcaaggaataatctctcctgtccttttaggcactgtttcttggacttgatgaacaaaaatgacccagggcagttaaagatactgacgttgagacttctcttcagacttacagaaacagaatatcttggggaaggagcctgggagattctaagtttaacaaacttattatcattcaagttgggaaatattgctttaagaaggagggtcttggccagcaccatgcctcatgcctgtaatcccagcactttgggaggccaaggcaggtggatcacttgaggccaggagctcgagaccagcctggtcaacatggtgaaaccccgtctctactaaaaatacaaaaattagctgggcatggtgatgggtgcctgtaatcccacctactcgggaggctgaggcaggagaatcacttgaacccaggaggcggaggttgtagtgagctgagattgcaccactgcactccagcctgggtgacagagtgagattctgtctcaaagaaaataaaaaagaagaaggagggtctcatacttgcgtatgcatcagaatcgcctgagggacccaccctgtttctgattcagaaaatctgagttggagcctggagatgtgccttttttgtttttttgagactgagtttcactcttgttgcccaggctggagtgcagtggcataatctcggctcactgcaacctccgctccccaggaccaagcgattctcctgcctcagcctcctgagtagctgagattacaggcccccaccaccacgcccagctgactttttgtatttttagtagagacagggtttcaccatgttggccaggctggtcttgaactcctgagctctggtgatccacctgtctcggcttcccaaagtgctgggattacaggtgtgagccaccgtgcctggccggagatgtgcgtgtctgacatattcctaggtaaagctgctgctgctgccctggaaaccacgcttggagaaccactgctctgaggccagcttcttcagcctcagtgctattgatgggcagcgtcattctcggtggggggttcctgtacattgtaggacgtctagcagcatccctggcatctacttgctacatgccagtggcagcccagtgcccagttgtgacaaccagaatatctccagacattgcctaatgcccctgggaggtaaaaacatccctggttgagacccactgggtcgaaaacctcatgctccctcctccccaaccccagcccaagtggaagcattccattccccctgatgtgaatggcctggacccctgaagcttcccgggtcaggagagtggcagtttctggaagcttgttagaagtgcagaatctcaggtcctgtggacaagatccccaggtagcctgtgtgcagggtatagagtgaaaggccctctccactgccaaggacgagtaactaagttctgtcaggcacctactctgtactgggtcatgctcctccaacttgaatgcacactggaattgcctaaagagctctaaaaacactgatagctctttaaattcattttatgttatgtgtgtggtctttgtttttttttaagagagagggtctcgctccgttgcccagggtgaagtgcagtggtgtgatcttagcttgctgcaacctccacctcttgggctcaagtaccttctcctcctgcctcagcctcccaagtggctgggactacaggtgcatgccaccatgcccagctaattttttgtatttttgatagagacaggattttgccattttgcccaggctggtctcgaactcctgggctcaaacgatcctcctgcctctgtctcctaaagtgctgggattacaggtatgaatcaccaccgttatgtgcattttgcatcaacaaaaatatacatatttatatactagtggatgtggcctgggcatcgggatgtttttaggctccccaggtgtttctggcgagcagcccagtttgagagcagctgtgttattaaggctcttccctgctccatatcatttcgccctttcaacgtaagagctgggtgctcttatgtccattttgcaggtagggaaactgaggctagaaaaggctggagaacctaagccaaggtcacggggtaagatgcacagctgggatttgaacctgcttctctgagtctctgggcctctgccctcagcctgctggctgctgactgctcctccgtgcgctggtggaccctgacgctgcccccagtgtgaggggacaggctggatgctgggggtgtgtgctggggcggagtggacattggaggacagctggtctgtgtgtgcattttttatttgaggctgggaggcagaagtcttgatggatgtggggtggaggcacggccgggtttccctctgacacccgacccagttccactctgagaagtccccggcacctttgctggtgcagtgcttggctgactcagctctgaccatcccctctcttctctcttggcagtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtactaa

SEQ ID NO: 361 - DNA, 13653 bp, Homo sapiens
cacttagccaggccgtgctgtggggccaggtcctccagctcataagtggcagccgcctctcagctccatgcccttcccaccccatgtcttggcaggtgagcacctgcacccaaggctcacagatgcttcagcaccaacctcattctttagaaagagtttgggggaggcttcatagattgaacacccgtccctgtagcacttgatcatagcaagacaaaatgtaaaacagcagatgaggccatggtgtaacgaactcccacacacacagcctgcagctgccctggggcccaggatgctggcccccaaaggtctgtcccagaagaggcattcgggaataagagtaacagcatgcgctctgccccagtcacttttctgagcactttacttgcattgggtgaatagcattatcatctccatgtcacagatgaggcaaccggggcacaggaagaataagtaacttgtccaaggcaacagagctaggaaggggcagagccaggtttgaacccaggaggctggctccagactgtcctttgccacctgggagggagctcaaggggctggggtgatgggctcccggctcctcccagggccccgctgtcctgatacctgattttcctccaccccgtccctctctccctcactcaggccaccagtgacttctgtgtggctcctgacaccttcatcctgaacgtcacggagggccagatcagcacaggtaactacacactctcaggctgctgctgtggatgcataggtggccggactctgtgcccctacttacctctttcagccctgtagccatccaacccctcctcaaccctgaacttcaagtccagctcatgctctaggccatttcctagaaagtgcctcccttgggagctcagggacggggagggaggtctggcttggccaccaaggatgatagagatctcatctggtcatttgtgagctgcctaacgttatgccgttgccctgcagaggtgactcgctactacctgtattgcagccagagtggaagcagccccttccagcaggtatggccccccgaggcctgccctcaccctgcccacagccgctcccccttgaccctaagcctcaccactgaccaagatggcggaggtggcagggccttgcttgcctcactgtggtcctctccttagctgcttctgtgaggggggcgtgcttttggtcgtgggttctagattggtggttaacacatatgcagctcaatgcgggagctagttcccatgcagatgctgtccaggagctctggggtggggccgagattctgtactactcacaagctcccaggtgaggccagggctgctggtccaaagaccacatctgagctgcaagcagggagaagactgtgcagctctcaagaagccagaggagtagggggagacttcctgcaagtggaggggcctgtgcagctgcagccaggtgggggggtgggaggggcaggagcataggcccctcagccactgtggggctcctgggagacggagcctcactgtggggctcctgggagacggagcctcactgtggggctgtgtctttcctggctcagaccctgaccaccttccagcgcgcacttaccaccatgcagatccaggtcgcggggctgctgcagtttgccgtgcccctcttctccactgcagaggtaaggcagctgtgcaggaagaggggagccccagatgaaccctgacagccctttcccctgccccggccccagggccaggctgtgcacagcttgctgctggctctctgttctcccgcccccgtgactcggctccctcccttggctctagaggcccctgagcacagctgctgtggtggttttctccgccagctctcctccacagcccctcggcctctctcgctctcttcccgcttcaggaagacctgcttgcaatccagctcctgctgaactcctcagagtccagccttcaccagctgaccgccatggtggactgccgagggctgcacaaggtgcatggggaccctggggtcacgtggagagtgtgagggcacccagcaggccacaccttccagagaaaagccggtagaggccgaggggagcgatggcctgggtccccttccggcccaggaatggaactgaagccagataatgggaagggagggggtgcctggcttctccaggggctgagacagggagactcagtacaagggaccaggggttcgggatgggagggttggatgcggttggctctgggtcactgggggaccctgaacaatgcaagggaggctgttccccattgtccagactcctagccatttcctcaacacatctgtctccctgggttgcaagtggatgtcccaatcccattgccagagtcttctttccaggaacttggaatatcagacagacacaatgatgcagggaacacatggggagcacgtgagagccccccacccaaaagcagtgagccagtgtatggcgacagctttcacatcccagatggatttagtgcagacagtctttgtcatcatcacagctgtcagctccatgcttggccctgttctgtgcattttatatccagtatgtcattcagttctcacagttatactgtgaaccacacgttatttcctaggaaattgacttgcttgtgcgtgtgtatggatagatccatagatacagctatgtgtgtgtgcacgtgcgtgtgtctgtgtgtgtgtgcgtgtgtgtgcacttgtggtgtatatgtctgtgcgtgtgtggtgtgtttctgcggttgtgtgggtgcacatatgtgatgtgtgtatgtatgtgtgtggtatgtgcatgcttgtgcgcatgtgtgctgtgcatgcgtgtgtgtggtgcatgtgtatgtgcctgtatgtgtgtgtggggtgtgtggtgtgtgcgtgtgtgtggtgtgtgcatgtctgtgatgtgtgtggtgtgtgtgcatgtgtgttgtgtgcacatgtgtgcacatgtatgtggtgtgtgtggtgcatgtgtgtgtgcatgtggggggtgcatgtgtgtggggggtgtgtgtgcgtgtatttataaagtggcttactgaagagtcccgagttggcacatcaggggcttgggtttagatcctggtagtctgacctcagagctaagaacatggcagtcacccctgtctcctctcttcttccccttctacatctaatccccagcaagtcttggcagctctcctctcagctgtaccctgaatccatccatttctctttctctccatggcttccaccacgatccggtcctgcccctccagcagacagtggcctcttcccactttctcttgccccctcaccacccatgagctttcacacatgcaaccagagcagtccttttgcagactaggttggatcacatcccttccactcccacaccctccaatgtctttctgactccttttaaaagtccgtactcctctcccgcattgcaaggcccagcacgacccagcccctgctggcctatgttctctctctttcctgaacaggccaagcctgtcccctttgccccctcttctcaaggtgtgctgcttcttgccatcctggcctcagcttcagtgcccccgtctctggttccccaccctgcaacctcctccgccctgttcagagccagcttcttagtgcccagctcacagtaagtgctcagcaaatgtttccagcgtgaacccaagaagccccattgtgttaggctccagagtgtggacctttaatggtgctgcaaggcgctcgggatggggagcagccaggagaccccaggtccaggctcgggggagagggacttccagaggagagctcggcccgcaggctttgcccccgctccttcactagctgcatgtccctcctcttcctccaggattatctggacgctcttgctggcatctgctacgacggcctccagggcttgctgtaccttggcctcttctccttcctggccgccctcgccttctccaccatgatctgtgcagggccaagggcctggaagcacttcaccaccaggtgggctgcctagtaaggaggggagcctcccacagcctggagttctgggagagcagcagacaggggcctctgctctacgatttagctgataacccaggactgaggagggcagcagagggcccgggcattcagcccaacaggctggctgacttctacagaagcttccccaagagtccacacagaccctccaaaggagttcggtggggcccagagcaagagctggggcccagggtggtgacagccctcaggccacagtctggcctcccttctcctctcttctcaccaggactttgcgatctggaatgaggagagttcttggtgctgggaggggtgccccaggaatagcaagaaggatacatggggtcactgttttcagggagcctgcagtccccttgaggagatgggcagggacacatggtgtacaggcacctggtgagcggattaggcaagaggacgcagggtagtggggacccacatgcgcatggtcagcgtggtggggagcctggaagagctggtcgtgaagctgggaatgggccagaatgatctgcaggaggcaggctggggaccgcgttttagaggagtctcaaggagacacgcgtggccagagagtcctgggaggaaaggcagggaagtaggacaggacctggctgcctcggagcctccttcacccttcacagccggccatcttctacccattgttctagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgtacggcctgcacacacacccaggctgggtagcactgcccggacagcatgttgggtggggtccacagtgccgggtgtggggaggaaggcatccaaggccacccgtggtccccactacagccacagggtgcctggagggaaggcccccggggagcatctagtcacccctccacacccacatgtgctgggggaagaaaccactgatgtcagcagcctctgccacaagctggtgggacaggtctcaggcccaaaaagctgcatttctccaggccatgctgctcccagcctccgttgcccatcagccacttgtccccaggcttcccaaggtgctcttctccatatctgcccactgcaccccctccactctatctgtggtttggttccatcccccacctcccatgtgctcacccatgggaccctcctgtagaaatctacacacacccccactcccacaccatcccctcctgagctctcctctcatccccgcaggaaccaagccatgctctttggtaggaacccacgctacgagaacgtgccactaatcgggagagcctcccctccgcctacggtaattggggctctggcccttccttgttggggtaatacataaagacaaaacctcctgccaacccagtgaatcctgtccacaaaggcagaaaagaatgaaactgttctgttattgaatatgcactaaaccagaccgtcgtgggtatcccaggcagtccgctaaggagattgcaaagatgcaagaaatctcactccttcccctagccaggcaggaacaagacacagcccactgcatacctgtcatccagcaagaggacttgacggcactgtttgtcacagtagtccaccttaatccacttgctaattggggtggccatcctggttaagtaattgcctttatttatttatttatttattttttgaggcagaatctcactctattgcccaggctggggtgcagtggcgcaatatcggcttactgcaacccaggtttcaagcaattatcctgcctcagcctcccaagtaggtgggactacaggtgcgtgccacaacgccaggctaatttttgtatttttagtagagatggggtttctccatgatggccaggctggtctcaaacttctgacctcaggtgatccacccgcctcggcctcccaaagtgctgggattacaggcatgagccaccgcgcccggccagctaattgcctttatccagaggaaaaataaaactcctatttccgtgacaatcagatagctacaacttggagccaggcccctaagtgaactgtcactgagaaggagatgaggtgctgtcttcctgatgtttgtacttccaagagatggctcccagacctgaaaaaaccatacctggattgtaacactggcaagggccatattcagcctttaagaaggtttgcagacatctcaaaagacagaaattatttacaatgataagttttctaaaggaaatactgcaagaagagagggggtctctttccctttttgctccagagaaaattaaggaattttttttctttttagatttctgtttaccttaatccttggtctcttttgggctggacggtgggttggctgtggtggcgggtctgggagggctgaacccaaacacagccttcctcaatccgtctcagctccccatgtccctaggactgtgcccaagtagggccagtgcctcttgtccaccccaccacctccagccagagtacctgagatacagcctcaggggagtagctcagggtgggcaggttgagaaggaaagactatgctgtctcatcccagagaagtatccaaaggacacagaaatactggctgagacaaagaaagctgtaaacagacagtgaagtgaccgccaaggttcagggacacggactccagtgccaaaggcctgggttcaaatcccagctcatggcttatggcctctgtgactttggacaagcactttgctgctctgtgcctcagtttccccatctatagaatgagtatgggaatactagcacattcctcctcggtggtgtgtgcaatgggcaaattgattgttatcagagcgtacgtgcgaagcatccagtgagtgccgtaggacagtgagctgttatttgtgactttcttccaccccaccttctccacagagctgtggcatttatcaattttattttattttttattttttatttttttttgagacggagtctcactcttctgcccaggctggagtgcagtgatgtcatctcagctcactacaacctccacctcccaggttcaagtgattctcctgcctcagcctccctactagctgggattacaggcatgcaccaccacacctggctaatttttgtatttttagcagagacagggctggctggtcttgaactcctgacctcaggtgatccacccatcttggcctcccaaagtgctgggattacaggcatgagccaccgtgcccggccagagctgtggcatttataagaaaggacaaggggaatgaaaggccagaagtctgccatggggtgggcagaagggtcctggagccaggcatctcccttcattgggcctggcgaggcatttcagtgccccgacccagatagtttggaaggggacatccaacaggaaagcagaagcactggggcccaaatacctgggaccagcgtgatagacctgggccctgaggacccaggaagtgcacgcacaggcacccagggagtcagcttcccggtcatggcgcttggtgaaaatcatagtgtcagacccgagaaaagagcaagtggaacccagtccctgtcttcaggaagttccagtctatagaaggggcactcaagaaggctgcctgtagaaagtgctacaaggtactttgggaccagaaagaaggagccatctttgctgctgctctaggggattccagaaggttctatttaataggtggcgtttgagccacagtgtagagcaggggctcacccaggggcagttttcccccctggggacatttggcaatgtctggaggcattttcattaccacgcttggaggctggggatgggggctggatgctattgacatctagggagtggagcacccaccacaaagcacggtgcagccccaaatgcccataggttatggggcctgtcctctgcgtgtgggatgttcagcagcatccctggcctctacctgctagcaagcctgctggaaccaatccccctgtcattcactcctgtgccaccaccttggtgcttttgcctggagcacctcacctgctgtcccatcccacagctttacaaacacaagccccagcctcatgtcgttctttcttcctggggtccccgggagtgggctggttgaacctgtattcaaagtcagcaccatttattatttatgtttatttttttgagacagagtatcactctgtgacctaggctggagtacgtggtgcaatctcagctcactgcatcctccacctcctgagttcaagcaattctcatgcctcagcctcccaagtacttgggactataggcacgtgccatcacacccagctaatctttgcattttcagtagagacggggtttcgccatgcaggccaggctagtctctaactcctggcctcaagtgatgcacctgccttggcctcccaaagtgctggggttacaggcatgagccaccacgcccagcctaaaagtcagcaccttttaaatgccagcctagcttctctcactaatcagaagcctcccgggttcctttttccaaccaccagctgccgtggccccaggaatgcagattgactttaatattaatctaagcacaacgtaattaggggaaatctgctgtgaaaaaagaattactctatgcactgtgatgccaaataaaaatgattttcagattcccttctgtttgaaagatccaggccactcatcctgccgttagcagagataatcagcaactgaccttatttgcaaggctcaaggacagaaaacccttcctccctagatttaagacctgcccagaaacacttattgctttggccaagttgactgcccagtcccacctagcccagcctgccctgggaagacccttccacctccatgcccggtaagggacctagagagacatctaatgatgccgcagaccaaggaaccccacagcatggagggtgtgggtgtctgccccagtaaagacagcacagctggctgcgccccaccctccccggggcgcctgctctaaacactccttagcaccgagcaagttcgagaggtggataaactcctccctctgccgagcaccctctctgggacagtcaggggacctcactgggtgggtgatgtcacgcctggtgatcgggatatacagcctgtcccttgctggaaatgtttcttcccccagctctgccttcaaggaataatctctcctgtccttttaggcactgtttcttggacttgatgaacaaaaatgacccagggcagttaaagatactgacgttgagacttctcttcagacttacagaaacagaatatcttggggaaggagcctgggagattctaagtttaacaaacttattatcattcaagttgggaaatattgctttaagaaggagggtcttggccagcaccatgcctcatgcctgtaatcccagcactttgggaggccaaggcaggtggatcacttgaggccaggagctcgagaccagcctggtcaacatggtgaaaccccgtctctactaaaaatacaaaaattagctgggcatggtgatgggtgcctgtaatcccacctactcgggaggctgaggcaggagaatcacttgaacccaggaggcggaggttgtagtgagctgagattgcaccactgcactccagcctgggtgacagagtgagattctgtctcaaagaaaataaaaaagaagaaggagggtctcatacttgcgtatgcatcagaatcgcctgagggacccaccctgtttctgattcagaaaatctgagttggagcctggagatgtgccttttttgtttttttgagactgagtttcactcttgttgcccaggctggagtgcagtggcataatctcggctcactgcaacctccgctccccaggaccaagcgattctcctgcctcagcctcctgagtagctgagattacaggcccccaccaccacgcccagctgactttttgtatttttagtagagacagggtttcaccatgttggccaggctggtcttgaactcctgagctctggtgatccacctgtctcggcttcccaaagtgctgggattacaggtgtgagccaccgtgcctggccggagatgtgcgtgtctgacatattcctaggtaaagctgctgctgctgccctggaaaccacgcttggagaaccactgctctgaggccagcttcttcagcctcagtgctattgatgggcagcgtcattctcggtggggggttcctgtacattgtaggacgtctagcagcatccctggcatctacttgctacatgccagtggcagcccagtgcccagttgtgacaaccagaatatctccagacattgcctaatgcccctgggaggtaaaaacatccctggttgagacccactgggtcgaaaacctcatgctccctcctccccaaccccagcccaagtggaagcattccattccccctgatgtgaatggcctggacccctgaagcttcccgggtcaggagagtggcagtttctggaagcttgttagaagtgcagaatctcaggtcctgtggacaagatccccaggtagcctgtgtgcagggtatagagtgaaaggccctctccactgccaaggacgagtaactaagttctgtcaggcacctactctgtactgggtcatgctcctccaacttgaatgcacactggaattgcctaaagagctctaaaaacactgatagctctttaaattcattttatgttatgtgtgtggtctttgtttttttttaagagagagggtctcgctccgttgcccagggtgaagtgcagtggtgtgatcttagcttgctgcaacctccacctcttgggctcaagtaccttctcctcctgcctcagcctcccaagtggctgggactacaggtgcatgccaccatgcccagctaattttttgtatttttgatagagacaggattttgccattttgcccaggctggtctcgaactcctgggctcaaacgatcctcctgcctctgtctcctaaagtgctgggattacaggtatgaatcaccaccgttatgtgcattttgcatcaacaaaaatatacatatttatatactagtggatgtggcctgggcatcgggatgtttttaggctccccaggtgtttctggcgagcagcccagtttgagagcagctgtgttattaaggctcttccctgctccatatcatttcgccctttcaacgtaagagctgggtgctcttatgtccattttgcaggtagggaaactgaggctagaaaaggctggagaacctaagccaaggtcacggggtaagatgcacagctgggatttgaacctgcttctctgagtctctgggcctctgccctcagcctgctggctgctgactgctcctccgtgcgctggtggaccctgacgctgcccccagtgtgaggggacaggctggatgctgggggtgtgtgctggggcggagtggacattggaggacagctggtctgtgtgtgcattttttatttgaggctgggaggcagaagtcttgatggatgtggggtggaggcacggccgggtttccctctgacacccgacccagttccactctgagaagtccccggcacctttgctggtgcagtgcttggctgactcagctctgaccatcccctctcttctctcttggcagtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtactaa

SEQ ID NO: 362 - DNA, 40638 bp, Homo sapiens
caagcaaccggtaaacgccgccgtttgaggagcaccggagccgcgaccgtggattgaacgcttccccagagacccagaagcagaaggagcggacccagggtaaggggcgggcgccaggaggacgtcggaggctaaagactagagtggagagtgacagggagagacttacagggtaataaccaccaagagtgccaaacattcctcttggggggcttccttctgggatagctctgccagatggtggctgccaggactagcgctcctagtgccctcttccccttagtcctcgctgccctggatccgccccaagtcgcaggaccctgcagcctctgtacaccctgcctcataccctcctacccactcaggtcctgatacagtccttgtcctggagtggactggagacctctgaaggatttacagctgaatggatggaaaaaaaagaagaaaaacagcctccggctagggtgatgggaagatgggccctttaagaggagagctttctgctcaggatagagggatgtaaattaacagtattgcacacctgctaggtggcaggtgttttaagtgctttctttcatttcttcctcaacctgggagctggcgttctcgtgtgatcgaggtcatacagttggtgagttcctccggagcgtgtgcagttcctccttcctgctcaaggtcaaggtttaccacattctcttgaaccacagaagtgcgtcttctcccagctttcagaccctatgtgttttcctctcgaatccttggtttcaaatcctttgcttgtttgtcacggtcagcagaggaggaacaggggagagagctgtagagagaagcctggtaggcgctggtatcacagtcactaacgcagcaggtgacaggagtcttgggccccttctatgtgccagtccctggggacgggagtgaataaaagaccacagtctttccgtcaaggagaccacaaggtagttgtgagggcaggtagtcactgacccccatcggtctccaattctggggacctcttcccaactcgtcctgccctcaaccttcactttccttggggggctcagccatgcttagtgctatcctgggggaaaataaatgggggctttctagggaggtctgcctcttttgagggtagagtgagtccctcaggaccccggaattccagaaggtgcacaaggacataagaaagagaaagaaagctgggtgcggttttcacacctgtaatcccagtgctttgagaggcccaggaggatggatcacttgaggtcaggagtttgagaccagcctgcccaacatggtgaaaccccatctttactaaaaatacaaaaattctggccgggtgcagtggctcacgcctgtagtcccagctactcggcaggtggaggcagaagaattgcttaaacctgggaggtggaggttgcagtgagctgagatcaggccactgcactccagcctaggtgacagactgagactccgtctcaaaaaaaaaaaaaattagccgagtgtggtggcatgcaccagtagtctcagctactcaggagactgaggcacaagaatcgcttgaacttgggaggcagaggttggagtgagccaatatcacaccactgcactccagcctgggtgacagagcaacactgtcccaaaagcaacaacaacaaagaaagagggaaggaagtcctctcctgccaggtgccatgcagggcccaccactcgcaggaacccagtaggggctgtaccagggaccaagaagaagaggaaaatgttctcatctccttattccactagggagttcaatgtggagggctgaccttccagcttgcctccttcccagtctcccacgctgacactcctcctccccatcactcccttggccttcctcccagcttggaaaacacactttcccttaagccaccggaggttctctccaggaattactttgctcattctcactgcacaagacgagttttgtttttatagtgagtgaaggttcccatctgactgcctccccggggatgcgggagacgcctgaatctttgatgtctggaccacagcgtccctgattctgcgtgttcctgtgtttgagactcacagtggtgttcttcacgcctctgggactctaggttcccacggggggaggatctccccccaaaactccagagggcagtgacactgctcccgtccccgctctgtcaccccatgcagacactcctgctcaggccttgcttggggaagcccaccctctagcactagtctcacaagaggttgggggagacctcctgagacgccctttgctgaccttgctattcatctgtgtgccctgctagcttgtgagaagagcttgctctgggtccttgaatgggttgtcttcccgtcaccaggccagtctttaaatgtcccctctgtctgcctccagacacaagacaatgcctctgttctcactcggggcttggccttgggaaacaccaagaaggaaagcaaagctgttaaaaatctgatctgggctaaagaggctatttctgtcttcctggagtttcctcattctcttcaatctccttgtgtcccctaggagccagctggcttgcagcaatttcttttaaaagtcagagacaggcagccctaattgcctgagtcctgcagccccatgtgggaggcacagttgcttcacactgtgttggcaaaggggaggatgccacgggatttgcatgctttttcacaaggccgtagctttgtccatgtggtaaaaacacactggggcaccccgctacaatctgggcttctcatcccaccctgtgccctctaagccattgctcccacccaggaaagagaatttccaaactacaagaaagagaagaaaacaaggctgggtgcggtggctcatgcctgtaatcccagcactttgggaggccgaggtgggcggatcacttgagatcaggagttcaagaacagcctggccaacatgctgaaaccctgtctctactaaaaatacaaaaattagccgcgaatggtggcatgtgcctgtaatcccagctacgggaggctgaggcaggagaatcgcttgcacccgggagacggagtttgcaatgagcctagatcttgccactgcactccagcctggacgacagagcgagaatccatctcaaaaaaaaaaaaaaaaagaaaaaagaaaaaaagaaagaaaatgccactttctgcaacagtctggttaaggttgagttgctctggggctaggagtgggatggggtggtactgtcttcaagacacaatgtatatggatgcaaagggttaaccttcctaccctccttctccccacctgctgccccagctgctccagggcccaagttccccctggcacatgcttctaggggcacacagctcctgccctgcctctcaggggccagcggccaggacccactggtctggtgccttgtagccctggaggcgggagagggtaggtaagacacaggtctggtagtcatgttcacctagggtgattgtgaaaaacacgaattgctaggccctgccccaggcatctagttcagcatttgcaggagagaggcctgggagtctgtgtatttttaaggaagatcccaggtttcagaaacgctggttgagagattaagttccctcactttaaatcaatggtcctcaaagttggctacacatggaattgcctggagaattaaagaaaaaaagcatatactgatgagagattctgatgtagttgttctggggttcaaacagcattgtgatttcacaaagccctgcaggtgtttctaaatgtgcagtcaggactaacaatcactgctttagagccagacatgcctggtggttctgcctgaactgaagaactgtgacctttggccctgtattaatacttcatctctccaggcctcagtttcttcatctcgaaaatgggctcatgcctataatcccagcactttgggaggctgaggcaggaggatcacttgagcccaggagtttgagacaagcctgggcaacatagtgagaccctcaactctacaaaaaaaaaaaaattagtctgatgtggtagtgtctgcctgtggtcccagttactcagaaggctgaggtgggaggattgcttgagcctgggaggttgaggctgcagcaagctgtgttcatgccactgcactccagcctggatgacagagcaagacactgtctcataaaaagaaatgttagtgagaattgtgatcactctttgggagtggtgctgggcatgcaggaagcacgcctggaaactgttgttcatagtgcttgcaacctggtcagtctttacatattctggatgcaagttctttatcaaatagataatttgcagatattttatccaagtctgtggcttctctttttgttaacattgttggccgggcatggtggcgcatacctgtaatcccagctactctggaggctgaagcaggagaaccacttgaacgcaggaggcggaggttgcagtgagcagatatgccactccactccagcatgggtaacaaaatgagattccatctcaaaaaaaaagaaagaaaagaaaagaaagaatgaataagacctactatttgataggacaacaaggtgacaacagtcagcaataacttaattgtacatttaaaaataactaacaggccgggcgcggtggctcacgcctgtaatcccagcattttgggaggccaaggtgggtggatcatgaggtcaggagatcgagaccatcctggctaacacggtgaaaccccatctctactaaaaatacaaaaaattagccgggtgtggtggtgggcacctgtagtcccagctacttgggaggctgaggcagaagaatggcgtgaacccgggaggcggagcttgcagtgagctgagatcgtgccactgcactccagcctgggtgacagagggagactccgtctcaaaataaataaataaataaaaataactaacaaaggataaattcttgaggggatggataccccattctccatgatgtgactattaatatctagtatttgatagcacaacagggtgactatagtcaaaataatttaattatacatttaaaaatagctgaaagagtataactggattgtttgtaacacaaaggataaatgcttgaggggatggatggataccccatttcccatgattgtatattgtatattgcatgcctatagcaaaacatctcctgtgccccataaatatatacacctactatgtaaccacaaaaattaaaaattaaaaaaaaatagcaaaacctgctcacaggcaaacctgctcacgtaatcctgtttttgagatagagtcttgctctgtcatccaggctggagtgcagtggcacaatctcgactcactgcaacgtctaccttccaggtttaagcgattctcctacctcagcctcctgagtagctgtgattacaggcacgtgccaccatgcctggataatttttggtatttttagtagagatgggttttcgccatgttggccaggctggtcttgaactcctgacctcaagtgatccaccggcctcggccacccaaagtgctgggattataggcatgagccacaatgcccggcctaatctcttgggcgttgaaaggcctttggttgtaaatctaccaaggcaagctctccttcagtttatcttcctcccaccagcaccagccactcatccacatcttttgtcctaaggctctgtgcaaccccaggagccttgcacagatcctcaatctgagcccctggaaacttgctatcaaaggcacaatttctgaaagtgcaggtggctggcagacggaaatctctgctaattccatggtgtgatatggcaggtacacaggtcaaagcgccaaccactgaactcattgagaaagccctcagacccagtggagtctagtgatgtcatgggggagtcagaaaggtcaagggcaatatgtgggaatggcccagcccattgcatttttacaacttctaatcagcatcagtgagaaacccttccttgcgtggcctgtgaaccccgcctctgatgctgctggagcactttcatttcacttctcagcatcctgtgggtgtgtcaggtctcagaaagactaagtggccctgcctaggtcacgcagctggtgacgggaggcccagaacttgaaatcagggccgagcccagcccacttcccaattccctgctgtgtcccatgaccagtagcacgcgtcagaggctttcccaaaggcctccatgtcccgcctgttggggaagcccctggctttctctctgtctgggattgactctcagctctgtcctggttggagagaagagatttccaggatggtacccagacagtggtggaggccagagtctggcaaccaacgagccttttggacaattgggtggggagttgggtcattgggttggagaggaggggttcaagaagaggcccaggggtctcaaatctgtgtcctgtgtgtttcatgcccagcatggcagggaatttagtccaacatcatcaccatcaatatttcctcctgccctgtcaataaacactgattcagtaaaaaccgtattgtaccacgtgcgatggctcatacctgtaatcccagcactttgggaggctgaggcaggtggatcacttgagcccagaagttcaagaccagcctgggtaaaatggcgagaccccatctctacaaaacaatacaaaacttagccaggcatggtactgcacacctgtggtcccagctacttgggaggctgaggtgggaggatcacttgagcccgggggttgaggctgcagtgagctgtgagcacaccactgcactccagcctgggtgacagtacaagcctttgtctcaaaaaaaaaaaaaaaaaaaagccctaaaaacaaaagacgaaaactgtatcatttggtgggtaagagctttggaatgggggcagaccagctgcagcatgcattagctataggaccttgggcaagtcactgatggcatctaagcatcaaatgccttcaaagaaaatggtgattttatttatttatttattttgagacagagtcttgctctgtcacccatgctggagtgcaatggtgtgatctcggctcactgcaacgttctcctcccgagttcaagtgattctcccacctcagcctcccgagtagctgggattacaggtgtgcaccaccatgcccggctaatttttgtatttttgcagagatggggtttcaccatgttggccaggctggtcttgaactcctgacctcaggtgatccacctggcttggcctcccaatgtgctgggattacagttgtcagctaccgcgcctggccaaaatttttattgccctcctcagagagcaactgcaataactaaacagggtaatgcttagcatatagtcggcactcaggatttttttttaatgcggatgcagcttctggacaaattcctaggatctccccaccaccccttgcttcctgccccaaccagattgagaacctggagctgtcctggcaggacctgtggagatagggaaggggccggtggggtccctcaccccacaccctccctctgccccccagcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggtgggtccctgccccaagggccctggcctgtcaggtgtggccaggcagggcggccagctggggccggtgagtggttctgtgggtccttgtccacctgaaagccagttagagtagaccaaatgcagatgctggaagtgagggcagaggctccccctgagttccacgcagtgctcagggtcagaggaagacccagcacccgccttcctcgagccagggaagtgcaaatcacaatgttccctctcccaagagctcttgtttcacctcgaagacacttaccagagttgttttggatgtttggtgtagctgggagacattttttttttaaacagggtctcactctatcacccaggagtgcagtggtacaaactcgacttactgcaaccttcgtttcctgaattcaatagatcctcccacctcagcctccctggtagctgggactacaggtgtgcaccaccacgcctggctaatttttgcaattcttgtagagatgaggttttgccatgttgcccaggctggtctcaagctcctgggcccaagtagtcctcccgccttggcctcccaaagtgctgggaatacaggcatgagccactgtgcccagcgtgggagagatattctgagggagcagagattcatatctacaggcaactacccagcttgagaaaagggaagtgtcccacagaaagttccagccagaggggcctccacgataagagaacttatcttgagggtcatggtcatgtgttcagaggccaaaaattccctgtctctatgaactaagtgattcaccctaattaggtcaacaactgctgagataaaatgataacgaaatcacttgatttggccaaaacacgtccaacagtcaggtgggtgtgggtggtttcagtgactcacagttcaaatgaattaggtgcttctctcccaggaccaactgctcccccggggatgagaaggactgtggccatggtgtagccaataagcagaatggccgctatgtgggccacaccctgggggccctcctgtcgtttccagcagctctgccttttccagacttgttttgttttgttttgttttgttttaacctttcctatggtgctgatccagattttaccttttgtgagagctggcttaaaaatggaaaggagatgggagtgacttcatgaggatggggtttccatcctgggtgatgtaagagttttggaactaggtggggttgatggttgcacagcactgtgtataataacgctgctgcagtgtacgctttaaagtggttatgtggtaaattttatgttacatgtattttaccacaatttcttaaaaacaggaagggctgggtgtgctggctcaagcctgtaatcccagtactttgggagaccaaggtgggaggatgcttgaggccacgagtttgagaccagcctgggcaacatagtgagacttcatttctacactttttttttttaattacccagttgtggtggctcgcacctgtggtcccagttacttgggaggtggaggcgggcggattgcttatgccctggagttcacagcagcagtgagctgtgattgcaccactgcactccagcttgggcaacagaatgagaccctgtctctaaaaataaataactaaataactaaataaataatttttaaaaaataaagtgaaaagaaggcagaggcgagaggatcacttccgctcaggagtttgacaccagcctgggcaacatggcgaaacaccgtctctacagaagaaaaacaaaaacaaaaattagccacgtgtggtggtacatgcctgtagtcccagctacttgggagtctgaggctggaggatcccttcagcctgagaagtcaaagctgtactggccgggcgcagtggctcatgcctgtaatcccagcacttccagaggctgaggccagtggatcacctgaggtcaggagttcaaaaccagcctggccaacatggtgaaaccccgtctctactaaaaatacaaaaattagccggccatgatggcgagcacctgtaatcccagctactggggaggctgaagcaggagactcacttgaatccaggaggcgaaggttgcagtgagccgagattccgccattgcattccagcctgggcaacaagagcgaaactccttttcaaaaaaaaaaaaaaaaagctgtagtgagtcaagatcatgccactgcactccagcctgggcaacagagtgagagaccctctcttaaaaaaaaaaaaaaggaaagaagggaaagtggcgacacccacgtgtaaaactgtcctccctgctagagaggataggcaaagcaaatccaaacttggagttttaacgttcaatttttgtgacactgacattgtcagtgatagggtggcattgttaatgatagagtgaagaaaggctattcactttttcttttttctttttctttttttttgagacggagtctcgctctgtcgcccaggctggagtgtagtgctgtgatctcggctcactgcaacctctgcctcccaggttcaagtgattctcctgcctcagcctcccgagtagctgggactacaggcgcccaccaccacgcccggctaatgttttgtatttttagtagagacggggtttcaccgtgttagcgaggacggtctcgatctcctgacctcgtgatctgctcgcctcggcctcccaaagtgctgggattacaggtgtgagccactgcacccggccaattattcaccttttctttggattctcacagagcagatggacaggcttctctggtccattagaattcagataaggtcagaacaggattttcatgaccacagctaccagttgcaaagctgcttagctccacagggttgcgctgttgcagctacctgtgcccacctgatcaccaggaatttccttgcctgcatttgaaaatactgtggctccggccagggcgcctcagcatccagccctgggagcccccgtgggacctggcttgcagaagtggccgagggtttgggagtataccagggtgacgtcttccctcctgcggctctctgtttaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctgtaaggcttcctcctgccccagctgcaagagccccatccatcactgcagctccccaagggatgcactgccccagctgtgcctggccatcgctgtgaggctcgtgtgaatgctggggggaaggggaccagctgctacctcaaggagccttctgtctgggagcaggcagaggtcccaatcacagaccaacagggaaggcagggaggtacaagggctgaccaggcatcaggaggagtctgaccttgggcaaaggtgactcccaaagtgccccacccagcagccaatagggatcattcattcatttgacaaatttggactgaacttcaagcctctgccaggcacagtagaggttgcaaaatgaatctcataattgttctacatacttgccagtgcaaaaaaaaaaaattgttttaaggaaaaagaaatttaaaatttaaattaaaagaaaaagaatctcttatacatcctgtcccaaagagattgcagtccattggaggtcaaagacaaatacagagacatcaccagataacataaaaagaaagaaatgctgaaagagaagcatgacttgtcctttgactccatgaggagggagggtcaatctcctgctgaagggaacagggaaggcttcctggaagaagtggcagggcttggttgtcctttggtggacatttgcaataaaggggagggcattctggatggaggaaccagctgtctgcaaggacaggaagaaggagatgagtgccatatacacacacacacatatatatatatagagagagagagagagagagagagagattaataattttatttgggctgggcttggtggctcacacctgtaatcccagcactttgggaggcagaggcaggcagatcactcgagctcaggagtttgagaccagcctggccaacatagcaaaaccccatctctactaaaaatacaaaaattagccaggtgtggtggcacatgcctgtagtcccagctacttaggaggccgaggcaggagaattgcttgaacccgagagacggaagctgcagtgagtccagatcgcacccctgcactctaacctgggcagcagagcaagactgtgtctcaaaataataataataataataataataataataataataataattttgtttgtctagcatggtgttcttcaaccttttcttcattattggccttcatgttttttctaatggccttctgcctccataaaatgtttgttgttgttgagacagagtctcattctgtcacccaggcttgagtgcagtggcgtgatcttgggtctctgcaatctccacctcccgggttcaagcaattctcctgcctcagcctcccaagtagctgggattacaggcggctgccaccatgcccagctaattttcttttgtatttttggtagagatggggttttactatgttggccgggctggtctcaaactcctgacctcaagtgatccacccgcttcggcctcccaaagtgctgggattacaggcgtgagccaccgcacccagcccatcaaatgttaatgctatagacatactgtatatctgttcatgcgctgcatgtatttccatgctttgtacctaaaaagcaatattattttacccccaggaaccaattgaaaattcctccattgaaagcacatggttaggtggatgggaaaagcccctggctatgtcctgtccctcccagactccattgcaggcctgggcaatctgaaaggacctccatttactgcggagaacttccaatgtgtcccccctagatcatggagcactgcatcaagcagaacaatgccattgacatctatgaagagtatttcaatgacgaggaggccatggaagtgatggaggaggacccttcagctaaaaccatcaatgtgttcaggtagcgccatagccaggcaggtgtctggccaccctccgtcacccccatgcatgggcgcctccaaaggcaactccttgccatcgctgcatgccctgggtgcagcactgtctgtgctctgagcttgataagtgacgtggtgataagtcacccagcagagaagtggccctgctctgggggcgggtctggttgatggaaagggagtacagactccagagaaagtgaaattgcccagctgcgtacaggtggggcatgttcctgcagggcagagtaagtacaagtaccaagcatgagcagctagcagcactgtgggcacacaggcccccgccgcggcctgcactcatgcgagtatatccatgaataactccagaggatagaagtttgacaccagggattcatcccacaggttgtgtgtgtgtgtgtgtgtgaaatcaccgcaggcgtggatattcactgcagagggtgtatgccagccaaagactagaacaagctaagtccatccataggggactggttctagcagttctggcacacccacacgacggaatgccatgcacctggtaaagcgagcggggcagtctgggcatggtggctcacgcctgtaatcccagcactttgggaggccaaggcgggtgcatcacctgaggtcaggagttcaagactagcctggccaacatggcaaaaccccgtctctactaaaaatacaaaaattaactgggtgtggtggcacatgcctgtaatcccagctactcgggatgctgaggcaggagaatcacttgaacctgggaggcggaggttgcagtgagccgagatcgcaccactgcactgcagcctgggcaatacagcaagactctgtctcaaaaaaaaaaaaaaagcagtgcaacttcttatgtgctgatatggagtcatttccaggattcagtatgtgaaaaccaaaccaaaacaaagccggtgcagaacagggtgtgcagagtgccactttttgtggcagtccccaacttaaaccattttttgtctttgcaaggctgcaaaagcaatgcaaatccaggagaaaccgtacttcaagtacccatacaaccattctgttttccaccctcagtacagtattcagaaaattacatgagctgttcacctctttattataaaataagctttgtgctaggtgattttgcccaactataggctaatataagtgttctgagcacataggctggactaagatgtgatgctgggtaggttaggtgtattcaatgcattttcagctcctgatatttccaacttactatgggtttatcagatgtagccaacatcattagataaggagcatctgtatatgtgtataaatatatgcatatgtgtatgtgtgtatatatgtgtagatgtatgtttacatgcctgatgtgaggagaacatctgtgattttggacttctggcatccggaactgtgatagaatcaatttctgttgtttgaagccacgcagtttgtgggacctcgttgcagcagccccaggaacagaataccccatcccagagcacctttgtagggtgtacaaaagaagctgataggaaggagagcttgggaacagggatggggagaagcctggggaagaaggactcctcggccttgaagtctggtggaaggagttgcagaaagtgggtggaagtgagaaagaccatgctctgtggcctcggttttgaccatgaagaaaaaagcaaggccgtccaatcagatgagtggagatgagcaggaggctggaatagagcagctggggaaatgcggaggggaagcctgtggacctggggcagaggacagaccttgggtctgggtgatgcaggactaggggtgtgaaaggtgtttgggaaatgacttgcctcagatcccagctctggggaattcatttcactaccacgactgacttaggggcctgggaagtacctagcccagtcccagcacagcaagaaagaactcttttctgaggcagggctgactcatggtgtgcaagcagggccagtggctgtcagcaaggggtgtgcaggagagggcatggcggggcagaggctgcccttcctgttgccctccagccctgctgggctctaacctcgtatatggaccaccagagcaggatgatgcattagaaatcatccgaggggccgggcactgtggctcacgcctataatcttagcactttgggaggcccaggtgggcatatcatctgaggtcacgagtttgagaccagcctaggaaacatggtaaaaacctgtctctactaaaaatacaaaaattagccaggcgtggtggtgtgcgcctgtaatcgtagctactcgggaggctgaggcaggagaattgtttgaacccaggaggcagaggttgcagtgagccgagattatgccactgcctgggggacagagcaagactccatctgacaaaaaaaaaaaaaagggggagaaattggggaacctcacatccagccttctgctctcttccctctcccctgcagggacccccaggaaatcaagagggctgccacacacctctcctggcaccccgatggcaacaggaagttggcagtggcatactcctgcttggattttcagcgggcacctgtgggcatgagcagcgattcatacatctgggacctgggtgagaagcagcggggtcctggtggcctgggagggctgagggctgggaccagcacaagtggaggagcgggagggaggggcaggaggtcaaggacactcacgcggttggtgcctcaagggaagggcccgcagtcgaggaggaacacactcttctccttcctctcttgtctggtttcaggcagagccaagcagagtcaaatcagaagcaggaaacccccaccaattccagattcttagttcgaggcatgaagacctgaccccatgggatctcaattcttagctcctaaggagcatatcaggccgggctcggtggcccatgcctgtaatcccagcactttgggaggccaaggcaggtggatcacctgaagtcaggagttcaagaccagcctggctaacatgataaaaccctgtctctactaaaaatacaaaaattagttgtgcttgatggtgggtgcctgtaatcccagctacttgggagactgaagcaggagaatcgcttgaacccaggagtcagaggttgcagtgagccgagatcatgccactgcactccatcctgggcaacagagtgagactctatctcaacagcaacaacaagacagagtgcccagcagactgagaagggactcaaggggcggcggaatggaacttgtgcctttgtcccatctgtcctgacacttgcctttaattcatggcctgcaggggcagcgtgtccatttattagcacaaaccattgtctacagaagggctggcaagacacaggcagggacagggtggtggtggcttcacgctctccagcttcccttcgttgtcagcattattaaaataaacatgtaggtgccaggcagagagctaacgcccgacattccaacagctcagcgagttctggcagcagccctatggggtggactccgtcattatctgcagtccacagacctggttggaagaaaccggcagagagttgactttgtgtaaaaactttagtatcaaaacctcgtttcacaccaaacctaggaactggactagaaatataattatcacacacatacgcacaccccaatcctgttcaccaaaaataaaaaccatcagcaaagcccctagggtcaagaatgccagattctggccaaggtggaccagggggtgcaggctggggaaagactggaggggcttccaggcttccccctctgccaccatgcccccgctacccacccgcagaaggggtgaaactggttgatcctgtccttttctttccgggcctggtggggataatttttttgtgctttatagaaaaccccaacaagcctgaacttgctctgaagccatcgtctccactcgtgacgttggagttcaaccccaaagattcccacgtactcctgggtggctgctacaatggacagataggtaaggagggacctaggcttttttatttttatttttattttttttagatggaattttgctcttgtttcccaggctggagtgtagtggtgcaattttggctcactgcaacctccgcctcctgggttcaagtgattctcctgcctcagcctcccgagtcgctgagattacaggcacccaccaccacacctggctaatttttttgttatttttagtagagacagggtttcaccatgttggccaggctggtctcgcactcctgacctcaggtgattcacccacctgggcctcccaaagtgctgggattacaggtgtgggccaccacacctggccgggacccagattcatagtcagagccaatcctgctgctatagggcagagcccacatggcagcctgggctcggccacagaagactaagtggggtgagggcctcccatagctgaccaactgcagacacgggtgaggcaggtttggctgacacctcagcagtgtctcctgttactactgtaagtctaaaattagctcaaaataaacagttttaaaaaactatagttcaagtaaaatcagagaatatttgactaggggccgccataaagggatgatgagagcgttggggagccctattttgggagaggtttctgggaaacctacatgctaacggatatgggtaatactggccttatagaatgagttgggaagtattcccttctggaagtttgtgaagaattgatattaattttttttttttttgagatggagtctcgctctgtcgcccaggccggagtgcagtggtgcagtctcagctcactgcagcctccacctctcggattcaagtgattctcctgcctcagcctcctgagtagctgggactacaggctcatgccaccacgcctggctaattttgtcttttttcagtagagttagggtttcactatgttggccagacttgtctcaaattcctgacctcaagtgatcctccctccttggccttccaaagtactgggattactggcgtgagccaccatgcctggccgctattaattcttgaaatgtttggtagaactcatcagtgaagccatctggtccctggcttttctttattggaagcttaaaagttacaattcagtctgtttatttgttatagatcctcttcacattttctgtttcttctttaattgcttttggtagtttctgtctttctaggaacttttccatttcatcaagttgtctagtttgttgacatttaattgttcacagtattcccttataatcattttctttttctttttttttttttttttttgagacagagttttactctgttgcccaggctggagtgcagtggtgtaatcactgctcattgcagcctcgacctcctgggcccgagcaattcttccaccccagcctcccgagtagctgagcctacaggcatgtgccaccacactcggctaatttttgtagtttttttagtcacaaggtttcatcatgctgcccaggctggtcttaaactcctgggctcaagggatccgcctgccttggctggcctcccaaagtgctgggatgaaccaccacacctggcctgatttcagtcttttaaaatttattgagacttgttttatggcctagcatattgtctatcctggagaatgttccatgagcacttgagaagactatattctgcttattgtccggtgtagttttcctttttttttttttgggacggagtcttgctctttcgcccaggctggagtgcagtggcgcgatcttggcccactgcaagctctgcctcctgggttcacgccattctcctgcctcagccttccgagtagctgggactacaggtgcctgccaccacgctgggctaattttttgtatttttttttagtagagacggggtttcaccgtgttagccaggatggtctcgatctcctgacctcgtgatccgcccgcctcggcctcccaaagtgctgggataacaggcgtgagccaccgcacctggcctgtccagtggagttttctatagttgtctgggaggtcttgtctatagtgttggtcaagacttctatttccttgttgatctttcacgtagtaattatgtctattattgaaagtaggatactgatgtctgccattattattgttgaattgtctatttctccttcaattttgtcaggttttgcttcctgtatgttaaggctatgttattaggtacatgcacatgcttataattgttaagttttcctagtgaattaacccttttatcagtatatgatgtcttcatttgtctctagtagcatttttcatctcaaagtctgtctttgagataagcactccagccctctttggttaccatttgcatggtatatctttccccatccttttacttttaacctgtttgcctctttgaatctaaagtatgtcttgtagccaggtgtggtgacacgcacctgtaatcccagctacttgggaggctaaggcacgagaatcgcttgaacctgggaagctgagattgcagtgagtcgagatcatgccactgaactccagcctgggtgacagagcgagactccatctcaaaaaaataaaaataaaataaaaaaataaagtatgtctcttgtagattacatgtagctggcatacaagtgaatcatagttttgttttgttttgtttttgagacagagtcttactctgtcacccaggctggagtgcagtggcgtgatctcggctcactgcaacctccgcctcctgggttcaagcgattctcctgcctcagcctcccgagtagctgggattacaggtgcatgccaccacgcccagctaatttttgtagttttggagagatgaggttttaccatgttggccaggctgatctcgaactcctggcctcaagcgatatgcccacctcggcctcccaaagtgctgggattacaggcatgagccaccacgcccagcttggatcgtggttttttccttttaatctattctatctatctctggttttaagtggagagtttaatctatttacattaatttaattactgataaagtttacatctgccattttgcttttttttcctatatgtcttacatctttttgttctttctccataactgccttcttttgtgccacgtattttctagtgtaccattttaattcccttatcatttcttttttttttttcttttcttttttttttagagacaaggtctcactctgtcacccaagctggagcgcagtgctgtgatcatagctcactgcagcctcaaactcctgggctcaagcaatcctcccacctcagcctcctgagtggttgggacaacaggtgcacgtcaccacactcagctacttttttattttttaatttttgtagagatagggtcttgctatgttgcccaggctggtcttgaactcctggcctcaggcaattctcccaccttggcctcccaaagtgctgggatttcaggcgtgagccaccacactcaacttaagctattgatcttattgatgatcctgtgtatgtgatgagtcatttttctcttgctgctttcaagagtctctgtcttcagctttgattatgatgtttctaggtatggatatctttgagtttatcccacttggaattcattgagtttcttggatgtgtagattatttttttaaaaatcaaatatggaatatttacaaccattatttattcaaatattctttcctaccctttctctctctcctctccttctgtgacttccattatgtgtatgttggcatgcttgatggtgtcccataggtctttagactctgtttttctttgttctcttttctttctattcctcagactacataatctcaattgacccatcttcacgttcagtgattcttctgcctgctcaaatatgccatcctgtagcttctctgctatatttttattttggttaatgactccagaatttctattttgttctttcttttaaaaataatttctgtctcatttggatgtggtggctcgtgcctggaaacctagcactttgggaggctgaggtgggtggattacctgaactcaggagttcaagaccagcatgggcaacatggtcaaaccccatctctacttaaaaaaaaaaaaaaaaaaatcagccaggtgaggtggagtgcacctgcaatctcagctacttgggaggctgaggcaagagaattgcttgaacccaggaggcagaggttgcagtaagttgagattgtgccactgcactccaggctgggcaacaaagcgaaactctgtcttcaaaaataataatgataatgatttttgtctatttgtatcttttatttggtgagagatcatctcatgcttttctttagttcttttgatgtgacttcctttagttctttgaacatgtttagcatagctgatgtgaggcctttgtctagttagtccaatatctgggcttcttggggacaatctctatttattgcttttttattcctgtgtttgggccatacatttgtatttcttggcatgtcttataattttttttttattaaaaactatactttttgtatgatttaatgtggcaactttgcaaatcagattgacatacctcccagagtttgtgttgttgctgtttgttgtagttgttctttgtttcattaatacattttcttagctagttctggaaagtctgtattccctgtcacgtgtgaccacttatagtctctgcttagcttagtgattagttaatgattgaacaaagatttccttaagcatttgtcaccaaaaaatctccccttctctgctaaggggctctgtgtgcgtgtgtgagcatgcctttacactcagccaggcagttgtcaactctgccttagtgtctgtgcagagatgaggtcagccagagagtttagggctttatcggttttcctgagcatgacacagctctgggcgtgcacacagctctatccatgcttgtgaccttctagactcccaggaatatgtcagatcttttcaaagccctgtggacacatcatgcttcagcttttccttttacttatttacttttgttgtttaaatgtaatagaagttgagcacagtggctcacgtctgtaatcctaacactttgagaagctgaggcgggaggatcgcctgcattcaggagtttgaaactagcctgtgcagcatagtgagatcttgcctttaaagagagagagagagagagagaggagagagagagaggagagagagaggaagggggaaggagggagggagggagagagagagagagagagaaagaaagaaaatagggacagggtcttgctatgttgaccaggttggttgtgaactcctggcctcaagcagtcctgcctcagcctcccaaagtacaggcgtgagccactgtactcggcccagcttttccttttaagcttttcggtaggtctattcctttccccacctgttatccactgcctcaggaagctgcaaagttagtcagttgcctgcaattacaccctgatgaaaagacttttcacaccaggcaaaggctgaaccaagtcaattacagccaaccttgcaagaggagccttatcagggaaccaccagaccggtcagataatgacagttctttgggcatgagacttgaaaggagctccagcctcattctgctccctcttgtggcgccaggctgctgtttttcatcaggagtgcagaatgtgaattttcaaggccaccacggaactgcagagtgtgcgatcttaactagggcaagtgaaaatgccactgttcttaccaagattctgctgtttttcttgaataaacattctcccgactgccctaagcctctggctaatttccagagttctgaaaaagttgattctgaccatttttgccagttttctcactgctattatggaggagagaatttttggaggtccttacttcacggattttgctgatggcacacctggaaaactgatttttgtttgtttgtttctttgagacagagtctcgctgtgtcacctaggctggagtgcaatgtcacgatcttggctcactgcaagctccgcctcccaggttcatgccattctcctgcctcagcctcccgagtagctgggactacaggtgcccgccaccacgcccagctaatgttttgtattttttttttttagtagagacggggtttcactgtgttagccaggatggtcttgatctcttgacctcgtgatctgcctgcctcggcctcccaaagtgctgggattacaggcatgagccaccgtgcccagactttttttttttttttttgagacagggtcttgctctgtcacccaggctggagtacagtggtgtgatctcagctcactgccacctccgcctcctgggttcaagcgatcctcctgcctcagcctccccagaggctggtgcatgccaccacgcctggctaatttttgtatttttaatagaaacagagttttgtcatgttggccaggctgttctcaaactcctggcctcaagtgatccacccaccttgacctcccaaagtgctgggattacaggcgtgagccaccaagcccagcccaaactgcttttttttttttttaatctccagtgagatcagaagtcacctgcctgggttggctctgaatgtccctacctgctctgttcccctgaacctggagtcgccagacacccaacccatgactacacccaggccagtcttgaccctgggcgtaaaaagcattccccactcctctctgctctgtatgttcttatacttttgctgcttcttcgggagtgggagccaggatggctgagaaactcctcctctgaagctgtctgtagtcagctgcttcctaaggccccgatctccctctcagacctgctgcctcctgcccaggggagctttcagattatggaatagacccgggctcccataaacgtccctgccaaactatctgggtgccagagctctaaaagactgaggcagagccactttgccatgattaattcaagagccttgactcagtcattattcataacctctttcagtggtttttcatgccagctcataccagcccagactctggtgctccgctgctccaagaagggcccctctagggccatgtgggacccagtgggacctactcttgagcactgctttgccaaagtagaacaggcttatcttttatttttatttatttttattttttgttttgtttttgagacagccttgctttgttgcccaggctggagtgcaatggcatgatctcagctcactgcaacatctgcctcccaggtgcgagtgattctcatgcctcagcctcctgagaagctgggattacaggtgcctgccaccacgcccagctaatttttttgtgtttttagtaaagatggggtttcatcatgttggccaggctggtcttgaactcctgaccacaagtgatccacctgcctcagcctcccaaagtgctgggattacaggtgtgagccaccaggcctggcctatttttattttttgagacagggtcttgctctgtcacccaggctggggtgtagtggcacgatcatggctcactgcagcctcaacctcccaggctcaagcaattctcccacctcagcctcccgagtagcaggcagcctcccgagtaacagcctcccgagtagcatgtgccaccatgcccagctaggttttaaattttttgtagagacggggtctcactatgttgcccaagctgctcttggattcctgggctcaagcaatccttttgcctcggcctcctaatgcgctaggattacaagcatgagccactgtgcttggctgagcaggcgtatctaagaaaacatatttctgggccagctgagttcagggaaaatgccttgaacttggagaaatactaagtcaaagcttacgagctaagtacttttgttattttacaaaacggcctttcctagaaacagctctgagtgacagggtgagccctcattgtgcattcatgggaaaatggaaacgaaatctaacaggacaaaggacagataacctttccatctttcttggcaaagcactaataacagatcacagtaaaggctaaagctcctctgtgagtttctttccaacagaggcagcagaggtacaaaggataagaggaaatgggctaatgtagcagagagattcacctaaatggagtctttccacgtgcttttccctacgttagggactcggctctcctctcgcctggctccctccatcctgaggctcatcttccatctcagctacctgtcacttcctccaggaggccttccctgaccaccctcatgtgttcccctgccactatgcctgtcctatccccagaggcttgcccagggccaagtgttgggtagggagtcaatgcctgggaggggctcaaggaactgaatgaagcttgcactctgggagtctctccagagagtctgtagaggctggtaggaaactcaggctgatttgaaccaagccctgattctagaaaaccacatacctgccaaaccagaagcagcagccccctctctcccctgctccctgccctaaggaaggaagcctgtgcccccttccactccttcttcatctccttcctcaccagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtacccaccagccagacactggagagaggagggaagggaggggcagtaactgttccctggttccccatcagaacccctggggacatttcctttaacacattttattttgagatggagtttcactcttgttgcccaggctggagtgcaatggcacgatcttggttcactgcaacctctgcctcccgggttcaagcaattctcctgcctcagcctcccaagtagctgggattacaggcgcctgccactatgcctggttaattttttatttttagtagagatggtgcttcactatgttggccaggctggtctcgaactctgacctcaggtgatccacccgccttggcctcccaaagtggtgggattacaggcatgagccactgcgcccagcctaacactttatttttaagttgagtagtgataatacatgcccacggaacagaatctaaagggtgcaaaaaagaaaatgccttcctctcacctctgcctgcacctcctcccctccctccctctcttatgtctgccttcagagctagtctctgcgtatgcaaggaaacacacctctctcttctttactctttctttttgcacacttcacacactattctgtactcgatgttttccattgtgtgtaccttggagatagtttcatatttcatacaccgctgccccatgcctattaataactgcatcatgtgggtgtaccataatttatatatggattctaatattttgttgctaccccccaaaaaatacagcaaagagcatctttatacacagattgttgcacacatgcggggatatatctacagcagacattgctggcagtgggacttctaggtcggagcacacatgcatttttaacattgccggatattgccttattgtggggagtcttggcatataccgattcttggccttgcacctggaggttttgattcagtaggtcgagggcgaggcctcagcatctgggttgtatgaagcttgccggcgactctgatgatcagccaggtgtgggaactgtggacagaacagcaatcctcaaagtgtatttgctcccacgaattgccgggagctccatcctttgtggcccagtggctgaccccaggacggtggggtgagggcggagaaggcaaaagccaggggaaatacagggcctcgaagtctcactgtcgcccctcctcccaccaggtcatgtggtgggacatccgaaagatgagcgagcccactgaagttgtgatcttggacatcaccaagaaggaacagttggaaaatgccttgggggccatctccctggagttcgaatctactttggtgagtgtcccttgctgtcccttccccgacttgcattgacagggcagccagggctaaagacaggccattgctaggatatcaggtgctcgtggaacccagcaccagcccagggaggccaccctcactgcagccatcctagacgtgtgtggcctttacaacaactttccagcagggggcagcagagcttctcgaagaaggacaccatagtcatcatggcaccaagtcatcttttggccagtggcccagctgaacacagagggcaatcttttgacagaacaattccagaaaagccctgttttgtggggaaggtcacgcccaggaccaacatcgggaggcctggactccaacccaggtcctggccctgcctggcacggggtccctaggctggtcacctgccttcctctggggaaggaagaggtactggagaggaaaatgaggtcaaagcaggctccttggaaaaccagagcacaagcatggtctcggtgttcagtcactgagaatgacaaagaaatatcaaagttcaggtcgggcagggtggctcacgcctgtaatcccagcactttgggaggccaagaatttaagaccagcctgggtacataatgagaccccccccaccgcccgcccagtctttaccaagaaagaaagaaagaaagagagggagagagagggaaagaaaaggaaagaaggaaggaaagaaggaaggaaggaaggaaggaaggaaggaaggaaggaaggaaggaaagaaggaaggaaggaaggaaggaaggaaggaaggaaggaaggaaggaaggaaggaaagaaggaaggaaggaaggaaggaaggaaggaaggaaggaaggaaggaaagaaggaaggaaagaaggaaggaaggaaggaaggaaggaaggaaggaaggaaggaaagaaggaaggaaggaaggaaggaaggaaggaaggaaggaaggaaggaaggaaagaaaaagaagaaaaatatcaatgtgaggcaaggcgccgtggctcacacctgtaatcccagcactttgggaggctgaggtggcaggatcacttgagcccagcagttcaagaccagcctggacaacatagcaagacactgtccctacataagaaaagaaaaaaagggccaggcacggtggctcacacctgtaatcccagcactttgggaggccaaggcgggcggatcacctgaggttgggagttcgaggccagcctgaccaatatggagaaaccccatctctactaaaaatacaaaattagctgggcgtggaggcgcacgcctgtaatcccagctactcgggaggctgaggcaggagaattgcttgaacctgggaggcgggggttgcggtgagccaagatcgcatcattgcactccagcctggacgacaagagcgaaactccatctcaaaaaaaaaacaaagaaaagaaaaacaggaaatatcagtttgagcatagtgcaaatgtgttagaggagggaagcttcctagaagcagtaaaggaagacttcctcgctagagtaagaagacaactttcccttgttgttggcttttggtttgggctgagtcttggtttacgtcttagtgcagcccaggcctggttcccccttgggggtgtcacttgtttgcttcggggtcatgggccatcattcctagggctttgggaggccctggcctcgaacatacctgggcaaccctagctcaaggctgagagatgaatgttgatggaaggaggagacaattccactgaccccctccccagaggacaaggcactgggcagggaggttggggtggcgagggctcaggaaaacattctgtcccagaggcaaggctttctaggccaagtgctagacatgcagccacatcactactagggccatctcctccatgcctggcccttgcagggtgcacactgtgtgttggacacttgtggctgcctgatttaataagcttgtgcagtcgcctacaaccatctcgtggggtaatgttattatccgtacttgccagacacacacgatgagtcttcatgagattaggttgtgagtcctagtacctggtaaagctgggactcaaacccagggctccaactctgaggcccagagtgtccacctgcagcccaccatgaagtctgaggctagaggcacgatgggccactcagatctgggtggcctttctctctggctcactgacgggcggcgtgcagtcggcttgaatactttcttctctggacctctcaagcttggtctttccacttgcccttgacgcccaacttgaagcccaggtttttgttttgttttgttgagacatcgttttgctctgttgcccatgctggagtgcagttgtgtaatctcagcttactgcaacatccacctcctgggctcaagcctcagcctcttgagcagctgggaccacaggcacatgccaccaagccaggctgattttttttttttttttgagacagagtctcactcttgcccaggctggagtgcagtgacatgatcttggctcgctgcaacctctgcctcccaggttcaagtgattctcgtgcctcaaccaccacacctggccatgttctgggtattttctagagattttatatttatcattttagtaattttctggtagaagaaaactgcataataaaacaatatgttttttaaaaaaataaaaataaaaaagctggggggccaggtgcagtggctcaggtctgtaatcccagcactttgggaagccgatgtgtgcagatcacttgagcttaggagtttgagaccagtctggacaacatagggagactccatctctacaaaaatacaaaaattagctgaccctggtggtgtgtgcttgtggtccctacgtgggaggctgaggtgggagtactgcttgagcccagaaggtcaaggatgcagtgagctgagatcgcactgctgcactccagcctgggcaatggagccagaacctgtctcgagaaataaataaataaactaggagttcttttttcttttcttttcttttttctttttcttttttcttttttttttttttttttttttttttgaggtagggccttgctctgtaggccaggctggagtgcagtggcatgatctcggctcactgcaacctctgcctaaaacctgggagttctataggggcaggttcaccagctgcagaggacatctgagcccgttgacaaaggccctcccctcagtgtgcccctcccctacctcactcagctgttctttccatttggaatgctgaggacacagcaccattgtaggctcaggccctgctggtggaggttgttcagtctagcccagaagttaagacagaacagtaaacaaggaagggcattgcgtgatggagggggtcatgctcagagacgcgaggggagcactggaccaggagtcaggagaccagcctttgtgcattcagtccgcagtgaagtgaataactactaaagctcagttcgtgggcgatggacccatgtcagacaagctcgtgcccctcaaagagctcacccaccagtggtagggggacgagttacatcaccgactgccaggtaacttcctgagtgctggttggtcacctgctctgagttctcagggacaccagcctggacaatgctatgacaaatgtcactgtcttgccagggaaggctctgcccatcccatgagtgatctgggtgggccaccctgcatcccctccctgggtcttctttactctctctgtaaacaaacattcaggatctttatggccaaatgcatcgaggacacagtggtgctctgcagagggggctagtgacctgacaaccctccaggactggaggagccagggagggcttcattcagcacaggctccttgagcagcttccaaaaagatggggtctgaggagcccgggaagagtggggactgctctccaggaggggccacagcccttgccaaggcttgatctgagggcctttctagcgcctgcagaccccccaagcaagctcctgtccatgcccgctaatcccagaattgatggttcgtggagtcttcccctcctgtgtcactccttccacagcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaagaggcgatgctggggacaggaggggatgcaggagacaggaggggatggagggagcccagctgggccccggagagtcccgagcctccatatgtaaaatggagaaaaacctttccacaaacacccgagctcgtgttagcaagtgacttgctccagccactccacaaagtgataagcttcaaacactcagttactaaaaataatggccatggcttaattttatttccttttttttttttttttttttttgagacagtctcgcttagttccccagactgagtgcagtggcgtgatctcggctcactgcagcctccacctcccaggttcaagagactctcctgcctcagcctcctgagtagctgggactacaagcacctgccaccatgcccaactaatttttgtatttttagtagagatgggattttgccacgttggccaggctggtcttgaactcctgacctcaggtgatctgcccacctcggcctcccaaagcgttgggattacaggtgtgagccaccgcgtctggctggcttaattttcataatcctcaaactatccccaggaggaggcagcattgctcttctcttcatctcatttttcatgttagggaactgggctacagaaaggccaagccacttgctcctgctctcccagctagtgaggagccgagattgggtgtgaaccaaggaagcttggctgggaaatgcgggtgccttggcacaattcagcagtgaggcatagcctgtcttgctcagtgccactcctctgaggagagcaacagacagggagcttgagacagagctatgagcacaatggttagaccagagaagcttagactatcacatccccctccattcttcttagggcccatttaccttgtctaaaagtgccctttctcctcctccccttcatctcctaaattaggtaataagcccgaattctaaccacccccttgagtcattcaccaccgagcactgccatgtgtattgtgcattgcatgtataaataattacttttttctcttgctaaaaaaaacatcctggggttcctttcctgcccacagaaccacagactcctgcaacgtcaaagccaccagcaaccctaatgagcatctttggttccagtgcttcccaaatctggttgcatcagaatatcttgggaggagtttttgtttgtttgttaaaatgcttttgagatggagtcttactctgtcacccaggctgaagtgcaatggcgagatctcggctcactgcaacctccacctcccgagttcatgcgattctcctgccttatcctcctgagtagctgggattacaggcgcacgccagcacacccagctaatttttgtatttttagtatagacagagtttccccatgttggccaggctggtctcaaactcctgacctcaggtgattcgcctgcctcagcctcccgaagggctgggattacaggcatgagccaccgtgcctggtggaggagtgatttttttaaaatccagattctcagccccaaccctgggggtactaacatagaatcttgggcttagcccaggaatgggtttgctaaggagcaaccccaggcttgtgactcagccagtccttgctttgggagcagaaacctggttcgatgtcctcattctacaggggtgggaacgctggctgacaagggcagtgcattgttccaggcctcatagcaagtagggggttcccagtagatgtgaagccctttacaggctttaggagccttcccaatgtcttcaggtcctgcaggctgccagggctgtgtgaaaggagcagggtgtcgagcacagcacccataggcctttcgcagggctggttcctagagggacttggtggacctgtgtcgtagaacctgggtctcccttgtcctcctcctgcataaggttaaacaaatttagcaaataagaatatttgaccctgggccaggtgcagtgggctaatgcctgtaatcccagcactttgggaggctgaggcgggaggatcacttgaggtcaggagttcaagacgagcctggccaatatggtgaatccccatctctaataaaaatacaaaaaatcagctgggcttggtggctaacgcctgtaatcccagcactttgggaggccgaggcgggtggatcacctgagatcaggagttcaagaccagccgagattgcgccactgcactccagcctgggcgacagagtgagactccgtctcaaaaaaaaataatatttggcacttagttaaatctgaattttaaaaaaaaaaactattttttttttagtataagtatgtcccatgcaatatttggtatatacttatactaaaaattattcattgtccaaaaatctccagatgtttctttttttggggggatgaagtctctttgttgcccaggctggagtgcagtggcacgatcttggctcactacaaccttcacctcctgggttcaagcaattcttctgcctcagcctcctgagtagctgggattacaggcgcccaccaacacccctggataatttttttatttttagtagaggcagggttctgccatgttggccaggctgatctcaaactcctgacctcaggtgatccaccattctcggcctcccaaagtcctgggatgacaggcatgagccaccgcgcccggcccagatcctttctttagtcttgatcatttctcccactgtggtctggctgtcaacacactaggtttgcaaaggtgactgggaagtgtagtctgccttgctcaccaggggcccagctacaactatattgcaatggaggaagggagaggaggtctgggtgaaaatctgaaggctgcactgtgtgtgtgtcccttttaaaaaaatgttccgtcttcactgaagaaactcttgaaaacccagatgaaaccaagtaggaagtgacactctccttatctcagcggtagcagcttttctgggcatgtccttcctctgactcccatccgtgagtcccagggctgggaccaggtccagcaacacgtgcctgctgcctggagttagcagcagagaaatgccagtggccagcccacgggaaggactgtgcccagagccctttctttattttatttgagacagggtctcactacgttgcccaggctggagtacagtggcacaaacatggctcactgcagcctcgacctcctgggctcaagcgatcctcccatctcagcctcccgaggagctgggaccacaggtgctcaccaccacacccggctaatttttttattttttgtagaaacagggtctttccatgttgtccaggctggtctcaaaatcctggcttcaagcgatcttcctgccttggcctcccaaagtgctgggattacaggcacatgaccagcccagagccctttaaagaacagcctgtcagacacctgaggtcaagagtttgagagcagcctggccaacatggtgaaaccccatctctagcaaaaataaaatattagctgggtgtggtgacgggcgccagtaatcccagttactcgggaggctgagacaggagaattgcttgaacccaggaggcagagattgcagtgagccgacatcgtaccactgcactccagcctgggcaacagagcaagagtgtctcaaaaaaaaaaaaaaaaaaagcaacctgtgagctgtggatgagtgaggtcagcacagctagaagtcagacacaaggaagaacttcctacctagcaagactctgagatcctggagcccagaagggaccaagtgagccaagctgtggctcagaagcctctgtccctccaaccatgatgtggtctacctcccacaggtaccacatggcttacctcactgatgctgcctggagccccgtgaggccgaccgttttctttaccaccaggatggacggaaccctggatatctgggacttcatgttcgagcagtgcgatcccaccctcagcttgaaggtcacgcgcatgtccctccttgtgcatccaggtcctcagggagccaggtcccggcgtgggtgtgagtgtggggtgctgtgagcacgtgtgcagtgtgtggccaggtgtgtttgggcctctgtgggggagccgtgtgcaggctgactgcagcgattgcttttgagcgtgtgctcctacaaaggttaaggggcctgggggatttggcatcctggtagcacaacagaaccacctgggggaaatttaaaaagaaacaaaagcaggtacccggcatctcctacccacaggccgattccttcagagcccctggggtttggctgctggaccttccccttcatgtcagggtggccagagctgagccccactggctggggccacggaagggtgggggcattggggaaccacagggtgactgtgaggcggaactgaaggggtggggcgggagatgaggcagggaagccaggagccttgacaaccagtctccgagtttgaacttcatcctgtgggcagaggcgtcctgaggatgtttgaatagggccaagtggctgagcctccccaggggccagttaatcagacacacataactttgctcctctctcctctacctgggtctgcccggccccttcaataggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccgtaagcaccgggtgcctggggaaaatccctccagcacgtcccgacctggccccacagcagagcaggctagtcagacaaatagatggccccgccctcccacccccagaacataggtgcacattttgggggaagcagtgtgggctccataaataggtgttggtgtgtccatttgcctttgctcaactgctgggtagctaagtggccttcagtaagtcacgtcactctccaggattcagttttttacctgtaaatcaaagaggttcgacttggtcagtttgtctagtttcaaataacacttttttttttttgtggaaactttccaatgaaggcttagtattgtattatattatattgtattttaatttaattatttttatttatttatttatttttgagacaaagtcacgctctgttgcccaggctggagtgcaatggtgagatctaggctcactgcaatctctgcttcccaggttcaagtgattctcctgcctcagcctcctgagtacctgggattacaagtgcataccaccacgcccagctaatttttgtatttttaatagagacaggatctcaccatactggccaggctggtcttgaactcttgaccttaagatgatctgcccaccctggcctccgaaagtgctgggattataggcgtgagccaccgtgcccagcctaattattttatttatttttattttatcagtttattttattttacttcattttgagacagggtcttgctttgttgcccaggctggagtgcagtggcacaatcatggcccactgcagcctctacctcccaggctgaatcggtcctcccacctcagcctcctgagttgctgggaccacaggcatgcaccaccatgcctggctcattttttaatttttgtagagacagggtctccttatgttgcccaggctggtctgaaactccagggctcaagcaatccttccacctcagcctcccaaactgctgggattataggcatgagccaccacgcccagcctgaagacttagtagaatgctaatagggaagccagatagaaggggacttgaagagggggactgagatccattcctacatcctttccccagtggacagccctgcaggcaaccccccagaaccatggggaacactgtggaactgaaaacccctagtgctagggccgggtgtggtggctcacgcctgtaatcccagcactttgggaggccgaggcgggcagatcacctgaggtcgggagttcgagaccagcctgaccaacatgaagaaacctcgtctctactaaaaatagaaaattagccaggcatggcgtcacatgcctgtaatcccagctccttgagaggctgaggcaggagaattgcttgaacgtgggaagcagaggttgtggtgagccgagatcgtgccattgcattccagcctgggcaacaagagtgaaactctgtctcaaaaacaaaacaaaacaaaaaaggaaaacccctagtgctgaggcctggagagcctcctggctctgcctgagactgggatctcaccattgagctggtccttgttgggccaaagccgccatatttcatagctccaaagggcgctcttctgcctgtggttctggaactccatgctccttggcattgagtaactcagtgtccctgctgcagccttccaaccccaatattcagccctccttccttgacaccagccctgggtacagacctctacagtacagggactgtatggagagcaaggagagctcagcagaagccccacctggccccagcactggagtcgcttgccatcctgccctctccccaccgggctctctctgtccctgggtgcccagatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcgcagagctgaagaagaaggaggcagacgccataaagctgacgccagtgcctgtaggggcctggacaggggttgggtgggttggggactgggcgggacacatggcacttgggttctgcttctgcttgccgacttcctgggtgaccttgagcaagtagtcttacctgctagatcttaatttattcacctggcaagtgggaagaattattcccttccttccaaagcatcccaagtctccaaacagacttcaggctccttacaggcaggaaccatactccatgcctcctggtatcctcccctccccccagagagggcacatggtgaaaatgcgtgttgagtgactgaacgagggaacatgtgtgttgagtgactgaacgagggtcctagaggtaagtgagctgtcagagaggaatgggccttgagacccctggagggaagggctgggacattagcggtgtgcacgtcatgctggcttacccaggtttggtgtcaggagtgtgacctgtggtcagctcatctgcccatggccccagctctaaagcactttctagctgtatcacctgagctggtcgcttcacttctggcttccttcatttccatctggaaaatgaggagatgttgctataaagatggtgtctggtcatcttccaggccctcttttgtaccagcggagagaggaagaaaagacattgcctgtctgggtcacctccttcaggccccacagataagatgccaagatatgaaagagccaaagagcagcgtggaagggaaaagaaacagcgggtatatgccaggatttacccttgtaggcaagactggctgcagacttggggattgcaggcactgcaaaatgaaaatgtgagggccctcgtttaaaaagtattaataattttaaaacagtgacaatagagcgttaaaccaagcgtgggccctgctgagacagggtccagtgtatctgcacagagcacccacccatgacgcctgcttgaagaagagctgtatggcaagttcttggtccctgatagagtggacagagcgaaggatggtgcatgagcacacagggaagataactggttccatcttgtgatttcttccctcttctgcctccctccccctgggtctaaagctgtgatttccacaggtgcattttgcatttgggggtacttggttatgagatgttttcttctcacactgggtaatacaggtggggcagagagctccctccacttctggtggaggcaaaactagaatcctggattctgacgcctaatccagggctcctcccactcaccactcctggcctatccagccctgcagaaggcaaagatgacactggccaccttttacaacgcaatggtggctggtaggcaccatgctttgtgacatatgtcccaaaacgtgctcctcaccatggcttgaacattctacatgaagaagttgagccttggaaggggttcaggttcacagaacttggccccttcctcctcctgcctgccacacacttcctgtctctctcttagtctgcaattggcccaaaacgctggtggtcacaaagtaccgcgtggtactgaagctgttttacataggctgggtccttatgcccactatttctaatcctggccacagccctgcaaggtgtcctgtcctctctatgggtgagggggccaaggagactcaggaggagctagcccgaggcctcccagtctgcatgtggcagaagccaggcgtgaacccaagtctgccagattcccccagctctgcccactttccgcactgtctgggccctcaccagccgcagagctggcacccgggttccagggtgctcagcgacccaggcttcagccatttggctgctttggtcctcgtggggttcacatcccaggggagtggggaaggcctgtcccctaccaacaccaacacttctgtgctgtcttcccctgcagcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttggtattgccccgctctcacaagtgggaggctgagctccgccttaaagcagcactgggtggtgggctgggagcatcgggccctgactccccagcccctacaaatcactagcccccactgactcactgggcactgagtcctgagccaccccttggagagagggaaggggcggggcttgtcccggagctggctgccccattgtctcagccaccctgagcccaccccaaggccgaggccaccttagtcctagtcctggatgtctcctgggattcagcttctcacaggctccccagcaatcattttcgtttgtaaccttgcagaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgcca

SEQ ID NO: 363 - DNA, 40638 bp, Homo sapiens; identical to SEQ ID NO: 362

SEQ ID NO: 364 - DNA, 29609 bp, Homo sapiens
gcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtgagacccttttagaccctcctccccaccccgctccgtggtctacttcagtcggcctccagcgacagagtcctgtcccctcgccgccaccccactgagaggacaggcaacgaccagggccgggactcttcagagcaactttccccaagtcctgcaggatgggtgtcaagaagggaccatggcctttttagactttcctgagcctgaaaattaccccaacttcaaccccacccccacctttccaccctcccattgggagatcccgcccccaaagcgtgcgcagatgaatctcggctctctcatccagaaacgccaggggcagggagggcttgacctaactgcccccagaaggagggtggcggtttcccagttaatcagaggctgctccagccctggtgaggtcaggagtttaaagggatgtgggggtcaccagtaggaagacaagggcccctggtgtcaggatggggcccggagtgcctggttcttgggctgcaacacggatgctgcccaagtccggattcgaagtagttcagagaagtgctagatgcagctaccatggccccacagagccctggggcctgggacagatggggaggtgagagtgggggctgtggaggggaaggtggaattcctgatcatcagtggtgcctgggccagagcaacaagggagatgactcagtgacctcgaggccaccactaggctgtgggtgggtgggtgtctctctcagcaagccccttcctcatcccctaatttttgaggtctggggaagggccctcatcaccagaaggtgggcagtaaggtaactggaggataatgttgctcccagagtcccctacctctcaagggtgggcttgcttctctgaaaggagcctcagctccagcccccaagcaagccctgggctctaggacatcctctctggctttttagaatgtgtctctttgaaaatcactggccttggcatgtattgtgtgccccggggagcagggatgaagggtcctcccctcccgccagtggaatttggctgaagatgccactaaaggtgacccgtcaggtagtgtagttccctctgaaagtgccttttgttttgttttgttttgtttttcttttttgagacggagtttcactttctcacccaggctggagtgaagtggtgcgatctcagctcactgcccctcaagttcaagcgattctcctgcttcagcctcccgagtagctgggataacaggcatgcaccaccacgcccagctaatttttgtatttttagtagagacggtgtttcgccgtgttggccaggctggtctcgaactcctgacctcaggatccgcccacctcggcctcctaaagtgctgggattacaggcgtgagccaccacgccaggcctgaaggagtcttcactcggccagagggccgttcattctatccccacacccagcagctgttgccctttgatcagcacaagacgtgctccccactccaccctgttctttagggagatccacgcacaggatgagacccatttcacactggctggaggacaggcagatgggggtgggcgctctaggtgacactctcctcggtgtaggaatgtggtcacaggctgttgggatgatgggggacattccctgctccatcccacctaccaggcctcatcccagagccgtgcctgcaccttcctctgcagcacgtcattcgcggaaacacagagaggctgctccagtgccagggccccaagttcaagcccaggggagctgcgagtgttttatttgggcgtgaggctgaggcaggctggaggagcagacagctctctcccctggggctctcccggaggccagggctcctggggagactcatcaactcagacacagtccaacactctgtggacctgctgccctctgacctaggtagagttttacttaggacaagggaggcctgagatggctgaatgctagagaagccaggggcttgcttgaggtctctctgaggcccagcatggtcctctccctctaatcccaggggcttggttttccctcccaggtggcgcttcgggtccggcccatcagcgtggcagagctggaggaaggagctaccctcatcgcccataaagtggatgagcaggtatgcagggctctgcagcaggagctgcagggcagaggtctgctcagatggctcagctcacctggtgagggcagaaagggcccctgtggcttgcagcaccctccttcctctactcactgaactcttggctgtgctgttgatgacatcaccaaggaagctgggggctcttcttccaggaagccttcctagattgatccaaggacaactgggagcttccctagcctgggtgggccctgatcctttacctttcacatgctcattgcttgactttcccaccctaatatgcctgctgcccacagagcacatatatatatggttgagagctaaagctcgcctctagggtgtaacgtgtggcaaaatcctcgctctctgtttgcaatcttggtcctcatgtcaccaggatgaggaaggcagggcacacgaggcaataagtgtgtatcaagtaccagcagcatgctgggtactgttctagaaactgggaaactgtggtgaacagaaaaggccctgtcctctctccattaccttaagtctagtgtgaagagatgaggcattcatcaaagaattgcatcacaaacaaacgagtttgcagctaacaagggcttcaaagaaatgcttagtggcatgagagtaggtaagaaggggataagacctaaacctggaggtcagcgagggcttccttaagaaactgtgcttgacactttgggaggccgaggaggccagatcacgaggtcaagagatcaagaccatcctggccaacatggtgaaacccagtctctactgaaaatacaaaaatttagctgggcgtggtggcacgtgcctgtagtcgcagctactcaggaagctgaggcaggataatcgcttaaacccaggaagtggaggttgcagtgagccgacatcacgccattgcactccagcctgggtgacagagtgggactctgtctcaaaaaaaaagagaaaaagagaaaaaaaaaaaaaaactgtgcttgagctgaaaacataaggggtgaagaagaggtcattagtagcatgcatgaggggagaaatgttgacctgaggggcttgcatgtgcaaagggcctgtggtgagagggactgggatgcaactgggtagctgagaaaaggccagagtggctcaagcaggagagtaaggggcaagaggtgtgaatgggctgggccaaaccacatactctgtagaccatggccaggatgtttgtttgggtaggcagttgaggactcgtgctgggatgtacacaggcacagtggtgggggcaacaggagtgggcttggtgcccaggtaggagcatcgtggtggtaggatgtgctaatggctcagagaagttgggtggcactgtacaatgcagagaaaggcacacgtgagcacctgatgggcctgggctcaggtcccacgggctggactcatgaagccctgggcccaggataagcaaaccagaggcagatggcacacttccaatgcctgtttacctctgggctccccaggggcaggggcccactcaagcctctttcttcagcagtgatgatggaactgtgggcacagtagagccatgggtagcagcatcctcatttctttgcccatattccttcttggaaaagggtgggcttcctcaaagaccttggggaaagcaggggatgactgggaagacctcgtctaaatgggtcagacccagctggagcagaatgaatgcacataaacagtggttcgaggaggttctgccatttgccagctgtgcagcctggggggttgcttccaggagcttcagttgcctcatgtgtaagtggagacagacatcatgatgccttctttagagggtctttgtaggctaatgtacgcacatgcttacccagtccttggcacataggaagagtttcatagatgtcagttatcaacgtctgctagagactgaaattccccagggctgctgggttggctcaggagaggagccatagagttcaggaggagaaacctccttccaggcaaagccactctgtttgtccaacttgtcccgaagacatcaggtcctcggggttgggacaatgctgactctctctctgctactcctggctcctggcctgcgtgggggctgataaatattaactggtgctgatgggaacgctccctgtcaaggggacagcccattgtgtgcccacacacggcaaacactggttcctttctatccctgcgtgtggagcaggaggggctccctctctgggtctggcctaatccagccaagatacgcctccactgcctccacctccaagaaggcctctgagctgggtggttctaacagggctgctcctttgtcagctggaggtgcggagagtcttgtctgggctggcactgaggagagctctccatgcaaactccctgtgggcttctggccctaagctccttctgtccccagtgggttcaaagtttggcttgcaccagggatccagcccagcccttctaacggaggactgtagtttaggagcagccataactgccaggctgggacccttctagtaacaaacactgtccctctgacaaataaatgcctggcaagtaggagacaagatacatgaacccaggaagcaaaatgcacatggacccccccttacccttgtccccgacctgaccagttcccccacctcctgaccttcacctgaccctagtgaccccatagctcgctcacagccctggcccagagggaggcttgggggtccagtcctcgtcagcttctctgatggggccagctggcccgtcaaagctctgtccttcctcctaaggcctggaggcaccatggacaggtgggtgtatttgggagctgagccaggacatgttcgtcctgagtggggagaggtggaccggggacacagtaacccgctgggctgggccaccgtgaggggtcctggggcagctttctttagtctaggcattgttctcctggggacacttcaaatgaaggagattgtggcaacgaggcttggcagaaggggacattcccacaggcggagagtcctctgggacaggaacccagggtgcttggattctggggaagctggagttcggatttggatttttttttttttcttgtgatggagtcttgctctgtcacctaggctggagtacagtggtgcaatcttggctcactgcaacctccgcctcctggattcaagcgattctcctgcctcagcctcccatgtagctgggattacgggcgcgcgccaccgtgcccagctaatttttgtaattttagtagagacagggttttgctatggtggccaggctggtctcgaactcctgacctcaagtgatacacccgcctcagcctcccaaactgttgggattacaggtgtgagccactgtgcccagccggtttggatttttaatggggatagtccagttgccttggaaggccagtgattccaggaccccgttcaattccattagtagtcacaatgccttctttagagggtccctgtggctaacggaggcacagtgcataacacagtgcctggcatgtgtcttcacaggggttaataaatgtgaatgtgtctcaagggctgaaatatgggatggcttcgggtcccagaggtaaacaaaacctggcccttgagccttcctgctccctcttcctgtgtcagagcactcaggacggttcccaaatgaacacctcagtgtgtgtgtgtgtgtgtgtgtgtgtgtgtttgtgtgtgtgtgtgtgtgtgtgtgtgtgtgtgtgttcctggaagtaaggtgggagctccatgtcttagtagctcctggggtgagatcagaccctaacgtgtaaacacaggaagcggggaagtaccaggtgggcctggtttaatttacctctggggccccagaggagccagggacagcctgagaggctggtggggcctcagcgttccaggtgggggaaaaagctacagatcaaacagccgtctcctccaatcccccatccctcccaaagcctgcagcccacagaccctcctcctagctctcccaggctgtttgtctgcaggagttaagtcagctgaccatgtgtatgtcccatcattagcatttacctgctgccacccccctctgctcccggggtgctgtagagccaggtaagggctcccaccaggcctagctgtggggcctaggccaggagggctgggtgagggtgggaaaggaaagaggagcgaaggcagaagggccaccaggggagatctggccggacagcgtgactcctgggatggaaaggagaaatgtaggcaagaggagccctgagctcccgagaacagaggctatacagcctgggacccaggaaccagagcacccaggctctctcagccctgccatgtcctggtcgcatactggtgggcaagttgaaactctccctgggcctctgcttcctcatcagaagacaggagaacaggaaacctgccccacccaccccgagagctgtcgagaggattaaaggagataatgtaagggggagcgcagccacgcaactgggaggctgttgggaaagataaataaagtataaggtgacagatgtcagctgcccgagcccagaagtgctgcgggagcagctgtctttagcccacctgcctgcctgggggcagtgaggtgggaaactccctgcacaccgaccatctggacgcttcttggccctggttccccaaagagctgagctggtggagagtggctaggggagggggtcaggattctttacctctccccgcttagccacctgcctgtgtccccagcccctcccagccccaggcagccactaaagtactatccatctccatattgccccttctggacattgaatgtgaatggaatcatgcagtatgtggtcctaatttttttttttttttttttttgagacacagtctggctgtcacccaggctggagtgccgtggcgctatcttagctcactgcgacctctgcctcccaggttctagtgagtcttctgtctcagtctcccaagtagctgggattacaggtgtgtgccaccatgtctggctaattttgtatttttagtagagacgggtttcctcatgttggccaggctggtctcgaactcctgacttcaagtggtccacccgccttggcctcccaaagtggtgggattacaggtgtaatctttatcaacttcactccttatgatacaacttcattaagtgatacaacttcactccttatgttgtgcataatcctctaggttgcaaggatccttacactcagcatctggatggatacaatccactgtgcctggctggtcctaatatttttgaagttcaagttcattcacattatagctcctatcagaacttcactccttttttttttctttttttttcttttttttttttgagatgggggtctcactttgtcactgccaccttgaattcctgggctcaaaggatcctcccacctcagcctcctgagtagctgggactataggcacatgccacagtgcccagttgatttttttaatttttagtagaggtgtggtctggctatcttgcccaggctggtctcaaacccctgggctcaagcaatcctcctgccttggcctcccaaagtgctgggattgcaggtgtgagccactgtatccagtcacctgaacttcactccttttgctggctgaataatgtttgaggtgtggattcaccgtgttctgtttatcctttcatcagttgatgggtgtgtgggttgttctttttggctcttgtgcataatcctctaggttgcaaggatccttacactcagcatctggatggatacaaggaagggtgcttgttaacctgcagatttatgggcccatttccccacagattctgactgtgcgcgtgtgggaagtgcctgagaatctgcattttataagctccctgggtgactcaggtgaaggtatctgcagaccctttgagagacacagccctagtatattcttggttatacacactccccatcctaagcctccaggtctcagaatcgtatagccaggcaggaatctgaccaggacatcagccaggtgtggctgtgtcctaagcagccagctgggctttggtggctttatgagctcagcagggtcaactttggccttctccatccagcctgaaggctgacaggccccagggacacccttcctgggatcaacgttgcctttattgaggactcccaggatggtatgtttacaactagaaacatggccagcaacaaattctcctttaaagaaacaaacaaacaaacaaacagaaacagaaacagaaacagccttacaaggcctagaatcaggatttgttgtggtttagttttacctgtaagaatgaaggggctgtggcctggctccctgggctgcagataaagccagagccagattatctgctgaggcttcctgagtaggataggggtgttggtataatatgatttctcctctcaaggctacagccatgttggtcctcctgacttccaactgggaaaaacttgaggcccagagaagtgttggagcttcctaaaagtcacacagcaatgtcaaactgagcctcacttgtggcaccccctccctcggagatttttgccactagccttggaggctgtgggaggaatggtctaagtcagtggttctcaaccagggcaattttgcccccaggaacatttggcagtgtcacaaccgggggaagggtgcgactggcatctagtgggtagcggccagggatactgctcaacattctacaatgcacagaactgcccccacagcaaagaatgatccagcccaaaatgtcaacagtgccaagcctgagaaagcctggtccgtgctcaggcatttggaggccagaaagaatcctgttaaaagtgcaaagctgataaatgcagctgcagcctagtagtgtgacatgctttgtgcaaagtatttctcacctagatgcttgggatgagcctggtcccccgatagggacacagcttatggatgagacctcctctccctggcctgaggcccccacttccctacgggatcttgagtttccagcttaaaagactccgactccgtctggaactctggaaaggtcaaaatctgcattgaactaagagcagggctgggagaggaggccgtggaggtggggtctcaagccagagcctctgctgagttgggagcctggagctgcagcagcagatgggcttggagggacagagctctggcttgaagctgcccgcctcccatgtgagcaaagttgccattgaaacctcccagagacaggcacccagtatgagcatgagaatgcattccccgggggggctgtgagagagaatgcccatgctgagcccacctgcttaaggctgggggaggagctggctgaagccccacctggggtgtggcaacactcagctccctatggcaggtgagcctgccttggatgttgtattagtttgcaagctgctgtagcaaagtgccacacactgtgtggcttcaacaacagccacttactgtctcacagtaggtggaagtccacaatcaacatggcagcagggaagggtttgctccaggcctctctccttggctttatgcttatttatttatttatgaaacagaatctcactccctgacccaggctggattgcagtggcataatctccgctcactgcaacctctgcctcctgggttcaagagattctcatgcctcagcctcccaagtagctgggactacaggcgtgtaccaccacacccagctaattcttgtacttttagtagagatgggatttcaccatgttggctaggctgttcttgaactcctgacctcaggtgatcgacctcccaaagttctgggattacaggcgtgagccaccatgcctggctccccttggctttagatgagcatcttctccctgtgtctcttcctagcagcttccctctatgcagacctgtgcccaaatttccccttttcataacgacactcgtcatagtggataaagggctccccctactccaatgtgacctcatccttcctcaactgattacacctgcaacaaccccatttccaaataaggtcacattctaaggcactaggcattagggcttcacaacatgaaatctcggggggacacagttccacctctaacaagcgggtactccccccagccaggcagctgtttgtccactcgtgcccttggagaagcatggtgggcaggctgggttctgagacccacaactctgaatctgcccagctctgcactttgcagtgaggctgtgggtaatttacttaacccaactgattcctcatctccaggcaagtgataataagagtgccctctctttttttatttgtttgtttttgtttttttgagacagagtctcgctctgtcacccaggctggagtgtggtggcacaatcttggctcactgcaacctctgcctctcaggtttaagtgattctcctgcctcagccccccaagtagctgggactacaggcgcgtgccaccatgcccggctagtttttgtatttttagtattttagtagagacggggtttcgccatgttggccaggctggtctcgaactcctgacctcaagtgatctgcccacctcagcctcccaaagtgctgggattacaggcatgagccaccgtgcccggcaagagtgcccactcttaagctgtcagggaaaacacacgccaagcccttggcaccatgcctggcacaatcaccactccctataaacgaaagctttattcagcaaacgtctcttggacatctgctgtgtgccaaccaggggggcctttagagggaggctcagaggatgtacagaagcctcccctagtagggactgcatgtgctcacggggtggggggggtgcctgggtgggtggggcatgcgtgtgctggcctctgtagatgcacacgtcagttctcggatctgtgcagtgaagagccttggcacattgagtggaaggtgaagctccagctctctcttcccgacccagtgtttctcacaagaaaccccagtgatctgagctgagaaccagtgccacagcctgcccatcgcctctttgccttgctcatgtaatagtccgaaattctctctccactccacctctctcattctttaggactcaatgctagtgccacctcttccaggaagtcttcctctaggagtaggattaggtgcctccctgtgctctggcactttccaggttattgacatgatccttgagggtcggaaggcaggaaacctggcctccttttgcactctgtccctgagaccttgctcagcaagcgtgttgacctggcctgagcaccccatgctggtctccctggcagctcagagcacctgtccccacccctctccagctcagctctggctcacctggaggaggggcacaagggctccattgtgtgctagaggggacaggaatagggtgatgctctcgagggtggggcgggggctggagcccggacagatggaacccagacaaagccctctttaagcggggatcgtggcagctgtgctgacagtgtactacaggagcctggttagctaaaggaaccaaatgcccaggacgctgtgaacttggcagtgtctggaggttgtatgaaggtcatgggtgggatgggcattggtgcatgccactcaccctccctagcactgaaggcccccctcccagagggtgctcctcaggccactggtcctccccgtgtccacaggaacaccggcattgggatgagagcgggagcagctggctgggttctggttgcatcccatggggacccataccggggaactcagagccaggttttaccttcagtggggtctgacaccagagcagggctcatgctgcaagctttggggcctgggacaggggccagatcctagaagaggctcactgtgaccacctagcttctggccagctggcagggagcctgagtgagtggcctcattcttttccccgcacaaagcccccggtccatcctatctagagccctctcctgtaactggctgacctgaaatcccatctgattgggaaagacttccacatgaggctgccagggtcaggcctcctcttcccgcttccctcctccactgagaatcccagaaggggccttgccagatacctgatggtcataggttagttttgatgcattgagcacaggtatgaacctatcccaggagtccaggtggtgaaggaagggggtttgacccagggcacacgtagaatgctgagggagtctggtgggagccccagggctgtcatcctcctgggactgggcattctaaatccgcaagctcgatctgggtggacccagagggacccacgaggatctcctggatccatggagcccggctgtgctcacagctctgctgcctgctgccccctcaccagcctctcctcaccccagagcggccacccctcatgccttgtctgttcccaagccctttttgggactgtcaccagccctggctcccctgctgacccaggaagggagcatagcccctgtctctgcttctatggggcacccctatgacagcccaccctcctcagtaccctgcccgctgttaggactcagtttacctccttggacagtatcttatccccggttgagttaggtagggctaatgcacaccctgggtgttggggcttcctggaattacaggaactactgagggacagggcaggaactcccctacctgccccaccccacaaggcccctcgtgggagtaggggtggaagtgtgtgcgtgagaggcagtttagaagggtagccggagcaccagctgggacccagactgccaggccccagtcctggctctgccatttcctagcaacatgactttgtgcctcaacttccccatctgagaagaatcatcgtgatgattcaaattgaagtgctcagtcacaatgatccattgtgattatgtgctgggaggagggggctgcccatgccctacctccctcgccaccttccctcccactgaaagaggggaccgatgagacacccattccctacctccctcgcccccttccctcccactgaaagaggggaccaatgagacacccattccctacctccctcgcccccttccctcccactgaaagaggggacgcatgagatgcccatgctggctgaggctgccgtcatgcactccgttcagcacccacggccccagggagcatgctcccttctcatgaagagcacggtggtggctcattttcccctggctatcacaagccaggaccccagggagcccaggcgtccccaggcgcagagcagcatttagaggcgccagctgcctctcagggggcacctccgcggtgcagtggttgggggtggtgcatgaggacagggactatggtccaaagggacctcaggcaggtgcagggcctgtggaatcccagtgaccttctccacggtgagggtggagttgtgggtctcgacttgatggcagagtcatgggtgcggggaacaggtggccactctcagtctccacccctgccctcttaacagcccgttgaacaaagactgttgagctcttggcacatgcccagcgctgtgcccaagcacattacacgttgttccagggtcttcccagcgctgcaggtggatcatgctgctgtcccatctgacagaggaggagatggaggctcaagcaggttataccaggcccgaccaccaataagaggtcacagggccctcagtgcctaccctgattctcctttgctgcccctgctcctctcatcctaaatcctccaaactcaagccctcccacgcatctttgaatgtctcccgtcatttccatgaatctggcattgtctctatcccctcccataccctagactagggcccccagcaaggacgcagcctccttcctctgcatctctgcatagagctcgggacaaggctgagtacacaccaagtgcacaggggcagaggcaggggcagagtggagcaggccctgagatagttctagaaaatgggcccctcggttacctttggaggaagggaagaacccggccaggacccttctgtgtctcaacacacgtgccagcaggtatgcgcgcgcgtacacacacacacacacactgctgccactcctaccctgcagggaggggagccccagctgggattggcccacccatggcctgtcctggctgccagcccaagcccctctgcctccctttccaccctttccactcccggctcaggctcaaagctgcaaagggccactggagcagttccctcacagccctctcagctgcgagtggagatccccaagcccagcgtgctgacctcatccctcacccagctgcctgtggctctttgctctgtcccaggctctgccctggaggggtgaggcggagcaggcagggctgtagcgaggtggataggagtcagtggactttgaactcagagcctggttggcaccctgggtctccccttgctgatgtgtgacgacctggggggtgtgactcctttggaccctgatttcctcatctgtaaggtgggagtcatagctggccttagcctggggtcatggctggggttaaaagagactgtgtgaggccgggtgtggtggctcatgcctataatcccagcattttgggaggccgaggctggcgggtcacttgaggtcaggagtttgagaccagcctggccaacatggagaaaccccatctctactaaaaatacaggtggcacacgcctgtagtcccaggtacgctggaggctgtggcaggagaatcactgaacccaggaggtggaggttgcagtgagccgagatcacaccactgcactccagcctgggcaacgagcaagactccgtctcaaaaataaataaataaataaaagagactgtatgtgtgggtgcttgcaacaggtcctgacacaaaatgagccctgacagatgctgcccgttcttctgttgcacctctctggcagaggcagcatggggggtgttgaagtgaggggcaggcccccagggtctgggctcgtggtagcctgggcatcacctgtgtgtgctctgctcccctggggctgtactggccttgcagaggcaattgctcgttgtcaggaaggtgtcccctttgggcatccaagggcagatgatggcgagcctgacccgacatgggaaagctgaagaggacaggaatgggctctggctccgagacctacctccagtgggacctgggccctggactccggcctctggcccctcccatctcttgcccacatcctgaggcgacgagggctagattcagagcccagaagggctttgttaactctgatcgacaaaggggttaactttgttaaccttcctgagggttgacctcatcagggcccggggttcccaggtgaccgtgggcctccctctggggaccttgcagatggtggttctcatggacccaatggaggatcccgacgacatcctgcgggcgcatcgctcccgggagaagtcctacctgttcgacgtggcctttgacttcaccgccacccaggtgagggagggcctgggctggagacacgcaggagcccctcccccacccttagccccactcaggaggggccctccagggcccctgcctttgaacctcagcctccactccacctgctcaccctctgttccttgagccttccccattcaggaaggttctcatgcacacaaggcacacacacccggcctcctgcaaggatgcactggggttggcactcagacaccaccctacacggtacaactcgcttggctcctactgagctggaaaaggagcttgaaggccatctggtgtggggaggacaggggcagagggtgggttcagcgaagctgacaccctcctcgaggacccccatctcgcccatctgtgggatgctcccaggaacagatgtgatgcatcctcagggcggggggccaggagccagctgcgcaggaaggcgtctcaggtgtcctgggctctctttcagcctgacgtcccccactgtgagtgtaagcagagacatcccctcccccaccccccacccccacttatcttggggctggggctccagggacagaaacctctcctatcagaggtcaggaagagccagtgggtgcctgtgctgtgccccgcctgtgtcccggcccctgacaggcttccttcctcgcaggagatggtgtatcaggccaccaccaagagcctcatcgagggcgtcatctcaggctacaatgccactgtctttgcctatggccccacaggtaaggggaatgcccagactgtgggcgaggaccgcaatgcccctgtaatccccgtcaccctccaactagtctgaccccagctggagcaggaatccaggatgtggtcgctccacatctcacccagggccctccagccccagaggccccaacccgagccggggcatcatcctccccactccccaccacctccctggccctctgagagggcccagccttgaggacaaaccccggtttccaggagtgcctgcccagcaaggcctccctcccagccccaccccggtcaccctccaccttgttctgccccaggctgtgggaaaacctacaccatgctgggcacagaccaggagcctggcatctatgttcagaccctcaacgacctcttccgtgccatcgaggagaccagcaatgacatggagtatgaggtctccatgtcctacctggaggtgagtcccccagcctaggctcagatggggctggcctccctccctggggctggtcactgtgcagcttcccggggcgctcatcactgctgccctcctgcatgcctactgtgagctccactttacaaacatcgcaggctcatcagagaggttaggcaactaggccaatgtcacacagtaagcgagggagcggggattcaaactcaggaccctgcagcttcaaggccaagctccgccctgtgccacgctcaccacctcaccatcctcacaggcccattccttagagcagaccctgtctgccctgccaggctgcctccagcgattctgtgtatgtgggtacagtgaaaactgaacatacatgtacagtctggaacctgtgggcctttgccacccagccacagcctcctggtgcccaccccatgggagtgctatcaccagacagtgatgggatgtcagggactggggaagcacacagagtccagaagaggtgggaggctggacttcatctggctcctccgggagctgataatctcctgggtgacatcttaaggaggcagtgaggcacagcaccagcagctgctggccaacaaggtgttgattcagccagcaagactcgctttacggggtgggggtgcccccagaaggagcacaggggttgcctagcaatgaacagggctcctcactgggtgggggaagggggttctggtcatttgtcaggtccccatgcaactaggtcaatgtcacacagtaagtgagggaatggggattcacactcaggaccctgcccggtgcccagcctgtctggaaaggggtgctccttggtttcaaagcctcctgtaaccttggctccagcagcccgatgtttcctgtggatgctgaagcccctgaccccataggaaggaaagggcctttcctcctaatcagggctcttctgagaagagcctgggctcaggaagggtgaactcttgtccctttcctgcacgaaaggaaaggggactcagccctggccttgacctcctgcccttagtctcccttcccccacccctcccccacctgtcccgtcagatctacaatgagatgatccgggacctgctgaacccctccctgggctacctggagctgcgggaggactctaagggggtgatccaggtggccggcatcaccgaagtctccaccatcaatgccaaggaggcgagttttgtgtggccagcctggagccgctgagaggaagctcaccgcctgaggggcaggaggggcggggacagaagccagggagctgctccccactcggctgaggctgggacagacaggagaatcctgagtggcagcaaggaggggactcacacctgccccaatgcccccaccacgctgaccctgggagagtaaccaggcaacactgcctctccatttacacagagaccctgacctccagagagccgaggcccacgccaggcctctcagcacacggagcccagcccactccagcctgccctttcccaactgctcagacataggaccctccctgctagccccctcaggggctcctctctgccggagcacctacggcagtcgctaagagctgcctctcctccctcccacccagatcatgcagctgctgatgaaggggaaccggcagaggacccaggagcccacggccgccaaccagacgtcctcccgctcccacgcggtactgcaggtgaccgtgcgccagcgcagccgggtcaagaacatcttgcaggaggtgcggcagggccgcctgttcatgatcgacctggctggctcagagcgcgcctcgcaggtgaggctgggacctgggctgggcagaggagggagggttgacccaggcaacagcggagggcaggaatggtgactcccatgcaaggccagcaccacaggaacaggggagacaggttgggaggtggggacagggacgctggcatctcagcttcgtaggagttggagcggggaggatgtcgcagcgaggtggaggggatgagtggagacccccgggttaaggaagtgaggaacgttccagaggagcagggttggggggaatggggtagggcatcccgggaagagccaaggagctctggtgggaaggggaaggaggatgggggtttctccagggaaggagactgtggctgccctaggggagggatccaggaagacaatgaatgggcccaaaggagtagttggaggcagggagagacaagcatcccctgactgggaggacttgacacatcctgggagaggacccagccagtcacatcacaaagaggagaaggtccccgtcacccatttctggcagcatctttgtcccctctcatgaagcttggctttgtggcagcacctttgtcccctcccatgaagtcctgcttgccgagctctgcagccttggtggcagcaccacccagctggtgtaggtctgggctccctcgtgcaggcaatcttgggggttttatggtcacctgagcaatgaggctgggtgatgtcaccattgctggcactggaacaaatgcaagggaaatgacagtgccagaaagaatgagcagtcttttgtctttgaacatctggggtcggatccgaacagggcaggttcaagaaacttacccctcccttccagtaaagcctggggggcttcctggaaggcacacaggggagaggcctgggaggagagagagtgcccttcagccactggagcgagctggtcccggcttctccaggctgggcagagccacctcctaaggggagctgcaggcagggcctcctcggctttgacatgctcctgcaggcccaagaaaaggagaagaacctgccctccaccaccatgcacatgtgcacgcactttcctccttgctccctggagcaccctctggagcaccagtggtcctgccggctcccagctgagctgcctggaaagcaacctccctcccatctcatccatggcactgtgtgtcaggccgtgccacggcacctgccctgaggagaaccggccatctcagccctcctcagaagctgtcagcccatcactcttgttcagaggcctctgggtctcttaaccttctccaatgccctcagtggccttggcaggaggacggccacaaggtccttgggggtttattacccaggatcaccaggtcattcattggtggggtggctggggagaaacccagtcccctgcctcatcaggccacacgtgtgccctttgctcgccccctagacacagaatcgtgggcagcgtatgaaggagggggcccacatcaaccgctcactgctggcactgggcaactgcatcaacgccctgagcgacaagggtagcaacaagtacatcaactatcgcgacagcaagctcacccggctcctgaaggtaccagccacagctgggcctgggcactgggcaccaagggtgaggctgccagattaaacaaatgaaaatacagggcacccagctaaattccaacctcaggatacacagcaaaatttattttagcgtaaatatgtcccatgaaatatttgggatattcttatgctaaaacaaagtaattgcatatctgaaattcaaatttaactgggtatcctgtattttatctgacgaccctaaccaaaggctgggcaatgggaaggaaaaggagcacgtgatacccccacccagggctgtgggtcagagccgtctagatttgggggtgcaggtgggcagtcagcctcatggccccacaggtcagctgtttgggggtggcctcctttgtgcaggggtgtccttggccttaaattatagcagcatcactgagcgcccactcctggctggtctcttgaattcagtacttcactctattagctccttagatctcgtcaacaactctatgagtttgagggattacatttgcagatgaggaaactgaggcacaactcagttaggtaatgttcctaagggctcacactagtaagtgctgaaagtaggatccagtcagaggcctccctgatctaatatcagagtcaccgcttacttaacattgccagcagctgccgtcatgactgcacctagaagccggggaggtggggacaattgcaaaaggactgcccccttaaaaagcaaggaaagccgggtgtggtggctcacgcctggaatcccagcactttgggaggccgaggcaggtggatcacttaaggtcaggagttcaagacaagcctggccaccatggtgaaaccccatctctactaaaaatacaaaaattgcccaggcatggtggcagacgcctatagtcccagctactcgagaggctgaggcacgagaattgcttggacctgggaggtggaggttgcagtgagctgagacagcgccactgcactccagcctggatgacagatcgagaccctgtctcaaaaaaaaaaaaaaaagaactaaagaggtgaatgagctttattaaggttacacagctggtaattgctggagcagggctttcttcctcccaagcctcacaccatatgacgctcagcagccgggtcccttaagtgtaaagagacagagagattgcactcgccagggagggcatcgtgaacagcctggcaggaggaaggcctgaggaggcagtccccactgaccacagccacctcccatccaggactctctgggaggaaacagccgcacagtgatgatcgctcacatcagtcctgcgagcagtgccttcgaggagtcccggaacaccctgacctacgccggccgggccaagaacattaagactagggtgagggcccctggaccgtccaccaggacacaccttcctgggctgagattcaagcccccgggctgatccctgccaccccactgcactctctggaaccagccactgctgcactggcctcattccctagttgatcgtcacctgtacactttccctgcacctccaaaccctgctcctctgccgggaagccgacagctcccaagggtccccgcttcctccagtcccaggactgtgctccccctgcctcatcccctcttctcttcccttcctcgtcttcagatgctcatttagacctttgcatttccaaagcacctcttcatgatggtcatcacaggaggcaagcttcattgagcacttgctctgagctgtttcacatgctacctcctttgatcctcaaaaaacagcagtattattgcggttcccatgtacagattaggacagcaaggcttaaggaagttaagtgacttcccagctggccagtgatggcgctgaggatggaaatgagatctgccccgtttccaagtccgtgtcctcacctgtctgtaagcatgtcggaacccttgccatccgcttagaaatccatttccacctgttcgtgtgtggaggagtgggaatggattcatgtatgatagcatgtagggaacattctcccaacacctaacacttgccagctgctgccctgagggctgtaagttttattccaacccctcaatgggggacgggagacacattcttgaaacagctcattgatggttcagaatattcctaatagcaggtaaatgatgccaatggtaggtgctggggcaagacaggaacaggaggtgggggtggcctggtggggtccagtggaactctctggagactgtgagtgggaccctgaaggctgggaggacattccagaaaggtgggagcagggagagcacaggttccaaaggcaggaaggggatggcgtctgtggtgggtatggggagagcaggacaggtcttcaactggagtgggatgttcatgcaggagcggtgagcccagagaaaatcagagagatgggggtggcccttcaacaacgggtggaggaatgaggacgttccccgcaggcattaggaagccactgaaggttgatgagatctagcagtgagtgtgacaggaggttgtggaagtggaggaaaggaggccattactgtcacccagaaagactgggggaggcagggggaagaaaggccctgcaggcaggcctcggtgagtgcacctggggtgactgcatcccctccgctccatacgtgttccctgcaggtgaagcagaacctcctgaacgtctcctaccacatcgcccagtacaccagcatcatcgctgacctgcggggcgagatccagcgactcaagcgcaagattgatgagcagactgggcggggccaggcccggggccggcaggatcggggtgacatccgccacatccaaggtgcgcctgtgggtctgtgtgagtggcagccccctccggccagcctcacgttgctctgggatcaggccatgttgtgttcaaatccagaatcgggctctttctggctgggtggttgagctaggcactcaccagctctgagcctcctagcattcagctgttaaatggggttgtgatctctgcttcagacagttaccagagatcacaagccgatttcccaaccccaccttggaagagtaggtgggatcccacgagggagaggcacgtgagcaatgagctgcgcagggcgcacactaagggctgtggcgtagggctgcgaggtcatgcctgcacccccggaatgggctccgtttccttgtagacctgcatatttgctatgatggttttccaacagacagtaaagctttttttaaaaaaaaatttactaatataaagagagaggcagacagtaaagatttttttttttttttgagacagagtcttgctctgttgcccaggctggagtgcagtggcatgatctaggcttactgcaacctctgcctcccgggttcaagcgattcttctgcctcagcctcccaagtagctgggattacaggtgcccgccaccacacctggctaatttttgtatttttagtagagacgaggtttcaccatgttggccaggctggtctcgaactcccgacctcaggtgatctgcctgcctaggcctcccaaagtgctgggattacaggtgtaagctactgtgcctggccacagacggtagtttctaggggcacctttttatagttggcacagaggtgctgtaagggttagcaggagcccagttcataccaaggagctgggaattgcttttgggcaacagcttgaagactcaatgtgggagtggggtctgggaggatgtagtaatctagggggtcttcctggaggaagcagttggacaggaagtgggagcactgagttgggaagaaaaggaggggaggggcccaggtgggcccaggctttgctagctgaacttgccgcctcctctaccttgcccaccctcacccatcggcagctgaggtccagctgcacagcgggcagggtgagaaggctggcatgggacagcttcgggagcagctcgccagcgccttccaggagcagatggatgtgcggaggcgcctgctggagctggagaaccgcgccatggaggtccagattgacacctcccgacacctgctcaccatcgccgggtaagcccccctcccaggaccctccaggccccacccctgtgcctgggacagaggagcacgacctgtggctgtacagtgtgccctgcccccatggcctgaatgccctgtctctctgggtggggctgcggcagctggaagcatgagaagtcccgccgggccctcaaatggcgggaggagcagcgaaaggagtgctacgctaaggacgacagcgagaaggactcagacacaggtgatgaccaaccagacatcctggagccacccgaggtggccgcagcccgggagagcattgcagccctggtggacgagcagaagcaactgcgcaagcagaaggtgtccagggtttggggggacaaggagagtgggtttaggggacagggtgagcaggtttgagaggcaaggcggaggggccagggtgggggtagccgtgagacttgggaactcaggccacaaatcctgtgtgactttgctaagctctttaacttctctatgcgtcacattccccacctgtaaaatgggagcagtccatggtgcagccctcatggggttgctgggaagattacataaatgcctggcacataccaaggactcaaaaaatggtaactaatgttataattagggtttttcaggctgggcacagtgactcacacctgtaatctcagcacgttgggaagttgaggtaggcagatcacttgaggccaggagttcgagaccagcctggccaacatggcgaaatcccgtctttactaaaaatacaaaaaaaaaaaaaaaaaagcctagtgtggtggctcacgcctgtaatcccagctactcggatggcagaggaataagaatcacttgcaaccctgcagaggttgcagggagccgggatagcgccaccgcactccagcctgggtgacagagagagatcctgtctcaaaaaagaaaaataataataataattagggttttcccaataacagatctttgccttctgttctgggacatacccagaccaaaggggctttagggtatcatgagccctgagggggtcacatgggctggggttgagcagttatcccccaagctggttccaggggtggtttgcggtcaggatagcaagaaagtggacactgaggggccaccttggagcagtccctgattgtaaggcccaagattcagcttttagggttggcctcaggctggagctccagacagatgcctggagtccaggcgctggagggtcgaggacgagctgggcaggcggatcggacccctctccccgctgccagatgctgacctgcgcctcctgcagctggcgctggagcagcgctgccgggagctgcgcgcgcggggccggcgcctggaggagacgctgccgcggcgcatcggctccgaggagcagcgcgaggtgctcagcctgctgtgccgcgtgcacgagctcgaggtggagaacaccgagatgcagtcgcacgcgctgctccgcgacggtgcgctccgccaccgccacgaggccgtgcgccgcctggagcagcaccgcagtctctgcgacgagattatccagggccagcggcagatcatcgacggtagggcccacgcccccgcgcatctgagccacccgcgggggggccgctggcactcactgagccctgccccttccccagcagactacaacctggccgtcccgcagcgcctggaagagctctacgaagtgtacctgcgggagctggaggagggcagcctggagcaggccaccatcatggaccaagtggcctccagggccctgcaggtgggtgggcgcctgggcggcctgaacatgggcacatgtgcccagggaggggctgatgaccaaggcaatgccttcaggcagctggaggggacaggaccaggctggctggcaccccagggagttgactccctttccttcttaccccacccaaagccttgtcaagcctgagtaagaccctcctccttgggcactcctgggcatcacttgctcccacccagggtctgagggtcagggctggccatctgagatatcacaaatggctccagctgccctcccaggagaccaagcatcaggcagtgccactggggaagcctagcagaccacagcttaaccccgaggacccaaacacaagcccactgcccttctggggctcccaggccatcttacagcccttgtcaccctgtaagcctttgtgactctgtgctgatttggtccaggaccaaatcttctaactgtccaccctggctccctcctccccaggacagctccttgcccaaaattaccccagcaggaacctcactgaccccagattctgacctggagagtgtgaagacattgagctctgatgcccagcacctgcagaacagcgccctccctcccctcagcacagagaggtgagatgggggccacctgccccagcccccaccctgtgccctgtcccagagaggccaacccagactaaggctaaatggggaacacagagcagcaatgagagggagcaggtggcccaggtctggagccaggactcctgggttctctctcctttcacaccaacagcttctcccctggggtgggggtgggacctcggtgagatagcctggtctacagccactcatcttcctctgccaacttcagtgaaggccaccacgtgttcaaggctggtactggggcctggcaggcaaaaagctcctctgtgcccaccccacctcccatccagctcggcagcctggtgacgcaggaggtgagctctcagtacccgatggccccacgagctccactgcagcgggtgcgggacatgggggtggacagcagcagttgggatggaccctttcccaaacggcaccagcttgaggccccgctgtctctgctgagtggggcatggggtccctgctgtgtttaagggtttcctcctcccaaccactccaccccacaggccccggctcaggacagcctgggcagctggatcaactcttcccctgacagcagtgagaacctgtcggagatccccttgtcccacaaaggtatgtgtgccctctgctgcccggccacctcacctggccttgtctaaactgttcagatcacccagctcaaagccctttcctgccctctgcactgccaagtgcaaccaagcattgggtgctacacattctgtagaggcaccattgcccctgaggattagtcagtcaaggacacttaagagtcttctctaagtcaaggacatttagagagatgggggcagaatcggaaattagaaaagagacatgtggcatggagacttatgtcccccctcccccgccgcctccgctcagtaatcactgtaatagcaaatatcgattcaatgtctgccccctggataatgtaggttgagcccatttcctcaattaatcctggaaataaccgatggcattagttttaccatcccccatttgcagatgaaagtgaggctcggaaatgggcccaagtttcttacatagcaaacccctggaagtgctaggattgaaacccaggaggtctggctcctacccacgtctgccatgtcagaggagggtgttgagaggtggccttgatctcgggttgtatgttccccgtgtcccgctgcagagaggaaggagatcctgactggcaccaagtgcatctgggtgaaggccgcccggcggcgctcgcgggccctgggaaccgaggggcgacacctgctggcacccgcgacagagcgcagcagcctgtccctgcactcactgagcgagggcgacgatgcgcggccaccaggcccactggcctgcaagcggccgcccagccccacactacagcatgctgccagtgaggacaacctgtccagcagcacgggcgaggccccgtcccgggcagtcggacatcatggggacggccccaggccctggctgcgtggccagaagaaaagcctgggcaagaaaagggaggagtcgctggaggcaaagagaaggaagcggaggtcccgatccttcgaggtcaccgggcaaggggtgaggcgaggcgcaggggtgggtgtctaggcactcccatagcagctggaggcctgagggctggatttctccaaaggctccagggcacctctagcctaccccatacctggaggcaccaccctccacagtctctgtccccagcctagcatagtagctgggacagatcctggtagcagatccctgtgccgctctcggcctcaccccactgttcaaccatcacagctctcccaccccaagacacacctcctggggccccatcaggcggagcgcatctcggaccacaggatgccagtgtgcaggcacccagcccctggtatccggcatctgggaaaggtcacgctacctttggccaaagtcaaactccctccaagccagaacacgggtcagtatgggcaaggaggggatggggaggggaggcctccaccaggcaggggagcagagaagacacattgcatttcctgcgcctctggctgccccttgctggaagcatggttctagcagaatactcatgggactggcatcctggggtggtgcccctagagagttcaaggccactgggtgatgggagaggagttggggaggcattccgaaaccactgatcctgcccctttccctgttgcaggcccgggggactcctcacccctggctgttccccccaacccaggtggtggttctcgacgggctacccgtgggccccgcctgccccacggcacaagcacccatggcaaagatggatgctcccggcataactgaggggccctgcctggaactggctctctcacctcccaagactgaatggggtctagcagggcatgggaggtggaggctgggcagatggagatgaccaggaagtaagctcaggatctcagcaggccagggctcctgagacccaggaactggggtctctgcccaaccctcccatgctttcagtgccactggggaaaagaggtgaggccaggggacatggccaggacggctgggctccctggcttcccagccctggacagaatgctgttgccaaaacctgcacagccctgaggccagcctcggccttggtaacggaggaaagcagctgacagtgagacggggctcctggcccacgtgtggggcacgggcatcctggatggttggggaggcgccgacaggcacttcacgtattacaattggggatgtgggtgagggagggaatctggttttgttacttggcagtggttttttctcacccttcctttttaacaataaaatcccatttgggtcttga

SEQ ID NO: 365 - DNA, 5403 bp, Homo sapiens
ttaccactctgagcatcggtttattcaggaccaagaacgttccttcaagtcagctgtgaaatcagctcttgaaaccaggcatcttgtctaccacgcctcacctggactccaccccagccctagggtggccggcgcctggccatccaggggaccaggcttgttgccacctccaggctcgccttgcccttcccagacccacagggaccacctaggccaggcctttattcccagaccccgaggctacttgggggtccggataagggtgtggtatacgggcttgacgatgaggtgcaggtgcagggcgttctcaaccaggtactcggagttgcgccgctgcaggtcggcgtgcgccaggaagtcgccggcctcctcgctgctctggtggaagctgtaggcgtggcggaccagcaggcggccctgctggcgcgcccccaccagcaccgtcttctggaagctcacgcccgccgcgtcgccgccgctgctggccggcgtcaccaccagccgcggtcggccgtcctccgggcgcgcggcgggcagagcagtgcccgcggcgtccgcgtaaacgggccgcaggctgacgggcagccagcgcggcgagaagagcacgttccaggtgacccggcggcccgcgtcgtggccactcgggcccagctgcgtctggaagctggtgctgcggtcgtcgcgggccgggttgttgatgacccacggggcgccccaggcgggcgcgaggtagttgcggggcaggaaggcgctgccgttgacgtcgaagaacttggcgtagtgcagcggcgacgcggcgtggaactggtaggcctgcagcaggaggtcggccaccgcggggccgtggcgcgccagggctgccgagcgcgcctgcagctggaacagctgtgccggtgggatcatggggtagcgtatggcgcgcagcgcccgctcggccacggcagggggcggccgcgcgcgacccagccaggcctccagcgcgtggaacagctccagttcatcctgcagcaccaggtccgagcgttgcaggagctgccagagcagctcggggctcacggcgccccactcggtgctggccgccacggccgacaggttccaggccaggaactgcaggcagctctcgcgcagggcctcgtccccggtgcccaccgcgtagtggtaccagcccaccgccgggcccgcgcctcccgccaggtgcgcgcgcatgtagtcggccacgccgcgctgcagggaggacacgccgtacttggtggccagtctgtgcagggggatggcctgggtcagcagcacggtcagctccccgcagtacaggtacctgcgggagagaccgagaggtggggcggggtcagggcggtacccacctcccaggatagattttttagagtccacaggggacccggcctggagttggagcttcactgtccgggtgcaaacacagtggaagccccaccctgaggcttcccatgttttcctttcaaggacccttccaggccattcttacttcacaggctcttctttccgtttccgcggtgatgtagaaattgcctgcattgactgtgcctctactaggcgtgcagccctaggctggaacaaaacagacgtggctcctgcctttggggtttccagtctggttgggatccatggcctgccttctccttgccatgagtctgggcaagtcacttaacttcagtgaaccttaggctaatcaatcacctaggaaagggggagtggcacacacccctcagggttactgtgacaaccagaggagaataaagaatcttgctacaggccaggtgggtgctagtggctcacacctggaatctcagcactttggaaggccaagatgggaggattgcttgaggccaggagttcaagaccagcttgggcaacatagcaagaccctatctctacaaaaaataaaaaatgttaaaacattagtcatgtgtggtggtgcacgcttgtagtcccagctgcctgggagtctgaggtgggaagatagcttcagcctaggagttcaaggctgcagtgagctatgatcatcatgccacgacactccagctttttttttttttttttttttttttgagatggggtctttctgtattgctcaggttggtctcaaactcctggacttgagcagtcctcccaccttggcctctcaaagtgctgggattacaggtgtgagcccccatttcttttttgcagcctcacctttctttttcctctcctactgttggtgatcacttctgctgagtatctcttcgtcttacttctgccactgtcccatggctcacctttcctgccagtccccaccggcacacggcaccgcacttgcctctataggagtgtggcagccactgccagccatcttccccaacgtccatttctcccctttcccctgcgtgattgcctctgggaataaaagaccacatttcccaggctccctcattctggccttggccatgtgactaactgctggtcaatgggcgcagtttgggatttgcaggaaggctgattaaatgcaactgattccgggttaacaggaagaccctttttgcccttctgtcttatcccctttcctgttgcctggaacttggaagcaatgtatggaattctgcaggcatctcgtctgagccgttagaacagagttactttcttagacactagtgtgaatggcaccccctgagcagcatcacggcaggaggcaggaggtggagagagccgtctaactttttcagctccctagccctgtggttccaaacctggccaaacaccaaaaccacagcgatgctttcaaataaaaaatattcgtctataatggaatatttaggaaaataaaaagtaaataaataaaataaaataaaaaatgattgctggccctaaccctagacctgaaactgacaatccaggttgggatccgtgaaactgtagtttttttgtttgtttgtttggttggttggttggttggttggttgatttttttcagacagaatcctgctctgtcacccaggctggaatctagtggcacaatctcagctcactgcaaacccaaactctgcctcccaggttcaagccattctcctgccttagcctcccaaatagctgggattacagtcgtgtgccaccacacccagctaattttctatatttttagtagagacagggtttcaccatgttggccaggctggtcttgaactcctgacctcaagtgatccacctgcctcagcctcccaaattgctgggattacaggcatgagccaccgtgcccggccccaaaactgtagtttttaaaagctgtctatggccaggtttggaaacagctctgagggggttactaggaaccgaaagtgacatcaaactgcacagatgacacgggcaaagacagggagctgtacagtggaagaagggatgcaggggtcactgtcatcccagtgatgtccggggaaatggacataacaacctctaagggcctgggcttccctgaccctgtaggtggaggagccgggggctgaggaagggatgaagccatcccctagtcttccgcgtccccacctgatgaacttgtcgaagacagcggcgcagtcctgtggctcctgcagcaccgcctcgctctggttacttagcagctccaggaacagctcactgtgcagtcccagcagcaggcggtgggcgtggaatacccggacctcatcggtgcccgcagcctgcacccgcagaaccacatcgctggcgttgccctgccgcagcagctcctgcaagcgctggagcaccgcctgggagtggttgatggaggtgccagctgcctccccgccaacatcggctctctgtgctgcagcaggaaggaacacagcatagcctgagaaggtgcccgggcccagaacctcagtcaggggtggagagggaccagctggagacatatgcatgggtgtgagcagagggcaaggtgggcctaggcgggttgtatgtgcatacctgtttgtgcccacgaggcgcgtggatgcatcggtgcacatacaaacgcaccctgggtgggaaggtcatgccaatgcaaaccccaagaggatgctcttggaagggggtgcattcaggcagggggaggttgtgctcaggtttaggacaacatgcccagaactcatctccatgctgccagccccccaggcaagggttgaggaaactcgtggtcccacccttctcacttcctaaagaattatccatctaaccccttggagcagtagtcagaagtggtgcattcactaacaaatatttattgagcacttactatatgctagacattctcctaagagcttgggatgtggcagtggacaaagcaagccaagttcttatgctcataaaagcacgaattgacatatcaaacgggtaagacacacacaaataagcactccagttttaaaggagccagccagggaaccagtgtcaaggcaggctccagccccgcaaaggcccttgaacggaatgggcctggggtactgggagcagagagagcattagggaggccacagcagtagcaggagagaggggcgggtgtgagacgaggctgcgggtgtggaagggaagctgttttccaggcccagccctgccctcttgggtcctgatctctgagacagaagccgattttctggggtggccagcaggggacaggagaaagtgcgaagggccagctggtgctggaatagaacttcctgggtaactgagcattgaggctggccaggccggccctttgcttatgctccaggatgccccgacagtcagatggggatatgcactcagttatagaaactgtcagcagctttcccaagccgagaacagcgaggggagcctcgcagagggaggcgggcgggggcctgattgcagcagatgggccgcagccacatgtgcacgcacagcacatgcaggcccgtggtgcacacaggagagaaggctcacacaggagcagagcatctgtgcatgagagagggaggccgagggacaaagggagggtgaaagagaagcgggtagtatgtttcccagcacggccttccccagctgtcactttgaaggacctgaatgctgatggcgtccccattcagcctctgcccaggacaatgggcaatggagggtcctcttgtccttaagagccctgcccacctgcctgccaggcccctccttccttcagacagatgagtccgtggagctgtccggtccaccccgtgctctccccagcagctggacaccgccccctcctggccggccgcgtgcagccagggctgggacgacctgccgctccaccctgccccgcacctggcccactgcccgctcacctgcatgggtgaccaggcccaccaaggtcagcatggcccagaagctgccccaggacccaggcttggagtagcctctcctaggcat

SEQ ID NO: 366 - DNA, 5095 bp, Homo sapiens
atgagtattatgatgttgcccatggagcaaaagatccagtgggtccccacttccctgcaggacatcactgctgtcctgggtacagaagcatatactgaggaagacaaatcaatggtgtcccatgcacagaaaagccagcattcttgtctcagccattccaggtggctgaggtctccacaggtcacagggggaagctgggacctccgaataaggccatccaaggactccagcagtttccgccaggtgaatccagctgcctcccagaacaggccttctatggggtgggatggtaagttgctggaaggacgtgcatggggcatcattgtagcaaactcagtccccctcctccatctctccctctcctcgctctgaatccagggagctctagttttctgtgtagcctgtgtgacagccttggttgaaacccttgtgttccgtctgaagaatatttaaggtttccagtcaagtgtacatccctcaaagaaacaaagtgggcttggcatggtgactcacacctgtaatcccagctctttgagaggccaaggcagaaggaccacttgaagcctggagttccagaccagcctcggcaacacagcgaggccccaaactctctctatatctatacataaaatttaaaaaacaaagtgtagggacagggtgggcactcggtaaatgttggcagggaccctccttgcccctcacccatggcagctccttgaagagagggtcagcctcctctcacccctagcctcctgctgcaaggaggtggtggcctggggcgtcatctgtgctacttgcactttctggggctggggtcccagcactccaccagaggacctgccctgagcgggcagctccgtctccagtcccactgtgccacccagggtgcctagccaaaccatgggactttcaggcttgcagggtcaggatgtggccaccagggggcagcagggcctgcgctgtgagtatccgagggggggttgggatggggagttccaggctctgatgtgagatctaactcccagagctgggaagctccctatatttcctgccatattttctgctgcattcccagaggacaggccatgggaggtgattccaggggggcctgagctctcctcccgagaccgtccacggggcatccatgtcccgggtacctgcttgtgggctgctctggtcactcttcctctagggcaggagagccagtctggcctcttctgagtgcacaccagcaacggctgttgtttatttgccagggattgatattcttgagggatggtccatttcaccagggccagggaaacaacagcttgcaggactgtggtttcccagcaccggctgcaggcagcctcgtccggctgctcccagaggatgccccaccctgtgcacggctgcctgccatcctgcccctgggggtagcctccacctcccccaccatggccactgcaggactgaccctgtgcacctggtcccctgagcctcttgggatcatagccctgtctgtggcagccttaccactcctacctggcacgacttccccaactcctcacagaggtgccctactctcttccctttcagtctggatgctcatagagtcagcaccctgagtccttctgcctgtccccaaagtcctcagccccaggtttgaccccagctgaacacaggccagctcacagagtgccccggggcacgaggcagccccccagaacccccatcctgccatcctgcctcttctcctcacttcctgctcccccaggcatagacatacctgtgaaccccatgccaccctcagctcgtctctcctgaagctgaagcccctgcccagcccgaccccttcccctgcctgtgcgccttagagcaccctggtttgctccaccagcatctactctagctctttccccggtgcctccgcccaccagttccttcctcctccttcccccgccccgccccctgcactaacaggctcagtgtctgcgtaaggatcctggggcaaacaaccacttggagagccaaggggtgagaggtacagctggcgatgctgacagggagctgcggggaccctcagaaaaagccacaggtgacccaggactcagggccccagagcatggggcttgagggacgagagacaggtaaggcatcttgaagtggggtgtgctgggggcaataaggtggaaaggcaggagggaacaggaggcaggttagggacctagagggtggagtaggggccaaagctgagagtgagtgagcagtgagccccccggcctcagcaggaaacgaaaagctggagttcagcctgaaagagacgcgcagtgtggcttcaggggaacaggggccagagtggacggtgcttatcctagaccagccaccttacccctgtggactgagtttccccatctgtggacttgggccattccagctttagtggtgctcacctttgaagagggtatctttagtttagaaaagagggggccctaccaacagcctctccttagagggggacagctgttgagtggagctgtgcagacctggggcctccactgtggacctcctagagaggtccctgtgtgtggctggcatcacccgggtcggaatcacccaggttgctgattacaagcacggctgctgcaaccccgcttcagaccctctggcccggaggcggcccaggagcctgcacctcgacaagtgccccctgtttcagagcccctgctaggccgggtgagggcccatggggaggacccatggggagcaatggtctctatggcagcaggccgtgctgccagggacttcccatcagtgggggagccgggccactgagggagtggggtgacatggggtgggggtgagggtggtcttggcaagaattctcacagcaacagacagtgcactcagctgggtctgactagagggtctgcacagagcagggtgactagaaagaccccaggtcagggcggggctgcgcccagccaggttagaaatagaccagaggctctgactctgcccatccgcaccttctagctggccagccacgagtgaccctgctgcccacgccccacgtcagcgggctgagccaggagtttgaaagccactggccagagatcgcagagaggtccccgtgtgtggctggcgtcatccctgtcatctactacagtgtcctgctgggcttggggctgcctggtgagtggggagctggggtctggggacttgggcttggccagaaatggggatcctccttcaatgggtgccagtcctctgtgtttgacccctgaggccctggatcatagacccctggtctttccttgccattgtcagggtgttctgggtcactggaggggaatacaagtaaggggctaggattgggggtgctcacagctaaacccaagttttccccagcagtgagcgcactcttaggataacaaaattcacataggaactggctcagctcagtacaaagctccccgtgctgcccatgccttcagagagcagagcttggggcagaggtgggtgtgtggatatgggaaggacgggtggtctcggccctggggatttccccaagtctgatagctaaacccatgcctgtgtctagggacgcctccattctggaggacacagaaaacctaaaaaggacttggaggacaatgccataggacaggtagctttttttttttttttgagatggagtctcactctgtcacccaggctggagtgcagtggcatgatctcggctcattgcagcctccacttcccaggttcaagcaattctcctgcctcagcctcccaagtagctgggattacaggcatgcaccaccgtgcctggctaatttgtatatttttttaacagagacggggtttctccatgttggtcaggctggtcttgaactcctgacctcaggtgatctgctcgccttggcctcccaaagtgctggattacaggcgtgagccaccacacctggccaggacaggtggctgctgaggacccttccatgtgcacttacctgtgcataaccggggtacagccagtggcctgcagtggatggacagggcagagctggcctgggtggccttctgggcaaagtggggtttcagaaggatctggaaggagaaaaaagagaagccagcgcagcctctgcacatgcagatggggaggtgcgatggcgacaccttggaaagcagagtctgagctctcttctgatgcctctcccctccctcacctcggctgccctcagtcagcctcctgaccgcagtggccctggcgcgccttgccaccaggaccaggaggccctcctactactaccttctggcgctcacagcctcggatatcatcatccaggtggtcatcgtgttcgcgggcttcctcctgcagggagcagtgctggcccgccaggtgccccaggctgtggtgcgcacggccaacatcctggagtttgctgccaaccacgcctcagtctggatcgccatcctgctcacggttgaccgctacactgccctgtgccaccccctgcaccatcgggccgcctcgtccccaggccggacccgccgggccattgctgctgtcctgagtgctgccctgttgaccggcatccccttctactggtggctggacatgtggagagacaccgactcacccagaacactggacgaggtcctcaagtgggctcactgtctcactgtctatttcatcccttgtggcgtgttcctggtcaccaactcggccatcatccaccggctacggaggaggggccggagtgggctgcagccccgggtgggcaagagcacagccatcctcctgggcatcaccacactgttcaccctcctgtgggcgccccgggtcttcgtcatgctctaccacatgtacgtggcccctgtccaccgggactggagggtccacctggccttggatgtggccaatatggtggccatgctccacacggcagccaacttcggcctctactgctttgtcagcaagactttccgggccactgtccgacaggtcatccacgatgcctacctgccctgcactttggcatcacagccagagggcatggcggcgaagcctgtgatggagcctccgggactccccacaggggcagaagtgtag

SEQ ID NO: 367 - DNA, 15902 bp, Homo sapiens
agaacctggaacggtcacaggaaacccgggcgcggggtagtcgggccgagggggacctttgcccacggtccagagtggtctggactcggcccacgcgtgagaggagcgcttggtgacgatcccacgtacgcttggtgactggtggaggtcccagagaaggaccgtgcgtgcaaaaggcgaacctcggtgtgcggtgtgtccacgtgtgcaagctggggaggggagggggcgcagaaggcgtgacaaagacggactctgtcttgagtgtgcgcctcgctccggcccgctcccagcgaactgtgcctgaagtgtgtctcacgggagggccaggacgaaggtgacaaaggctaggtgtcccccacggagacgcgccaaggtagccccgcgcgtgtccgtaggcgcgctctctggaagacgcggtggggggtgcgcagggctgcaccctcacaccaattgccccggcgaaggccgagcccagaaagtgagtgcgcgtgagtgtgcgcgcgcccgcatgcgggggcgtggcagtcaacagcaacaacccacacgccggcagggccagaaactcccatctccctcaccagccggaaagtacgagtcggctcagcctggaggtgagtcggggcggggagggccgggcaggctttgttcctgtgtaaacggagcgcacgtacctggagcgcggcgggcgcccgattagcgccctgaatggaggtgatgtaacggtgatgcaggctccagcccaccctcgccgaaagcaaggagccctgcctggggacaggcccgcgcgagagcgagcaacccagcgcgcctggctcagcctcggtcccagggagaggcaggccctgcgtcccggcccgggccccgccatcccagccaggaccgggcctggcccagcgccccgcgccgcgtccctcccacccccgcccgccccccgcctggggctggagttggccccaaacgctgcgctggagcggggccggcggcgagtcccaggtaagggctgctgccttcccgctccgccgcccggaagagtcgggtcgggacggcggggagtgggcgagggcagaggcggggggactggacatcctgcgggctggggacgccgcgccaactccgctcggtcgctgaaagttttcaaacccgagccggctggggactgggggggtgggggagcccggcgctgcggctcgggctggagggaggggaaaccactccataatcggggtctccaagaggagcccctccaccgcctgcctctcggtgggagtccgcggtcactctctctcgtgggtggcgtcctctctgccgcctgctactgtggatgtggagggcaggtttctgtggccctaaaaatgggagagagtgactggttcccttgctccccattccagccacccagggagcgcaggtgtagaccccagtaccgtcgacccaagtagggacgagagggttcagaatccccctgagggaagtttggaaattcagactatcaaagcgcctccccttctggtagcctggcccctagatcccgaacccccactcccggctggcttttccagcgtcctttgcacctccatccccaggcccgcagtgttacacgctggaagacccaatcacttacaaactccacgatcaagatcctaaagcccgggagaggagactgttggaagtagggttttgtgctcctggagcttcctctccccgccggccccccacccctgtgccttcaactggactgggggagggagtgcattggggggtggggcgcattccagagtgacattccagagcagacccttgaagatttccaagtctcagagagctcagggcattttggcccaaatgcctggtcttggtgcggggcaggggcagggggataggggtggggtgtctaggctgaggttcgaggaaccccaacccaccccccaccaacctacacactgaggccgctccttccaggcacaggcgtctcctgtgcgccttcttatcgatggggtaaacgcctgagcgccctgcacagaggggtgagacagtgggacctaaccagggactgggagagaccgataggagtggaggcaggaaggctgtcagtcgggccatcgtctttccctataggctcttgagtgtgtgggatgggaggaaggcaagtgctctgtggtatccctgggggaacctccctgaagagtgccctggtcacagcacccttgaagacagccattggccatgggtcagtgttgagtttggttggccctgtgacgcgctggagctctctttccagtgcggtatccttggccctggtgggtggagggggtctcaggcttgtgtgtggatgatgctggagcgaggaagggagttttgctctggagaagtgagaaggcctggctgtctccccggttgctggatgaagccacttgttgctgggggaaaccagtcagggctgcttgggcctctgggcctctgagcctctgagcccaccaggcctctgcgccccctggagagagaaggagggaggagggaggttcagcaactggactgcactgactcacaggagagctgggggcagggtggctgagcctggggaaaggccgatttcggaggcgattaaaaatatttgtacaactgattccagggaagtgaagcaaaaggcccttttgtccagaaaataatctgaggctggagctgggcttcagctgtggggtgggggagactcagggcggaaggaggttcccctcctacccccctccttgaaccctctgagaatctttaagcagaagatgcaactccaacatggaggggacaaccctgggtgtggagaaatgcacctgggaccatccagaggtgacttccaaatgcccactgtgttcaggcacagcaccagctgtggcagtggattctagaagtcttgttcaccagcttcaaagaccttacagccctggaggggagacacggacatgatttgaacgttcagggatcagaaggctcagtcttagtgcagggtctggggacccacaggaggcagaagtttcctccagggtcctgaggaaaagcctctgaccagagctgagtccatcttgtcagtcccttagccaccatcttaaaaggtggcattgggccgggaacggtggctcacacttgtaatcccagcactttgagaggctgaggtaggtggatcaccttaggtcaggagtttgagaccagcctggccaacatagtgaaaccctgtctctactaaaaatacaaaaattagttgggcatggtggtgggcacctgtaatcccagctactcgggaggctgaggcaggagaattgcttgaacctgggagttggaggttgcagtgagccgagatcatgccattgcactccagtctgggcaacaagagtgaagcttcgtctcaagaaaaaaaaaaaggctgggcgcagtggctcacgcctgtaatcccagcactttgggaggccgaagcgggcggatcacgaggtcaggagattgagaccatcctagctaacacggtgaaaccccgtctctactaaaaatagaaaaaattagccgggcgtggtggcgggcgcctgtagtcccagctactcgggaggctgaggcaggagaatggcatgaacctgggaggcggagcttgcagtgagccgagatcacgccactgcgctccagcctgggcgacagagcgagactccgtctcaaaaaaagaaaaaaaaaaggcattggctgaatgtgcactcccggcatcagagggctggagctgtgctcttctgagcttctctttaactctctgagggtccctgtcctaggcagtggatgagagccacgcccagaaagcccaggtttcccacctgagtccatgtatttctgtcttcccacctgcccttccatttctgggggaaccagagaaataagatatttcaggatgggaccaggttgtttcctctgaggctgttaagttactcagcaacttactaaaagcagcagcctggctgctgggcagcagcatggtacctggatgcggtgaggggcaggtacaggctcctctctcattccttgaaagtttctatattgagggggttggcaggagaagcaagacttgaagggtcaggtgcagaaggaagttgctggtcaccaaccacaaaatcagggggaaactggaggtgggggcttagggacagagagctgtgaagctttcctgaccctagcccaagtgcctgtgggcttcttggagccagcagggtacaggcaagtatttctagggcaagatggatcaagaagaatgagtgacattggtccctggcttggttttctgtaatgacatgcctgttagatttgaacttgtagtatgggctttagtatccttttcccccacctccgccatccaaccagtccttcgattgttttttggaaaggatctttcagagctggccattatggctttacctttggccttgacctttaaactggaatgaatgtgccccccaacaaatcgattgcctgtgcatttttgccagactcttttcctaaaagcgcaaccctggctatgcccccatgatgctaaaagcagccttcagtggctgcctgttgcctttaggataatgcccccagccccacccctgtagcatttccaatgtgtcagccagcagctgcagcctccctttgcagactcagctgatacttggcaaactgaattcttttttaacttgctctggacttgggctcaaagggctttgattcacaccatcttttctgccttgcacgtccctctccttgttcccttcacctgctcagtccttcctcacattcttcagggcttagcttttgggtgtccctgtctcttggcagtgtctgggacctggtatgtttttttattagattctgagtaaaactctgcggaacagtctttctctactctgcctgtttctcttctgtgttcctgtagcccctgtctctctcctgcaggtaaattccgttgtgtggcccttaatcatattcttccttgtgtaatttttgtgagtacctaccttatctctcttgatagattttaaatgccatcaagtcagggactacgtttgttcatgtttgtattttccacagctctgggaacaacagggcctttccttcccaggcgcacagtcaatatttgctgatttggagtaattgcctgttctaaactgggccctggccgagggaggtggggtgaaaagcccttgaaagtgcaggtgtccggagtctaagtggcagttctgagggttctcttccctacgtccagcttcaagcccaagttctggctggtttggctgtggagcccaagatgaagttgaacatttaggatcccacagcttgttgttatccataaattatctcccaggagtgggtccatattacgccttcccttttttgttgttgttgttgttgtcgttgttgtttttggtttttgagatggagtctcgctccgtcacccaggctggagtgcagtggcgcaatctcggctcactgcaatcttctgcctcccaggttcaagggattcttctgcctcagcctcctgagtagctgggattacaggcgcacgccaccacacctggctaatttttgtatttttagtagagacgtggtttcagcatgttggtcaggctggtctggaactcctgacctcgtgatctgcccgccaaaagtgctgggattacagcatgagccaccgcacccagcctactccttacctcttagccctctcttactcctctttccagcacttgtaaataaaatgcagttggtgctttattgatttacaaagtcccctacagaagcttatttaagtcctgcattagaagtaaagagaaactagccattagaacgccagttatttaggaaaacaacagtacatttacatgagatagttaattttaagagttaatcttaagcaagcttaattgaaagatgaggtagctgagatggctaagacgacctaaatattttcaagtggcatggagactatttgaagggactttgaaaatggatcctctttattgtgtccatttcacttaattttatgagttgcattgcccctgatttagtaagtgttctttcacataacaattatggacagaatttttttttttttttgcttctgtgttgaaaagagggacaatttctatcaactgtgggatttagggcttttgtttgcctattagaaattaagtagccaggaatggtagaaaacagtaaggaggtaaaccatgtataaacaacctcacaatccccctaaaaaaggaaaaagggtggcagcctcacagaagagagttagataatgccattcccctgccagccactagtggtcactgtcagaccaggaaagcttggttgctgttttcccagagagttcctgatgaagctgggttacaactagttatttgaacacgtggggtgacttaaatgtggactacctgcattcatagaattttgaaacgtataacctgtttctttaagcatttaaattttctttttcttttcttttcttttctttcttttttttggaaacagtctcgctctgttgcccaggctgcagtgcagtggtgcaatcgcagctcactgcagcctcgatcccctgggctcagatgatcctctaacctcagcctcccaagtagctcagactacaggtgcatgccaccacactctctgctaattcatatatatatatatatatatatatatatatatatatatatatatatttgttgttgttgttgttgtttgttttcatacagagtctcactctattgatcaggttggagtgcagtggcgcagtcttggctcactgcaacttccacctcccgggctcaagcaattctcctgcctcagcctcctgaatagctggtattataggcgtgcacctccacgcccggctaatttttgtatttttagtagagacggggtttcaccattttggccgggctggtctcgaactcctgacctcaagtgatccaccagtcttggcctcccaaagtgctgggattacaggcgtgagccactgcacccagctgctaatttttgtgttttttatagagacggggtttcaccatgttgcccaggctggtctcaaactcctggactctagcaatctgttcaccttgacctcccaaagtgctgggattataggcatgaaccaccgtgcccagcagcatttaaattttcagtgttaggtttcctccaagtacatttaaaacttttgattggaaaaaaactcattgatttggtctttaatatttcttaacctgttaaatccattacctccacttcacgtgggaaaatccaattggtattgggagcaggagtttggttttcttctctggcacagatctgtggcatttggtagagcggcagtcagtagatggagtgaaaattaccttgctggtgttaataaaagctaattttcttgccttctagctacaacgtcttaaagtcttctattaaagattaattcctttgggttttgcattgcccttgcctggttcttacttttaaaatgttaatgctccgaaggaaaatttttgcattaagtcattaactccttagctggggacttcgtttatttcacccttgacttccgcttccgagctaggcaaaaaatggaggattctgaactggagacttggcactaaaagtgggaaaatgactgtctcttcatttttcctggctgttggttatgcctgctgcagctgcttgttaagtctattgaatgaatgaatgaacacatagctgactggctgtggatttaggcctcacaggaatggagtttaggggcatagcagctgacctcctgaagcctgaaagtcccagggcagagaggaggtactgggtgggtggtatgcttggtcttgacttgttcacaagccccttcatcctccaccgtggccgccagagctcagggaatatctgaacccaggttatgtttggtggaagggagggaactgaaaattcaatgacaggtttttcttttgccatggctaggaatagggctgacaaatgggcttcatctcatttgcctctgtggccagttgaaatgcctctcaggggttctatgttaagaaggattctgaggtccagagagcctcacggtcagcagctagcactatctgcctgggtttaggttgggggaagcagcaccatgtatattggagtctgatcttggaggactaattttgtcccttttccttctgtctctagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcaggtgggtctctgtggatgcccccagtggcccctttctccatcccatgtcttttactgcaggacagggagccagtctcttgagcaaaatggaaagtttttgaggttttctgtagttttctgcctaagtgtctctaaattccatttaatttaaagatttttttttttcagttgggcatggtagatcatgcctgtaatcctagcactttgggaggccaaggcgggtggatcacttgagacgaggagttcgagaccagcctgatccacatggtgaaaccccgtctctactagaaatccaaaaaaattagctgggtgtgctggctcatgcctgtgatctcagctactcgggaggctgaggcgggagaatcacttgaacctgggaggcggaggttgcagtgagccaaaatcgagccactacactccagcctgggtgacagagcaagactccatctcaaaataaataaataaataagattttttttctatattcatataattcatgcatacattctcactgtaaaatttcaaacattacagataaaatgaaattttccccagctgcctccccagtcctacccgtcccatcctgttccatccccagaagtgaccactattgactgatataatatctatgtgcctttgtttctccatttgtaaaatggggataatgtcagtacctatttcatagggttcttgtgaggattgaattaattagtgccggctgggcgccatggctcacacctgtaatcccagcactttgggaggctgaggtgagtggagcttgagcctaggagtttgagaccggcctggacaacatagtgaggccccgtctctacaaataatttcaaaaattagccaggtgtggtagtgcatgcctatggtcccagctcctcaggaggctgaggcaggaggattgcctgagcccaggaggttgaggcttcagtgagccgtgattgcaccaccacattccagcctggatgatctcaaaaaaaaaaaaaattacttagtgcccggcccatgaaaagcactcttgaagaattagctatttgctgtgtgtgcgtgtctattattttacatattttactaatactatccttccagaacttgtttttctattatgtatgtatccataatcaccttagttttctttaaaaggaagtatttttcaggtaatttttttctctttttttattttttgagacggagtctcgctctgtcacccaggctggagtacagtggtgtgatcttggctcactgcaacctccgcctcccgggctcaagagattctcctgcctcagcctcccaagtagctgggattacaggcacgtgccaccacacctggctaatttttgtatttttaatagagacgggatttcactatgttggccaggctggtctcgaactgctaacctcaagtgatccgcctgcctcggcatcccaaagtgctgggattacaggtgtgagccactgcacctggcctttttctctttttaataaaagtatttggggtgccgtgtagtggtctcagcagcgcccttgttagctgtacagcccactagcatttcctcagcacctgctctgtgccagcccctgtgctaatccccttaccgatgtggcccattgcacgcatcccacctgctcttcctcagcctgctggctgcagcccctcatctgacatgacctggaaatttgggggtgccatctcaaagtcctgaccctgcccccagactgtgctgatctggaggcctgggggcttcagactttcttaactgcccggttaacaagcaccggctctggggtctctgctgggaggtcagagtcaggcagtggaagttccagaatcagagacattcctttctcttctacacactgtgaaatcctcataatccctgctttggagaaagagatgacccttgtcctgccgggcacttgatctttgatctgcccacctgggctgaggtgctggcctcacccctgggtggcccctgtcacacgcacggtgtgcatggcgggggtggaattggcaaaacccaccagagaggtggggcttacagacaagtgctgggaggagcctcaggccccgcccccacactgaatgccggtcggggccaaatggttctcaaccttggggctgagtttttacttcctttttttttttctaaatggaaaaatcaatagagtgagcccagccccagcacttaggaaactctatataggttgcggtccctcagaactgcagggccgtcagccttgccggagccagacgtccgctgtgccgtcctcacagcaaggcctgctccgaggccccggggtgcgtcagcagccctcctcaaacaccctgggagtgcccagcagggcggaacacaccgggaaaccaacaccccaaaggcacaaggaagtatccctggagctaaaaatagttctggaaacttgccagggggccacaggctgggacgtgcgttaaggctccctggccaggctctgggttggtgtagtggggaaggggcgcccaggtcggccctgggaggacatgaacaggcttaggccgagggctctcagatgtatttacctctgtgcctggcagctggcccgtggtgacaggcagagctggaggctggccatcttggaaggcggccgaaggcccatgtgtcctcttggcctctggccccggagggcggatggggatgtggaagttgctgacagagcattttctgagctgttgggtcaggggctggggtgtctacagtgcagggaagctcagcagtgttgttcactcccatgcatctgtacaaaggggtgctaggcttgggagggggcccccgtgttcacaacctcacccccaagttggccactcctgggttagagactatgccagggttggcctgccccctttacctcttccctgcccccagagagccttgcttggtttgtgggaggtggggaagggagctgagagccctgggatcttcaaactgttcctgcttttccttgtagctaagaggccggtgtcaccatacagcgggtacaatgggcagctgctgaccagtgtgtaccagcccactgagatggccctgatgcacaaagttccggtaagtgggttccccaggtccccgtgacacgtctgggctacagagaccagcctcagcaggccagtgggagaaggccatgtggccagagctgggttgggtggaggtggtaaggggaaggcaagcttctccatctggtgcttttacctggggaatccagagccccagttcttaaattccttgtcctggagtcagtgtacccaccaccttcagctgcactgcagtgggacccgccctgtgtcactggggcattgcacacaggttgtgtcgggatgctatagggaatgctgggtgagctctccctggtgggagctgccagctttaccctggagggcttggggagggacaaaggagggtctcagccaggtgctcccaaaatagacaggggtccaaatgtcacaggtctggataggtgtttacttctcaaccacagctgtgccaagggggcccacactctcctccctctctggcaggcagcaagtctcgaccttacacctccccctgggttctggaaactagaagcatcgttagccaggggagggggagggagcaggaagacggtgggttggattctactcactcctatatgtgttcctcctcccggctggcagaggctgtggggagaggtcagtgacccgtcttggcaggacactgggaacaggaaacaaggaggtcagctgggtggcgttctcatccccctccccgccctctctgtgagagccgcggggcagggggaggtgagtgtggctgaagcttccaatcccagcgcctcccctctccctgagcctgaacctgagcctgggcagaggagagcttccggagcaccaggagtggaggctgcgggctgtcagctctggcggggagtgggcagccacagaagcctttgctgaatagcttccttcactgttgctgcacctcactccccagcgcgtttggagtctgcttcctgggggatgatctggattaacagggatattttatctgaccggttctcaaaacatggtacccggaccaccagcactagcctcacctgggagcctgctcaaagtgcaaatgggggccaggcacaatggctcacacctgtaatcccagtactttgagaggctgaggcaggtggatcacctgaggtcaggagtttgagaccagcctggccaacatgctgaaacctcatctctactaaaaacacaaaaatcagccaggcatagtggcacatgcctgtagtcccagctactaggaaggccttagccagaggatcccttgaacccgggaggtggaggttgcagtgagcacagactgtaccactgcactccagcctggacaacagagtgagactctgtctccaaaaataaataaataagaaaaaaaaaaaaaagtgcagatggggcggggccagagctgggatggagctgactgttagcatccgttcagggcgtcggcaccatgggggcactatccagcgcagatctgcaagcccagcattcagcactccctcccccagccccagctgttgccagctgcatggggccagctgtgttgggtggggactgtgtagggtccagctatgagttggtggagtctgcgtggggactgtgtagggtccagctatgagttggtgaggcttaacaagcagtgcaggtgattccaatgcacactcatctgtggttttggaccacagatgtagatgttccagggaccacatggacaggggccattgcagacaggcctgaggacctcctgggcctgattgacttgaaggctagtttggggtctgggagctacagagatttggtggcagctctttcccatagggctaagacagatggggccaggaatacacctttcctccagcataggagccggaacaggtacctcaggaccctcttcaccccacagctggtgtctctcacccacatgggagcaagacccagcgccaggcagagaattcaggtttcaagactccaaatcagggctggttgcagtggctcatgcctttaatcccagtgctctgggagactgacatgggagaactgcttgaggccgagggttcgagagcagccctggcaacgtagtgagaccccccccccccgcccaccatctctacaaaaaaaaaaaaaagactccaaatcagaccggccagactagatgcctagagagatgtgtgggcacacccagagccatgtcctccgccagggaagccagcaactgtgatgctgggggtatggtagtgacaggcggtcgactcggggtaatattcttggaggagccgggcatggtggctcacacctataatcccggcactttgggaagccgaggcgggtggatcacgaggtcaggagattgagaccatcctggctaacatgatgaaacaccgtctctaataaaaatacaaaaaattagccgggcacggtggcgggctcctgtagtcccagctactcgggaggctgaggcaggagaatggcgtgaacccgggaggcagagtttgcagttggccgagatcacgccactgcactccagcctgggcgacagagcgagactccgtctcaaaaaaaaaaaaaaagattcttggaggaagggggcctgggagctatgtcagacaggtagtagcagctctgtgtggctgactctccactggccctagcatttccctaaacaattggaagtaggagggtcttgagaaggggatccccctctgtgaagccccagcaccatccaaggtcagcaggggcctcgttcccatgcccagaggcagggtgagataaggggctcaggtctggctgtcccaggctgctcctggggcccagccagagggggcagaggagccgaggggggagttgggggggatctggcagtcccagccctgcaggaagtgtttgtgcatccgccccggcggaacctggctcccaatccccgactgtgagaccgcctgttcttccttccagtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaa

SEQ ID NO: 368 - DNA, 13733 bp, Homo sapiens
ggggaacctccctgaagagtgccctggtcacagcacccttgaagacagccattggccatgggtcagtgttgagtttggttggccctgtgacgcgctggagctctctttccagtgcggtatccttggccctggtgggtggagggggtctcaggcttgtgtgtggatgatgctggagcgaggaagggagttttgctctggagaagtgagaaggcctggctgtctccccggttgctggatgaagccacttgttgctgggggaaaccagtcagggctgcttgggcctctgggcctctgagcctctgagcccaccaggcctctgcgccccctggagagagaaggagggaggagggaggttcagcaactggactgcactgactcacaggagagctgggggcagggtggctgagcctggggaaaggccgatttcggaggcgattaaaaatatttgtacaactgattccagggaagtgaagcaaaaggcccttttgtccagaaaataatctgaggctggagctgggcttcagctgtggggtgggggagactcagggcggaaggaggttcccctcctacccccctccttgaaccctctgagaatctttaagcagaagatgcaactccaacatggaggggacaaccctgggtgtggagaaatgcacctgggaccatccagaggtgacttccaaatgcccactgtgttcaggcacagcaccagctgtggcagtggattctagaagtcttgttcaccagcttcaaagaccttacagccctggaggggagacacggacatgatttgaacgttcagggatcagaaggctcagtcttagtgcagggtctggggacccacaggaggcagaagtttcctccagggtcctgaggaaaagcctctgaccagagctgagtccatcttgtcagtcccttagccaccatcttaaaaggtggcattgggccgggaacggtggctcacacttgtaatcccagcactttgagaggctgaggtaggtggatcaccttaggtcaggagtttgagaccagcctggccaacatagtgaaaccctgtctctactaaaaatacaaaaattagttgggcatggtggtgggcacctgtaatcccagctactcgggaggctgaggcaggagaattgcttgaacctgggagttggaggttgcagtgagccgagatcatgccattgcactccagtctgggcaacaagagtgaagcttcgtctcaagaaaaaaaaaaaggctgggcgcagtggctcacgcctgtaatcccagcactttgggaggccgaagcgggcggatcacgaggtcaggagattgagaccatcctagctaacacggtgaaaccccgtctctactaaaaatagaaaaaattagccgggcgtggtggcgggcgcctgtagtcccagctactcgggaggctgaggcaggagaatggcatgaacctgggaggcggagcttgcagtgagccgagatcacgccactgcgctccagcctgggcgacagagcgagactccgtctcaaaaaaagaaaaaaaaaaggcattggctgaatgtgcactcccggcatcagagggctggagctgtgctcttctgagcttctctttaactctctgagggtccctgtcctaggcagtggatgagagccacgcccagaaagcccaggtttcccacctgagtccatgtatttctgtcttcccacctgcccttccatttctgggggaaccagagaaataagatatttcaggatgggaccaggttgtttcctctgaggctgttaagttactcagcaacttactaaaagcagcagcctggctgctgggcagcagcatggtacctggatgcggtgaggggcaggtacaggctcctctctcattccttgaaagtttctatattgagggggttggcaggagaagcaagacttgaagggtcaggtgcagaaggaagttgctggtcaccaaccacaaaatcagggggaaactggaggtgggggcttagggacagagagctgtgaagctttcctgaccctagcccaagtgcctgtgggcttcttggagccagcagggtacaggcaagtatttctagggcaagatggatcaagaagaatgagtgacattggtccctggcttggttttctgtaatgacatgcctgttagatttgaacttgtagtatgggctttagtatccttttcccccacctccgccatccaaccagtccttcgattgttttttggaaaggatctttcagagctggccattatggctttacctttggccttgacctttaaactggaatgaatgtgccccccaacaaatcgattgcctgtgcatttttgccagactcttttcctaaaagcgcaaccctggctatgcccccatgatgctaaaagcagccttcagtggctgcctgttgcctttaggataatgcccccagccccacccctgtagcatttccaatgtgtcagccagcagctgcagcctccctttgcagactcagctgatacttggcaaactgaattcttttttaacttgctctggacttgggctcaaagggctttgattcacaccatcttttctgccttgcacgtccctctccttgttcccttcacctgctcagtccttcctcacattcttcagggcttagcttttgggtgtccctgtctcttggcagtgtctgggacctggtatgtttttttattagattctgagtaaaactctgcggaacagtctttctctactctgcctgtttctcttctgtgttcctgtagcccctgtctctctcctgcaggtaaattccgttgtgtggcccttaatcatattcttccttgtgtaatttttgtgagtacctaccttatctctcttgatagattttaaatgccatcaagtcagggactacgtttgttcatgtttgtattttccacagctctgggaacaacagggcctttccttcccaggcgcacagtcaatatttgctgatttggagtaattgcctgttctaaactgggccctggccgagggaggtggggtgaaaagcccttgaaagtgcaggtgtccggagtctaagtggcagttctgagggttctcttccctacgtccagcttcaagcccaagttctggctggtttggctgtggagcccaagatgaagttgaacatttaggatcccacagcttgttgttatccataaattatctcccaggagtgggtccatattacgccttcccttttttgttgttgttgttgttgtcgttgttgtttttggtttttgagatggagtctcgctccgtcacccaggctggagtgcagtggcgcaatctcggctcactgcaatcttctgcctcccaggttcaagggattcttctgcctcagcctcctgagtagctgggattacaggcgcacgccaccacacctggctaatttttgtatttttagtagagacgtggtttcagcatgttggtcaggctggtctggaactcctgacctcgtgatctgcccgccaaaagtgctgggattacagcatgagccaccgcacccagcctactccttacctcttagccctctcttactcctctttccagcacttgtaaataaaatgcagttggtgctttattgatttacaaagtcccctacagaagcttatttaagtcctgcattagaagtaaagagaaactagccattagaacgccagttatttaggaaaacaacagtacatttacatgagatagttaattttaagagttaatcttaagcaagcttaattgaaagatgaggtagctgagatggctaagacgacctaaatattttcaagtggcatggagactatttgaagggactttgaaaatggatcctctttattgtgtccatttcacttaattttatgagttgcattgcccctgatttagtaagtgttctttcacataacaattatggacagaatttttttttttttttgcttctgtgttgaaaagagggacaatttctatcaactgtgggatttagggcttttgtttgcctattagaaattaagtagccaggaatggtagaaaacagtaaggaggtaaaccatgtataaacaacctcacaatccccctaaaaaaggaaaaagggtggcagcctcacagaagagagttagataatgccattcccctgccagccactagtggtcactgtcagaccaggaaagcttggttgctgttttcccagagagttcctgatgaagctgggttacaactagttatttgaacacgtggggtgacttaaatgtggactacctgcattcatagaattttgaaacgtataacctgtttctttaagcatttaaattttctttttcttttcttttcttttctttcttttttttggaaacagtctcgctctgttgcccaggctgcagtgcagtggtgcaatcgcagctcactgcagcctcgatcccctgggctcagatgatcctctaacctcagcctcccaagtagctcagactacaggtgcatgccaccacactctctgctaattcatatatatatatatatatatatatatatatatatatatatatatatttgttgttgttgttgttgtttgttttcatacagagtctcactctattgatcaggttggagtgcagtggcgcagtcttggctcactgcaacttccacctcccgggctcaagcaattctcctgcctcagcctcctgaatagctggtattataggcgtgcacctccacgcccggctaatttttgtatttttagtagagacggggtttcaccattttggccgggctggtctcgaactcctgacctcaagtgatccaccagtcttggcctcccaaagtgctgggattacaggcgtgagccactgcacccagctgctaatttttgtgttttttatagagacggggtttcaccatgttgcccaggctggtctcaaactcctggactctagcaatctgttcaccttgacctcccaaagtgctgggattataggcatgaaccaccgtgcccagcagcatttaaattttcagtgttaggtttcctccaagtacatttaaaacttttgattggaaaaaaactcattgatttggtctttaatatttcttaacctgttaaatccattacctccacttcacgtgggaaaatccaattggtattgggagcaggagtttggttttcttctctggcacagatctgtggcatttggtagagcggcagtcagtagatggagtgaaaattaccttgctggtgttaataaaagctaattttcttgccttctagctacaacgtcttaaagtcttctattaaagattaattcctttgggttttgcattgcccttgcctggttcttacttttaaaatgttaatgctccgaaggaaaatttttgcattaagtcattaactccttagctggggacttcgtttatttcacccttgacttccgcttccgagctaggcaaaaaatggaggattctgaactggagacttggcactaaaagtgggaaaatgactgtctcttcatttttcctggctgttggttatgcctgctgcagctgcttgttaagtctattgaatgaatgaatgaacacatagctgactggctgtggatttaggcctcacaggaatggagtttaggggcatagcagctgacctcctgaagcctgaaagtcccagggcagagaggaggtactgggtgggtggtatgcttggtcttgacttgttcacaagccccttcatcctccaccgtggccgccagagctcagggaatatctgaacccaggttatgtttggtggaagggagggaactgaaaattcaatgacaggtttttcttttgccatggctaggaatagggctgacaaatgggcttcatctcatttgcctctgtggccagttgaaatgcctctcaggggttctatgttaagaaggattctgaggtccagagagcctcacggtcagcagctagcactatctgcctgggtttaggttgggggaagcagcaccatgtatattggagtctgatcttggaggactaattttgtcccttttccttctgtctctagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccatcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcaggtgggtctctgtggatgcccccagtggcccctttctccatcccatgtcttttactgcaggacagggagccagtctcttgagcaaaatggaaagtttttgaggttttctgtagttttctgcctaagtgtctctaaattccatttaatttaaagatttttttttttcagttgggcatggtagatcatgcctgtaatcctagcactttgggaggccaaggcgggtggatcacttgagacgaggagttcgagaccagcctgatccacatggtgaaaccccgtctctactagaaatccaaaaaaattagctgggtgtgctggctcatgcctgtgatctcagctactcgggaggctgaggcgggagaatcacttgaacctgggaggcggaggttgcagtgagccaaaatcgagccactacactccagcctgggtgacagagcaagactccatctcaaaataaataaataaataagattttttttctatattcatataattcatgcatacattctcactgtaaaatttcaaacattacagataaaatgaaattttccccagctgcctccccagtcctacccgtcccatcctgttccatccccagaagtgaccactattgactgatataatatctatgtgcctttgtttctccatttgtaaaatggggataatgtcagtacctatttcatagggttcttgtgaggattgaattaattagtgccggctgggcgccatggctcacacctgtaatcccagcactttgggaggctgaggtgagtggagcttgagcctaggagtttgagaccggcctggacaacatagtgaggccccgtctctacaaataatttcaaaaattagccaggtgtggtagtgcatgcctatggtcccagctcctcaggaggctgaggcaggaggattgcctgagcccaggaggttgaggcttcagtgagccgtgattgcaccaccacattccagcctggatgatctcaaaaaaaaaaaaaattacttagtgcccggcccatgaaaagcactcttgaagaattagctatttgctgtgtgtgcgtgtctattattttacatattttactaatactatccttccagaacttgtttttctattatgtatgtatccataatcaccttagttttctttaaaaggaagtatttttcaggtaatttttttctctttttttattttttgagacggagtctcgctctgtcacccaggctggagtacagtggtgtgatcttggctcactgcaacctccgcctcccgggctcaagagattctcctgcctcagcctcccaagtagctgggattacaggcacgtgccaccacacctggctaatttttgtatttttaatagagacgggatttcactatgttggccaggctggtctcgaactgctaacctcaagtgatccgcctgcctcggcatcccaaagtgctgggattacaggtgtgagccactgcacctggcctttttctctttttaataaaagtatttggggtgccgtgtagtggtctcagcagcgcccttgttagctgtacagcccactagcatttcctcagcacctgctctgtgccagcccctgtgctaatccccttaccgatgtggcccattgcacgcatcccacctgctcttcctcagcctgctggctgcagcccctcatctgacatgacctggaaatttgggggtgccatctcaaagtcctgaccctgcccccagactgtgctgatctggaggcctgggggcttcagactttcttaactgcccggttaacaagcaccggctctggggtctctgctgggaggtcagagtcaggcagtggaagttccagaatcagagacattcctttctcttctacacactgtgaaatcctcataatccctgctttggagaaagagatgacccttgtcctgccgggcacttgatctttgatctgcccacctgggctgaggtgctggcctcacccctgggtggcccctgtcacacgcacggtgtgcatggcgggggtggaattggcaaaacccaccagagaggtggggcttacagacaagtgctgggaggagcctcaggccccgcccccacactgaatgccggtcggggccaaatggttctcaaccttggggctgagtttttacttcctttttttttttctaaatggaaaaatcaatagagtgagcccagccccagcacttaggaaactctatataggttgcggtccctcagaactgcagggccgtcagccttgccggagccagacgtccgctgtgccgtcctcacagcaaggcctgctccgaggccccggggtgcgtcagcagccctcctcaaacaccctgggagtgcccagcagggcggaacacaccgggaaaccaacaccccaaaggcacaaggaagtatccctggagctaaaaatagttctggaaacttgccagggggccacaggctgggacgtgcgttaaggctccctggccaggctctgggttggtgtagtggggaaggggcgcccaggtcggccctgggaggacatgaacaggcttaggccgagggctctcagatgtatttacctctgtgcctggcagctggcccgtggtgacaggcagagctggaggctggccatcttggaaggcggccgaaggcccatgtgtcctcttggcctctggccccggagggcggatggggatgtggaagttgctgacagagcattttctgagctgttgggtcaggggctggggtgtctacagtgcagggaagctcagcagtgttgttcactcccatgcatctgtacaaaggggtgctaggcttgggagggggcccccgtgttcacaacctcacccccaagttggccactcctgggttagagactatgccagggttggcctgccccctttacctcttccctgcccccagagagccttgcttggtttgtgggaggtggggaagggagctgagagccctgggatcttcaaactgttcctgcttttccttgtagctaagaggccggtgtcaccatacagcgggtacaatgggcagctgctgaccagtgtgtaccagcccactgagatggccctgatgcacaaagttccggtaagtgggttccccaggtccccgtgacacgtctgggctacagagaccagcctcagcaggccagtgggagaaggccatgtggccagagctgggttgggtggaggtggtaaggggaaggcaagcttctccatctggtgcttttacctggggaatccagagccccagttcttaaattccttgtcctggagtcagtgtacccaccaccttcagctgcactgcagtgggacccgccctgtgtcactggggcattgcacacaggttgtgtcgggatgctatagggaatgctgggtgagctctccctggtgggagctgccagctttaccctggagggcttggggagggacaaaggagggtctcagccaggtgctcccaaaatagacaggggtccaaatgtcacaggtctggataggtgtttacttctcaaccacagctgtgccaagggggcccacactctcctccctctctggcaggcagcaagtctcgaccttacacctccccctgggttctggaaactagaagcatcgttagccaggggagggggagggagcaggaagacggtgggttggattctactcactcctatatgtgttcctcctcccggctggcagaggctgtggggagaggtcagtgacccgtcttggcaggacactgggaacaggaaacaaggaggtcagctgggtggcgttctcatccccctccccgccctctctgtgagagccgcggggcagggggaggtgagtgtggctgaagcttccaatcccagcgcctcccctctccctgagcctgaacctgagcctgggcagaggagagcttccggagcaccaggagtggaggctgcgggctgtcagctctggcggggagtgggcagccacagaagcctttgctgaatagcttccttcactgttgctgcacctcactccccagcgcgtttggagtctgcttcctgggggatgatctggattaacagggatattttatctgaccggttctcaaaacatggtacccggaccaccagcactagcctcacctgggagcctgctcaaagtgcaaatgggggccaggcacaatggctcacacctgtaatcccagtactttgagaggctgaggcaggtggatcacctgaggtcaggagtttgagaccagcctggccaacatgctgaaacctcatctctactaaaaacacaaaaatcagccaggcatagtggcacatgcctgtagtcccagctactaggaaggccttagccagaggatcccttgaacccgggaggtggaggttgcagtgagcacagactgtaccactgcactccagcctggacaacagagtgagactctgtctccaaaaataaataaataagaaaaaaaaaaaaaagtgcagatggggcggggccagagctgggatggagctgactgttagcatccgttcagggcgtcggcaccatgggggcactatccagcgcagatctgcaagcccagcattcagcactccctcccccagccccagctgttgccagctgcatggggccagctgtgttgggtggggactgtgtagggtccagctatgagttggtggagtctgcgtggggactgtgtagggtccagctatgagttggtgaggcttaacaagcagtgcaggtgattccaatgcacactcatctgtggttttggaccacagatgtagatgttccagggaccacatggacaggggccattgcagacaggcctgaggacctcctgggcctgattgacttgaaggctagtttggggtctgggagctacagagatttggtggcagctctttcccatagggctaagacagatggggccaggaatacacctttcctccagcataggagccggaacaggtacctcaggaccctcttcaccccacagctggtgtctctcacccacatgggagcaagacccagcgccaggcagagaattcaggtttcaagactccaaatcagggctggttgcagtggctcatgcctttaatcccagtgctctgggagactgacatgggagaactgcttgaggccgagggttcgagagcagccctggcaacgtagtgagaccccccccccccgcccaccatctctacaaaaaaaaaaaaaagactccaaatcagaccggccagactagatgcctagagagatgtgtgggcacacccagagccatgtcctccgccagggaagccagcaactgtgatgctgggggtatggtagtgacaggcggtcgactcggggtaatattcttggaggagccgggcatggtggctcacacctataatcccggcactttgggaagccgaggcgggtggatcacgaggtcaggagattgagaccatcctggctaacatgatgaaacaccgtctctaataaaaatacaaaaaattagccgggcacggtggcgggctcctgtagtcccagctactcgggaggctgaggcaggagaatggcgtgaacccgggaggcagagtttgcagttggccgagatcacgccactgcactccagcctgggcgacagagcgagactccgtctcaaaaaaaaaaaaaaagattcttggaggaagggggcctgggagctatgtcagacaggtagtagcagctctgtgtggctgactctccactggccctagcatttccctaaacaattggaagtaggagggtcttgagaaggggatccccctctgtgaagccccagcaccatccaaggtcagcaggggcctcgttcccatgcccagaggcagggtgagataaggggctcaggtctggctgtcccaggctgctcctggggcccagccagagggggcagaggagccgaggggggagttgggggggatctggcagtcccagccctgcaggaagtgtttgtgcatccgccccggcggaacctggctcccaatccccgactgtgagaccgcctgttcttccttccagtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggcccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaa

SEQ ID NO: 369 - DNA, 18416 bp, Homo sapiens
cggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccaggtgagagtttcccttcccgggaaagtctgcggcagggagggagggtgcgaggggcagggccgcagggcaggtatcacacgagacgccccgagtctggactccgtgcagaacgcagaatgcggtgcgctctgtctaccacataagatggacagatgaaggtccacacccctgggagaggaaggagccagggcctctcccggctctgcacccacgtaccttggctgaaccacagcggggcaagtgataaggggtgggtgcagaaaagggaccttttaggttttcagttgaattcttacaggaagggggacgagaggcaggatgtgtcagggtgggtggagagtggcagccactgactgcgaggggcatgtggtgagggtgggggagatgccgggctcactgggtgcagggtatggaggaggggggtgtggggagggtgggggagatgccggcctcactaggtgcagggtacggaggagggggtggggcggtgagggagatagggtcggggtggggagcagatcgatagtctctggaatgcggagatttaaccagggcagcccagcggctggggcctgagcagggggaagtcccgaggcagccttggctggggttagcccctgcatgggcctgagaaccaggggtcagtcctctccaagaaggggatatgggacagaggggacagaaaaggtggtggggagggcgaggagggaaaagatcgggcagagaagcgctgagatcttctttagggagaagcgtggagttgagtcttccctgtccaagcgcagggattcctcccgcagagtcacctgctgtgccttcagtcacgtccaccgctctcctcagacagctcctgtgcagactcctcaggcctagtcctagggtattgtacgtctttgtggttgctttccttacagatcggaggttttctgcaattatatttgctaactacttgtctgtgggaaggttattacttttggtgtcttgacttggaaacgggtcatcctcccataacaggtgctcctgcgattctcttgggtgttcttctgtttcatagggtcggtgtgcatgggaaggtttcagttcctgtctaatatctgtttctctttctcccattgactcattggctggtacagccggagtgaggcccagcggacatagtggtagtggttgtccctgccttgttgctgactcagggaaaaaggaccagagcttctcattattaggaagaagggatccaccaatgactattcacaaagcatttttacttttatttatttatttatttatttatttatttatttattttttgagatggagttttgctcttgttgcccaggctggagtgcagtggcgcgatcttggctcactgcaacctacgcctcccaggttcaagtgattctcctgcctcagcctcccgagtagctgagattacaggcatgtaccaccatgcctggttaattttgtatttttagtagagatgggctttctccatgttggtcaggctggtctcaaactcccaacctcaggtgatccactcaccttggcctcccaaagtgctgggattgcaggcgtgagccaccaagcctggccaacatttttatttttttgagacagggtctccctccgtcacccaaactggagtgcggtggtgcaatcacggttcactgtagcctccacctcccgggctcaagtgatcctcccacctcaacctccccagtagctgagactacaggtgtgtgccaccacacccagctggattcttaattttttttagggacagggtcttaccatgttgcccaggctggcctccacctcctgggatcaagggatcctcccatcttgtcctcccaaaatgcagggattacaggcatgaaccaccacacctggcccctacaaaacattttttattttatttttatttatttttttggagacagaatctcactctatcacccagggctggagtgcagtggcttgatctcagctcactgcaacctccgcctcccgggttcaagtgattctcctgcctcagcctcttgaataactgggcttacaggcacccaccaccactgctggctaatttttttgtattttagtagagacggggtttcaccatgttgcccaaggtggtctcgaactcctgagctcaggcaatctgccagccttggcctccggcccccacaaaataccatttttattatttatagaaattattattattattatcctttcagctatgaaggaggtgaactacattaggagatctggtcagatgtttgtcttgatttattatgctggcttcatggaaagaattagggagatctccctgtttccgtgttctctgcaaatgtttacataaaattgaaattatttgttccttgaagtttttagagaactagcttgtaaaactgtctgagttttgcttctttttttttgatggaagggaaagaatttcttaataacactcatcatttttggtctacattaaaaaaaatctagctgggtgcagtggctcacacctgtaatcccagaattttaggaggttgaggtgggaggatagcttaagcccaggagtccgagactggcctgggcagtatagcaagcaagaccccgtctcttaaaaaaaaaaaaagtctattcttggcctacattgatgatttatattttcctaaaaaatcatcagtgtcgcccaggtttgcagacttatttgcagagatttgcaaatttttcttttgaattttatatctgcgtcttctttatttttggtctgactacctactagtctaattaattgtttgaggccaggcacgttggctcacgcctgtaatcccagcactttgggaggccaaggcgggtggatcacttgaggtcaggagtttgagaccagcctggccaacatggtgaaaccccgtgtctcctaaaaacacaaaattagccaggcatggtagtgtgcaccctgtagtcccagccactcgggaggctgagacatgagagtcacttgaacccaggaggcggaggttgcagtgagccgagatcatgccactgagctctggcctgggcgacaagagcgaaactctgtctcaaaaaaatgaaataaaataattaatcatttaccccttacaaaaaaatccatttattaatgtatatactaactccactgtttttctgtttcttaattcactgatttctgtgaattcaccagttcgtgaaagatgacctggttctttctgtgttgtgtgtgggtgtgtgtgttcctcttctgacctcttgagttggacaattcagtcatttacctgagagttaatgggtcaagattctgtgatcttcaaggaaaacgttaagacgacagaggaatatcctggtagaggaccctggccccaaggtggtccccagtctcctgtttatgattagaggggtttggggtggtgattcaggttggaagagagaaagcgcagaaacacaagcctgggagcactggggatccatgtgatcgttccaggtaagtggggaagtaaatggagggttttctgacacttcgcaatctctaaattataatgacaccctcacaggtggaacagagctttggggagatgattgggtgacagttttttatccaagatttcagagaagagaagttaatcaggagagagagaaagagagagagctagagggagagagagagagggagaaagaaactaaatccgaagggaagtcagacactggaggtaggacgagagacaggattgggtgcagtgggcagaggtggtggggtcactgaggtcaggagagaagccaaaacatggacaaagaaagatgacgattcgcagcccaggagaggcagggaatcgggtcaggacagggagcaggaacagtgtcttgggtgaaggagggctgggaactgacagtttttatttattttttttgagatagagtctcactctgtcgcccaggctggagtgcagtggtgtgatcacagctcactgcaacctccacctcctggactcaagtgatcctcccgcctcagcctcctgagtagctgggaatacaggcacgtgccaccatgcctggctaattttttgtgtttttggtagagatgggggtctcaccacattgcccaggctggcctcaaatgcctaaggctcaagcaatcctcccactttggcctcccaaagtgctaggattacaggcatgagccactgcacctggcctatttatttatttgagtcagggtctcactctgtcacccaggctgaagtgcagtgatgcgatcatagctcactgcagccacaacctcctgggctaaaatgatcctcccacctcagcctcctgagtagctgggaccacacgtgtgcaccagcacacctggctaatttttgtatttttttgtagagatggaatctcactatgttgcccaggctccatttacttattaagtacttaatatgtgtcaattttagtgatttgtgtttttctagaaaataactttcatctaagtttatgaattttatgtagagaatttctgcaaaatatcttgactcttcattctttcttcatctatggtccttttctcttgtcatgtcttatttagtcagcccagaggttatctatttttattagctggagtcatgtgaaaccctgttgtcttggtcaaaaagtttaatatcagccatttcatgtgattcaacctaatgttatttaccaggcattttatacctgtgatctcatttaacaccctcaaaggccatatgagtcagggacaattgtcaccactctatagacaaggtgtctgaagctcagagaggttaactaacttgccccagaacacacagctgatacgtaatagggtagagatgtaaacgcagatggttctgaggatctttctgctttgtcctggcaattgctgctgagagcctcaggaagcatcacacctgtgacaagcttagaaaggccttctctgcagggggatgtgtacatccaggcgtggagaggtttgggtgggactctgggagaggcacagaggagcttatctttgggcagccgtgggctgggtgtggagctagtggggtccaggagaagcttgcactgaagtttttgtagagggcctacaggtgcaaggcacctgtagacgttgaaggtataagaaggagacccctaccaaagtctcatgtgtgaggagatttagcatctgaaacagtaagtaaaattaaagagttctggccaggcgcagtagctcatgcctgtaatcccagcactttgggaggccgaggcaggtggatcacctgaggtcaggagttcgagaccagccaggccaacatggtgaaaccctgtctctactaaaaacacaaaaattatccgggtgtggtggacgcctgtaatcctagctactcggtaggctgaggcaggagaatcgcttgaacccgggaggcagaggttgcaatgagccgagatcccgccactgcactccagcctgggcaacagagcaagactccatctcaaaaaaaaaaaaaaatcaaagagttctaacccaaggaaagaagagcaagcccccatccccaccatccttgaacaatatggggcctaatcacagaattacaagggcattgagacactgcacacacaactgcccagcaggcctgtgcccatctgcctggggcaggggccatgtgtcctctgcttggcagccaacactagcttcgagccatcaccttactctccttgctttgcatctgataattatttgggaaaatgtcagacataattttcaaggaagttcatttatttccgagatttaagtctaggagagctgggcaaactaaggtaagacacaggatgaaagttttcgtcagcaagccttctgcgtttgtgactctttttttttttttttgagacagagtctcaccctgtcactcaggctggagtgcagtggtgccatctcagctcaacataacctccgcctccagggttgaagcgattcttgtgcctcagcctccccagtagctgcaattacaggcgcatgccaccacgcccagctaatttttgtatttttagtagagacagggtttcaccatgtcggccaggctagtctcgaactcctggcctcaagtgatccacccaccttagcctcccaaagtgctgggattacaggcataacccactgtacccagccagtattcttgtcaaaatggcttgacaaccctattactgcccgggtttgccccttggtgggaccagatcagtgtgtgggccggtcttcctcttgcagggttgcccagggctggggtggccctcccgggagtgcaggtgcttaggggtgagttctcatgctcctggcaggtttggaagcaggaggcccctggtgggtgagaggggtgggaagggtaagggaaaggaggcagggggctggagaaaggggctactatgagcaaaatcttgagggtggtagagcagaaaagagaatactcaagctgtgatctggctgatggggctgatatgaggtgaaggagtcaggggctgagggctgggggtgctgatgtggagtcggggaatctttggaggaggtgactccagggcacccagcctgagctcttccggtctccatggaaagcctctgccccattcccacctgtgtgcggaggtagcctctcatcctcagtccccgctcctgggtggacaaggcctctctgcctgccgctgcctcctccacacccccagggtccatgcggccctgaccccagggcacccctgaccaggctcatctgaggaggagctgggactctggcttgtgttttccaggatgttttgctctgagcaaatgcaggaccgtggcgggccccgtggggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccatggctccgagactttcatgatcccgttgtcgaggttgaggtgtccgtgttcccgggtgagcccctccttccctcagcgcctaaataggctcaggttggaattgttggggcaggaatcagatcagagacgtgaagcagacagtgtgtgtgtgtgtgtgcgtaagagagagagaggtgggggccaggggaacacagtcagggggtctctcctggagcagctgacatgtctgcccagtattgaagaagggaagggtccagtgacagggaggctgagagagcgttgcctgtgaaggagccaggagcgcacctgtggctcagccccaacggaagtgcagctgagtgggggaggggtggggctgaacagagaggctggggggccagatgggaagctgctgtcctcagggggagccttaccacatgacaggtcagatttgcagtgtagacagactcctctgcagcatggagtttcgcaggagcacctggaccctcatcagcaggatggaaaatcaggaccactgggagtggcacccgtgtcctgttcagaaatgcccagttggcccaggagggtcctggagagactctagccccagggtcctgcatcctgcccccttccttagtgggcagtttgtgtgaaatcaaaccaaaaaggcatcctgagtggtgggagagccagaggacagctccctgggtctgacttgtggttttgccaccagcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagtaagcaccctagcccctgagacatggagggggccctgtgctaagaggaggagcccagggcggggaccttggccatgtgggccagctggaggtgtgcatcgctccctttgccccaggcccaggttggaagccatagtctgaacaccccggcttggacctgcccttggctttggaagggggctcaggtaggggggaagttggggggcagatggaaggaaagtgatagttactgacagctggtaacatcctacgaggcccgtgttagatgcttcacatgagtattctcacttgcctttcactgcagccctgtactgttgtcattccgtgtattagtctgttttcgcaccgttgataaagacatacccgagactggataaattataatgagaaagaggttttaatgtactcacagttccacatggctgaggaggcctcacaatcaaggcagaaggcaaaaggcatgtcttacatggcagcaggcaagacagagaatgagaaccaagcaaaaggggtttcctcttataaagccatcagacctcgtgagacttattcactaccacaagaacagtatggagcaaaccacccccatgattcagttatctcccactgggtccctcccacaacacgtgggaattatatgggagctacaattcaagatgagatttgggtggggacccagccaacccacatcaatccccattttacagatgagtaaactgagactcagcgaggtgaagcaatttgcccagtcaagtagctacaagaggctaaggctaagcttccaattctggtttatgtgactccagagccttgagttctcctctctaaatagtggttcttaacctttttcgggttcaccaaccccacatagaatctgacatctatggacactctccccagaaaaacacatgcagtcacaaaccttttctgggattcacggactccctattctagcacaaaaccccacaattccatcctggcactatccacccagagttagtgcagaccccacaggtgaagagcttccacatctaaatcagatcccacaagaccgccctgatttagatgccagtcgaactttggggatccccaggccaccacacttctgaccaactggatgcaaatttgggggttcccaggacccccccaggttcaataatttgttagactcagaactctggaaagcattatacttacaattacagttttatcataaggataaaggataaagattaggaccagccaatgcagagacacataggacaaggcttgggaggattcccaaacagtttctgtgccctctccaggtggaatcagggagcatcacctgcaccctccctgcggcacctcaatatatttatcaaccaggaagctcctccaagctttggtgtccagagtttttattggggtttcattacataggcatgatgtgattgaactgtctccacctccagtccctctttgggaggttgggctggctcagggctccaaatctctaattacgtagttggtctttctggtgaccagccccatcctattgtctcatctcttaccaaagtccaggtgtgattcatgaacaacaaagacactcctaatttttgggacattccaaggatttagagcctccctcctaagagctagggacaaaggccagccagattctttactggacaacatccataaacccctccacaggcttctgccaacatataagacaaggcaaaattcaggcttgaacatgccacttccagaagtttagcctgtagatacacataggtggcagcgctgagttctgtggggcctgaaggttgtgcagtttgcggggtgggttggtgggtgggtaatctaagaaaaagatgagaaaattatgaatgcaaacgtaggcatgaaggaaagggcccaagcaatggagggacctgaagctgggctgcatcagcctcctggtcaatctgctgctgcgtggtcaggtgtgaaaaggtggagctgcaaggcgatttataagcaacgtttaccattgcaaaggactggggaaatgcccattcagtgggaacatttaaataaatcacagtctatccatgtgttggaataccctgcagctataggaaagagtgagggacttctttatgtactgacgtggaaagacctctaagatgtattgctaagtaaaaccagaatagtgttagacgaggcctcctttgtgtgaaagagaaaggagatcccgtacattcgtatttgcttgtatacacataaagaaactctggaaggttcttaagaacagcacgtgtgtgtatgtggggaaattggggaatgtgtaaatggggggtgtgtagaaagggggctttatactgtctattttttttaattgaccttatctatctacttaaaaagttagagaaggagaccaggtatattggctcatgcctgtcatcccagcattttgggaggctgaggcaggagggtggcttgagctcaggagtctgagaccatcctgggcaatatagcaagattgagtctctacgaaaaatttaaaaattagccgtggtggcctgtgcctgtagctggaggctgaggcaggaggatcacttgagcccaggggttcaaggctgcagtgagccatgatcaccactgcactccagcctgggtaacagagccagatcctgtctcaaaaaataaaaataaaaaataaaaataaaaaagtaagttggagaaggcaagttggccccgcccttaccatcctgtgcctcctccaggctcccgctgctcctctccctgctggcattgttgctgcttctgttggtgggggcctccctgctagcctggaggatgtttcagaaatggatcaaaggtgagttggctccccacacccctctgccccacctggggtggtcagaccctgaccacagacgctcatcttcaaagctatgtccacgtcccacagtattgctatgacatgtgacacccagaccacacatcctaggtgatcctacagggcaggtcccatgggaggcatccttgtgcgtggtggttacaggctgtgagaggtggctcccaagcaggaggctttcccacttccaggccaagggtggttgccccatgaagcaatgaccctcttctgtttaaaaccctggcatggtgtgctgggtgcagtggtgtgcatctgtagttccagctactcaggaggctgagatgggaggattgcttgatcccaggaattcaagaccagcctgcgcaacacaacaaggctcccgtgtctataagataaaataaacccttgcatggtctcccccaccataaaaagtccaggtatctacaggagtcactgccctccacgatctggctctacccacctccctctccccatccgcgcaccctggaaaccaacttcttgtatctcctttaatgacagcctcaacctcagcctctcctctccttctgggtttgctctgggctggagggcctcccctgccccctctccccagctcactcccagtggactccaacagtggtcctcagactttcttttctctgggaccttttctttgactccaaagagtggcttggggcccctcctggctatacctctgctgtcacagccttttgggaaccagactgtcattgctggtgtcctcatctgccttcccacaggcatgtgcttcaaggaggtacagaaccaatatttgtcaaattaatgtgttattcagtatctccagctgcaacgggcaccccaggggcctccaggcaatctctagtccagctgccctcctctgagctcagattaaaagagagaacaggaactcttggcactcagtaagtagatgctcaataaatagctgataggcaaattgaataagcacaggaacagaggaacaagtggaggtgtggccaccagtcctctagattgcagatccctggccgaggtcaagtgtaagcctgaagcttcctccctgttcggagagttgaagattccacaggcagaagattctcaggggaatctttgtccaaagccttccaagactgcagtgagactggggtgggaagagatggggttatcctgtcccatagctgcaggataagctgctgcatgcttggtggggggcactgctcacacatatccccagtgcctcctgtggcgcccaggcttttggcggagaaatcagcctcagtagatctgtgcagggtgtatgggaagaaaaccacttcctctttcccatctgctttgtgtgtgtcattttctggtaatcccatcctaaacttcagcacccacgtggatgccactgggttgtctcagttctgagcccctttcggtttcctttgtgccctttcacccagaaagtctctggctcctcaaagagcctcctccccccttgaaaaggatgtatgtgattattgtaggaagtttgaaaaatgagcaaaagcacaaagaaggaaataaatcccccatcatcgatgataactaaaaaccccaccacctagagaaaaccagccactggcccctgaggtatatccttccagtctttttttctatgcctatgtaaatgcatctatgatttctttttttttctcttttttgagacagagtctcactctgtcacccaggctggcgtgcagtggcatgatcttggctcactccagcctcgaccccccactgcccggggctccagtgatcctcctgccttagcctcccaaatagctgggactacaggtgctcaccaccacgtctggctaatggttaaatttttttttttaagagatggggtttcactatgttgcccagcctggtcttgaactcctgagctcaagcccagagtgctgggattacagatgtgagccaccacacccagtcatgcatctgcgatgtcttaacaaattggcctcataccactcattctcttttaaacctacatttttgcacttaacatatggtaccatgttcccagctagtaaatgttctaaaaatcacagacgcagagtttactggtgtcttaagcttcctgtaacccatcctcagtaacaagataaaggctttctattcaaacatttttgactctctgtcccctgctttgcaagtccgtgccccatcccctgactgtgtggctggggctgacttccccttgccctgcctggagcctgacacctgcctcatcacacctactccccactctttcccccagcccacatttgtcgttcattcattcgtacaacaaagctgtcctgagcacctactgtgtgccaggcctgtgctgggccctggggacaacattgtgactggggtagactgggtcttaccttcagtgagcttcccctaccgctggctcccccaaaccttctcactaccaccctccttcccgggcgttgaactcctgtctcttccccaccagctctttttctccttcccatcagaacacttgtcccaggtggggacagggagggcagtgtggtgcctgcgcacagcacttggaagcagggcacttcgcaccccagagtacccggctgcgcactccattaggtcagctgtggctcagcaagcccgtcactatacgtggtcttgtgtctcccaaccgtgggctcctcccctttaattctgggggaggagcccacagatccccacagcatccagtgcagtgggctctggggttgcctggctgtggacctaaccaagggcatcagcagcgtgtgtgtcacccgctgcccacgtggtccgggctcctggggtgaaagggttagggtgtacagggctgtgctcataggcagcacccttatagagcaggtgccagcagccaagggctgtgtgagcctgagctggcgtccctggggctgacaggcctccttccctacggcctggggcagcaggcaggtgggctgtctgggagggcagacctcaggcacggggatgggagcagaggccccagcaacttcccacagtctgatgcagccctaagccccagatgcacagggcttttcagtggcatccttcctcccctggaaacatttgtgtgagatcccgtgttgagagcttgttttggtccctctcctccagctgggagctttctttcctttctttctttctttttttcgtttttgagacagagtcttgctctgttgcccaggctggagtgcagtggcatgatctcagctcactgcaacctccgtctcccaggttcaagcgattctcctgtctcagcctcccaagtagctgggactacagggcgtgtgccaccatgcccagctaatatttgtatttttagtagagacagggtttcaccctattggcccggctggtctcgaactcctgacctcaagtgatctgccctcctcggcttcccaaagcactgggattacaggcgtgagccaccgcacccggcccagctggaatctttctatttctccatttattcactcatcctgtgctcgttcattcatttactaagtcactaattcactcactcaacaaacccttgagttcctaccatgcttcaggcctgaagggataggtccccagggctgaggtctctagggaaaggccttttcccagaaggcttgtaaggtcctccatcctggccattgttccgggattcaacctccttcctctcctcttgtctctagctggtgaccattcagagctgtcccagaaccccaagcaggtaagggggctttagcaggaggtgtatcaggtggctgggcggagggtacagaggctgctggggagttggacagtcccatcggccaacggaggttggatggagcggggagctcacccagagcaggacgaatgatgctgggagatgtggtcactaggtcttgttctgagtcctggccagcctgtcccctccccaccaaggcaaatggaatgaagggaggccctcccagccaagctgacctggggaacattaaactactggacggagtggggtggaggcaggaaggggaaggtgggggctgaggtgctcagagcatagaggaaggggagacacatgcagagacgcagggacagaggctgcagggctccgtggacacccacctgggacctcctgcccacccaggctgccacgcagagtgagctgcactacgcaaatctggagctgctgatgtggcctctgcaggaaaagccagcaccaccaagggaggtggaggtggaatacagcactgtggtaagtgcaggagcccggcttttgggcatgcggcccctgggctgtgccagggcacccctgggagggtgggcagaaggggaaggaaggggtcggcttggtgatcttgtgcctgtcagggacagggccacatggagatggagcaagtgtagattttgccagagcagaggtccttaggagggcttggtgtcattgtggtggggggtttttgggggtggccagcagctatggctctgacagtccgtgaagtccagcatgggttaagcacctgctgtgtatcgtgagccaagctgagaacctgtgacttctcactgttttggtctcatcatctctttgacatcaattctgctttcgggtttttgtctgtgacccgctgtgggtcaacccttgggcgcagccaccttcaactgggatgatgggatgggggctgcctccctgggtcgtgacccacctgctagtgggagagttcaagcagaagctgggggtcacttggcagagaggatcgggagggatgtaagcatcagcagggaagcttaaagtgcccccaggcctgggagctgaagaggcccctcagacaagtcgtgtggtgccatggagggctggcaccagggtgacaggggacattgttgctggtctgcctggaaaagtggcccaactccctgggatatctccagcctggtaccgttctccccaggccgccgttttgcacctgacaggagaagaggggatccagacctgccacttccgggtcccctgatagccgcaccgttccccaacctcccgccagctgtctgcatgaggatgagggtggtctgggggcccagggtcctggatggctcctggccaagttccttccttccttccttcctttctttctttctttctttctttctttctttctttggaatctcgctctatcccccaggctggaatgcagtggcacagtcttggctcactgcaatctctgcctcccaggttcaagcaattctcctgcctcagcctccagagtagctgggactacagacacctgccactacactggctgatttttgtatttttagtagagacggggcttcaccatgttggccaggctggtctcggactcctgacctcaagtgatccgcctgccctgacttcccaaagtgctgggattacagtactgagccaccacacccggccagctcctggccaagtttctgagcgcccctgcactcaagcctgactccttccttgcatgacatgatcttgtgtccacgaagctgcatggcctgggaccagcaacagccttgttctaacttgttgtctcatgatttaaagtggatggcacatggtcttactcttctcccagcccccttggtacaagttgggactcatgcccacagtacagcaagttaatcagagctgcagggccaacgcagtacccctgtactggcttcaactccacctagagaacgaggggtcctctgcagaaagggatccatggctgcttcgttgtgagaactttcctttttttttcttttcttttctttttttcttttttttttttgagacagagtcccactctgtcgccaggctggagagcagtggtgcaatcttggccattgcaacctccgcctccccggttcaagcgatcctcctgcctcagcctcccaagtagctgggattacaggtgtccaccaccacgcccagctagtttttgtatttttagtagatactgggtttcactatgttacccaggctggtctcaaactcctgacatcaagtgatccacccgccttggcctcccaaagtgctgggattaagggcgtgagccactgtgcctggcctcaagaatatttcattaagagaagcacagaggtgtcttgggggagcccagccaggtctcagggcctcagtttcttccctgtagaatggaccaggctgggtcagccctgaggagcccccggagcctcctgcctctgatgctggggatgttgtgctgctgcttgcccagttggggaggagcagctgggtggacaggatcatagagaaaaagaggccaggacagtggagcctctacagtgaggcctccccaaagcccctcaggtgtcctccctcctccatcctatgttgggggtcctttcttcccttgcctctcccaagtcttcagtttcttggtttctctctgcaggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaatgcc

SEQ ID NO: 370 - DNA, 18416 bp, Homo sapiens; identical to SEQ ID NO: 369

SEQ ID NO: 371 - DNA, 10301 bp, Homo sapiens
tccagagagattgacggattcattgaatatcaacaggaagaaacggtgggaaaagaatgacatcacgttgacaagcgcccatgtcccctcgcccctgagtccagctggtgaagcaccatgctttggctttccctcccgcggagcggtgccgtcctccctgggtctggtcggatcttcgggaagctggatccaggaaagcattccaggaggtagggccctggggctggtggactgtgggtcttggtccctcacagaatgactcaggggatcttagccgggctcgaactctcctctctggccattatggaattttcaggcccatcattggccagagacctaaattcagttcaaagtcagagaaagtttctctttggctgaaggacaagaagaggggaggctctgggtgccatgctagggaccagagggtcccctctcctttatccactgctgacagtcagtactccctattagaaccaagagcaggttggaggcgtcctcatgggtgttcaaagggcaacatgccgaacatgtgtggtgtgtttgcttgtgggcaggtgggggcgggagcacatctcacatgggaaggtccctttggtgtgagggtccctcaaccatacagcacaaagtgaccacattcaagggcctcatcgccgtgggtgaagcctgtgaggagacagaaccacttccctaggacagttttcattagtaacatgatttcaacatcaccgaaaagggagggtgccatttcctgcgatggttttcgttactgccctccccacctggaggtggttcttgaggcctgacaggctcttttggggaggagacccaagctgtcatgctgaggaggctcccaagctgcagcccctcggaggtgggggaataggcagggagcttggggagctaggaggaggaagaggtgggagggggaggacaagcaccgggccgggccagggaggttcccattgcctcctcagccctgtggactcagagccatgtcctccctggggacagggtccatccagcccctcatgccctagaaccaggaactcatcccagaatcaccctccttgtgtgtgggatcagagaggtttcctatgaacataagtcattaaaacccaactttgctagaaaaaaaaaaatttaaaaacacggatatatcaggttctcaggcaaagacggtgttgagttggtctccggaatgatggaagtctagggctgggggggtctcccccaacctctttctgtactttggtcccatgctctgtgcccgagttattccagcagtggggacagagtcgtccagtgcttgagctccatctctacagctcctgaccaagagaacaggtgctggcaccccaggaggtgatggtggctcaggagaggacctggctaagtccctgagctgtgcagaacagggaggtgcccaccagctccaaggccagggcggaggcccagggcccctatctcagtcactgcatcccgaggactcgtagatgttccttccacagcccgagtctcttctggaaacgtggccagggcaggaaggctctgcagatccatctctctaagtggccatgtctttagtcagaggttcggagaagttcatgtagataggctgttcccctggctcctcagggaccctctgagaccccttcaaccagaggatggcagtgaccaagatgagcaagatgggcaccttcacaaataccaggagcatgtagtggttcctggggaaggggatgcagtggtcagagccctgggcatccccaggccatgtcactcccatcccctgaccctgtgagccaccagccaaagcctgtgaccctgggccgggcagccccactctgaagattcctgtaaacctcctccttggttcaacctcaaggggtcctccaacagtcaccttggctggttttgcacggggcccatcttcctttctaacatcaccttctgggaccctctttgcccaaagtacatctcagctcaacagaagcgccagaggtcaccaaatacaggttgtgtttcctgcctctgttcctgctaatgctagctccaggctggtaaatcacccttcctgttctgtgtcccttgatgtcttgcaccacagagggtggtatcttatctccccctggcacccattaggccaccaatgcaaggttgactgattgactgggagaatgatgctcactgagaagagttctgcagagcggttttctggtgagagctagagtggggagatggtggattgcagtgatgggggcaggagagagatggagggtgggcttggggccttgactctggctagaacaggtgctggcatttggtgacaggcaggagttcccaggcttggcttccccttaggagggaccccaggtaggggcaggagaaagaaccacatgactcacctcttgtgggagccgatgaacactgccatattgctgttggtaggtgagcttgctgttgtggaagccgctccctctagacacaggcaaagtcagccatgggttattagcacagttgggagctcatgcatgggtcacaaagccacgcgaccctgccagccctcaccagaagacccttttccctggagtaggaggatttttctctcctgctacagcccctcatgcttctactgagtcacttcaatctcaacacacagacatttttcctcatcatgttcagatgtggcaagaaaaattaaaaattaaacaggagtaaacactgtagtttattctgggagagagaggttttttcatactttctttccacctatcctgcaagtgggactattggatggggaaataaatttctggtcttttccactggagtggtgcctgagcagggcttaaggagagaagattctggaaatgggctgtccagaaattggggtagtccagaaaaagggaaaggggactccagaaggctcatgaagaaaagggcacactccagttaactagagaacatcgactatgagaaacggaacatttttaggagcaaccatataggcaatttgttgggggcagtctggtcaggggggccctgagcccagcccagcactgagtatccatgacccaacagtgatcttttatttcagtcctcggccccagcaaatttttctcaaaggtcccaggctgtccaggcacggtggttcacgcctgtaatcccagcactttggaagaccaagggaggcagatcgcttgaggccaggagtttgaaaccagcctgggcaacatggtgaaatcccatctctacaaaaaatacaaaatgaaccaggcgtggtcatgtgcccctgtagtcccagctactcaggaagctgaagtggaaggattgattgagcccaggaggtcgaggctgcagtgagtcaagttcaccccactgcactccagcctgggctacagactgaaaccctgtctcaaaaaacaaacaaaacaaaataaaacaaaacaaaacaaaaaagtcccaggctttggccacactaggtgggctcctgtctgagctgcaggtaattccaatcacaacagttcctatggagcccctgatcgttttacaggctggtacccctgtagatcccccacccaagactccggaacatctctctccctaaagctccacactggccactgttttttgtctctttgtaccgcctgcatgtcttgctcaatcccctctctgcccccatagatattctgggtttcccctacttggcagccctggggaagtcttgcttgaccctttctggactcctctttactcagctgcagccactgtgtccatgtgcctctttggtcccaaccccaacagtacacaggcttgttctaaagccggcattgtctatttccacatcaccaccaaatggacccgagtggacactgagctgatgaagtactgagtaggggtgtgcgggtggaagtgggggttgggggctgcttcccagactccagcaacagcagcaggatgaccccagagtctatcagtagagtccaaggcatggaggagaagccagggcacccagagtggtccctgacgttgcccgtgatggaagccatccttttgctttaaagcgtccactgtcacccatgcacctccctggggctttcttaccccgtgctcatcttacacagccagataaagtagcggagcaggtggctggggacctagagaggagggtgttgtaagacacccagagctactctgggttggtgcagttagtgggactcaatactaggaccccctgggcagctctaggttccttctctgccatgtcatgagcagggctgggccaccagtcaccaaagctgaggtccccattcccacccccatcccaagccccacctggattccttggagagacctcagggactgagatagcagagcgatgctggccaccactctcccttagtttctgtcacctccttcccagtcagtttgtctgcctgtctgtctgtctgtctctctctctctctctcttaggctcaccatcattccctttcagccttggaggggagcaggtaagagcactgactttcccagccctgagctccagggcctccttgtgtagatgagaaagttcttacctgggtcaacgatcactttcacttgagtcccaaggtcaggtcctcttctttcaatcccacaccagtaaacatctgcgtcatctcgcctgagcccctccatggtcacagtgaacgtgcggtctttctgattgtccttgatggacacacggtcactcttctctccttgctccgaccctctggtttcaatgaggatcttgcatgtatcccagcgcacccctcggcaccaccacttaatgtaggtctcccatccttgcttatagtggcattgaaccgtcagggacccctgctctggggctctcacagactctgggccttggatggagaaacagcctggaaaacagaatcccaagatacagctcattgcaccggcacgaacccctgctctggggctctcacggactctgggccttggatggagaaacagcctggaaaacaaaatcccaagatacagctcctgttgcctgagccagtttggtgtttaagagtcccgagtgtgtctctagcacacccgattcctcatccccatctccctctcagtccattcccccaccagcttctagacctgcttagcatgtgacaccatggtctcctaccaccttctttccttgtcctctcaatgctgttttcatcggagccaaatatttaacaaccagccctctgggggaaaaaatctctggtttaggagctgggcacggtggctcacacttgtaatcccagcactttgggaagccaaggtgggcagatcacctgaggtcaggagttcgagacctgcatggccaacatggtgaaacccagtctttactaaaaatacaaaaattagctgggcgtggtggcagtcacctgtagtctcagctatgcgggaggctgaagcatgaaaattgcttgaacccgggaggcggaggttgcagtgagctgagatcgcaccactgcactccagcctaggcaacagagtgagactcttgtctagaaaaagaaaaagaaaaaaaatctggttttaatatttgccaaattccatagtgtaaatactcccacggtggcagatgtcaggtaatccatgtgatgtcactggacacagagctgggaaaagatgtcccaagccagctcctgtgagccagccccagcacactgcgggggtacccagggttccctctccagccttcatcttgtctcacctgacaagcctccatggagggagtctctccatttccatggctttaatgattacctgtttcctgatgattcccaaatccatatttgcagctcagactccccttagctagcccaccatttacaaagacacactggatgtctccaccccagattccttcgttgcagaattgaatgcacttcctctcccaccctgaactactcttcttcagtatttttttctagtggagcaattggatgtggcaagagtaacaaaggcctggtgaaagctgaacaggttagaggtgagcataatcaaatggcagtccgtgcctccgctgattgactccagttaggctgtgtgtagataggctctttccttggcaatgacacgggtttcttgatcacgcagaagtggataaacaggcagagaatcacaggggaagcctctcttgactgtctcttggcctcagagcttcaggcccaggccaggggtctctgcagggtggagaaagccaggtctatttctccaggcagatgccgcctcctcacagcttgggccttctccttgaagctgtgttagttttcttgaactttgcattcgtggttggtagaataatgtcccccatagctgttggcatcctcatacacagaacctgcgaatatgtcccctgacatggccagagggactctgccgatgtgatgaagttaaggaccttgagacaggaagaatatcccgaataatctccatggatattctaagtgaaagagggttgagggagagtccaattggaagatggtctgttgctgctttgaagtggaagaagaggccaccggccaaggaaagcagatggcttctagaagctggaaaatgcagggaaacagattctcccctagaataggggttcccaaccccaggacaacagactagtaacagcccatggcctgttaggaaccggaccttacagcaggaggtgagcggtgggcaagcaagcgaagcttcatctgtatttacagccactccccgttgttcaaactaccacctgatctccgcctcccatcagaccagcggccgcattagattctcatagaagtgagaaccctattgtgaacttcgtgtgtgagggatctagattgcacacactttatgagactctaatgcctgatgatgtgtcactgtctcccatcacccccagatgggatcatctagttgcaggtaaacaagcttagggctcccactgattctacattatggtgcagtgtataatcatttcattatatattataatataatagtaatataaagtatacaataagtgtaatgcgtttgaatcatcccaaaccatcctcaccccactcctgatgtggaaaaattgtcttccacaaaaccggatcctggtgccaaaaaggttggggaccactgctctaaagaaacccaaccctacttgcacctcaattttaaccagtaagaccacgccaggctctggtcttcagaagcatcaatgagatgatgaaattgtgcagttctaagccatagagttcatgttaatttgttacagcagccactggaaattcacatggcattcaatcagcagaaccaacttgattctcttcaaaccagcagctccaccacccagccttcaggaagagcttggcatcttctttcatgctgtcctctccttcagcccccgagctgattggtagccagtttagtcagctctatcctagagatgctcctcagtttttttttttcttctttcagtctctgccatcgcaggccacaaggacagcatgacatcagagagagtgtgagctttgatgcagaaagacttgacactgaactagttgggaaaccctggcagagttgcttaacctctgcaagtatcgcttccttattcataagacagtcatgctacgctctactttgaaggtggtaataggacttggatgtgtgtaggctgggcaaggtggctcatgcctgtaattccaaagctgtgggaggctgaggcaggaggatcgcttgagcccaggagttccagactaacctgggcaacatggtgaaaccctgtgtctgcaaatgcaaaagattagccaggagtggtggtgcatgcctgtggtccccactgcttggggggctgaggtgggaggatcgcctgagcctgagagttcaaggctgcagtgagttataatcgcccaccactgcacttcagcctgggtgacagagtgagacactgtcttcaaaaaattatttatttttaaatttaaaagaagacttggatgtatgtccaacgccagacatttggggtttgctctgtcagtgacagctcatcaacaggtcagaacttcatctgtgcctggatcatggcagtggcatctggagaggtcttcccagccccagcagcatcctccccaactctcctctcctgaggattatggccttcataatcttgtcttttgtgtttccaacctcatatccaactcgccacccccaagatgtcctgcacactgacagctccctcagctttcctctccatactgctgcctgagttgggtactgagactgtctcctcctcctcatcagctgcacttgccctgagcatctaaaagtcttttcggggccgggcacggtggctcatgcctgtattcccgcactttgggaggccaaggtgggtggatcacctgaggtcaggagttcaagaccaacctcaccaacatggtgaaatcctgtctctactaaaattacaaaaattagccaggcatggtggcaggcaccttaatcccagcttcttgggagactgaggcagaagaatcactcgaacctgggaggcggaggttgcagtgagccaaggttgcaccactgcactccaacctgggtgacagagtgaaactccgtctcaaaaacaaaaaacaaaaacaaaaacaaaatacccaaaaacataaattggatttgtcagcaatcactaacagcagaaaagagatgctgctgcattgaacaaagtgtcatcaatcccagcttcagtcattcaaactgtaaatggctcacgatgtaattagtcccgtttaaaaaaatatttgggggtttctctaaccacagaatatgatggctggaactattaatcaggcttctatatgttgtcaagagttggtatgaggaacgatagagatggaaatgacagggcagccgtcagcttggagcagagccccgttgaacgggctgaagggtggaagtccagccaggactggagtcgggtctcagaactccccagccatgctctttcctgttgtccctccgtggactgctctatctgtgccagatggtcagtccctaggcaccagcagaaaactgtgtggcccacacacattgcacaccctgcgtaaaattctagattgtcccctaatgccctctaggtgtccaccaaggtttgccatggagaagatcatctagcccttcccactttccacctgggttcttgagaagttttttctttgaaagtctcagctcctgagcctggcgtggatggccttcataatcttgtcttttgtgtttccaacctcatatccaactcgccacctccaagacatcctgcacactgacagctccctctgcatgaatccaccattctttctaagcctccatctctctgcccaggtcccccaacacacacacacacacacacacacacacacacacacacacacccaactctctagagtgttctcctctcagctctgctccagagactgaccttccttctacaaggcacatcaagtgcacagcttcgtgagtctttctctagtcaccagagagaactgcttcatcctccgcacacgcctccaccaatgccttattgtgtcctgcaattgctcattgtttatgtgtatgtctcacccactaagccatctggagtctttttactttattttttttttgagacaaggtcccactgtatcacccaggctggagtgctgtggtgcgatcataactctgcagaattgaatacctgagctcaaaggatcctccagcttcagcctcccaagtagctgggactacaggcacggtcaccacgcccagctaatttttgttcattttatatagagacgaggtctcaccatgttgcccaaactggtcttaaacgcctggactcaagcaatcctcccaccttggcctcccaaagtgttaggattataggtgtgagccatggcctcaagcctggagtcttctttaatggccagttctcctcctcttttttcttgatgtcctcaggccccgaagcacacgatgtcagtccccagtgcacctttgtcgaatgacttcacaaagccacctctcatttccctggatgtggaaggacaaatgccctctgcctcctgccctgcccctgtcataccaagcgcccaaggccccagccccactcacctgagaggctgagaaggagcagagcagggggcagccacatggctctgccttcccggctcctcgtccgcctgatctgcaaccagtggcaaatgcagatcccagatgcactctggaagttctgcctgagctctggcttgcaccttctgcacatctagaccgccttt

SEQ ID NO: 372 - DNA, 5106 bp, Homo sapiens
ttctcactcaggtctgactgagtgggcctgatacatcccaaacctacacattgtcatttattaaagtttgaaagcatcattgaatcgacacactcagcaaatggaagcagccgcatattctacactcctggacccagggagtgtgggccattatggtggcaaaggtgcaggggagtcctagacctgcttctccctgtgaaaacggtggaggaagcagtgccaggctcctggagaaatggaagggtgcagggagggcatccgggcactcagaggtattgctgacggcccgaggcttagctggccggggcgtgcacatgagacgtggactcacagctcagggcgtccatgtccgtcaggttcacatgtgacacatgaggatcgggcacagggaaaaggctgaaggaggctcacaaaggattccaggagatgtggagagagcagcccgggagggagtggtcaggaggtcattccagtcccccagaggggctctgttgcagcacagggccttgatggacagcagatgctactggttctcacccttgggccaattctgcctgcttctagagcttctctgaggtctgttcacccagaggacggcacccagcatgctcaggagcaggggcagctccaagaggaccaggagcaggaagcggacattgctgaacagggagctgtggggacacggtgacaggcagtgagtcacctccccaggggaggcccaggtgccctccaccatcccctgacccttgtgtcccaatcctgtgaccacagccaaccacataagcacccccctggacagtccatcccgtctcagcatcacggcccctaaccctcagcctcggatttacccttgacctgaggactgtgacacaggaagggcaggaccatgagaggacgtgaggtcacgccagggatccaggcagggtctgtgtccaggacgcagctgtctacctctgtgctccccatggagggttacccagctggggtcccggaattcacaaagggttatttgtttggtgtcaactctcctgtacacagcgtttccaggagggcagggaccatttgtttcattcacagtgagtacctgctgcctacccggagtctccaataatctgccctacaacttcagtggttgttgaaggaattaatgaatggacagctcagctctcagctcctcagaggactgggcttatcaaacaggatgaaactctggccagggctgcgagagaggcaggggagaggaccagggccaccggaccccagagcatctgcccccttccctggcctggccaggtcccaaggctcctcgcaggacatttgcctcactcctccctccacctggacccttcttcctccagaccccagagtgcccagcccccaacccttgaggtctctgtgctcatgtcctctaattctcaaaccctcttctgatcatcgtcagtgaaatagcaactccaacacctgcacacgctctccccaaacccaagagtcaaacatctcatcccagcattcattaccctttgctgtatttgtacatcagcctctgtgctgacttgctcaatgcgtgaatccacgcagtagaactcaacttccaccagggcaggacagtggctgtgtggttccctgctgtgacccaatcccaaaaggagcgcctgacacttaatagaaccttcacgtttggtgtgggaggtgcgaacaaagaagggactggaagaagggacatccgagtcccctaaacatcacacgcagtggggaggccgccagcgtggcccagtcctatgcgcaggcaccttacccagggtgtgggctgggttcggggctgtcctttctggtcacgctgggccaggtgtgcacgggcagcttcgtgggaggacctgaggtgcccatggagctctgggggctggaggctgtggtcgtcccggctgtgggtgaaacacaggtcaaccttgatgacatcacatgggtctcccacttactctcacctgttctgctccaattttcacagacaaggtcaccaatgatgtgctggacagatgccctgcatccatcatgccccacggccacacccaggcctgaccagggtcctgggcctctccttgtcccatccctaggtactgcagagccaggacaccatttcagatgtgagagctgccctgctcacctgtggcaaaggtacgggtctccaggtttcaccccagccagggagggacagggtgacctgggggaatggggtgatgtttactctgcgaagggtgacccagagtgactgcgaagccagggccctgggcacagcagtggctggagagaggctggaagtgaggacaggaagtcagtggggtcctccctgaacgatgggacccgagtccactcagccccaaatggcagccatgctgcggccccacaaggccattggaccatcctctcagcaggagggaatgcccaggaagaaagatctagagaggggatgcccggtgaagcctgggcggcggcccgtggtgaatacagctggataagggccctttcctcctctccctggcgccctcaggtgggatcttagctcctcactcctagataggaaggcacaaagggcgcaggagggacacgtcgcccccggggaaatggagaacaagaagatgctccgaggaacctgggacattgtcagaagaaaacgatggaaaagcaaccacactgaggccactgggtttgtgtcttgtgagacaggagggggcctttgagggaagaatgatcttcggcacgggaaagggccctcaggtccgtgccagtctcagctcatttccatccacaggtccctttgcctgagggggcaatttctggggttccctcctgtggtaaaaggtgccagagaataagggggacacacaggtcagcctcaggggcaggatgtggttcccaggagcatgagaaccccacccagggctctggggctccttcctgtgtcctccagtggctgctgcaggagctcccaggacagggctgtgaggctgcggcctcaggaccctccagacagggcggcatccatgcaggccccagggcaggggcagccttgagtgagaggagccaatgatgggggggtccaattccccgtggggaagagcgagttagacccaggcgggacagtgggcacccttcagtatggatccggcccttgtcaatacagggaggtagcaaggaccccagagtcaggggtggcctcacagaccccacccaggaaagtttcaggcctgaggccgtgagggagggcccacagcggggggtctccagccacagggccagggtgcttttgtgggcgcccaccctcccaacacacacatgcaggtgcacacacacacaaaccacaccacaactcctatgcaggcacgcatacacaaagacgcactcacactcatccacacacagcggcacacagtgtcctgactcaccaacccccaggctcacaccctcctgttccacttctttcttcagggacagaatgaccagccctaggctcaggcaggcctggtgctgagaaaaggaggggctcacccgggaacacggacacctcaacctcgacaatgggatcatgaaagtctcggagccacggtgtatccaccccacaccagtaggtgcctgcgtcctcctctgtgagattctccagggtcactgtgaagctgaggtttgcaggactgtccctgatggacactcggccattccttttccctgctgaccctttggtctccacaatcttgtcacatcggagaatctgtggtggtctgcaccagaatttgttgagggtcctgtgttccttctcatagcgacactgcacactcagggatccccccacggggcccgccacggtcatggggtggctcagaggaaaatagcctgaaaaatacaagccaaaatcctgtctccttaccagaggggcctggtcaggggtgccgcagtgtcagcccctcatggaccctgggcgtgtggagaaggcaatggcaggcaggcagcctttgtccacccaggaacagggactgagggtgggaggctccctctgtgcagaggtgggaagggcatgggaagtttccatggagactggaaaggcaaggctagggaaacactgggtgtgtgcgggcctgtgtgtgcatgtgagtgtgactctgtgtgtgtgactgtgtgagtgtgactgtctgtgtgagtgtgactgtgtgtgactgtgtgtgcatgtgtgactgtgtgtgcatgtgagtgtgactgtgtgtgcatgtgtgactgtgtgcatgtgtgtgtgagactgtgtgagtgtgactgtgtgtgcatgtgtgtgagactgtgtgagtgtgaccgtgtgtgcgtgtgagtgtgactgtgtgtgtgatcgtcccagataaaatttgtgattggataactttggcaatgacagtcacagcatcacctcccaccagggcttcctgtctcgggcacagaggaataggcctcccccgtgctgtgccctgccgcctgctgtcccctggtgaggcagctgctgaccgctcctgggtgctcctttgccctcctcccctctccctgccccactcccctctatgaccgctactccagcgcctgcacccctccctgccctctcccactcaggacagagctccccaagtccagggtcggcccactcacctgggacaagcaggaggagcagagctgaagaccgccacgaggcccaggccctggcagtcattcctgtaacacgaatgtcacctgccactgtgcaagaccccaggaggggacaaaatgtaatctcctcccagcagatctgagcttcgcttctgcttttcttctgctctctgcttccttgtccagccctgtctcaggtctgaggctggagagggtcagggtacaggaagctcagggagagagccgcctgggctgaggccggtgctgacagctctgggatggtgctagtggctcctctcaaccctgacgtctggcaaagtccagggtcccttgggtggcgatgcagccacttccccacagcccacagcttctggcttcagtgtgttactcacactgcagaaggcagagccaagctgggccatttcctaccacatgggctgctccaccctctgt

SEQ ID NO: 373 - DNA, 12260 bp, Homo sapiens
actctcatcatcgggctgactcctcctccttcaagaccttctttgtggtctgtttacccagaggacggtccccagcatgctcaggagcagaggcagctccaggaggaacaggaacaggaagtgggtgctcttgagcggggacctgtgggaacacggtgacaggaaatgagctgcctcctgggtcagaggtctcaggtcttctcagctctatgcccagatcctggcttccaatgtctatgtgagggtaagcctggaaccccagacaggccagcccctttggtggggcacagtcacactgctcaccagcgaggctcccagtcctccctacacctccagtaaactcagcctggcattcaaggtcccgtctgccaactcccatccggcctttttggctggtctcccataactcctcctcacctatcttgaaggggtttagcattccctgtctctacttacctcggcttctgctgcattctgcacccagagggcctctccgccctcatcgctgcctgtgcaaacgctacccacctttcaggtatcagatctgacatcatattcttgaaggccttggaggctgaccttgctctgaccctcttcctgtggaccagcacctggccctggggttccttatgttccctgttactttctatggatgtgtaaggcccagaaccttattgaccatcaattccaccccctcaccatcctccacccacttcccagggtctcgacctcccaacttgggccttcgttgtttctttcacctcagcgcaacttgaagccactctcagctcacggataaattttaaaaatcaggccaggcgtggtggttcgcacgtgtaatcccagcactttgggaggccaaggcaggtggattgcttgagcccaagagttcaagaccagcctgggcaacatattgaggccccatctctaaaaaaaaaaaaaaaaaagacagaaaagaaaattcaaaattatatccaactccagaatgccggatgagccctcagatgatgggactgagggtatttgggggagatggaggaggggctatacagcaggccacgggtcaaaatgcccccaaaggtccttcccagcatcttcactcttggggctctcctgctacacctctggagtcctttgccctctgtcccctgacagctaaagtcccatcagtttgcacaaaagcatggaggaggaaaaaaacaaacaaaaaaaaaacagtcgaggagtcctaaagccagctccgtgggtggagctctgcagatgcattctcagaactcaagatcgagtgaataaaaaaaaaaaaacagagttgaactgcagagggaactggcagaccttgaggagtagttccaggaggactgagccagagacacgggcctctgcgctgggctctagcaggagcaggacggtctgtggtttgggctctggccttgacctggggggcttgaccacagcaggccgtgatggaacccaacggctagctatcaggtgccgacctctggggactcctctggacacctccagggctggtgagcatcagactaatcctccagacccctctgccagcttgggagggtgagaacgccaaacttccagcttccccctttccctctagcattttccattcccctactctggtgtcttgggagagagaggctggaacaatatttgttcttgggcagaaactaggagcagatgagagaggtgtctctcctaacccactaaaggccaaacctcgatatgccctcttgaccccaggaggtggggagggcatgttcaggcccctctcctgccaccttcagtcatgtggtggctcatgtctgtgctgcagagtttgccttcatgtagccaacacttagatgggaaatcttattttcctcaaaggtaaactgagattggggcaggccatcggaggtttgcagtgactttactgatacaaagacgaaacagcaggggcctatgggggtcccagcctgagtacccccagaaaacagggctatcagagttaacaaataaaagcatagaatgctcagttaaatttgaagttcagataaacaacatatgcttttttagtataagtatagcccatgaaatagttgggatatacttatgctaaaaaatgttttgttgtttgtctgaaattgcagtgtaactgggcatgctattgttgtatctggcaacccctgttagaggagaggccatggggccaggcctgtgcgaaagtggtgggacctggctccacctacctggtgagggggctgctggtcttctgggtggctgcagctgtgaaagccaggcttgctgttgtggttgtccattctgagactgcagtttgtgtgcctaaacatacaaagcagaacacggttcaccccttccatggatggcccagctctggctgtggccctaaggcttctccacctaggaattaaggagcctctgccttggggtccaagactgtctggtcagcatccaaaatattacatgaattatcttctaaagagaagttactgaattattaccatgtgagaaattctgaggagcagactaaggagggaatttgcaatcatcagttgcatggcacagcttagcacactcgatagcattccgctctcctcgggctaggctagctcttttctgagtctcggccacagccgaggtgaactccttaccgcctgttctggagtgattcggcggctgagctggtggccccctcgctgagccacttctggagagccccggattcctggctctctgcagccaggcccagcgccctccacctccgctcttccctctctggccgtttcctgtcttccagcagcttcccaatctcaccctccctacccctgttgaagtctggctatgtctgatgcatcccagcctctgctgtgtgccaattcctgctggaccacaccctactcacgctgacggtgtgtgtagtgagttttgatattcaaagtttgcttcaggagcaatctaataataagagatcacagcatcatatttgtctttttatatcatttttctgggattaaatcaaggtataactgacacataataaactgtaaatatttaaagagaacaatatgttaaactctgatgtatgtgtatacccggtaacaccaccaccatgatcaggacagtcaacacattcataatccccatgcccgccctcccccttactctgtccccaggtgttagggactgaactgtggacccctaaaaattatatgttgatatgctagtccccagtacctcaaaatgtgactatatttggagataggacctttcaagaggcaattaagttaaaatgagtttgttagggtaagtcctaatgccatctgactggtatcgttctctgaagaggagatgaggacacacagggagacaccaaggcatgcgagcacagaggggcaaccgcaagaaggggtagcaagaaggcagccacctgcaagccagggagggaggcctcaggctcaactgaacctgccaacaccttgatctcggacttccagcctccagaactatgagaaatacgtttctgttgtttacgccacccagtctgtggtattttgttgtgacagccttagctaagggatgatccattttctcttactatctatgagttggcattttccagaatctaatataaatggaatcatacagtgtaaatcagcttttgagctggtttctttcactcagcataactattttatcattggtatatcagtagaacattcccttttattgcaagttgtattccattgcatgagtatttcactttttttttttttttttttttgagacagagtctctctctgtcactcaggttgcagtgcagtggcatgatcttggctcactgcaaccactgcctcccaggttcaagcaattctctgcctcaccctcccaagcatctgggactacaggttagtgccaccatagccagctaatttttttttatttttagtagagatggggttttgtcatgttggctaggctggtctcaaactcctagcctcaagtgatccacctgcctcagccttaacaaagtgctgggattacaggcgtgaaccaccacgcccagcctgtatttcacatttttaaaaaaatccactcacttgaattgtttccagttttttgctattacaaataaagctgctatgaacattcacatacaggtctctgtgtgaacataaaactttctattattttgactaaatatggaagtgctgaggggctggatcatctctggcgggcatacatttcatgtctgaagaaactgcaaactcttttcccaggtggttgcatcatgtgcattcccacctgcagggtatgagggctccaggtactcgagagtgtttccaacacttggtgtcaaggtcagtaatgttaacttttgttacaggccgaaagaatgagagtcatgaccaacacagtatagcactggaggctatatgagcgaacagaaaactgttctcatgaaagcaggatgttggaaaactggcaacggtgtctgctgcccgaaggggtgctgagggcagtcacaccccaagtgctgtgttccttgtgattatctataggaacatctgaagcctgttgtacaaagaaagctattgtgtgtacctgtaataaatcaagcagctgaccaaccattacctctccctcccttctctttctacctaataaatacgaagggctgtagaagctcagggcccttgttcactagaagcaaggagctccctgaccccttctttcaaaacagatctctttgtctttgtcttcatttctgcattcgtcccccctttgttcaatcccctagcaaccaacagcgacaagtggtggccgggacaggaacgtgagcaaagaaggtctgctggagcagagaaagagaaactgacaagacgaacgagaaaccctggaacaagtctgccggcagccaataaaaggtcagtgccctaaagaggtactgggagcggcagcagatacaagatcagtgccctaaagaggtactgggatatcaggtcagtgccctagagaggtactgggaatgggaagttttctgaataagggtaacatggggcagaatttgtctattgaggtgcaacattatgtgcatttgcttaaagttttacttaaacaaactggtgctcaggttagttctcaaacattaattaagatgctgaagaaggtcactatacataacccgtggtttccacagacaggcagtcttgatgtagaaatttgggacagagtaggaccaggattaaaacgggctcaccaaaaaggtcttaaatttgatctttttgttttttctgcttggagtttagtccgtgctgtcctcctgccattatcttcttcttattctgctagacagcaggaatcatattccaagtctaaaaatctgaaaaaatattttgtcccacccacagtaccaattaaaaataataaacaggagaaggaggatgaaaactggcctgtgtcaccccctccagtagcagaaacgtctgtactgcctccttcagtagcagaaatagagaccccaatacaaagaattttatgctctgctgctatagctggaaagcccttaggaccttgcgcttttcctatttccataaggcccgatccaaataatcctcagcagtttattcatgaacacaccccactacagtttaagttgctgaaggaattgaaagcgagtgtagttaataatggagtacaaagcccatttactttaggattgctagaatctatatttggtgctatgcgccttccaccctttgatgtaaagcatttggcttgcacttgtttgtctgctagtgcatacctgacatggaatttaaattggcaagaactgtgtgcagaccaggctagacagaatcatgctgctggacacggagacattacagaggatatgctgttaggtaatcgtccttattcagacctggaacatcacatggcactcccagacactgcttataagcagtgtgccttggctgctaaacatgcctgggccacaattcctgaggaaggggtcccagtacaatcttttttacatatcatgtaagggtggccaatgcacattttcttgcaagattacaagaggcggtgaagcatcagattcctcatactgcggctacagaaatgctaaccttaactctagcttttgagaatgcaaatgcagattgtaaatgtgcactggcatctgtgagatgtacaaaaaactcgggaaattttctcaaagcttgtcaagatgtgggaactgaacttcattgctctacaatgttggctcaagcaatggctaatttagtagtggacaaatctaaaaacggccaaggagcaaatcctaaaatgggaaaatgttataattgtggaaaaatcggacacttcaaaaaagaataccgtcagacctttgggcagaagggatcttataatgcagccccccaccccagaaaaaatgccaggactttgccctcattgcaatataggaaataactgggctagtcaatgccactcaaaatttcatcagaatggcacccccctgtcgggaaacgagaagggggcctggacccgggccctataaacaatggaggcattccctgtccagcccacagccccatctcagggataggttcccggaggcacattgattccctctccccaggaacacctggaagctcaggattcgatctcccagtcagagaacaggtaacgttagtgggaggagacaaacccaccaagattcccactggtatttggggacctttgccaacaggatatatgggattaattttgggtaaaagctgtcttaatttacagagcattaccttagtcccaggagttattgattctgattatgaaggagaaattcaagtagtggtaatgtcacaaggtctttgggtttttgaaccaggagaatatattgctcagctactgcttattacctgccagttacacccttctttacggaggttgggagttcgagaccagcctgaccaacatggagaaaccctgtctctactaaaaatacaaaattagctgggcatggtggtgcatgcctgtaatcccagctactcgggaggctaaggcaagagaatctctggaacccaggaggtggaggttgtggtgagccgagatcgtgccattgcactccagcccaggcaacaagagcgaaactccatctcaaaaaaaaaaaaattgatattatccggtcctgaactcaccaaagggccatctgagcctgaaattttcttcgtgagaagatggcaaatgacaaattctatttcattaaaagatatagagctattccagttatctatttcttcttgtgactggtagtttgtgcctttcaaggatgtttttccatttcatttaacttgttgaatatattggcataaaagttgtttacgacacatattcccttattattcttttagtagctataaaatctgttgtaatgttacctctctcatttctgatgttagtaatttatatctttttcctgatcagtctaggtagaggtttaacagtgtttctgatgttttcacagaaaacatatctcatttcattgatttttccctattacttttgttttcgatttcattaatttttcattgtggtcttaatattatctgtgttctgatgtttgctttgagtttactttgatcttttttttccctagtatcttgagctaaggccattgacttgaggcccttctccttttctgatacagggacttagtgctataaagaagttccaagaaggcactggcagggattggggtctctggttaccagggaagggggtccctttggcctgtgggctgaaactggaaccatcaccctgtcatctgtgggcaacagactcaggcactgagctgtgcagagaaaaaaaaaatgtgcctagaaagacttaatcccatcctggagggagccctgggagccatggggtcattaagagatcccctcaatcccaagcggtccttcagggtcctatgagacctgtcttagtctactttttcttgcttataacagaatatctggaattgagtcatttataaggaaaaggaatttgtttcttacagttatggaggctaagatgtccgaggttgaggagccacatcttgtgagggccttcttgatggcagggactctctgcagagtcccaaggtggctccaggcacctcgtggtggcggaactgagtatgctaagtcaggtctgtctgccttttcttataaagcagttccattcccatgataacccattcatcctttaatccacgaatggattaattcattcatgggaactctgcccccatgacccagtcaccttttaaaggccttgtctctcaatactgccacattggggattaagtttcaacacgagttttggagggacaaatattcaaaccatagcaagacctcaggactcagacaccctctgtcacaggtcactctgagtgacagttaatttactcaagtgggacctcagggaccaggacagagcaggacctgagagacacacacgtatatacactccctcttacctgggttaatggtcacttgaactttgaccccaagatcaattccaggtctctcagtcccacaccaataactgtcagcatcatctcttttgagattctccatggtcacggtgaacacgtggtttttctgattgtccctgatggaaactcgattcttctttacctcctgctctgatccatttgttttaacaaggatgttacagtaattccaatcagctccttgacaccgccacttcaagtaggtctcccagcctgagccataagcacactgcacagtcaatgagccctgctccgagccattcactgttgttggaccagtgattttagcggcaatggagtaacctggaaaacgcaaattcatgtgtcgtcacctcccaccccaagggcagggccacagcctcgtgcattgggagtagcagccaaatccaactgccttataacagtcaaggaagcaatacattttcctcaagacaaatctttgtccttcaaaattccactgggtcaaagtcaccaggaaaatcactgaagagcacaactgcagatccccaaagaaacacaaatgttggcattgagcaataatagcttcctgcagttcacccctctctctttccctatggccagcaaatctttatattccaaggaatgctctttggcaaccatctttgtgttatactggtctgatggggaggaaatggcagaaggcccttttccagaagaatgattgctgccttgatgcttggctgttcctagtggttctaatggtttctggtggctctgctgtagttaatcaccctgaatgaatccctttgaaatcaaccaaatagtgatgccaactggtctctatctgctatgggatccacatcacacagatctccatttcgccatacagtgttataaattccacttccaaaattcctaggaaaagctaacttttaagataaacacaagtaaaggttaggtataaacagagcagcacccattcaacacccttctgcatcttataagttcttctctaaacataatggacatgattcaagtcagttaaagggtgaggaacgggcatacctaattagctccacttttcaaacaatttgatccaggacaagactagtctccatgaacttgtcagcctaatctttcacttgaaaacaattcaaaacagtggaaataccttaagtgagagctttgccagaaattctttaaattcaactgacctaaagggagacccatctaaagaaacgattgattttgatgatttatgcactggcaataaaccatagctgtgattagtgcagcataaacttgagatggaactagaagcacattggagcacttgaagaagccctgggggcaattcctgtggcaggagagaggttgtctctgaaacgccaagagacacccaaggtcgtgggtaagagctcaggctgtgccagagtgcttgggtttgaatcctggctctaccactgataagttttgtgaacctgggcaaattaacctctctgtgtgatacggtttgtctgtgtcctcacccaaatctcatcttgaattgtagctcccataatttccacatgttgtggggggcaccagttgggagttaattgaatcatggggcggtttcccccacattgttctcgtggtagtgaataagtctcatgagagctgatggttttataatgggaaacctctttcacttggctctcattctctctcttgcctgctgccatataatacatgcctttcaccttccaccatgattgtgaggcctccccagtcatgtggaactgtgagtccattaaacctctttttctgtgtaatttactcagtctcgggtatgtccttatcagcagcgtgaaaatggactaatacactgtgacttcgttttctataagtgggaatagtaatggcatctacctctatgttactatattatgtttgttattattattattattattattacccctggatgaatgaaaactttagacttcattggaatgtcttgaaaaaccagggtcaccatggtgggagcggaagacaatttcaccataaacaggcagagctccacaacccaaggaattcctggaacagaaattggactccatgcccaaatctgctttctatggcatctgaagggaactaagaaactacacacgacctcctggggaaagatgggtataggggcttcatttgttcactctgaaaaaagttctacatcagaatggaaagacaacaattaaggtaaatatttaaagaaaaactacatctggaagttatttataagaaataagagctgggtgtggtagctcacacttgtaatataacaactttgggaggctgaggcaggagaatcgcgtgagccctggagcttgagagcagccctggcaacatagcgagactaaataaataaataaatattagctgggtgtcgcaccacatgcctgtagtcccagctactcactcaggaggctgaggtgggaggatggcttgagcctgggaggtcaaggctgcagtgaaccctgatcccagcactgtactccagattgggtgacagagcacaccctgtctcagaaggaaggaaaggaaggagaatatatctgaaaattgtttacagaatataaatttgaagccaggcatggtggctcacacctataatcccagcactttgggaggccaaagtgggaggatcacttgagcccaggagtttgagaccagcctgggcatgaaagtgagtcctcatctctacaaaaaaaaaaaaaataaaaataataataataataataataatctattttaaaagaaaataaatttgagattggaaggaaaaattttcttacaaagcttgatctgagtatagataatatgagaagcacatagatttgttacattttaacagaaatgaaaacactacgtatcaaaatttgttgacatgacagccaaagctgtactcaaatataaatccttgggaaaaaggtttgatgcttcctcaaaaagttaaacatagaattaacataggattcagccattttacccctagatatatacccaagagaactgaaaacatatctccatacaaaactgtgctatgaaagttcataacattattactaacaatttttaaaaggtagaaacaaccctaaggttcattgacaaatgactggagaaaccaaatgtggtatatccactgtgaaatactatgcagccatgaaaaagaatgaagctttgatttgtgctacaacacaaagtaaccttgaaacatcatgctaagtgaaagaagcactccagcctgggtgacagagcgagacaccagctcaaaaaaaaaaaaaaaaaaaagttcttcaagaatggactcactcattagttccttccttcattgatatctgttcattcatctgtttatatggaacagtcagggttgagaaccactgttccaacaagaagctatacttgttttgttttgtgtgtgtttgtttctgcagcatctaacacagaacctgtcagataacaaaaacttgattgctatttaatgaatatgggcatggatggatgaattggcgctgtcattttccctgacatgtctccttcctgagaacagagcgtctctgtctccaagccagccgctgtcattccagtgccttaaagctccagccacactcacctgggaggatgagaagcagcagagatggggacagccacatggtcctgtctcctctcctctccttggtga

SEQ ID NO: 374 - DNA, 9292 bp, Homo sapiens
agtgccctaaagaggtactgggagcggcagcagatacaagatcagtgccctaaagaggtactgggatatcaggtcagtgccctagagaggtactgggaatgggaagttttctgaataagggtaacatggggcagaatttgtctattgaggtgcaacattatgtgcatttgcttaaagttttacttaaacaaactggtgctcaggttagttctcaaacattaattaagatgctgaagaaggtcactatacataacccgtggtttccacagacaggcagtcttgatgtagaaatttgggacagagtaggaccaggattaaaacgggctcaccaaaaaggtcttaaatttgatctttttgttttttctgcttggagtttagtccgtgctgtcctcctgccattatcttcttcttattctgctagacagcaggaatcatattccaagtctaaaaatctgaaaaaatattttgtcccacccacagtaccaattaaaaataataaacaggagaaggaggatgaaaactggcctgtgtcaccccctccagtagcagaaacgtctgtactgcctccttcagtagcagaaatagagaccccaatacaaagaattttatgctctgctgctatagctggaaagcccttaggaccttgcgcttttcctatttccataaggcccgatccaaataatcctcagcagtttattcatgaacacaccccactacagtttaagttgctgaaggaattgaaagcgagtgtagttaataatggagtacaaagcccatttactttaggattgctagaatctatatttggtgctatgcgccttccaccctttgatgtaaagcatttggcttgcacttgtttgtctgctagtgcatacctgacatggaatttaaattggcaagaactgtgtgcagaccaggctagacagaatcatgctgctggacacggagacattacagaggatatgctgttaggtaatcgtccttattcagacctggaacatcacatggcactcccagacactgcttataagcagtgtgccttggctgctaaacatgcctgggccacaattcctgaggaaggggtcccagtacaatcttttttacatatcatgtaagggtggccaatgcacattttcttgcaagattacaagaggcggtgaagcatcagattcctcatactgcggctacagaaatgctaaccttaactctagcttttgagaatgcaaatgcagattgtaaatgtgcactggcatctgtgagatgtacaaaaaactcgggaaattttctcaaagcttgtcaagatgtgggaactgaacttcattgctctacaatgttggctcaagcaatggctaatttagtagtggacaaatctaaaaacggccaaggagcaaatcctaaaatgggaaaatgttataattgtggaaaaatcggacacttcaaaaaagaataccgtcagacctttgggcagaagggatcttataatgcagccccccaccccagaaaaaatgccaggactttgccctcattgcaatataggaaataactgggctagtcaatgccactcaaaatttcatcagaatggcacccccctgtcgggaaacgagaagggggcctggacccgggccctataaacaatggaggcattccctgtccagcccacagccccatctcagggataggttcccggaggcacattgattccctctccccaggaacacctggaagctcaggattcgatctcccagtcagagaacaggtaacgttagtgggaggagacaaacccaccaagattcccactggtatttggggacctttgccaacaggatatatgggattaattttgggtaaaagctgtcttaatttacagagcattaccttagtcccaggagttattgattctgattatgaaggagaaattcaagtagtggtaatgtcacaaggtctttgggtttttgaaccaggagaatatattgctcagctactgcttattacctgccagttacacccttctttacggaggttgggagttcgagaccagcctgaccaacatggagaaaccctgtctctactaaaaatacaaaattagctgggcatggtggtgcatgcctgtaatcccagctactcgggaggctaaggcaagagaatctctggaacccaggaggtggaggttgtggtgagccgagatcgtgccattgcactccagcccaggcaacaagagcgaaactccatctcaaaaaaaaaaaaattgatattatccggtcctgaactcaccaaagggccatctgagcctgaaattttcttcgtgagaagatggcaaatgacaaattctatttcattaaaagatatagagctattccagttatctatttcttcttgtgactggtagtttgtgcctttcaaggatgtttttccatttcatttaacttgttgaatatattggcataaaagttgtttacgacacatattcccttattattcttttagtagctataaaatctgttgtaatgttacctctctcatttctgatgttagtaatttatatctttttcctgatcagtctaggtagaggtttaacagtgtttctgatgttttcacagaaaacatatctcatttcattgatttttccctattacttttgttttcgatttcattaatttttcattgtggtcttaatattatctgtgttctgatgtttgctttgagtttactttgatcttttttttccctagtatcttgagctaaggccattgacttgaggcccttctccttttctgatacagggacttagtgctataaagaagttccaagaaggcactggcagggattggggtctctggttaccagggaagggggtccctttggcctgtgggctgaaactggaaccatcaccctgtcatctgtgggcaacagactcaggcactgagctgtgcagagaaaaaaaaaatgtgcctagaaagacttaatcccatcctggagggagccctgggagccatggggtcattaagagatcccctcaatcccaagcggtccttcagggtcctatgagacctgtcttagtctactttttcttgcttataacagaatatctggaattgagtcatttataaggaaaaggaatttgtttcttacagttatggaggctaagatgtccgaggttgaggagccacatcttgtgagggccttcttgatggcagggactctctgcagagtcccaaggtggctccaggcacctcgtggtggcggaactgagtatgctaagtcaggtctgtctgccttttcttataaagcagttccattcccatgataacccattcatcctttaatccacgaatggattaattcattcatgggaactctgcccccatgacccagtcaccttttaaaggccttgtctctcaatactgccacattggggattaagtttcaacacgagttttggagggacaaatattcaaaccatagcaagacctcaggactcagacaccctctgtcacaggtcactctgagtgacagttaatttactcaagtgggacctcagggaccaggacagagcaggacctgagagacacacacgtatatacactccctcttacctgggttaatggtcacttgaactttgaccccaagatcaattccaggtctctcagtcccacaccaataactgtcagcatcatctcttttgagattctccatggtcacggtgaacacgtggtttttctgattgtccctgatggaaactcgattcttctttacctcctgctctgatccatttgttttaacaaggatgttacagtaattccaatcagctccttgacaccgccacttcaagtaggtctcccagcctgagccataagcacactgcacagtcaatgagccctgctccgagccattcactgttgttggaccagtgattttagcggcaatggagtaacctggaaaacgcaaattcatgtgtcgtcacctcccaccccaagggcagggccacagcctcgtgcattgggagtagcagccaaatccaactgccttataacagtcaaggaagcaatacattttcctcaagacaaatctttgtccttcaaaattccactgggtcaaagtcaccaggaaaatcactgaagagcacaactgcagatccccaaagaaacacaaatgttggcattgagcaataatagcttcctgcagttcacccctctctctttccctatggccagcaaatctttatattccaaggaatgctctttggcaaccatctttgtgttatactggtctgatggggaggaaatggcagaaggcccttttccagaagaatgattgctgccttgatgcttggctgttcctagtggttctaatggtttctggtggctctgctgtagttaatcaccctgaatgaatccctttgaaatcaaccaaatagtgatgccaactggtctctatctgctatgggatccacatcacacagatctccatttcgccatacagtgttataaattccacttccaaaattcctaggaaaagctaacttttaagataaacacaagtaaaggttaggtataaacagagcagcacccattcaacacccttctgcatcttataagttcttctctaaacataatggacatgattcaagtcagttaaagggtgaggaacgggcatacctaattagctccacttttcaaacaatttgatccaggacaagactagtctccatgaacttgtcagcctaatctttcacttgaaaacaattcaaaacagtggaaataccttaagtgagagctttgccagaaattctttaaattcaactgacctaaagggagacccatctaaagaaacgattgattttgatgatttatgcactggcaataaaccatagctgtgattagtgcagcataaacttgagatggaactagaagcacattggagcacttgaagaagccctgggggcaattcctgtggcaggagagaggttgtctctgaaacgccaagagacacccaaggtcgtgggtaagagctcaggctgtgccagagtgcttgggtttgaatcctggctctaccactgataagttttgtgaacctgggcaaattaacctctctgtgtgatacggtttgtctgtgtcctcacccaaatctcatcttgaattgtagctcccataatttccacatgttgtggggggcaccagttgggagttaattgaatcatggggcggtttcccccacattgttctcgtggtagtgaataagtctcatgagagctgatggttttataatgggaaacctctttcacttggctctcattctctctcttgcctgctgccatataatacatgcctttcaccttccaccatgattgtgaggcctccccagtcatgtggaactgtgagtccattaaacctctttttctgtgtaatttactcagtctcgggtatgtccttatcagcagcgtgaaaatggactaatacactgtgacttcgttttctataagtgggaatagtaatggcatctacctctatgttactatattatgtttgttattattattattattattattacccctggatgaatgaaaactttagacttcattggaatgtcttgaaaaaccagggtcaccatggtgggagcggaagacaatttcaccataaacaggcagagctccacaacccaaggaattcctggaacagaaattggactccatgcccaaatctgctttctatggcatctgaagggaactaagaaactacacacgacctcctggggaaagatgggtataggggcttcatttgttcactctgaaaaaagttctacatcagaatggaaagacaacaattaaggtaaatatttaaagaaaaactacatctggaagttatttataagaaataagagctgggtgtggtagctcacacttgtaatataacaactttgggaggctgaggcaggagaatcgcgtgagccctggagcttgagagcagccctggcaacatagcgagactaaataaataaataaatattagctgggtgtcgcaccacatgcctgtagtcccagctactcactcaggaggctgaggtgggaggatggcttgagcctgggaggtcaaggctgcagtgaaccctgatcccagcactgtactccagattgggtgacagagcacaccctgtctcagaaggaaggaaaggaaggagaatatatctgaaaattgtttacagaatataaatttgaagccaggcatggtggctcacacctataatcccagcactttgggaggccaaagtgggaggatcacttgagcccaggagtttgagaccagcctgggcatgaaagtgagtcctcatctctacaaaaaaaaaaaaaataaaaataataataataataataataatctattttaaaagaaaataaatttgagattggaaggaaaaattttcttacaaagcttgatctgagtatagataatatgagaagcacatagatttgttacattttaacagaaatgaaaacactacgtatcaaaatttgttgacatgacagccaaagctgtactcaaatataaatccttgggaaaaaggtttgatgcttcctcaaaaagttaaacatagaattaacataggattcagccattttacccctagatatatacccaagagaactgaaaacatatctccatacaaaactgtgctatgaaagttcataacattattactaacaatttttaaaaggtagaaacaaccctaaggttcattgacaaatgactggagaaaccaaatgtggtatatccactgtgaaatactatgcagccatgaaaaagaatgaagctttgatttgtgctacaacacaaagtaaccttgaaacatcatgctaagtgaaagaagcactccagcctgggtgacagagcgagacaccagctcaaaaaaaaaaaaaaaaaaaagttcttcaagaatggactcactcattagttccttccttcattgatatctgttcattcatctgtttatatggaacagtcagggttgagaaccactgttccaacaagaagctatacttgttttgttttgtgtgtgtttgtttctgcagcatctaacacagaacctgtcagataacaaaaacttgattgctatttaatgaatatgggcatggatggatgaattggcgctgtcattttccctgacatgtctccttcctgagaacagagcgtctctgtctccaagccagccgctgtcattccagtgccttaaagctccagccacactcacctgggaggatgagaagcagcagagatggggacagccacatggtcctgtctcctctcctctccttggtgatcacaggtgtctggtgcccttcagggacttgaatccaagctcggaagtcaacaccgcaaacctactcgaatctccttcaagtctcttgctcacttcctgttacatctgtagctacttctctttttacatattaggagaaaagaggtgtcattctttgaaaagactaaggtacagtgtatgttgcaaggtgtgcccaaacttttgtgcatgtggaaaagaaaatgtgtccgggactggtcaggtttgcacgggagtgcacgtaggagccaaggagcaggaggagccaggaggaacccaagcattgaggagctgcgggatctactgcctggaggagaggacggacaaggccagccatgaggagtgcagggagaggagcactttgggaagaccacagtgcacaggactcacacccagccttgctggagaaagcccatgccccaggcttcttccaggcagccccactgtaagacatctcattgcctcttcctgccctgggctgtctgacccactgccccttcccccaggaacacttccactgggatcatgagtcactctgaagccactctgaaatcactctgaagccaaagctgggctcagtggggaaggtcaggaatggagaaattgccttttctcgttagcctcctcttgccctgatttcatcctccctatccctgcacactttcccctggctgctgttgtaatctacttgttctgctgacgcccgaactgacttctttcccggtctctccccactttctttagatggtcccttccctctttctctccctttccctcctgaatcgattcattttttctctcctgttttatattttccatatctgtgggctttgttctacatttggggagctttttatattgtttatttcatgcttgtactttcccttccaatccttggatcaaatattgattttagagactgtatttttatttcgaaaagtttttttggttctttgattactgatgttttcaaactctcttctgttccttgaactatatccctccactcagtggtcacatctttgttttgttgtctgcttcttctatattatgagccttcctcaagtgtctgctgattcttggttatccaatcatagttgagaacaagataaagtgtagctaactgagacctcagagtatgtaggagtaaatagtatataaaatagctctggtggctcatgcctgtaatccagcactttgggaggccaaggcggacagaccacctgaggtcaggagttcgaaaccagcctggccaacatggagaaaccccatctctactaaaaatacaaaaattagccaggtggtggcacacgcctgtaatcccagctactcaggaggctgaggcaggagaatcgcctgaacctgggaggtggagattgcagtgagcccagattgcaccactgctctctagcctgggcaaaaaaactagttccaaaaaagacacttgtacacgcatgtttatagcagcacaatttgcgattgaaaacatagggaaccagcctaaatgcccatcaagcaatgagtggataaagacaatgcggtgtacatatacaccatggaatactattcagccacaaaaaggaacaaaataatggcattcacagcaacctggatggagttggagatcattattctaagtgaaataactcaggaatggagaaccaaatattgtacatcctcacttataagtgggagctgcgctatgaagatacaaaggcacaagaatgatacaatggattttggggacttaggggaaaggatgcaggggatgagggataaaaaaccatacattgggtacagtgtacactgctccagtgaagggtgcaccaaaatctcagaagtcactgctaaagaccttatccttgtaaccaaaagccatctgctccccaaaaactattgaaataaaataaaatataaaaagaaagagaaagaaaagaaaatagttccaatttatcatgcc

SEQ ID NO: 375 - DNA, 13876 bp, Homo sapiens
tagacacacaataaaagtttattgaatgaatgagtaaataaagggaaaaaagaaaggaagaataggggaaaaaaagggagtaagggagaagggaaaattcaaagcatggagaagccactgtttgtttctcctgcacctgctgtctgccatctgtctactctttcttaactcttctcttctggcttctgctgtcattgctctgttgatctgctcttctgaacttcattagtgaccttgtgaatgataagttcaatagcctcctctcaatcccggtcctcctccacctctctagctctgctctcctccttgaaacattcatggctcttgacttctcatcttccacctgtttgattctgctccagcaccttgatcaatgtcttcctcctaccctttgtctttaaatgcaggtgccccgagggctctgtccttggttctgaactcttccctccatgttttcacttcttgctgggttccagttaatctctctacacacattcctctccagccctcaacactctgctaacccacatctctagctatctgctagacctctctgcctgatgattccaaacacacagaaaactaagctctgcatcatccaagcctgctcttgactttcctacttctgtcaatgatgcccgattcctctggttttccaggcttaagactccggactcccagattcttcctttcagactttgctacatctgctaggcaagtcctcctaaagcacatctgcaatcccatcttgttctgctcaaatccatcccaccatagctaatcaaagtttaagtaagagttgagtcctaagcctcctgaacctgccaccacctgagttcttctagattagttccatctggcctgccacaggaaaatttcactccattggaatcttagacacatcctaccatgagcatctgtatgtgaacagtacagtccatttgctgataggtcttctataagtgactattgttatgaagattatttcccgcctctctgctttcacttatgctgtttctctgtcctctctctctccctgttgctccatccctgctccgctgaaatcctatacctccttcaacatcaacatgaatgtcaccttctttccctgacctggccagcttggcatgatattctcctcaccaaccccctgacatcaggaagcatctcttgtggctctagagttcttcctatgctgtaatgacttgggagcttatccttctcataaaatgaatcataagctcctttcttgctcatcatcatatttcccgggttaatataattaatatgggccttgttagattgaatttctctttcagcatgagtcctgggccagccccatctttcccctagtcaccatgcatgatggagctgggagccccaccagagctcaagttcagagcacggcagctctgcctaagcactcggcactcagagggtcactccatgtgctctggacactggcatcactagctcaggatgagctcaggcctgggggcagagggggagcactggtccagatgtaggtagcaagtggagatggtgatgcttgcttgtggcagactgtgggagtcctccccacaaactttagggaaacagagtaattgacaaacattcagaaaaccaactgagctcattcccgagccaggggtcaccagtagtggtgatagcactgtgcacttcaagtgtggacaagtatccttcacctctgtgccctccatcctgtctttgaaaaacgatatctgctctgcctgtggaaaaggttaattgctaacaggtggtctcagccagacttctaaagtggacagaactgactctgttgaccttgtgcattggacacctccaggtgggggaattccaggagtgatatcaggggcacccaccagctccttctccctttactgtttcaactcgccccagaactttaacctggagcagctcatccacggcccacccaggcagagatgttctgagcccagccacacactgcctggttacagggagagaaggggccttaaagccagggagacccaaggggcgtcagaagacgagaggagccctgagcatgtgggacactgggcaactgcatgagcaagctctgccgggaccaagctcccttggggttgtcccagagaagagatggagctctgtgagcctaaaggctggggctgtgaggggtgtgtcctcagggagactcctgtctgcaggaaggaggtagttattgccctgggggaaactggcctgagaagcatttgtgccaagaagaatgaagggccaggctcctccagaaaattttttccctcccttcctccgtccttttctctctctctctctctctctcgctctctctctctctctctctctgtctctctctctctctctctctctctctctctgagacagggctctctatgttgcccaggctggcctggaactcttacgttcagccgatcctcctgcctcagcctcctgagctgggattataggcactcgctatggtgcccggccaacttccagggaattcttgcccttgggaagtgggcatgagggcagggaggcaggggactggggaggagaaaggaggacccccaagctgcacattgaggactccagaggagtgtcctctaagagccaggaccctcctttgaggcacaggaacaataaatccctccagagtccacaggtctctcgcatccagtctgaaaggttgactccctgcacggggcactcctggggatggggctctgcagggcttcgggtcagcctggctctatcttccaggaggagcccactgaggcctgttcacccagaagacagcacccagcatgctcaggagcaggggcagcttcagaaggaccacgagcaggaagtgagggctgctgagccggaacctgtggtggacacggtgaaaatgagtcacttccccgggagaacccccaggacccttctctccccacctctccccatgctctgactctggagcccaaataacccaggagcagccagggaaaggacctatgccagggcagccccttctgtggcccccatccctccttctccctccatcaaggactgcccggggggtctcatcaaggagaggtgatggagtgaagacagaagagggacccacttccaggagtgcgctccacagcaccctctctgtccctgtcccactcacagcctccactttatcaactgacttcttaaaaccagtccccactctcgctttttttattttctgagacagagtctcactctgtcacccaggctggagtgcagtggtgcaatcatggctcactgcagccttgacttcctgggctcaagtgattctcccacctcagcctcctgagtagctgggactacaggcgcaccaccacacctggctaattttgtatttcgtagtagagacagggtttcaccatgttgcccaggctggtctcaatctcctggactcaagtgatccaccgcctcggcctcccaaactgttgggattgcaggcgtgagccaccacacccggccaccactctcactgttccactccagctccttgttccctcccctcagggtctagcagcaatatcacagccctttctggatatctttgggagaggagagagaactgattcaaaccccagcctggagctggcccatctccccacagaccccacagacagctcctggtggcaaaatccccagctgagcaaagacctttgaaaagggccacagaactgggaccccaagtccggagctggatggggaaggagacaggaaggagtggggaagggaggaggggctgcacgtccacctgaactcaaccttcgacctgagtcccagtagctgccccatagggaaaggcgttcacagcacaagtgatatttcccactcagcatccacatgcagcctcagagagtatgagaatcaggaccagagatggagagaaacagcagacagtgacgatctcaggtcacggtgcgccacccccaccccccagcttccaccccagggttgctccctccatggcctccaggccctgcgtgcttaccctgaattttgggtcaacacctccccggtgctgaggtttcgcccagggttcaccaccaggaagatgggaggtgtggctggatgtgtggtcctccttggggttgtaattgctgttggagatgaaaatgatgcatcagccgtgcctgggctcccagccatgcacagaacacccgtatggatgtcatacagaatcacccactcacagaagaggctggaaagatcttctgaagccagatccagggcacctcctgggtgaaacccctcagggacaaaaagagcccttaccagaaccagccatgagagtcccctccaataagtgccaggtctttctctgcatctcagagaaagactcttaccactctgcccactctgccctcatcccactctgcctggggtgagggcaggggtctctctgggcttccgcagccagatgtggagttccaggaggaggaggggaaggaggagtctaaaggaagatggctcagcctgtggcccaagaagcctcgtagagaccatgagagggggctctgagcacccttcatgtggacactcttttttttttttttttttttgagatggagtttcactcttgttgcccaggttggttggagtgcaatggcacaatctcagctcaccacaacctccacctcccgggttcaagcgattctcctgcctcagccacccaagtagctgggattacaggcatatgccaccacgtttggctaattttgtatttttagttgagatggggtttctccatgttgatcaggctggtctcgaactcctggcctcaggtgatctgccctccttggcctcccaaagtgctgggattacaggcgtgagccaccgcgcccggcccatgtggaaaggccactgtaggccacccctagggaggggataggttgacactcggctcctcctaaggacttcaggtgaccaccagactattgacatagtctactccctcattgccactggactcccagctcatgatctccctaaagcagttgtcctggaggctcagcccttcaccggtgcccgacacaggctcagtgtgatccgataagccgcgttcaacctctctgttgctggagattcgttgatggacgtggcatgagccccaccccgttggaggggcagagacacataaacagacggactcacttccgctggaagcagccctgggaaggagccccagcaggtgcaatgggagcacaggggagaagcctaatccacccccaggccagcagtgaggaaaacatgggcggcacctagcagaggcgaatgccggaccatgggatgcttttgggaagtgagagacatgatagagtgtgagtctgaggacaggagatggtgtggatagctaaggggcagggggcaggggaatttggttcaagagggatggggaggcagaaaaccacaggacaaggagccagccccaggaggatcacccttgggcaggatggggaagcctgtcctcaacccgaaagggaaaggggaagaatgagtgtagattgcatgaaagtttgcaagtggagaaggaaagaaactgatgtcctgtgtgttctcaggaaggtagatgtatgggagagtaatgttggaaactcttaacttctactggcagccacaggcaccattttctcactttttttccccagcagcgctagagcaggtggattttagacagggcgaccaactttcccaggacttttctagccttagcactgaaaatcccacatttgggaaaccccttagtcctgggcaaactgggatgattagtgacctttattttaggattgatccagggatgagggttttgtcaggtagataaggaaatggaatatgggagttatgagtgctgctaagagaagaaaatgtcaggctgggcatggtgtctcactcctatagtcccagcaccttgggaggccaaagcgggtggatgacttgaggtcaggagtttgagacctgtctgggcaacgcgggaagatgctgtctctactaaaaaatacaaaattagccaggcatggtagtgcacacctgaagtaccagctactcagggggctgaggtgggaggatcacgagcccaggaggcggaggttgcagtaagccgagatcgctccacggcactccagcctgggcaacagagtgagaccatgtctcaataaaagaaaaaagaaaatgtgatctattgcaggggctcaaagtggtctaggaaggaagtgaggtcagaacgggagtgatgggggcaataaattggcggaaatggagggatcagaagacagaaggtcactgtgaggttgagaatagggacaatggcatgaggatgggggagagctgattgatgaaaagttgtcagaaaatagaatgtctgagtttaagactctgggcagcgaccaggtcgggtgatgacaagctctgaggtgtttccatggggtgcaattctgaagagagtagaaaataaaggacaccaaggttgagaatgtcaaggaacccaaggcaagattgccaagttattcattaaagcctgccaagataatggcagaggttggagtggaggcactggcaggactccgttgaatgagggggagcagcctggaagctgatggtcggccttgtcaagcacaggtagagggtgggcatggccatctggcacagcatttaaaggaagcaggtggaaagtcatagggcggaagttgtgatgtgggcaggaagaattgggacacggctccatggccctctagcatagggggagtaagagaaagagtagcttccactcaagaagctactaaacaggaaggtcttcccaagcaagacatatttcaaaacaacatggtagggggatgttctgtgaggaggctgcaaatgtacaggagtgtttcttctttggtacaggcttcccaaagggcacggtggaaacagctttggctcagcatgaaggggcctcctccacgctggataatggggtgaggcccaggccctatgggagtgatggcgcctgagctgtgcaccccccagcccacccaaggctgaaggatcagccgcctctctccatgcccatgccataggctcctcccaacaccactgtgactgaggacaagacaagacttggacgcacacttcagtgtgccgcccacccttgttcccttgtccagtcgcaccccaaaccctgctgccaaagtgaggggagctcttacctggggaaacatacaccctaaccaggtccgagggatcgcgtgaccatgaatccaggacccacactgtctgaattttgcaccagtaagatccagcatcatcttcattgaggttctgcatggtcacagtgaaggcgagagcctccgggtggtctctgatggacacgcggccattcctctccaccttctcttctcccttggtctccacaatgctctcacatgacgtgtcgtactgtcctcggcaccagtacttgttatatcccttgtacatgctctcatactgacaccacactgtcagagagtcccccgcagtgccagtcacagagccggggcccttcagagacaaacagcctggaaaacacaagcccgagtcccaagtctccatccagatggccccatcagcagccgtctgtctgaagcttaaggggaagattgccagggagacctgggtgtttcctgggaggggaacctggaggaatacttgagcttaggacctaagccaaagagtccctgtgagagcagaaacctgtcccctgtgagagcagggacaccaagtcacagcacaggggccccagcacctggagaccaaagctggaggcaggagcagagaggagctggtcatcccacctcgtcctgggccctgcagcctctgccaggcatgagatttggtcatatacaagatcacttccctttggagtgagacccatatattctggggtcttctgaatctcaggcttattctttaaaagcacaacttgcggtttcctccactttcagagtgttcttgtgggaggaaaaatactctccggctctgatcttaaccactctccagaaagaatcaacatggcactgggaagaggggttgtccccaaaggaagccctgataagcttctttacctgaatttgggacacaagatgacccccccgacaatagtccccaggtcttgggagtcagaggtcaccatgcattcagaggaaagagggaagctgctctctgtaaccaagtgaggtgatttgggtcctgggaggaaagtggggtttagaatctgggaggcaaagtgtgagaagttgatacggaagcaaagagaagggacaagaaaggctgtaggtaggcagaagttcaggcattatgggatgtgatgctcagcagagccccccaatatcttaagcaagtgctgaaaaactgacaagaggctttgtttgaacttgagtgtatgtgcatgtgcacgtgtgtgtgggtgtgagagagagggagagaaagagaaacagtgatgaggctgagctttgcaccccctcagagtaacctgagttcacaataagaggatgaatacgcgcaggggccacggaagcttaagccgttagaatgagcagaaattgtgaaagagcccctggcatctgtgggtcctatgactatctgggctcctgagctaactacatctagatctgaggtgattgaggatggaggagcccctgacttctggctttcattcatttccctcccctcctcccaccatctgcctttcctccccactctgtctgcagctggctctgtctgtcatatgccttggcagatgtgtgagctgccaccacgcacaccttcctcaccccaccaaccatgcttggcctgagacaatctcactgtcactatctcttcccaccctcctggtcccttccacactcagtagcacctgtcacccccaccctgaccccttcccagcccctaccccaaaccctgctccaaacctgtgttttcccgctctgtgctcccttgaccacagcaaagtggctcctgaccccgcaccttctgagcactccccatttctctgctgtcctaattctcgtaagaaccttcctcgctctggatgctgtgccctcaggaatcttcccattcccaaatccctgctccccacctacgttctcccccaagaacctgttgccccgcagctgcacacccctcctgagatttgagagctggtcctcacctcctcccttccacctgcccccagcttcctcctggaggtggcacatcccagcagcacctccttctaggttctggacagagctcaggactgcatttcccacagtgggagcttggcagggtacaaagggcttgtcacagccaagagtctggtgatggagccggggcctgcttgtgctgcttcctaaagggatccttgctggagagcttggggttgttcttcttctgctaggatcagagccagtcccttcagagctgaatgtgtcctagaattcctgccactccaatcaagaagatgccagcagcagataggaagtcagactcaagagagctttccaggctccttccagcccaaaaagtctttaattcctcaattgcgtaagagctggcctggccttctgcccctggcctctggaaagaggctttctcctctggaatctgtcctccactctcctgattacaacctgggctccttcagccctgctaggaagcaaatgtttcactcctcctctcaatcacacacacacacacatacacacacacacacactggggagagcacagctgagggaggaaaccatgggaccattttgtcccttccagagcccagagccacttacttttagctccctctggactgagctgtttccttccccaggtctctattgggtaaatctccaggtttggggggtctttctggttcacaaactttacaacttttcaagccattctaagccaagcaaacatcagtccctttgaagaggcagaatctcatcctgaaaagcctaaaagtgctattgggaaccccaaacctagcaaatctggaaggtcaccctagaaaagaaagggccttctgcattcatgatggctattctctccagtaggcaaccttctcattgaaatgaaaccaattcaaattaatcttctgaaaagacagaagatggttcttaaaatgtggaaatcacagctgggcgcagtggcccacgcctgtaatcccagcactttgggaggccgaggcaggcggatcacaaggtcaagagatcgagaccttcctggccaacatggtgaaatcctgtctctactaaaaatacaaaaattggccgggtgtggtgcctcaagcctgtaatcccagcactttgggaggccgaggcgggcggatcaccagaggtcaggagttcgaaaccagcctggctagcatggtgaaaccccgtctatattaaaaatacaaaaattagccaggcatagtggcgggggcctataatcccagctgcttgggaggctgaaggtgagaatcacttggacctgggaggcggaggttgcagtgaacctagatcacgccatgcactctaggctgggcaacagagagagactccatttaaaaataataatcataatacaaaaattagccgagcatggtggtgtgcacctgtagtcccagctactcaggaggctgaggcaggagaatcacttgaacctgggaggcagaggtttcagtgagccaagatcgtgccattgcactccagcctggcaacaaagcgagactccggccaaaaaaaaaaaaggaagtcacttgtaaagacttatatttcagaggtagggcagcagtgtggataagagtactatctaaagcccagtaagcaaagccacctccaaaatggaggtaaagcaaggcaacttgcagaggggagagcctggataggtgagcttaaagaaaaagataaaggccaaggtgagcggatcactggaggtgagaccagcctggctaacatggtgaaatcttgtctctactaaaaatacaaaaattagccaggtgtggtggcatacgcctgtaaccccagctactcgggaggccgaggcacgagaattgcttgaacctgattggcggaggttgcagtgagccaagatcaccccactgcactccagcctgggtgacagagccagactccctctcgaaaaaaaaagaagaagaagaagaggaaagaaaaagatgagataaggggtgtggctgattaaatcacagaccctcagatgtagagcatggcttatggttgcttagcccaattttctacttaatgtaaaaatataacaaaagcaaattttcatgcaaagtattggcagatgacaccaaattactgttgtttgaaagaagaaccaggactggattgggaaggagtgggtagatccatgctgttgataacattctagttcatggattggccagtgagctcacagatgtttgttaagttacatataattaaaataaaagagggtcttgaatggaccagtgatgagagagtgttccatgacccatgatctaattctgggcacctgaagttaaggaaaaagaaggttatgctaattccaagatactttcctctgtcctgctagagtgttacctgaatgcaagattagcatttctcaaggaaatccagcatgttcctggaaataattgatggaattatataaatgcgtcggtgcatttgttgaaacatgtgcttgctggttgcttgaggttaatgggagctactaaatattggacagcaatcagttcagaatggaaataccagatgatgtggcagagaggtcagctattttgtcactattactaggttagccttattcttgacacctccatggccaatggaaagagctctgtggaggacacagatctggacttcatttccagcttgtctacttagttcttatgtcatcagatctcccttcatcatcttatttataaagtggagtcaatgctatttgccctgcctgggtcacaaaactgctcagagggttaaattctatcatctatttggaagtgtttataggttataaaaatgtgtaataaatagaattctagttttgctctttttaaattttttacttttctttttttgtagaaatggggtcttgctatgttgcccaggctgatctcaaactcctgggctgaagcattcctcctgctttgacctcccaaagcactgggattacaggtgtgagccacctcactcaaccaacgtttgcttattttgtatttgaatttgcttccttcctctttgtcatttcccctccctgctagaattgccctttccatctctctttcccagttaagattttcagagggacctgcgcaggtcacattgcgagtctgaggatggggaatgagataggggtggaaagagagatggaaagggcaaagaaaaaggaagcaaattcaaatacaaaatgagcaaacattggttgagtgcagtggctcatgcctgtaatcccagtgctttgggaggtcaagagaggaggattgcttgagcccacgagtttgggtccatgtcacctacctggtcttcttcctttaaatcgctgtcattttcactcacccttctagaaagaatcttgtcattacattgggcaatttctatgttttgtgagggaactcaaccataaaattcattctgcaaacatgaagaatgtcctctaatttttagcctaaatttatttccccagagacaaatgtgttttcctgcagttttgtattttgaatgtctattaataagagtttctcttctgaagtccaacctttgcaggacagtttcatttacttgtttacaccacaccttgttccgggaaggatttaaggtagatgttgaggatggcatttttttttttcagacaggatctcaactctatcacccaggccagactgctgcagtggtgcaatctcggctcactgcaacctccgcctcccaagttcaagcgatcctcctgcctcagcctccctagtagctgggactacaggcatgcatcaccacgcccagctaatttttgtatttttagtagagacagggtttcaccatgttggccaggctggtctcaaactcctgacctcaggtgatccacccaccttggcctcccaaagtgatgggattacaggcgtgagccaccacgcccagcccattaattatttctcacaaaccattccaacccctttacactaagcttcgtcaaaacagaactattgttaattcttgaactctccatggtctttaatgtcctcacacttgcacataagctattcctttcccactcagccaactcattcatcctgcaggatggacttccaatgaagcctcagtgacatctcccacccttccaagagcaaagtgaggggttcctgttgcatactctcatcaccacatgaatgagtctctacaacagtaatttccacattgtattgtagttagttgactccctcagttcagaagttactcttaattacagcacccagaacagtcctggcacatatctggtgctcagtaagtgtttgtaggatccgtggatgaatgattgaatgtatagaaggatgcacaggtgaatgaacggatgtatctttcccttttctgtggacacttcacctctggtttgaacccaggacagctcttctacctactgtcctgccccctgcaaaaccaagtccccaaagccacagccccactcacctgagaggcagagaaggagtagagctgggagcagccacatgttcctgtctccttggcttccgtcctcagcaaatctaggtcccagctggaatccaagtatatgtaacggagcctgggtcatccactttctacttgtccaagtttcctttgtgttctcactcatctatttcctctttt

SEQ ID NO: 376 - DNA, 76219 bp, Homo sapiens
agctgcgtggtgacggagatgcccgttcgctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataaggtaaacatctcctgtattcctcaacctaacgttggaagaggcgccagcaccaggagttttctccactcccctgactttgctttgggacttaatgagaaactagcttgtatctgtgagtctggggagccctttctgtctgatcctgtttcctgctcaaaacagagatgcgtgagctcttggggaagggctgccgccagaggctcagatggtcagaagcttcattcattcacttacatcatctgtgttcctttttcaccccctccttctccttgcctatttatgcccctgggtgacccctggcaccttgctctcctaacccttgtaggagactgcatttctccctgttacatctgctagcagtggccaaatacctgaatttctggccaatttgtctgaaattagataaatggtctgcagcagagatgaactgctgttttcaaatcagactccctcatggctccagaaagcttccctccagccatgattccctcacagcccctgtaagcatttgcttatttcaaagcactaacatatccattgcttccttcactcaagtttcttatgcaactcagttttcagtaatgcaggtctccccctaagatagttgttgggaaaaatagtagcctctctcaggataacagttttaattcaaaatccatcactctgaaataatcaaagtgttatatttgccataagaagttattatggctcaccttccttttctctgactttgccatgccttcctgctccagcccctatattttctgctttgataatgccagttcacctgctagtcctttgaaaagctgtacgtgatcctataggtggagttttttaatcaaaacatcactttgaagagtctatgaatgcaagctttgaaataacctaacccaacctcctcctctatcacccagcttatatttgaggaaactaaaatccagagaggaaaaatgacttgtccaagaaagcaagctggtaaatggcagagctgatactaaaagccagaaattactactacacgtgtagtattctttcctctatatccttactaaacttctcatcaaagtgtgcagtccatggaccagcagcattggcattaccttggaacttattacaatagaaagccctgaccctagattggctgaatctgaatctgcattttaacaagatctctaggaataaatatgcacaataaagttttaggtgcatggctctgtgccatgctgcctgtttctgacacaaatgaaagaaaatcagctattgaaggaagcaggtctctagatctgacagtccatgtgtcttctccctccaggtctctgaattcctaggatatagagaaggagaaaaaatgtataacaactatcccagtctagaaattttaaagccatcacagtttgaagtaaactagaagaaattctgtgctatttgatgttgtcaatttagcccagtaaaaactgcatgcaaggccaggcatggtggctcacacctgtaatctcagcactttgggaggccgaggcggtggaccgcttgaggtcaagggttcaagaccagcctggccaacatggtaaaatctgtctctactaaaaatacaaaaattcgctgggcatggtggtgtgcgcctgtgatcccagctactcaggaggctgaggcaggagaattgcttgagcctgggaggcagagactgcagtgaaccgaaatcacaccactgcactccactctagcctgggcaacaaagcaagaccttgtctcaaaaaaaaaaagaaaaaaaaagtttatgcaagcagaggaacataattacaaatcaattacaaaattttcctggcaactagatatgtgggtctctccaagtttataccatcctataaaggtataaatactcattttgaaagctttaagattgggagctcagattgttcaaaatattgatcagatgtggtattttccatttcaattacccacacacgagatgtaggatgtagtccatgaagactgttacttcctttgagtttattgatcaccaaattgagagtgggaacccattccaacaagttccaacatatttaaaggcaagtatctatttactactagtaaaggctcaatgtcatcagcttggctgtgtgagcaccctgagagcaggagccagccttaaaccttctgtggtgcccagcagagtgacatatgtatgtaaggaaagttttccttcttatatagtgctgacaacctcctcctaatactactttatgattgtgcatgatgttttattgtgatccacttaaaactctttttgtaaaggggtagggcatcaacttatttgtattatattaaaaattactatgtagtagagtccaaggagttcccattgattgattagtgtctattgtccatgagaagcagggctcccctccaacattaattgctaggataaattctttttttgaagtggggtctcagtctgtcacccaggctggaatgcagtggtgtgatctcagctcactgcaacctctgcctcccaggcaagtgattctcccacctcagcctccccagtaactggaactgcaggcatgtgccaccatgcctggctaattttttggcagttgttgttttgtagagacagagtttcaccatgttggccaggctggtcttgaactcctggcctcaagagatccacccgctcggcctcccaaagtgctggcattatatgtatgagccaccatgcccagcgtggggaaatgattttttaaatagacttgttattgacacataacaaacaccactttgggaagctgaggcgggcagatctcttgaggtcaggagttcaagaccagcctggccaacatggcgaaactttgtctctactaaaaatacaaaaatcagctaggcgtggtaacacactcctataatctcagctactagggaggctgagacaggagaatcacttgaaccgaggaggtggagactgcagtgagccaagatcacaccactgcactccagcttcagcaacagagcaagactccatctcaaaaaaacaaaaagaaatatgacaaacaccaaaaaatcctgaatcttatgtgtctaccttggtgaattatcacaaagtgaacatacctgtgcaatcactatcaagagaaagaaatagaaccttgtcagcttcccaagaggccccctcccacattccacttgccaaacaccctcccccagagattgtcattatagaggaagaagcatcatcttgtgttttgacagcacagcagatgttatgtagggtagtcctagaaacttgccagagaagagatattgtcgtatgatgaaacgaaactccaggcttggaataagccaaaccttgatgtgactttgagcaacatctgtgagtcttaattttcttagctataaaataggaatgataatacctgccttattatttttgagcaaggatgttagcgaatataatgtaacgcgtatatataaaatctctggaatataggaagcattcaataaaagtggttgtattggctgggcgcagtggctcccagcactttgggaggccaaggaggatgaatcatgaggtcaggagatcgagaccatcctggccaacatggtgaaaccccatttctactaaaaatacaaaaattagccgggggtggtggcatgcacctgcagtcccagctactcaggaggctgaggcaggagaatcgctttaacctgggaggcagaggttgcagtgaaccaagatcacaccactgcacttcagcctggtgacagagtgagactccatccgaaaaaaaaaaaaaagtggttgtattagggcatgcatcttgggctccaaagcagcttcaatgggtgtcacattcagtctcacctaaaatgatgagctttgtgagaagagcagcagcttcatacaagagaatctcagaaacacacacactacctatttcacaggcagaagtccatggaaataaactcacacaacccatctatacaaaaagcgtgacttctatgcaaacatcccagttctgacttcctaagttgagtatcttttttctcttggaggtggtgtatgggacttgatgaaattcatttatatgaaaaacatacgccaaatatcatgataggcattgtgtagctcttgcactttagctggtcccaatagttggaggctgacccaggcaagcccaagtaactcttagaagattcccgtagggtgggctggaagctgggaactgactgaaaacattgagctcatccatcatgtgcctggagtttttaaatagagttgttgttgccacaaatctgaaaatttggtgcagctaaataatttaaaacaaaggagcaacctggctgctcttttccttagagaactctcagttctctcttgccaccagcttcaagagccatccagggcaatggtctggggtaggggttcaggaacagcccacggattgggtccctactgtgccagggtctgaccttgagctcccagaaaatgaaaagattttcatttcattttcacagagagggcaagcttttgccccagataccagtgaattaggacaaaagggcttcagttcaagcacttacttcctaattccctatcaccagggctctaaggaacatccacataccagactagcttccagagggacgaacaattcctaggacaaagtcagtctcagaaagactgggggtggggggcagaaaaacgtgagctgctcatccattcatccagggcttggttcttcttgggtgaaaagggattaccaggtctctgtcttccaaagtatgtccatttcctccgactgctctaacacctcttctgggtgaaaggaaaaggcaagcaggtaatatctgccactctcccccatctcctgcacttattcttcacttccttcttctattacccatcttgtaatttctgtgtccctcaaaagtccgcatgcctcatcgattcattcagcaaacatgcattggacatttccaaagcgtaaagaactaggctggtcattgtcgagaatatagacgcaaatgattcccaccttcactaagcctgtggcctagaaggcatgcacacaaatggctatacttttatataattccagaagtgtcctaagaaagatacgggtagctgcaagggagtgacccaggaagaaaaggtcatgtctgactgaatttgaaatgtcctctctcacttatggcttctgattaaagttaacctccaggcttggcacggtggctcacacctgtaatcccagcactttgggaggctgaggcaggtggatcatgaggtcaggaattcgagaccagcttggccaacatggtgaaactcgtctctactaaaaatacaaaaattagtcagccgtggtggtgcacgcctgaaatcccagctactcaggaggcagaggcaggagaatcgcttgaacccaggaagcagaagttgcagtgagctgagatcacaccattgcactccagcctgggtgacagagtgagactctgtccccccacaaaaaaaattaaaattaaaaaataaaaaataaagttaacatccatgagagacagagttccacacatcagctagctccctccccatgggactgtcacctattaatcctagggaaaggtctggatacaacagtgttctccttccctgccagaaaattgtacaagagaaagacaaataaaacagcaaaagaccatactcgccattctgtgttcctctctcattctctatcccacaggtgcttcttttatttttttttcgatgaaacaatgataatgataatggtatgcaaatttgtcctcaaaagaatccaaattagcagaaaaatccatgccctgtaagtgaagagagttttgttttcaaagcgcactagttccaattctcaaagatttctattgtcagctcaggaacaaacaagaaagccaagaaaagctagctgctccctgtataatatttccactggcttgttttcctctcttgcttgctctgaaggcttacagataaacaaatgaagtgtatattacatcactggcaatctggtgccgtctgggactcctttggctgataggtcggtcctgcccagatcccagagcaggcagctggtgtggggagtggtggtgcctgctagttctcttaggataacctcagcaggaaatgatggtgactcagtccagcgcctcaaagtcgttttccaaactctccaggctttcctctcctaagcatcctttcctttaatttgtggtccctggggccttttgtgagaaaatgtctgagactcacttgtgttgctgccctaatgtttcctcttataagctgttctagggagggacgtccttcagtttcagggcaggaaactccgccttactgggtggaagtaaacagccagaggtgagcaccaggctggagaattgttgaagtgggcatttgaagtggctctaaatttatcccaatacccttcttgcttccttcctcctcttctcaggcaagagaaacagtctgtagagactgcgagtgcgaatggagatcacagctccttgttaactcactcaggcaatgtagttcccagctgggagtggccctggacatcctcctatctcttaaccagaggaggttttctggggccaagagagacagctccaagcaaacagatctggaaaatattaacccctaactgatgacaccaggcctcaccctgctcctaaagggagcaaggccttgagtggtgcagtgaaaataacttgagacgtgcagggctcaagaattctcccagcacatggttcctgaccttgatttctaagtcagctccctcccttctcatttgcttatcagcgccttttcatttgcttattagcaccttctcatttgcttattagcagacagtttctacccatcaacatgaggatgctatttaatcatttgtgcttttgcaaatgcacatgcttttaggtatctgaaaccaagctgtgcttaagttcaaattttctcttacttgctagccttctgcccctggccaccacacacacagacacacagacacacacacacacacacacacacatgcctgcacatgcacacatacgcacccttcctctcatgagctgtgggcagggccagtgatcatccgtttttgttctctgtctccccttagcttttgttatgagccttttaaaagcaaagcaggctgggtgcagtggcttagtcctgtaatcccagcactttgggagtccaaggcaggcagatcacctgaggtcaggagttcaagatcagcctggccagcatgaggaaactctgtctctagtaaaaatacaaaaattagctgggcgtggtggcaggcgcctgtaaccccagctacttgggaggctgaggcaggagaatcacttgaacccggaaggctgaggttgcagtgagccgagatcgcaccactgcactccagcctgggcaacaaagcaagactctgtctcaaaaaaaaaaaaaaaggcaaagtaaacatttctcctcctcttcttcctccctcgcctgtttgaattttgcattcataccctctcccagcaactctgtttattaaaaatcggaactgtcatttattagagcagtacccctaggggagagtcaggaactggtaacaccttccccaagctcacagtgagaagcagtgtaagctttggaagggaataaagtctggtacacagtccagatgaggcagacaccccctttcagcccctggagtctccctcctcgcctcccccatgcctttacccagatccttcctccttctctgggtcccacctcaggtttcatttggttatcaggtaagaaatattaaaaatcatctctgcactataatccaaagggacccagtaagactaataattgttcccaatacattatccaaataagcatatggtttatttctgcagcactttacagtttgcgaaacactttaatatatgccaagacattttatacttaacatatgctttttccagaagatgttactattaaactaattaatgtccatattaataggacagggaaacaaaggccagatggctgggcatggtgcttcatgcctgtaatcccagcactttgagaggctgagatgggcagatcatgaggtcagtagtttgagaccagcctggccaacatggtgaaaccctgtctctactaaaaacacaaaaattagctgggtgtggtggcgggcacctgtaatcccagctactcaggaggctgaggcaggagaattgcttgaacccaggaggcggaggttgcagtgagctgagattgcgacactgcactccagcctgggtgacacagcaaggctctgtctcaaaaaaaaaaaaaaaaagaaagaaagaaagaaaaaactgacttgctcaaggtcatagccagcattgtggaagcctgaatcattacagcagacccttagatagcacttgcatgccatgtaatattctaagcacttagcatctcttaactcacttaatcctacaacaaacctattttaatctcattttacagatgagtaaactgaggcatggagacattaagaaatttgcctatagtcaaatccaagcaaggtagacaggcagagggatagagtcaggagaggacaaggggcttcaccaagagggtcacagatggtcactactttagggcattgacagcagtccattgtgtggccttcagctctgtagagctggttttgctcactcactcaagagtggctccatctctccagtcaggctgatgttaatcagactcacaagacatgtattgccctagatgccaagccacattataatcaggagatttttttgttcgctaagcatgaaatccaggggaaaaaatggaacttggaggattcaaatgtttaatgctatcaggctgacatgagttggtagctggctacactataggcacagcctcaatctacgaccccactggccccttctacccttaggtcctctcccctaccccttgccccacctctgcctccctcagctgtatatatttaactgccttgggccggacagtcattctattctctccaggtctgtatttcctgcaatcctttaagaactccttgcctttgagcttgagaattccctggacttgacctggttatggggagggaaagggaagggatgttccgttcatcatcgccagagttgtcatttcatacttcttcctccatctcactcaaggcctgtgtcagagccttagggacttggatttcaggggcaagaaccatggaagagtagaaaggtgattggggacatttccttataccccaccaccacccctgttcacatgctccccttgaaatctgatatttctgcctgagaatcctgagaatcaattcagcaaatatttactgcgcaccacatgccagtccccaggaacaaaacccactcttcattccccaaggagctgcgtccagcaggctgggtggatcagagggatggcacaggcagagatggctcaggccacatctgactgcagctcagtgtgccacgtggaccttggtgcccatgaaggtcaaagacctctagtcccatatagtgggaagctgagcccttggggaccaggtcaaaagcttgcagctctcgaggctgccaacttctggctcctggctgattgacggatctgaggggttataaagcccaaagtcccaggatggggccccacctctgaaggtcagagggctctgagcccctcaacacagggatcccttcaagcccatgtccaagaaaggaagagactcctgttgcacttctgagaagtgcccagtgcaaagacccctgtccaattgtggcagagtccaacacatagaaactaagctggatcccttccatgaccatctccaaagacatgggctgaaaaacactcaaccaaacccaaaacaccaggatcccagcccttgggatgacagtgtggcacacaaagagaggcttgggaaaacagaggggcacgccacgtgagctctgcaggcatgtcctccaggaccctcactctcctttccctgaaaccaggtctcctccagacagcaggcacatgagaaccagcatagcataggccctgaccatcacctgtcctgaccaccacctgtgctgtctaccacctgtcctgttcaccactggttccatccaccacctgccccatccatcacttgttctgtccaccacctgtcttgtctactgccttccctcttcaccctcatcctgttcactacctgccctgtccaccacctgtcctgaccaccttctgccctgctcactgattttcttagagtaggaggcagctcattagcagagaaagagaactgggctttgagtaccaaagaaccaagctttatccctgtctctgctgttagccagctgtacattctaggtcattccattccaacagcactttccaacttgcagaaaacttgcatataaatcatttcggttgaattccccagcactgtgtgtaaagagaacaggcattattcttgactgcaaaaggggaaatcttgtgatcaggactctcgatttccagtgacaaaacccaactcaaattggcttaagccgaaaagagaactcattggttcctgtaccagagaagcctagggagtgcagctgacatcgagctcagctggtcccagggactctcagtgacttcggcctcactctctgtctctctctctctctcatttttctctctggcttggctccattcacaggcaggcttctccccgtggggccccattattgacagcagccccaggatcacatcctcacagctcccaattccaaacaaagtcctagacccaatactcactggagactgaaattgccacatgcccacccctgaaccaatactatagccagagggtagaacatgatggacggcttaagctcgggtcacatgtccaccccgaaggtggagtcaatcccacccaagccctgtagatcaagagtggaagaaaatgggccgggcgtggtggatcatgcttgtaatcccagcactttgggaggtcaaggcgggtggatcacccgaggtcgggagttcaagaacagcctgaccaacatggggaaaccccttctctgctaaaaatacaaaattagccggttgtggtggtgcatgcctgcaatcccagctactcaggaagctgaggcaggagaatcacttgaacccgggaggcggaggttgcggtgagccgagattgcaccattgcactccagcctgggcaataagagcgaaactccgtctcaaaaaaaaagagtggaagacaatggtttccagggaaaatgggatggtgtcatctggaggctagccatgcaaaaacaacagatgtcccatggtaatccagggcaaggctgagtcccagcattttcaaatctttaatgagaagtgcctgaaaagaaatgaagagaacttgtcacagtcccacctgaactggcctcttggtgcctcacacatagtgtcatttaagactaaataactggatttgggttattaatgactggacttgggaaacaaactgctgtcaccctatgaagcgataggcttattggggctgcagagccagacctccctctatgggtgggagtagaattttctctgaaggaaatagatgatccaactgtggaccatccagggaagaggttgattggagcagggaatgaggattcaggaagctgacggagctcagacaggaatgaggggaagctcttccgcctctcttaaggaccatggttagctgctatggagacgcctgaatttttccattgctgtgtagggcgtgtcagcccagggctacatgaacacagatgagaagtgaggcagaaaagcaccaaacaaggccaactttatgagtatgccacctacaaagtcacataacgccctgcacttagaagggccctgcatttggtttaacactttgcattcgccatctttaaagtcttaataatgtttgtacaaggacccctgtatttttattttatatagccattcttgctgccagataaaaacccctgcaaggtctgagcctggctctgtggggtagttttgagctattccctggggcacctctgccttctgatggcctcacaccacgcctggttttggatgtgcctcgagtaaccagggaagagtcatcttatgctttgggccagatggcaaaggagtgggcagcaccacagtggcattcactgtcgaggggtggttgcgtccccaggacagcatctgcgagggtcacgggcagcaggaagtgtggcctggaaggcagatcagacagtccgaaggtgggtgggtgggcaagtcctcaggggtaagtggctgtgacagaggcaggggaagaagtagacagggatcatgtttgtgatctgagcattgtgctgaaaaaacaataagttcatattggtggctattagtgaataatgagagtcattattttatttatttatttatttattgagacgagtctctctctgtcaccctggactgcagtggcatgcactctgcctcctctgcctcctcactgcaacctctgcctcccaggttcaagtgatcctcctacttcagcctcctgagcagctaggattacagatgtgtgccatgaagccctgttaatttttttttttttttttagtaaagatggtattggccaggctggtcatgaactccagacctcaagtgatccacctgcctcagtctcccaaagtgctgggattataggcgtgagccaccacacccagccaagagagccattattattaatatatttaattgcaaaatttgaaaaatgaaaaacaaagaaaaaatttcctgtgatgccagtgtttcaaaatacatatcttaaaaataaaaatggactgcgcacggtggcttacgcctataatcccagcactttcggaggccgaggtagctggatcacttgaggtcaggagtttgagaacagcctgaccaacatgacgaaaccctgtctctactaaaaatacaaaaaagttagtcgcgcatggtggcgggtccctgtaaccccaactactcaggaggctgaggcaggagaatcacttgaacctgggaggcagaggttgcagtgagccaagattgtgccactgcactcgagcctgggtgacagagcaaggttctgccttagaaaaaaagaagatgaaattgccatgtaaaaatacatgcatgtgtttatttatacatatgtgtgagatagatagatagatagatagatagatagatagatagatagatagatccatcataggaattttgttatacacatttttaccttcattctttttaatcactacatagaattccattgtatagataagtgaaaattcatggtttattctgaaattttgaaactcatagaaaggtacaaaaactagaagaacaaaaagaaaatgacacatgtacctaccatctatatttactaaatgctaacattttgccttaaaaaaaaaaaaaaagaaggctcctataggtagctgggatccactttgcaagatagccatgggatagaaggttaattgggttactttgtttttgttttgatatggagtcttgctctgtcacccaggctagagtgcagtggcgcgatctcggctcactgcaacctctgccttctgggttcaagcgattctcccacctcagcctcccaagtagctgggattacaagtgtgcaccatcacacccagctaattttttgtgtgtttttagtagagacagggtttcaccatgttgaccaggctggtctcgatctcatgacctcaagtgatctgcctgccttggcctcccaaagttctgagattacaggcgtgaaccactgctccaagccctagtttggttactttgaaatcacagcctgatgggtctgcggcacttttagttacactccatttcgtagaagagaaaagagatctgagagacattcagtggttgttcaagggcactcagcagggaataaaagagaaaccccaatccaagcttcaactccagaccctaactcttctccttatccctccctagattcccaaggtccttaggaaagggaaggcttggactggaagctcccccaaacccctttatcactgacctccagaaatgctagtgaagcccaggtgacaatctcagcctggcccaggataaacaccaaagcaaaatcaatgccagtgggagatattcattcacaaagtggattcaagaccctgcgtgcagagctgctcagatgaagcaggcccaaatgcagttagtcaccgttaattgggtctcaggagtggaggagcaaacaacagcatcccctggggatttgcctccatcaacccaagtgcagggtaagaagcccaggaaagcaagccaagctttgcaagcaccagcactgcccctgggcagactctccttcactctatctccacgttctctcccatttgccctcatatcttgttatattttttttttcttgagatagagtctcactctgtcacccaggctggagtgcagtagtgccatttcggcttaccgtaacctctgcttccaggttcaagcaattctcctacctcagcatcccaggtagctggggttacaggcacacgccaccatgcctggctaattttttgtatttttagtacagacggggtttcaccatgttggccaggctggtgtcaaactcctgagctcaggcaacccacacgcctcagcctccaaaagtgctgggattacagacgtgagccaccaagcccggcctattattattatttttgagatggagtctcgctctgttgcccaggctggagtacagtggcaccatctcagctcactgcaacctctacctcctgggttcgagtgattctcctgcctcagcctcccgagtagctgggattacaggcgtacaccactacacctagctagtttttgtattttttttagtagatacgaggttttgccatgttagccaggctggtctctaactcctgacctcaaatgatccacccatctagccctcccaaagtgctgggattacaggcatgagccatacaaccagcctcttctagtattttaagctgacttactgtacctacatctccactggttctttcccttgccacctgccagacagctggatgttacagtgcaaggatgcaaggtctctgggtcgcagtccttctttgcttattattaattttgcagaggctgtgtgaagtttgaaataagtgcaccgtctgaatttcacaactctttccactgaactgagggaaggcaccgggcagtatagctgagatcagggcctgtgacctgttgcttctttgtcgtggaaaccctctgcgtcattgatagagggcagcattctgcatgtaaatgccaacaagtgccagtgctctgctctgctcatagcagatttctactacacaagggtgcagaatgtccctcctgtatttctgaccttgggggacagtctttcccctcccttaattctgagcccctcctcagaggtaccttcagaaaaacaaatgagtcagtcaccttttctttttatttattcagtttattttatttatttattttatttttatttatttatttatttatttatttgagatggagtcttgctctatctcccaggctggagtgcaatggcacgatcttggctcactgcaacctccatctcccaggttcaagcaattctcctttctcggcctcccaagtagctgggattacaggggcccgccaccacacccagctaatttttgtatttttaatagagatggggtttcaccatgttggccaagctggtctcaaactcctgacctcaggtgatccacctgcctcggcctcccaaagtgctgggattacaggcgtgagccaccacacccagccaagtcaccctttcttgatgcaagagttgcagaccctcaggacagagccatgtgaggatatggtcacagtggactactttggggaaggggcttgtgctggggcagggggaatctgattgcttcaagggtccctttcacaactactggagagctccacagctctcattagtgacaaccttcatcagcctccaaacaaagagggtcactagaggccctcaggggaagcctcactacaccagcggagatgtgatggagcgggtccatgcctggagaacagtgtgaaccggatccatggctgccaattctcagtccatacctaagtaccagcccctgacaagtaccaactgatgtgtaggaaacgatacacacacatcagtagatgttggcataaagttaccaactgtcctttcttaggaaatactgtctattatcctgagacttggggtgctcaaagctcctttcttttatgaaattatggtgacaatggattgttgaatagaaactttgttaagcaacccctcacttaaccaacttattaggtcaaccaatacccttcagtctcttactggagcacactgactaagcctgaggcacagagtgctcacagctggcaggctcttctctgctctcacagttgtggtacctggttaacaagaatgcatttgggcccatacttgcttatgctggtcatacgtgttaactagaatgatgtacttgaatcaattcacctgtaaacaaaggaattggccgggcgtggtggctcacgtctgtaatcccagcactttgggaggccaaggcagggggattacctgaggtcaggagttcgagaccagcctggccaacatggtgaaaccctgtctctactaaaaaatacaaaaaaattagccaggcatggtggcaggtgcctgtaatcccagctacttgggaggctgaggcaggagaattgcttgaacctgggaggctgaggttgcagtgagctgagatcacgccacggcactccagcctgggtgacagagaaagactgcacctcaaaaaaaaaaaaaagaaaagaaaagaaaaagaaaatacaaaggaatttaaacagaaagactattgaccaataaaataagagtgtaaaaaaaaagagaacggttatctctacaaaaactaaactgctttggaaagacactataaaagcctgtcactttttaaaatgctatcaaattaggaatgaatgagagaactgtaaaatatcggaaagaaatgcataaaaatgaagaaagattttgcaatcaggtggcttcataagtttctagaatttcttgcttcatgttaaagaaactggaactgaaaccccaggatcatgtgtgtgtggtttgtgcttcaggaaaggcaatgggccccacttttcagcagacttgtaagcaaagcaaaggctttaggtctacatcaaaatacttgctaataactacacatttagatattttaagtcaaaataaaacatgtagaggaaaaatagccttggcgcagtggctcaaacccgtaatctcagcactttggaaggctgaggcagatggattacttgaagtcagttcaagaccagcctggccaacatggtgaaaccctgtctctactaaaaatacaaaattaaccaggtgtgggcgagtgtggtagctgacacctgtaatcccagcactttgggaggtcgaggtgggcagatcacctgaggtcagaagttcaagaccagcctgaccaacatggtgaagccccgtttctactaaaaatacaaaaattagccaggcatggtggcacatgcctgtaatcccagctacttgggaggccgaggcaagagaatcgcttgaagtcgggaggcagaggttgtggtgagccaagattgcgccactgcactccagcccgggtgacagagcaagactctgtctggaaaaaaaaagaaaaaagaaagaaagaaaagaaaaaatacagtatatctcttttatgagttccgggtttaacaaactttttcaatgaactgaccaattaccaattcctgtgaaattgaataagaatttacctacttggttcagacatatttgactttggcaaagaaaactgaaaagctaaaaaaaatgtgcctacttggtagaataaaaggctgatcactgtatctgtccttgccaatctaaaaaatttattggtacatgaaatcaaccgattccagcagtctcccctttccaaggctaagcagctttgagctctatttttcaagatgtcaagcaaaggtagcctttcacctcacttgagtgcaaatttatcttactcatggattttggaggttgccaactcagtagtttttttttctccctcaactactctcaaacagtactatcttctgaaagccaatgatatgcacatagttctcaaaaggaggctgtccaaagcttacaggcttatcaagtggaatcttttttgacatgaggcctcactctgtccctgaggctggtgtgcagtggtaccatctcggctcactgcagcctcaacttcctacgttcaagcgatcctaccccctcagcctctggagtagctgggtctacagtcgtgcacaaccacacccagctgattttttatttttggtggagatatcctttttgtaggcctccctatgttgctcaggctggtctcaaactcctgggctcaatcgatcacccaccttggcttcccaaagtgctgagattagaggcatgaaccacgatgcctggcctggaatctttaaatattaataattcaaaaaccaagaagggaagccccagcaactttagatggctataaataattaggcactcaatcaggattgagtgcttagaaatcttggagtttgttttaacacaatgtgctttcctggaaatcatataacaagatagtaaatgctaccctcactcagacctgaggaaccatatttaagatggttcctcttgcaataaacgtgctggccagccacccaaattctgccttagcaaagtcatgatggggtgcggggatacggctgagatgacacccagatacaaatctatagacattatgaaacaatttcctttcctgcctcttgcgtatatctgcctccctcctctcgccccagctacttctctagcactctaaactctagctcaggcttgagcaaaccgggctggattagcagctgactcctacagtcatagcactgcacagagagaacccagacacttcctatcaggaccacaaggcagagatctgctctgtccagctctggaattgactggactggctcatgactgtcaacctatttctgagaacataaaaaggtccctttcagactgccaccaattcagagggctagaattttagataaaaacagtatatccagtaatctgttctctcttgtagacacttcctcgtttttttgagacagggtctcgttctgtcaccgaagctggagtgcagtggcatgatcacagctcactgctgcctagaactccagggctcaactgatcctcctgcctcagcctcccaagtagctgggaccacagacgcctggctaatttttttaatttttttgtagagatagcaatcctcaagcaatcctcctacctcagcctctggagtagctgggactgcaggcgtgcgccaccacacccagctaattaattaattattgtaggtctccctgtgttgcccaggctgctctcgaactcctgggctcaatcaatcacctgccttggcctcccaaagtgctgggattagagttgtaagccaccatgcctagcccagaatcgttaagaattaataattcaaaaaccaagggagggaaaccccagtaaccttagatgggtttatcacgttgcccaggcttgtctcaaacacctggactcaagtgatcctcctggctaagccttccaaagcactgggattacaaacgtgagccaccatgcccggcctgtagacaccttttttcaaagtttgactaaggcaaccaaaagggatcagaatggatcggtcttcccatgctgtttcactgctcttcagcagcccatgtccaccatccagatgaaggtagaagcagcccaattcctccagccaagccaaattgagctaaattctagtcttccctgtgcgtctagcttaatgtcagaagtttcatggcaataatcttcactgggatctatgattttatattaccagaaaagatgaatccgtttctatccaacataagcatatacttatacattctgggtagtgctggctgcttgaaataaactctgaaataaatccactttatgcacaatagttgaaatggcacagttacgctctgatctaaggccttatgttatgccatttttttttttttttttgagacggagtcttgctctgtcacccaggctggagtgcagtggcgcgatctcagctcactgcaagctccgccttctgggttcatgccattctcctacctcggcctcccaagtagctaggactacaggcacccgccaccacacccagttaatttttttgtatttttagtagagacggggtttcaccatgttagccaggatggtctcgatctcctgaccttgtgatccgcccacctcggcctcccaaagtgctgggattacaggcatgagccaccgcacccggccatgttatgacttttattcttataccttgactcattctaatttggctctgctttgaacttttccattttaagatctctctgtgggcgcttcttgctctgtaaatttaaaacagtctgtgtcaaaaacagtctcactctgacctgaccagcttagatgactagctcaagaatagtcaagcttgcttgggctccatgaagtcccccagagcggaaaagcccttgaaattctagggaatgatctttgaggtcatgggagcaggatctctccaccaaggtcaccaatgccagatgcccttggggtgtccatagctgtgagaagtcaggcaaaccccaggacacattgatatggactgctaaacatgcctacagcctcctacctgctgggtcaccggcctgtggtgctcagggatagctcgtcatctcttcccaagccatgatgcctttccctgacactttatccccagcccctccctacaatccccccatccaacaaaaatcaacctagatgaagtgatagacctttgtcctccagccagaggacatcgtagcccctcatctctcctcaattttcaggagaggaaaaaggagtctgtccacgtcatgcttctgggcagtcaatcctgaaattccttaggttgtttggcccaggactgccctgccagaatagtgaacaccgctgcctgtgctctgagagatgccttctactccaaatacactgcttattcattgagtcaaccaataaacatttgagaacccatcatgtgccagacagtaactaggcacgggggatatgggagtgaatgagacaaagtccccacttaaggcaccacacagcctagtggagatggggaaaatgacaaacacagaccccactacataagtcatttcaccaaaggaaataaagcggagcaacaagacagagagaaattggaggtgggctgcaggggccactgccccctaagtggccaaggaaggcctcttctaagaggtaacatttaagctgaaatgtgatgataaaaaggagctaactattcaccagtctgcgggaagagcattctggaaaggaggaatagcaaatgccaaggccctaagaagggagcaagccttatcttgttagaaggacagaagaaaagctggtgtgcatggagcagagcctttgagagggagggtggatggagttgggggtgaaggggcagccagcagcccatggatcccctgagaacttgcaggctgggagagaaaccatcagaaggctataagcagggagtaatcaggtctgtgcttggaaaagatcactctggttgctgggacgagaatggactccatggcagagaatgaaagaggaagaccaggcagggaatggttgcttggactagcaatcattgtgggcttggtaaccacagagatgatgagacgtggtggggttcagggtactttctggaaggaaggctgtcagattgctaaaataaagataataactctgtctgggtgtggtggctcacacctataatcccagcactttgggaggtcgagataggcagatcacttgaggccaggagttcgagaccagcctggccaacaaggtaaaatcccatctctactaaaaacatgaaaattagccaggcatggtggcaggcacctgtagtttcagctacttgggagactgaggcaagagaattgcttgaacccgggaatcagaggttgcagtgagccgagatctcaccactgcactccagcctggggaacagagtgagactctttctcaaaaaaaaaaaagatagtccagcatctgtaaatgagcatgatccctgtgtgagcagcagtgtatgtgtatacacacacacacacatgcagacacatgcacatacacactatcctccttatacaaacagtgcagactccaggctctggagtcaaatgtgttcaaattccaactcatctgcttacttgccattaaacttggttcaagtcactgaacctctccatccctagggttctctgtctgtaaaaaggggacagtaatagaagtgcctcatggttgtcatgaggattaaattagttactacatgggaagcatctaaggaagggcaactgccacataccgtatgagtttcctgttgctgctgtaacaaattagcaccaatttcgtggctcattaaaaacaacacaaatttattctcctgcaattctggaggccaggagctcaagatcagtttcaatgggctcaagtcaaggcgtgggcagggctggtttcttttggaggctccaggcaggggaatccattcctttccctttctggcatctgaaggctgcggcattcatggcccctgctcacgtcacacccacgtccacttccatcatcactttgtctctacctctttgaccttctggcctctttcttatgaggacccttgtggtgatattttgggcccacctgaatcagcaagaataacctctctatctcaaagtccttaacttacatacatctgcactgtccctttctgccacagaaggtaacagtcacaggttctgaggattaggacacagatatctttgggggccattattcagcccataacatgtggtaggcaataaataaaggttcattgtattacgataatggtacttcatgataataatgataacatttttctcattatcatcttcatcattcccatgaaagccccagagcatatccctagccccctcctcaactatgtaggagaggaggggacgtttagaaaaccccaactcctagaagccccctgagacttggccccaagcccaacccagagctaggggcaatgctggctgatcaggcagaggcaccagtccccgggttggtcctgatgaggggagcagggggcagacggtcgatgaggcaggagtgtgctcacagcctggggtccaagaaggagcctggagtgcaggctaaggcctgctgatggtgctgtattccgtgggctcctcagggcccctgccggggaggtggctactgaggtggcccatgttgcagtaggtcggttcctgatcctcagcacccaaggtcagagatgcataggaaatgtcctccttcggcaaggaagcctgcagcaaaggcgggctccaggtcagagaggacggcaggaagtgacggtcacggggcagaggagccctcggaggaggatagtggggatggaccattcagggcttctaatcccactcaagccctccagcttcccccttcactctgccaagcaccctgagcttcaaccacaacagaacagattctcccccaaccctgcaccagtgcagcacatttcctgtggaatcccaagtcactcagcctgtctgggactctgctgcccacgtggggactgtgtttgccagtccctgtgtccccaggactgagacttgcctgtgggagctcctaggcgagtcctgcagtgactatggctttgccccacacctgcctcctctatgcccacatgagcaggagaaagcccaccctccaacggggtgcaacggcaggcctgtgtccccctgccccagcctcacagcagcccccatggaggacgcaccatggtgacatattccacttccacctggtcaacctgggcagaggaaagcttcgtggtagccttttgcggggaggttccggccagctgcagggtcaggtctgcatagcagaggtcgccctccaggggctgcagtacctgggacagggaacacaggctggggagtcacaagatctgtctgtggacacaggttccttttccacggtgggacgggacgagagcctctccacttccccaggtgcccctctcccatttccctccgtgtcctccacttctcaggctcctgtacccctcagcccttgtccccctggctgtttccaggccctcagcccccaggccctgcagggtgccatgaggacaggatactttggcacaggacttctctgatattttggaccttctgagagatggaaaatgaggaaggggaaagaagctgcctggtctctctggtccgaccttgggggctatcttacctgctctggggacatcccggctgctaaaagacaaacaacaattcagaattagaaagcccattccccagactcacaagaacccccaggtctagggaagagaaatatggaagaaaagaggtgaattgggtccaggctcagagacagggacctggttctaattctgattcctcagatgacacagtctgtgacattcgtcatgtcacctctctgacctttcacttctccaccaggaaaagagggacaccccagccccctgctccccacatcatagaactgtgcactcagctgatcgggtggccctgccagccatcggctcccctgggagtaagtttgcttctgcagaatcccaactcggcctggaattccaccatgtctctctacctgattcatccttcaggggtcaattcaaagtcatgcctgccttctgcagctacccaggctgtctaatccccctcccgggcccccggggggcacttgctctatgtctgtctcatcatcttcgtcctactgaattctagttagtcctcaggtgggctgtaagctgcagggtggctgggcctgtcccttccttacaacctgggtgcttggctgtgctgagcaggtggtgctccatcagtaaaagttgtctgcagagacaggaatgcaccaagctgtcccccaaccccgagtagaatgtgcaagctgggtcggcacagtagggaccgattttgtttggtttggtttggtttggtttggtttggtttggtttggtttggtttggttttgagatggagtttctctcttgtcacccatgccggagggcaatggcaccatcttggctcactgcaacctccacctcctgggttcaagcgattctcctgccttagcctcctgagtagctggaactacagatgtgtgccaccatatccagctaatttttttgcatttttagtagagaaggggtttcaccatgttggccaggctggtctcgaactcctgacctcaagtgatccacccgcctcaacctccctaagtgcggagattataggcatgagccacgacacccagagattggattggattgtttttccactgggaccgattttcaggtggttgctggtccctgtcttctttctcccctccccagccaccagccccacatccctgccctagggacaacaaagaaatggggggttttcccctggtttcaaaagtctagatgctggagaacacagaaagcacttagaccttaggccgtgggcaatacatttgggagaaaaagcgatgaataaaagtcaggctctaattttgaaaaagcatcacagaaaacaaactaacagagagtcaggctcccctcttcccaggcgaaagatttcccaggctgtggggagggagaagtgttggagggaaccctgtgagagttaggacccagctgttctagaagagaaagaggtacaattgtgtgagaatgtggaagtgaagccacattctcacacaactggggttttgttgaggccaggcctcatgatctgtgagtgtagactcctgcgccaagaggctcctccctgaagagctagttcacaaagggcaagtaggtcagcctgggaaagtccagtgggcaagggagggacagaaggaaaggccattccaatttcctgatcagacttggagggctgtgtgtgtgtgtgcatgcttgtgtaatgtgatgagtgcacatgcactgtgggatccatgcagtgtgtgtgcccatgatcgcgcatgtgtgtgtgcatccactggtgtgtttgtgtctgtttctccctccccattccatgtcagctcagtacctccttgacaaccacatagacccaactctagcgtctagtctagacaccccagactggaccacccacctaagaccattgccacctatgccatcaagagtcaatccaggaaagagacagggaggtggatcagagagaagagaaggggaaggacggaggtgcagggcaggcggcgaatgccaaaacctcctggggctcccctgcaagctccagggcgccccccggtcccctggcactgccagctgctgagggcctttgggactgtgccatttcctgattgtgtgggtaatcccttggaccagatagctcccagatgccacatccccagccacccggcccagtctcagcccagcctcacccaggtcctctcacctttctgctggtacttcatcatcctccaagccaagagtgaggcggccaccaaaagcagcagcaatatggtgaagatgaggggcaggaggacactgagcttcaggagcttgtgcctagaaacaatggcaagcgtcccctgcatcccaggctcaccacctgcctctcagcccaatcccacccacccagcagcaggggagggccacacacctgatgagctgcaggtctgtagtttgcagcctgggaaccctcactcctggggatcctcaaagatgggtttacaatgagtacacatagacacaaagaagggaatggaacaagagacaccagggcctacttgaggatggagggtgggaggaagcaaagaatcaaaaaactacaaactacctattgggtactatacctattacctgggtgacaaaataatctgtacacaaaaccccggtgacgtgcaatttaccgatataacaaatctgtacgtgtacccctgaagctaaaataaaagtttttaaaatttaagaattttaacaaaagatagttgtttttggttttctttgtttttcatttttttgacacagagtcttgctctgtcacccaggctggagtacagtggcatgatctcggctcactgcaacctccacctcccaggttcaagagattcttctgcctcagcctcccaagtagcggggattacaggcacccaccaccacacctagctaatttttgtatttttagtagagacaggattttgccatgtaagccaggctggtctcgaactcctaacctcatgatccgcccacctcagcctcccaaagtgctgggattacaggcgtgagccacagcgcccggccttaacaaaagatagtttttaaaaggagaaaagggttccatgaggtggttttaatgtgtctagaagcctaacagaaattgtagggcagcagactcctaaaacacctcctgcctctacacctgccctctctactgggttgaatagcgtcctcttcccctcgaattcacatccactcagacccgtgaatgtgacctatttgtggatgtaatcaagttaagatgaggtcatagttgattagcatgggccctgatccagcgactggtgtccttacaagagggaaatttggacacataaacacacacaggaagaagaccatgagacgacagagacagggatcagagtgatgccgccacaagaccgggaacacaaaggatcgcaggcgcccaccagcagctggaacagaggcatgagacagactctccctttgagcccccagggtggcaacagccctggtgacaccttgatttccaattcctggcctccttagctgtgagagaacgtatttcttttgctttgagccactcgtaacggcggccacaggacactgacaggccctactgtagtggatcattgccacagcagccggggggcctgtgaaccaaacgtcaaagcacacccctctctttctcaaaattctgcaacaggccaggcacagtggctcatacctgtaatcccagcaacttgggaggctgaagtaggcaggtcacttgaggtcaggagttcaagaccagcctgaccaacatggtgaaactccgtctctaccaaaaaatacaaaaattagctgggtggggtggcgtgtgtctgtaatcccagctacttgggaagctgaggtgggagaattgcttgaacccaggaggcggaggttgcagtgagctgagatcgcgccactgcactccagcctggtcgacagagcaagaccctgtctcaataaataaataaataaataaataaataaacaaacaaacaaacaatcaaaataaaataaataaataaataaatcccgtaacagccccatttcagcccatgaaaatggccagggctgacaatggcctccactcctgcctacgactcacccctgcctgcttcactccagcctcacttcctgctgctcctcaaatattccaggcacatccccacattacggaccttattccagttgcatttttctccaggaacatgctccctccagagctctgtgtggctcactttctcacctcttccagtctttgctcaagaatcactcgactgagcgcggtggcttacacctgtaatcccagcactttgggaggccgaggcaggctgatcacatgaggtcgggagttcgagaccagcctggccaacatggcaaaaccccatctctactaaaaatacaaaataacagccgggtgtggtggtgcattcctgtaatcctggctactcccagctgcttgggaggctgaggcaggagaatcgcttgaacctgggaggcgtaggttgcagtgagccgagatcctgccactgcactccagcatgggtgacagagcaacactccgtctcaaaacaaacaaacaacaaaaaaaactgttgtgggctgggctggattgtacaccaccacccccccaccccaatccatatgttgaagtcccaccctttagtatctcagaatgtgattgtatttgaagataggatctttaaagaggtgattgaggttaagtgaggtcactggggcaggccctaatccattatgactggtgtcattagaagagatcaggacacagacacacgcagagggacgaccacgtgaacacataggaaaaagatagccatctacaagctgagaagactcagaagaaaccaaccttgtggaccacttgatctcagacttttagcctccagaattgtgagaaaataaatttttgtgatttaagcccccattctgaggtattttgttaggggcaacccaagcaaactaatataaggattatctccttcatcactggatgtgcagaaatttgagaaagaaattcatcagtcaattaattgtgtcaaccctatttggttacactaattagctctagattgtaagtacctcgagggcaggcattttgattatttggtccattcttgtaccctttttaattcccttaaacagtgacaggctagagtgagtgctcaagagttatgtgttaaataaatgagtgaacaaaccatctcatgctaatcaaaggccctaatcgggcacttacataaggcttcgattcataaaataataaataaataaataaccttaactattacttattcaaagcagtttggtagaaaataaactttcaaatcagagggtatcctgtattgatttgcttaggaaaaagaaaaatagggacaaagcaaggtggcttatgcttttaatctcagcactttgggaggctgaggtgggcaaatcacttgaggacaggagttggagaccagcttggccaacataacaaaaccccatcgctactaaaaattggccgggcatggtggcttacgcctgtagttgcagctactcgagaagctgaggtatgagaatcacatgaacctgggaggtggaagttgcagtgagctgagattatactactgcactccaacctgggcaacagagtgagaatccgtcaaaaaaaaaaaaaaaaaaacaattagctgggtgtggtggtgggcgactatagttcccccagctactcaggagactgaggcatgagaattgcttgaacatgagaggcagaggttgcagtgagccaagatggcaccatgcactcaagtctgagctacagagcaagactgtctaaaaataaaaaaaaagaaaactttaaaaagtttaatttaaaaaaaaaacagaaggcaaatgggagagggggagtagaagggtctcaggtggttagaataccggggacctcccatagggattttgtggcaaggtcccagcaaaaggagaacttggcacttggcagatctaaaaacaaagtcaagagggccaaggagagtgaaaggaagaaattaaaggggacgttcctcttctagaaagcccagctgactgcagatggttgggcagggcactaagaggcatgacctgagctatggtgtagagcccagagacttccatccaagctccagcaccacccttcactgaggaagggactgaggctcagtttcttcttctgtaaaatgggaacatttgtatctgcccattcttccacatggggtggttgtaggaaaggtcaaagaaaacaaaataatgcacaggaaagccttttgtgagctgtcagttgctctagagatgtgagaaactataggcatcactgttcttgccataatagtaatcagaggaaaattaagggaaacaggacttccccaagccctcctttccttgtcctcccagaagttgaaccaagagtcatccctgcggctccatgaccccacgcccacactcacatgagacacactgtcctcactgactgccaactcatcggtctcccacactgagctccacggggacagtccatgtctgtgtccccagagctcagcacggtgcagccatgtagaagttattataacacagtaaaagtggggcgaacgaatgaatgaacctacaaacagcactgagctgcagaatgaaggatctgtggagactgaaaggacaccatgtggcctgacagcaagtgggaagggctcccagcttcctcatcctcaccaaggagcatgcaggtcccagacaaagctcaggctggaaaatgggacttcaaagagttctccattggaggagtttgggccaagtaggccacagtggaaccagagctggcttacctgttgtccaagtggtggccggtcagagttggggagctgctagtttcttcttgggtgactggtgctgtaaacgtagtggaggtaggcgtggtgggggcaggagtcgacgctgtagttgatgcttggtgtataaaccagatcacagatgcccctgcccatgagcccacccgcagccctgcacacagctctgagcctgggcgggggtctggactgctactatgggaaggggctgcagcctggaccactcatgtctccctggtctctaggagactccagagcctcataggcaggtggggctgggcagggtccagggaggacgctgagctggccctgggagggttagagggggctgggaagagcctaagggcagctggagaccagctgaacttgagcaacctgctgcttatgacagtgccttggtcaatctccacccccagccctatttatccagcaaaaacaggagcagagtgggaacttgcacagtgaccctagatctgtgacatcaaaggtcaggaccagccctgaatgaaatcatcatattcaggaagaactttgactttgggcaagttacaaaacttcaatgatggggatgcccccttctcaggggtattgtgaggacccattgagacaatgcacgttcagcactttgcaaactagaatatgccccagaggctccgggtgcaacctggggccccaaggactgtggtgctccttccatgccacaagggccctcgagccatcctgcttatcttctgagggacagcagaacaagcccaacaaataaacccatgcaaaccgaggcactgggacccctgagctaacgctcccaggagtgtctgcattctagaaggacataggaagaaatatcattaagtccacacacacaaatggctcatggtgggatgtcagggaccaggaatgcagccgtttgactgtgaagacctttctggacttgggaattagaccccagcaccccgactatgctgagcctctttttcccccaggttagatatggaatgggagatgggaacagcagctatgaagccccagcccagaactccaccaaaagcaggacacacctgggcaccagaggtctccaaaaagcaatggcaaggactggggtctctgggtaccatgggaaggcatccctttggcccatgggctgaaactgggaccatcaccttgtcctcaggcactgagctgtgcagaggtaaaaaatgtgcctagaaaggcttaatcccgtcgtggagggagccctgggagccatgggggcattgaagagaggccctgctcccccagtcccaggtggtcagtcagggttctatgagactcgggactcaagtgatagatcactcagtgacaattaaatcacttgagtaggacctcagagaccaggacagagcaggccctgagagacacacacatatatacactccctcttacctgggtcaatggtcacttgaactgtgaccccaaggtcatttccagttttctcaattccacaccagtaagtgtcagcatcagttttcatgagatcctccatggtcacagtgaacgtgcggtttttctgattgtccttgatggacacccggtccctcttcacctcctgctctgacccactggttttaacaaggatcttgcagtcacgccaaatagctcctcgacaccaccacttcaagtaggtctcccagcctgatctgtaaacacactgcacggtcaaggagccccgctccaagccattcactgttgttggaccggtgatttgagtgacaatggagtagcctggaaaacacaaattcatgtgctgtcacctcccaccccaagggcagggccacagctttctgtttagggaatagctcccaaatccaagtttcacaggttaaataacagtcaaggaagaaatacaccttccgcagacaaaacttttgtccttcagctttccactgggtcaaagccaccaggaaaatcactgaagagcacaacaacggatccccccaaaaataaaaatattggcataagcaataataacttcctgcagttcacccctctctccaccctacggccaaggtaatctgtatatttcaaggaatgtccttttgcagccatctttgtgttagtccagtgtggtggggaggaaataccaggagacccctttccacagggtcttaccttgactcttagcactgatgaccctcatgaggtcgagctgaggcagccacatcagatggctgtggagaggctgtcctggtggtcctaatgatttctagtggttctggaataaaccaccctggatgaatgcctttgaagttgatcaaaacagcaacggcaactggtctccatgtgctataggatccatacaacacagatcccactttctttaatgaattgctttgacccctttgtcaaattgcaaatttgtggatttcccattctgttccattgatctatttgtccacctttctgccaatcctacattctcctgattactatcaccttgtagaaaagcaggtattatagacagtaaggcagtatttacttttttttttctttttctctttttttcttttgaaacaggctctcactctgtcgcccaggctggaacacagtggcacaatcatggctcaatcatggctcactgaagccttcacctcccaggcttaattgatcctcccacttcagcctcccaagtagctgggactacaggcacatgcctccacgcctggctaatttttgtagttttagtagaaacaggattttgccatgttgtccaagctggtctcaaactcccgggctcaagcgatccacccacctcagcctcacaaagtgttgggattacaggcgggccccacaacgcctggcctgtattttcttaaaatacatgttttccttcaaaatcatgtcctttgcagcaacatggatgtggctggaggccattatcctaagtgaattaacgcagaaacagaaaaccaaataccgcatgttctcacttataagtgggagctaaacattggttatgcatggacataaagatgggaacaacaggcagaggagggaaaggggcaagaacaaaacagaggagggaagggagcaagcactgaaaaaactaccaattgggtaccatgttcactatctgggtgacaggtttgattgaggctcaaacctcagcatcatgcaatatatccatgtaacaaacctgcacaggtacccactgactctaaaaataaaaaacattttaaaggaaaaaaaaaatatatatatatatatatcccaaagtgctgcgattataggtgtgagcaactgtgcctggccttttttttttttttaagtaaagaaatatttccctgtatccggaatctttcaaaggtgagaatatgagagaaagaataaaaagaacatatatatataaattcccaacatgaggttgggagttcgagatcagcctgaccaacatggagaaacgccatctctactaaacatagaaaaattagcctggcatgatggcacatgcctgtaatcccagctactcgggaggctgaggcaagagaatcgcttgaacccgggaggcagaggttgcaatgagccaagatggcgccatagcactccagcctgggcaacaagagcaaaactccatctcaaaaacaaaacaaaacaaaacaaaaaccagcagttcaagcacaacaaccaacggcgcggacagagggcctcagtgtcagagagaccctgggaaggggtgaggaccacggcagcctggattggagagcagggtatccatgcgaaggcacagccctccttccactccagcccgggtcctggggaaagaagcgggccctgtgacaagaacacacaatggggaaaggacagtctcttcaataaacagtgctgggaaaactcgacatccacgtccagaagaatgaagccggacctttatctcacaacatatacaaaaatcaactcacaatagagaagatgtaaatgtaagacctgaaacttaaatctctcagaagaaaacctaatggaaaagctccacaacattggtcttggcgatgatgtcttggagaggacgccaaaagcacaggcaacaaaagcaaaactagacaaatgggactcacaaaaccaaagagcttctgcacagcaaaggaaacaaccaagagaatgaagcgacaacctacagagtgagagaaaatatttgcaaaccataaatctgacaaagagctgatatccaaaatacataaggaactcaaacaaatcagtaacaagaaaacaaataatctaattaaaaactgggcaaggaatctgaccagatatttctcaaaagaggagctataaatgggcaacagatctatttttaaatgctcaacatctctgatcaccagaaaaatgcaaattaaaaccaaaagagggtcaggcacagtattcacacttgtaattccagcactttgggaggccacattgggtggatcatctgaagtcaggagtttgagaccagcctaggcaacatggtgaaatcttgtctctactaaaaatacaaaaattaaccaggtgtggtggagtgcacctgtaatcccagctacttgggaggctgaggtgggagaatcgtctgaacctgggaggcggaggttgcagtgagccaagatcgtgccactgcattccagcccgagcaacagagtgagactccatctcagaaaaaaaaaaaaaaattaaaagtggtatatgactgtatatcctgcacatattaaaaagttaataaaccatgaataagataaaaggatataataataaaaggatatttaaacaatgttatgccaatgaatttacaatttgagatggaataaacaaattcctagaaaaaaattatacaggccaggcactgtgagaggccgaggcaggtggatcacctgaagtcaggagttcaagaccagcctggccaacatggtgaaaccccatctctactaaaaatacaaaaattagcctggcgtggtggcacacacctgtagccccagccacttgggagactgagacaggagaatcgcttgaacccaggaggtggaagtttcagtgagccgagatcacatcactgcactccaggctgaacaacagaacaagactccatctcaaaaaaaaaaaaaagaaaaaagaaaaagaaagaaaagaaaaaaaatacaatatgctaaaatcagcacaaaataaatagaaaacctgaatcattccacagctattatatttaaataaatcaaatcccttgtttaaaacttccgccagaataaaactccagacccatacagcttcaatggaaatatttaccaaacacgtaaagaagaaataatgtctattttatagataattttccagagcatagaaaaagaagatgaaatcccaaatccatttcacgagattaacataatcttgatgccaaaacctgacaagggcaaagcaagaaagtattgtaggcaaatatcactcattaacataaatgcaaaaacctgaaacaaaagatcagcatacggaatctggtgatacataaacaggataaaacattatcaccaagttgggtttatgccaaacacccaaaatggtttttaacattaaaaaatcaataaggaggctggacgcggtggcttacaccggtaatcccagcattttgggaggccaaggcgggcggatcaggaggtgaggagatcgagaccatcctggctaacacggtgaaaccctgtctctactaaaaatacaaaaaattagccaggcgtggtggcgggcgcctgtagtcccagctactcggaggctgaggcaggagaatgacgtgaacccgggggggcggagcttgcagtgagccgagatcgcgccactgcactccagcctgggcgacagagcaagactccgtctcaaaaaaaaaaaggaaaatcaataaggaggccaggcacggtggtttacacctgcaatcccagcactttgggagtccgagtcaggcagatcacgaggccaagagatcgagacaatcctggccaacatggtgaaaccccgtctctactaaaaattcaaaaaattagctgggcgtggtggcgggcgcctgtagtcccagctgctcgggaggctgaggcaggagaatcgcttaaacccaggaggcggaggttgcagtgagccaagatcacaccactgcactccagcctggagacagagcaagactgactcaaaaaaaaaaaggaaaaaagaaaatcaataagggtaatatgccatattaacagagtcaaggagaaaaatcttgtgatcatcttaggtgcagagagaagtagtgataggaatcaacgctcattcatgattttttaaaaactcttagcaaactaagagaactgcctttatctgataaagattgtctatcaaaaacctcagcaagcaccacacttagtgcgagacattcatatgtactttataataatttgttaacatggatgttgaagttttatgcacttttttgtacattttattttccacaattaaaaagacttttaggacaccataaaccaagagccaaattattcttttttttttgagatggagtcttgcttggtcgcctgtcacccaggccggagtgcactggtacgaacatgggtcactgcagcctcaagtcctgggctcaagtgatccttttgctgtaacctcttatgtagctgggacgacaggaccacaggcatgcaccaccataccaggctagtatttttttttttggagagacaaggtctcactttgttgcccaagctggtctcaaactcctggactcaaccgatctgcctgccttagcctcacaaagtgctgggattacaggcttgagccatcatgcatcaccagccaaattattcttaacagtgaaatactataggcattcctattgacatcataaacaaaacatgaattcccaatatatataataacatgattctggaagttcttttttgtttgtttgtttttttgagatggagtcaggctctgtcgcccaggctggagtgcagtggctcaatctcggctcactgcaagttccgcctcccgggttcacgccattctcctgcctcagcctcctgagtagctgggactacaggcgcccaccaccacgcccagctaattttttgtacttttggtagagatggggtttcaccgtagccaggatggtctcgatctcctgaccttgtgatccgcctgccttggcctcccaaagtgctgggattacaggcgtgagccactgtgcccagcctggaaattctaatcaatataggaagataaggaaaaacataaaatgtataattatcaaaagggaaaaaagttagagaaaattttttaattttaaatgaaaaagtattttaattcataattgaatttaatagagtggctaaataataaacatgtaaaaatcaatggctttcctataaactgctaataaatagttggaaagtaaagtagaaaagtgctcatttacattagcaataaaagtgtattaaattcctaggaataactttaacagaaacaataaagacttatggaaaaaaagcacagtgaggctgggcgcggtggctcacgcctgtaatcccaacactttgggaggccaaggcgggtggatcacttgaggtcaggagttcgagaccagcctaaccaacatggtaaaaccccatctctactaaaaatacgaaaaaaaaaaaaaaatagccaggcatgctggcacacctgtaatcccagctacttgggaggctgaggcagaagaatcacttgaatctgggaggcagaggttgcagtgagccaagatcgcgccactgcactccagcctgagtgacagagcgagactctgtctcaaaaaaaaaaacaaaaaatctgttcttgccaggcacggtggctcatgcttttaatcccagcaactcagacggccaaggcaggaggatcacttgagcccaggagttgaggctgcagtgagctatgatcatgccaccacactccagcctaggcaacagactgagaccccaactcaaaaaaaataaaaaaccttcctttctcacagaaaacaaacttccggatgggtattttttttcttgggtgttttaaaacgataaattatttagaagagggaaacagggtaagcacacttgctgcttgtgggtggaagttctgcaggagaggctggcaagagctgatgcatgcaggttcacagtggtatccgggctccatgttggcgcccatagctgtgcctgctggcttttctgcccacttcagacagaggtcccaaaccactcccactcccaacacgactctcacatctgctcactaccaaattctctcatttccaggtgtcagaaaaaaagcagccatacctgtcctggtctcactgtgccaatgcatttcataacatctcacccaaagtctgccttctccacttacatgctgaaactcggggccaagtgtccatgagccactccctgctcttcctgtaccagcctagcagtcctggacaagtcactttcttccccaagaccttttctccaatctgtcccaccaggatcttctgaagcatgaggcaaagccgtgctgacctccctcttcctcagacgtgcccagtccaagctcattcctacacaagagccctcgtatctactgttccctgtgcctggaaagctggtcccgatcctgtgtctgatccttttcctaggtctcggctcggacaggcatctgggaccctcttcaggggggttgtttcagcccacctgacttacagcatccccctacctgggtcccactgtaacatatcatcttgttctgttttcctcacagtacttatcacttctcacttcttgaaattatttttttgttttctttctttttttttcttttttcttttttcttttttttttttttttgaaacagagtctcgctctgtcacccatgctggaaggcagtagtgtgattacaggtcactgcagcctccaactcctgggctcaagtgatcctcatgcctcagcctccagcctcccaagtagctgggaccataggcacatgccaccatacctggctaatttttgtactttttgtagagacagggtttccacatgttacccaagctggtctcgaatccctgagctcaagcaatcagcctcccaaagtgctgggattacaggaatgagcctctttccctggcctcccttcatttttaataaaaattgtatgcaccaacttaaggtgtctcctgccctctggctctgcccacatctcagtccctcctttcctctacgtccctgccagtcttatctcctcttgacctttccgtccctcagcaacttctactatttccttctgccccaaatgcctagaaccaccactccctctctgcccagcaaactccctcttccctcctttcaaagtcctccagcctcacctcttccctgacgcctgcccttgctcagaacacctccacgcaggtgacagatcacccagtccaggatcaggcagtcgcctgctctcctgagcagcccatgttcctcctctgcttttccctggccggcggggcctacagtctgtccatttcacatgatcagcccctgggggtcaggaattctgccttgcactggcttcattatgaaggtcatgccctgtattcctgccttggcaacggaaatgctaggtgaatggtgggtatgtggatgaaacgcacaaggctcatgccattaaggacaccttctggccgggtcccttcttccctctctcagccacctcctcctgcttgctaagcttccccaagaagacagacccaggcccgctcacctgagagccagaagaggagcaggtagagtgtcagcaggggcatcttctcttcagacaggtccccgttcccctcagtggagcctggcagcaggaacaaactacagactcccagccttctgctggtactcactctcgcccttgaacttcctccttcagtcacttcccatgggtgaaagagactaaaagaggaaggaggtggttggttgggcaccgtggctcaggcctgtaatcctggcactttgggaggccaaggcgggcggatcacgagatcaggagttcaagatcagcctggccaacatagtgaaaccccgtctctactagaaatacaaaaattagccaggcgtggtggcgcacacctgtagtcccagctactcaggaggctgagacagaagaatcgcttgaacctagtaggcggaggttgtagtgagccgagatcgtgccacttgcactccagcctgggtgacagaacaagactctgtctcaaacaaaaacaaaaaaaaaaaaaaaaagaggaaggaggtggaaagggtgaaatttcgaggcagttgacaatgcaaggggtcacaggaatcatcagcttctgagaagtacctctctgtacacagccaccgtgggttctctaaaaagagaacttcgtggctcctctgtcatgtggaaacctgcagacagatccactgggtctggccagcccttatccaatcctccaaacctggtgggttggctgggggcaggggcacgcggctccaccagaggggtcctggagagccacggctgatagacacgatgtcctaaacctggagcttcaggtgtagccagatgcttgggagcccagaaggccagaagttcaagaggattgaggggcacttgtggccaaagtcagaaagccagaggagagattccagaccaaaggttggaaggcagctatgaggagattgggtatccaaccccagactacaaggccaggtacggtggctcacacctgtaatctcagcactttaggaggctgaggcaggaagatcacttgaggccaggagttcaagaccagcctgggcaacatggcaaggcttcatctccacaaaaaaaaaaaaaaaaaaaaaaaaaaaaagtcaggcatggtggctcatgcctgtaatcccaacactttgggaggccaaggtaggcagatcactccaggtcaggagttagagaccggcctggccaaaatggtgaaaccccatctctactaaaaaatacaaaaattagctgggcgtggtagcattcacctgtaatcccagtgactcgggaggccgaggtaggagaatcacttgaacccaggcggcagaggttgcagtgaacccagatcgcaccactgaactccaacctaggcaacagagcaagactctgtctcaaaaataataacaataataataataattagttctgcagagtcatgcatgcctgtagtccaagcaatctgggaagctaaggcctgaggattacctgagcccaagaggtcgaaactgcagtgagctatgattgagccactgttcactgtactccagcctgggcaacagagcagacgctgtctctttaaacacacacacacacacacacacacacacacacacacacgcacgcacagagaggttcagagagaagggagatgcaagcagggaactactggcccactgacaagaggcgctttgtcctgagaacacgaaggaagctcctactgctgtaccccagcccaccaggtgagatcccagggatacctacatctggaatcttccagaaacctgtccattgtaccagggggtctacctgaggaaaccagttcattgctcaggactattatcccctcgctccacccctcaccttataactatttgttgaaggaaggaaggaagaaaggaaggaccagttttgcccctcactctcctccttctgacaatcatgtccatcccccatctctcctttcccatcaagaccccagcaagtccctagggtcgggactggggatataaaaggattaggaagggccagactcagtggctcacacttgtaatcccagcattttgggaggccaaggcaggtggatcacctgaggtcaggagttcgagatcagcctggccaacatggcaaaaccccgtctctactaaaaatacaaaacttagccgggtgtggtggtgggtgcttataatcccagctactcaggaggctgaagcaggagaataacttgaacacaggaggtggagattgcagtgagctgagatcgcaccattgcactacagcctgggcaacaagagtgaaactccatctcaaaataaataaataaataaaaataaataaaaggattagacctttctcaccttctgcacctggagccacttttgccatgtgtcacatacaccctgtgacatcttgacaagggagtgagtctcaaagagggacgcaaccccctcacaccctaatcaggaatgagtgggtgtgcagagggttatttgcacagaaaaccacagcagctgataagccatggcttttccaggacgtggccagagatggcttctcgctttacatatctgcagaccataaagtaggtcaagaatccggggtgagggcttggccagccctttggtccctgctgcatgtcaataggtcctctgcccagggcaccatgcagatactcagagagcaatcagccctctgcagtagggaagccattggcttccaggaaaaaggaccaggaatgggggctgccctgaaaaacaaggggcagatgcatcgagggtggtggggtaagctttcttctcctgggcatgagcaacaaggagggaacagcactgtctgttagaactgcctgtggccagaccctctgatcgtggcctctcccagacctggcctccccaagaaggattcccctttgaaacaagaacagagaattcaggccgggcacggtggcttacacctgtgatctcaactctttgggaggctgaggcaggcggatcacctgaggtcaggagttcaggaccagcctggccaacatgtcgaaaccccatctctactaaaaaatacaaaaaattagccgggcatggtggtggatgtctgtaattctagctactaaggaggctgaggcaagagaattgcttgaacccgggaggcagaggttgcagtaagccgaggtcacaacactgcactcctccagcctgggtaactgagcaacacactgtctcaaaaagaaaaagcagagaattcgccaagtggttctgagtagctgctcctctaaccaagtgcctatggggaatacaggggaatcggctcttctgcaggccttgcgtcctcaaaaactcatttgaacctgtaatcctggtttgaccattgacctatacacaagccagttatatccctgggcttccctgtccccatatgtgaaagcagggattagacaggtcatctgagattctccctgctctaacgcacctatgtatgtatgtatgtgtgtgtgtgcatgtatgtacgtgaatggttgaacctgtcattctgccctggccttgtgtgctctgctaggggactctgtctagcacctaagaaccagtctctgtttttataaatcataattcttctcagaaaccattcctgagcccttttagttcccctcacttccaattgcactttatctttcccaaccacttgtgctatgtttcatattttccatcattattacattgaatcctcactataaatctagaggaaaggtgatgcgtttctcatttttcaaagaaattgagacgcagagagcaagtgacgtgtccaaggtcacatagctagtaagtggcagagccaagattcaaacccaggcctggttcatataagccatgctgccttgtgtcagggtcagggagggggcagagaaagagagagagagagagagagagaaaacagcccttagatcctgctcagtgctgacaatgaagaattgataaagcagagaatcccggagctggttgtcaccagggcgtccactccaaggttgttttttaaacaaatttcctggccgggtgcagtggctcacgcctgtaatcccagccctttgggagggcaaggtaggcggatcacctgaggtcaggagttcaagaccagcctgaccaacatggtgaaaccctgtctctactaaaaatacaaaaaattagcttggcatggtgataggtacctgtagtcccagctgctcaggaggctgaggcaggagaatcacttgaacctgggaggcagaggttgcagtgagctgagatcgcaccattgcattccagcctgggcaacgagagcgaaactctgtctcaaaaataaaataaaatgaaataaaacaaatttcagaatgaaagaatgttttatcatgcactgaaaactgacttattaagcaggtaactgataccaccagccttgaacattttccagatctcatgcccctcttctgcagtgtatggaatgggaatctgggccttacccaagttcttgtccaggaattcaggcacaggcaaagcttatttctgagaaaaataggcgtctccaaagagtgagtctgaaagtttgtgtctctcgaatttcatacgttgaaacttaaccttcaatgtgatggcattacgaggttgagcctttggagagtaactaggtcaggagagtaactaggtctcctgaatgggattagtgcccttataagaaaggccccagagggctgggcgcggtggctcatgcctgtaaccccagcacttagggaggccgaggcaggcagatcacctgaggtcgggagggagttcaagaccagcctaaccaacatagagaaaccccgtctctactgaaaatacgaaattagccagatgtggtgcatgcctgtaatcccagctactcaggaggctgaggcagaagaattgcttgaacctgggaggcagaggttgtggtgagccaagatcgtaccattgcactccagcctgggcagcaagagcgaaactccatctaaaaaaaaaaaaaaaaaaacagaaaagaaaaagaaaggtgccagagagctgccttgccccttctaccatgtgaggacacagcaagaaggagtcctccctgaggagtgggtcctcaccagatcctgagcctaccagtgccttgaccttggactctccaggctccaaaactgtgagaaatacatttctgtttataaaccacacaatcagcagggcatagtggcccacacctgtaatcccagcactttgggaggccaaggcaggcagatcccttgagatcaggagctccagaccagcctggccaacatggtgaaactccgtctctaccaaaagatacaattagctgggcatggtggcacgaccctgtagtcccagctacttcggaggctgaggcaggggaatcacctgagcccaggagacggaggttgcagtgagccaagatcgtgccattgcactccagcctaggtgacagagtgagacactgtctctaaaacatcatatcatatcatacatcatatcatatcatatcatatcatatcatatcatatcatatcatatccacccagtctatggtattttgttatagcagccgggactaagatagtgggttagagaaaaaaaaagggctctttgattttcagaatagagcacctgtcatctttgctacctgctccttgacaaagtggaagagctgcaattgaggctccccctgcctagaaaatttgatcttgtttttaagcacctattaattggctagatgtatttggaaaaaaaaacaagcgtttgttcagcaacaggtaggctaaacttgggcatccccttagctttcatcagattccccagtgcaatgcacctcctcaacacacacacagactttttcccactacaaaagtaatgtgtgtttgttagagaaaaacagtgaaatacagatgaacacaaagaatgcatcttaagtcactccgaatcctgccacacagaaataactgctgttaaatatatgtgtgtgtatctattaccaatcttttgttcttctgtagaaaagcaatttatttcaggttacatgaaggatcactcatgtatgagtttgctttaccaactggactactacctttattagggcattttaatacaggaaaaacataaaaagtatggcagtggagggtgttgataatggggaaggttatacatctgtgggggaaaagggtctgtggaaaaatccctgtatcttctgcccagtgttaatgtgaacctagaaattctctaaaaattaaatcctattttataaaaaagagagacatggccgaaaataccagctctgaaatacctccagttaatactttctttaaaaaggtaaaatgcaggccaagtttggtggctcacacctttaatctcagcactttgggaggccaagatgggtggattacttgagcccaggagatcgagaccagcctgggaaacatggtgaaaccccaactctgcaaaaaatacaaaaaaattagctgggcacagtggcatgtgcctgtagtcccagttacttgggaggctgaagtgggaggatcacccgagcccagagaggtcgaggctgcagtgactcgtcatcatgagccacagcactccagactgggcaacacagcaagaactcatctcaaaaaaataaataaataaaataaaataatttgctcacaattacctttctttttcttttccttttttttcttttgagatgggttctcactgtgtcaccaaggctagagtacagtggtgcaattatagctcaatgcagctgtaattctggaaaatctcctggactcaagtaatcctcctgcctcagcctccccaatagctgggaatacaggcatgcaccaccaagcccagcttattgttttatttattgtagaatagggtcttcctatgttttcaagctggtctcgaactcctgggctcaagtgatcctcctgcctttggcctccccaagcactggaattacaagtgtgagccactgtacctggccaagcaaattatttaaataaattttttaaaacatagaaaaagattaaatgaaaagtaaaagtcttatctccatttcccacctaccagccccagaacctcaaaggcaatcctcttggcctctattgcctccctgagaaaagttaatcatactccagcagataaacctaagtaacatatacacattcatcatactatatacatcactctgccccctgcttcttttgcttaataatgaactttctcccaaacagtgagacaggagagttcctttgacccttttgcaggtaggaactggagggcaccagctctgggtccagtcggccatttaggcaccagcagggacgaactttacttgctcgaacccactgggttcagcccctcgtgagagggagcacacaggcaagtgggtgctagggctgggacgagtacttttgggctctggccccacggcagcatgaaggggtgtgttacaattaaggttcttttaggccaggcatggtggctcacgactgtaatgccagcactttgggaggccgaggtgggtggatcacctgaggccaggagttcaagaccaacgtggccaacatggcgaaaccccatctctactgaaaaaaaaaacccaaaatttggcagggtgtggtggcgggtgcctataatcccagctacttgggaggctgaggcaggagaattgcttgaacccaggaggtggaggttgcagtgagccaagatcccaccattacactccagcctgtgtgacagactgagcctctgtctcaaaaaaataaaagaaaagaaaaacacaattaatgctcttttagcagttgccatccacagatggctaagtgttagccagctcagcggagagtcaaggtgacagcctttttacaccctgccctcttggtacagagttaagtgttaaccagctcagtggagagccagggtgacagccttttacaccctgctctcttggtacccgggttcttgtcaggtgtccaggaagaatcaggtcacatagacttgaaggatgatgaatgcggagattttattaagcggtggaagtggctctcagtggaaggggagctggaaaagggatggtgtgggaagaaggtgatctttccctgaagcctggctggagataaccgggctcctctctgaagccgtgccatctgaagttaagccgtgtctatccgtatgctccgatgctcagttgcttccactcttgacgttcagctgcttgtctcttctctccttctcagctacaccactctgctcgtctgccaagagctttttatgggtacagggctggggacatggtgggccagggtggttttggaaaaggcaacattcaggcaggaaaacaggaatgcatgttctcatttagggccgcaggtccaggcttgagggtggagccatcgccaggacctcgccctcttttacccagtatttccctgctgcaacagggacatacagtacatacagatcttcctcatccttttactgttttcacagtactgcattgtatgtatattctagagtttacttcactagtctctactgctgaattatttgttcttacaaacactacaatgagcatccttatacacatatcttggtttactttttttttttttttttgagatggagtcttgttctgtcacccaggctgtagtgtaatggtgtgatcttggctgactgtaacctccacctcccaggttcaagtgattctcctgcctcagcttcccgagtagctggcattacaggtgcacgtcaccatgccctgctaatttttgtattttcagtagagacagggtttccctatgttggtcaggctggtctcaaactcccaacctcaggtgatccgcctcggcctcccaaagtgctgggattacaggcatgagccaccacgcctggtcctcttggtttatttttgcaaggaaagccatagagttgctgagtcaaaggaatttgcacttgaaaccttgatagatattgtcagttgctatccaaaatggttgctcaatgtatactcccactaatagtgtatgtatgagtgcctgtttccccaaatctaagccagtactgaccattaccaaacttttatcaagccgctatacattatattgtcattgtatcggttagggttctccagagaaacagaaacggtaagctatatatatggaaagaaagagagatttgtcagccaggcacagtggctcacgcctgtaatcccagcactttgggaggctgaggacggtggatcacgaggtcaggagatcgagaccacagtgaaaccccatctctaccaaaaatacaaaaaattagccgggcgtggtggcgggcgcctgtagtcccagatacttgggaggctgaggcaggagaatggcgtgaacccgggaggcagagcttgcagtgagtcaagatcgtgcccctgcaccctggcctgggcgacagagcgagactctgtctcaaaaaaaaaaaaaaaaagaaagagagagagatttgtccgagaaattggcttacatgactgggggctggcaagtccaaactctgtagggccagcccaaaggctgtaaattttcaggcgagagttgatgctacaaacacgaggcagaatttctgcttcctcagggaaacctcagttttgctcttaaactctttcaattaatcagaggacactcacccagattactgaagacttaaagtcagctgcttggagatgttaacaacatcaacaaagtaccttcacagcaacatctagattagtgtttaattgaataagtaggactatagtccagccaagttgacacataaaactaaccacatgtacacaaaaatatatcaacctattcacatcctttgttcacttttctattgaagttttcttctgagagctctccttatatgagggatattaccatatgtcatatgtctcgaaaatatcttccctgtaccatttctcattcgactttgtttgtggaatcttctgtcaaccaaaacatttttattgcagcaaatctatcgatcttttctttatggcatctgaatttcctgtcttgttaagaaggtcactcagagccactttaggagccatggtaaccatcccatttatcaggttttctaaaagctgtccctgaataataaagtcacagaaaagcagcaatagtgtacttagacagcattagcctggctcccattgagaggcctggataaagtaggatttaatgttatgccctgcatttatcaagggtcgatacaacagctttagaaaaagctttgcgtcttccgcaaagttgcaattgcccattttgttattcaaggccccttgcagaaggatccacttaacagattatagcagtgtataacaggagaaaatactcgatggaaaggactcaggcatacaatgtcagacaagtaccatacaccccacctggttttcccctttgccttgattgtcaggaaacctataaccaaacacaatgctcaaacgcagtaacaacctaacctcactctgggatggaagatttgccccagcccaccccacccctacacacacacccctattctttgtatattttttcaggcaatttcttgaactgccttctcgtacttgtgggtttgtttgaaaccacctgtccccattggaagtgaatgaggcacaaatacagatataaacaaaatgactcaagaaagaacaaagacgcttgtctgaatggtggcaaagttgacccagaggtttctgtctgaaccacaattaactaactttttttttttttttttttttgagacggagtctcactctgtcgcccaggctggagtgcagtggcgtggtctcggctcaccacaacctctgcctcctggattcaagtgattctcgtgcctcagcctcctgagtagctgggactacaggcgcgcatttttgcctggctaatttttgtatttttagtagagacggggtttcactatgttggcaggctggtctcaaactcctgacctcgtgatccacttgccttggcctctcaaaatgctgggattacaggcatgagccaccgcacccggccgtaacattttcataaatgcgaagagaaacacaaagagggaaggcatggtgacaaatctggacccaaagttgacattcagcttctccaagcagtgaaactgggaaccaacttggagaaatttaaggaattttcagcagctgttgggtggcgagagaagctctgctgggttatctgtgaaaccagaaaatctgagacaagtctcagttaatttagaaagtttattttgccaaggttcaggacgtgcccatgacacagcctcaggaagtcctgacgacatgtggccaaggtggtcagggcacagctaggctttacacattttagggagacatgagacatcaatcaagatatgttaagaagtgcattggtttggtctggaaaggcgggacaactcagaagcaaaggcagaagactggaaacatggagggagcttccagatcacagatagttgcattcttttgagtttccaatgagcctttccaaaggaggcaatcagatatgcatctatctcagtgagcagatgggtgacttagatgaatagatgggaggtaggtttgccctaagcagtttgcagcttgagctttccttagtgattttgggggcctaagatattttcctttcacatatctgtctcatgtgtccgtgtgaagagaccaccaaacaggctttgtgtgagcaacgtggctgtttatttcacctgggtgcaggcaggctgaatccgaaaagagagtcagcaaagagcagtgggattatcattggttcttacaggtttggggataggcagtggagttaggagcaatgttttgcgggcagggatggatctcacaaagtacattctcaagggtggggagaatagaaaagaaccttcttaagggtaggggagatgacaaagtacattgaccagttagggtggggcagaaacaaatcacaatggtggaatgtgatcagttaaggctattttcacatcttttgtggctcttcagttgcttcaggccatctggatgtatacgtgcaggtcacaggggatatgatggcttagcttgggctcaaaggcctgacaatatctaaggtaatggatttaggcagctccatccctaacatttgggggccagggctagaatacaaatggaggcccacataccatgtgtctcagtatcttaacattctaaagcaagctcaaaaagctacaaaatcaagtgtgtctaatcttccctcctgaacaaaataccttcttaccaacctggaagccaggttagcatgtaggattctcagaagttccacactaaaatgtggcagcctagggacaaacaacctcctgtccccagccccccacccacaagctcctctccttctcctcccacccttgggcaccccaaccccaaaggaattttcagcagctgttgagtggcgagagaagacatgtaacaagtgcttttggtttggtcagaagaatgcatgaggctccacatccaagctctgtccacagcccctgcaaatcgtcaccccttggccacaccacagacctagggatgccaccataagagcaaccttggggaaaagtgcagtcagtctacaggaggaataggagcctttggccatgtggacacctcgcttcatggggaggagcacagagaaggagcaggcctaagggaggtcctaggtttaggaagagatcattcaacaatgcttgtaaatagaccagcgctgagctctccacgatggcctaggtaaaaagctcttagagtcattatcagtagatttttttttttttgagacggagttttgctctgtcacccaggctagagtgcagtggcatgatcttggctcaccgcaacctccaccacccgggttcaagggattctcctgcctcagcctcccaagtagctgggattacaggtgcctgccatcacgcctggctaatttttgtatttttagtagagacagcatgttggccaggctgacttcaaactcctgacttcaggtgatctgcccatcttggcctcccaaagtgctgggattacaggcttgagccaccgcacctggccattgtcaatagatttctaatgctgataaaaaaaagacctagcagggcattgtggcttacacctgtaatcccagcactttgggaggccgaggcaggtggatcacgaggtcaggagatcgagaccatcctggctaacacagtgaaaccctgtctctactaaaaatacaaaaattagccaggtgtggtggcgggcgcctgtagtcccagctacttgggaggctgaggcagaagaatagcttgaactcgggaggcaaaggttattgtgagccgagattgtgacaccgcattccagcctgggcgacagagagagactctgcctaaaaaaaaaaaaaaaaaagaccatgaccaatatgagaggatcatcctgccccaccccgagccaaggttcagctgaatctgaaatgctgaaccctatgtgcacccccggacctcagtgagctggaaaatgtcccgagaagacaggactgtttcctatgatgaaaattgatggaaactcctcaccctggaaaggaaaaggataaaagtgaaaagaattagaatctgtcacattctttaagacacgaatgaggggaacgtggatggactacccctcacattctggaatattctctctaggaagcacttcttaaagcctgaggaagttagattctagatgtaaattattaaaaccactgcacataacaaacaaatgagttctctaaccaggaggaaataaaagctggagaggttcaggaggtgggtgggggcacagtcatgggacatccaaagtcaatgccatggacaacctcatggtaagcagacgctgatatgcattcccttccatgtcactgccagagttgaacagtggctgggcccgacccaaagaggcccagccaatctctatgcttttacggtttagttgtttttatgtctttatgtttttacaagtccagctaaagtttgcacctcctagtcctttcacacagtcttgaattcttgtctttggaaagaggccactgtccactttacactaaggcatttatccactcacccattcattcatccattcattgagggtaccagcctctgggtgcatgtagagttcttctctgttgtttatgattttctttcaaacatttcatctgaacttccaagctaattatcgccccttctccctcccagttcagacctcccagaggaaggcggccttccccctcttttcccagaatctgcttctctttgaaatcttgtcttctccttgttctaagtccaagtgtgcaaggcacataccagctatctgattttgttttattctatagactggatttttggggctctcccacacaggagatctatggacattgtgttagtcccggtcttccgaagaggagatgtgaagagggaatcaaatgtgcaagggttttactgagggaaatgcctgtgagagaaatagagtaggtgccagggaggccaggggagccttcagaccatgatgcaggttggatccccgtgaaggaaagagggcagaaaggttgcatggaagcatcccagaccaccttgcagtatctggagggttgtgcaaggccatgagggagcccttgagctaactcaaccgttagaggggtcctgtgtctcccaggaacaggcctgcctcagtgtccctgctgtgctccgcctttggctggtaattgcctgtaggaagcatgaccttggtgcaaacatgacaatgatggctttcagagcacggcagtggggaccatcggtcatggatgcccctgtggatggaagtctgagagacacattctcatggtcacttcagatgctcattaacttggagggagatctcctctgtgccttcatgcccctttcagtgacttcaatagaaaatcgagactttagtgtgtttgtgtgtctgggtgtatgtgtgggtatctgtgtgcatgtgtatgtgtttttatgtgtgtgtgtctgtgtctgtgtttgtgtttatgtttgtgtgtatatctgtgcatgtgtgcatgtttgcgtgtatgctgcatgtctgtgaatgtgtgtgtctgtgtgtcggtgcctgtgtatatgtgtctgtgtgtctgtgtgaatgtgcatatgtatgtgtatatatatatgtgtttgtgttatacatgtctctgtgtatgcatgtctgtatatgcatgtctatgtgtttctgagtttctgtgtgtgtgcatgtgtgtctgtgtgcatgtctttgtatatgtttctgtgtgcatgtgtttgtgtgcacatgtgtctatgtctgtgtatatgcatgtctgtgcgaatgtgtgtttctgtgtgtttgcatgtgtgcttgtgtctgtatatgaggatacatgttggtgtacatgtgtttccacatgtctgtgtgcatgtgtgtgttctgtgtgtatgtgtgtgtttgtgtgtacatgtgtgttttatgtgtactatgtgtatttgtgtttgtgtgtgtagatgtttttgtgtgtatgtgtatctgtgtgcatgtgtgtgttctttctatgtgtgcatgtatgttttgtgtgtttgtgttgtacaagtgtgtctgtgtctgtatacgtgtgtttctgtgtgtacacgtttttgtgtctgtgtgtgcatgtgtgtttctctgtgtgtgcatgtgtttgtgtgtgtgcctatgtttctgcatcatgtgtgttctgtgcatatgtgttgtatgtgtgtatgtttatgtgtgtgtgcctctgtatgcatctgtttctgtatgtatatgtgtgctctgtgtatgcatatgtttgtgtgtgcatgtgtgttctgtgcatgtgtgtgcatgtgtgttctgtgcatatatgtgtacatgtgtttttctgtgtctgtatgtgtcttgtgcatgtatgtttctgtgtcatgtgtgttctgtgcatacatgtgtacatgtgtttttctgtgtctgtatgtgtcttgtgcatgtatgtttctgtgccatgtgtgttctgtgtgtatgtgtgtacatgtgtttttctgtgtctgtacgtgtcttgtgcatgtatgtttctgtgtcgtgtgtgttctgtgtgtatgtgttgtacatgtgtgtacgtgtatgtgtgtgcttctgtgtgtatgtttctgtgtgtatgtgtgttctgtgtgtgcatatatgtttgtgtgtgcatgggtgttctgtgtatgtgtgtacatgtttttctatgtctgtatgtgtgtgtcagtgtcttgtgtgtgtgtgtttctgtgtgtgtgtgtgcatgttgtgcacatgcgtgcttagaaagaatccactcccacagccacaaggacacctctgaggccaactcacatcacaggccctcagctctctctctattgttcccttccagaccatcctggtgggtgacagtggtgtgggaaagacgtctctgctggttcagttcgatcagggcaagttcatccccggctccttctcggccactgtgggcatcggattcacggtaagcactggccggcactgccagctctgggcctgggctcaggaccccagcgtgtttctgttgagtgccagcaggaaacaggtggacactcgcattggatcattcaaggaggattaaggagaagactgttccccaaggtgtaggagggtgttgggtgaccaggagggagggtatactgcccctgggtagtccaggaactccgcccacctctagcctcaagcaggaagggaaggcaccctcaccagaacccagggacaaagcaggctgctgggtgagctgcctggcaggagctgcgtgggactttcagtggagggacacagcagcccatgggagccccccagggaggcagccaggagaacaatcccctgtcccaccttgctctcctcctgctccccatctccttctggggctccacattggatgaacgcaagtggaagccagaaagcaaaaaatattttaatatgggatagctcaggtcagccctccaaggcaagaagatctggagggacaaagggacgacaaagttttcagcacagtccaaacttagcagtcacacgggtctcagggagctggcaggcccaggttacagttccgtgtttagtcctcggtaaaatggtaaaagggcagctcgggttaaggaagcccagtgccctcggctttttctgcccgcagcccctctgcgagacaagggatccctcctttaccacacatcccatctccccgcgttgtcccgtgcctgcggctgcagctgcccttgaattcctgggaagaccttgggagagggttccactcctctctcgggctgtggcaggaagagcagggccttcccttgggactccagaatcctagcatctcaagatggggaagagcaaacatctcttcttggacaacgcggatgtttgggaacctctgagaccagagcacagggcctgtgagatcacgctcagggtcaggacgcagcagtgccacactgatgggaagagagagaggaaaactcagaaaaatgggcttgcccactgggtcacagccaggaaggcaggggttcagaatgaacatggcttctgcatgaccttccaggaggcaaagcggaagtgagtgcctggttcgggtgtgttctggggcctagaatcggccctgaaacaccagttcccagggctctccccagactgggaccggctgggctctggtagtgctgaatagggaagggctgagacccaggaggccaaggctacctggcaatccctgaggtctgggaccaggctgccatgaagcaaaccaggatgacctggtgccaggcgtcacccaccccagcccaggcccagtctgctctcagcagccagggcacaccctgccctcagggtcacacccgcatctcctcacccacccttctgcctgtctggtgaggaaggaagagagtggggtggatgtggctgtggacatgcaaagtctgactcacgttccacagaccacagaggtgagatctccaaattttgccgctagcttggcaagaaaattgaggccgatttcctgtgaaggaaaaagaaagtgtgtggtcaaactgtttgtctagcctgagatgagacacactgggctttcccactgacctcagggtgggcctcctagagcctgggctgcctgcttggtaccagccagcacccgatgttctggtgcatctcaggacaaacctgttgcctgcttacgctgagtgaggacctgagcccctggccagaaactcagcctggggacacctgagcaaagaactggtggacatcggggtctcctccagatatcagcggtctgggggtccccggagagccaggctacaagacacttgtttacccatctgtccttctcacggagatttgagatatggcatggataagggccctgccgctggccaggctgtagcctgcaactcctgcatgatgggaagggaggcaggtgctgccacaggctccgctcaggaggctgagtgccgcccaggtggcaggggagggacagagcccctggtctcccactttggaggagccagaggtgagcagggtgactacctcgggcatgccttcacccataaactaccaggcccatcgccttctggaagtgggacctgcccaggtcctgtgtagatgcctctcagtcaagaccttccctaaattctccactaccagccccatcaaactggctgtgggggtcgtgctgatggggttatggcacactgatgtcgatggggttcacacaggggtctttccagtccaccacagttcaggtcctccttgttacctctctcctcagtttcccccaaattccctagtcttgcctaaacactgatgcaaaattcctctttcaaaaccttcactcaggccaggcgtggtggctcacacctgtaatcccagcactttgggaggccgaggcgggcggatcacttgaggccaggagttcaagaccagcctggccaacatggcaaaaccccttctctactaaaaatacaaaaacgtttgccaggcgtggtggcacacgcctgtaatcccagctacttgggaggctgaggcaagagaatcacttgaacctgggaggcggaggttgcggcgagccaatatcatgccattgcgctacagcctgggcaacagagtgagactccatctcaaaacaacaacaacaaaaaaaaaaaaacacctcactctgctcatcccccacctgaacattcacggttcactattaccttccaaataaagtctgaatctctcatctgttggtcaagctgttgcacagtttagaccagtggttttcgaacactccttcagcgcacataaaagcctccagggggaagctcatctgaaatgcaaattctaagctccctcatacacatgctgcttcagtaaaaccacgtggggggcccagaatctgggggttctgacccagggggtccatgcgccacattttgcaaaacatgagttgaggccttgtccctccagtctctgcccgggtctccttcccacatcccgaccctgtgctctttgggctgtgctgttccccagctctgaagttttctgccatcgacctggatagcagggagtcccctgcccccatctctgcaggtgtgatttgaggtgtgtgtggtgaggtgatttgaggggtgtggcaggtgtgtggtgtgatttgaggtgcgtggtgaggtgtgtggtgtgatttgaggggttaggtgtgtgtggtgtgagtgtgtgtgtatggtgaggtgtgtgtgtctggggtgtgatttgaagtgtgtgtggtgtgaggtgtatgtggtgtgatttgatgtgtgtgtatgtggcgtgagatgtgtatggtgtgatttgaggggtgtgtggtgtgacgtgtgtggtgtgatttgaggtgtgtgtgatgaggtgtgtggtgtgatttgaggggtgaggtgtgtgtggtgtgaggtgtgtgtggcgtgatttgaggtgtgtgtgtgtggtttcaggtgtacacaagagcccccccatctttcaacacgcatgagggtctgtctcactgacacttggtacctccactatcagcagggctgcatgacaatgacagtgtgatctgtgatcaggagggtaggggtgtctatttgggggtattgtgggggtgtgcgtctcagatctggaggcaataagaggtgttgggggtcatttatagggtgatatacacatttggtgatggtgtgaggcatggggtccattggagaggcaggtgtttgcacagtgatgtggcacaggtgttgatggtgtgaaataaactgtgcctggagctgcactgtggtgacaggagtgtgtgtttggagtgaaatgaggtatgtgtgtttgagggtcatgtaagatgtgtatgtatgtggtatgatggtaggtgtgtttgtttatagtatgaggtgcacatttgtggcataatacaaagttgtgtgtgggacatgttatgaagtgtgtgtttgtggtataatgtagggtgtgaggcatgtgtatttatggtatgatgtgaggcagatgtgtgtggtatgatgtagggtgtgtgtgtatatttgtggtgtgatttgagagtgtatgtgtgtgatgtgaggtgtgtgtgatttgagggatgtgtgtggtgtgaggtgtgtggtgtgatttgaggtgtgtgtggtgaggtgtgtggtgtgatttgaggggtgaggtgtgtatggtctgaggtgtgtgtgtgtggtgaggtgtgtgtgtctgtggtgtgttgtgggtgggtgcacacgtgtgagtgtctgtggtgtgtgtctggggagagacacaggctaccacagcgcatacacagcctcagagtgaacgttaggaggcccaggtttcctccccagagaccacacggatcccttagtgagtccctattctgcacagcccctgttccctgttctgaatgtcttagaccctaacccacttctgactcacccgaggctgcccttgaacaccctacaggacattacagtggccctggggacagtgtacgcaccctccaagtatgacattacccacataccacagacccagcaggcctgcagcccctctccccatgttcaaagacttcttccctaggtcagattcctccatccagactagtgcagcaacgcagcagggaagtgcttcaggccactgctccttctggatgattcgtgctaatgttcaaccttctgtattccaaacccaccataggacaaagagggccttggagccaacaacgtgaaccacagctggaggctagaaatctgaactcaaagtaccagcagggccacgctccctctgaaggctccagagaagggtcattccttcctcttccatggccttggtggctcccaggagtccttggcattccttggcttgcagccacactcctcccatcttgcctctgtcttcacctggatgtcttttccctgtgtctctttcttcttatgacaccggtcatactggattaatggcctgccctatattagtataacctcatcttaatgagtgatatctgcaatgaccacatttccaagtaagggcatgatctgaggtactggtggttcagacctcaacctgtctttgggggacagaattcaacccataacagcatggtttacagtagaaggtgagcatgaggcatgccctgtcccctctctcattcttcctccaccatttccctcctgcaatgaaaacccgcatcctggctgggcacagtggttcacacctgtaatcccaatactttgggaggctaaggcaggcggatcacctaaggtcaggagttcaagaccagcctggccaacatggtgaaaccctgtctctacaaaaatacaaaaattagccaggcatgatgatgggcacctgttatcccagctacttgggaggctgaggcaggaggagaatggcttgaacagcccgggaggcggaggttgcagtgagccaagatcgtgccacttactccagcctggatgacagagctccacctcaagaaagaaacaaaaagaaagaaagaaagagagacagagagaaagaaagggaaagagagagaggaaggaaggaaggaaggagagaaagaaagagaaagaaagaaagagagaaagaagaaagaaagaaaaagaaagaaagaaaaagaaaggaagaaagaaaaagaaaggaaggaaggaagaaagaaagaaagaaagaaagaaagaaagaaagaaagaaagagaaagaaagggaaaagaaggaaggaaaagagaggggaaggaaggaaggcaggcaggcaaagaaagaaagaagagagagagagagaaaggaaagaaggaaagaaggaaggaagggagggagggaggaaggaaggaagggagggaggaagggaggagaggggaggggagggaaggggagagaaaagaccgcataccaggccaggtgcggtggctcacgcttgtaatcccagcaatttggaaggccaaggcaggcgtatcgcctgaggtcagcagttccaaaccagcctgtccaacatggtgaagttctctactaagaatacaaaaattagccaggcgtggtggcgtgcacctgtagtcccagctgctccagaggctgaggcaggagaattgcttgaacctgggaggcagaggctgcaatgcgccaagatcccgccactgcactccagcctgggcgacagagtgagactccgtctccgggagcccacggcattgagcaaacctcggcattatttgcagcaagagcctctggcatccaaatagcaaccaacaccacgcctctgtagtgtgctgcgcagcctccacactccagtctgaggctccctgtttgagtcccgccctatgcccagctgaggttatagcacgctcacctccagaagaggtaacccaagctctttactctactggagatcacctctgtccccactctgggcgcttctcccagctgacagaaaatacctccagctgatgtcagaaaatacagggctggaggctggcgtacaaagtcagtccccacaggcctatggtggcccataagccacgtctacccctgctcctcacctccacacctaagttaagaattgcaggccgggcgcagtggctcacgcctgtaatcccagcactttgggaggctgaggtgggcggaccgcctgaggtcaggaatttgagaccagcttggccaacatggcaaaaccccgtctctactaaaaatacaaaaagaaaaaatagccgggcctgatgtcgcgcacctgtaatcccagctactccgggagactgaggcgggagtatagcttgaacccgggaagcaaaggttgcagtgaggcgagatcgcaccactgcactccaggctgggcgacagagtgagactctgtctgaaaaaaaaaaaaagtgcaggtacccctctccagctctcccctccctacacatccctcaaaccgtcccgctgtaatgcacccgccctgttccttggtaacttgaagctgcttatagaatgtggagatgggggtaattgaaaggtcggcccaggccacagagcccctgagctctgctaccggcaaccccagctgcactccccactctctgtcaccaggagctgccgggtgcctgggatatcctggcagctctgctcaaaatgatctacgacttcatgaatttatttggctcctcctcggggccagggtgagtgtcatgggttaataaggccggccccgccttcaggagcggtccactgggagatgtgtgctgcgcagccctcttgcgaaagctctcccctggtgggacattctgggcacaaccaacaggccgggggaaatgagaggtgatccatactaaagggtcaaagtccccgcaccaggcagaggccccaaaacaccgcagcgtacatgtgctgcaaggcgagtacgggttggtaaacaaaactatattcagatgagctcgggccgggtgacttaacagatgaggaagtgtctcggggccatcggcggaggcgcagcccaggggtccccagctccccgcctcgccacctggggacagcccacggcccggggctcgggcgccgcctgctgtcgcggtgcgcagcgactacgggaactcttccgcagcagacggggtccccgcggcccgctcccccaggggcaagcaagcgaccacaggggaccggtcccggggctggatgtggctcatgtccgaagcgcacggagccgagccggtgttgctcagggaggctgcccgccccttcacgcagaccctgcggctctgcgtgccctcagggaacagcaaggtccgagccggtgtcgtcgagggggcgacgggacggagggaggagcctgaggggtcccggtcgagggaggggaggagtgggcggggcgggggtggggccgttcctgcgctctccttcgcctgcgggccggcactgctcacctctcgtccagggacatgacgggcacgccaggcgccgttgccacccgggatggcgaggcccccgagcgctccccgccctgcagtccgagctacgacctcacgggcaaggtgggtgggcctcttccgtgagacccccgccctcctcggcgctagccccttcctggctgcgtctgggttggactcagcccttcccccaggcagctgcgtctcccagaggagggagggagagagggtcaggacacagcctctggggccgtcccaagctctaggtgtctctgctggcttggtgggggcgggtcgcggaagatcgcaaaaactgagtgatccccccgccggccccaactcagttctcttctgccacactctggcaaatatgagcccccgggagcccatgcttcttggtgagggttaagcgcgcaactctcggggctcaggctgggaagggctgggagatggggaccgaacggagactcggagaggacgtcccctgctggcagaggaactggcgttaatgccattttccgagctaagctcttagttgagatctgacatccaggtttaaggcctgatgtcccccagctgctcccctcccattccacccgctggaggcactgcctcccaccttcctccctgcagtcggaagccgctcctcccagaaggatgttgccagccggcctgcaggtcacttgggaatttttcgaacctgagaaagatttcagtggttggtctttcgcatcccgcacttgagagagctccagggctgctctctggggcttgctccctctacaggggtgtcctgtatggaaacaggtagggacagcagtggactggtctgtcgccttccatctgtgtccttggagtgagcgggtaccagaaactgaaagaactgctgagggagcctagagcttccactcttcctctgcagggttggggatggagtgagggctgtcctggattccgctgcatggccttgaaggagacctgcctctctctgggcctcggtttcctccccgacaccagggctcacccttgctgggagcctcagcctccaccccagtgtttcgggggaagccaccctgcaagtcatccgcccagagccgttgagataggcgtcctgtgtgggcttgtggcaggaaatgggcccctgcaccctcggagaggaggagctgctgttggccaggccccaggctgagggggactgcctgaccttgttgccctgcaaaccagctgggttgtttgcctaggaggtggccaggctaggcagctgtttgtgtttggtggaatcaccgagctgggtgggtagctggcatcgtttgctcaaggcagctgtgatctgtaaagtacacaaagactggccctccctccctccttcctgctccagggctgggacccaggagccagggaggagtgcaggctccagaaagctcctatcccccaccccttcatctgttccctggccaagcggcattggccggagagttggtccccagcctccccgggcctgccccaggggagtgagtccaggaccctctgagaaagcctggcaggagctccttggaccagactaggggtgatgtggcccacaggcagacagttcccaccctgggccactcttccctgggtcttaggtgattcaccacgatgatgggccctagccattaacagactctagaaatacctcaaagacattatccctcctccttctacccactatggaaaccatgccacagaaaggttaaggaatcttcctaaagtcacacagtaggccatttacaaatcaagacccatccttcataccccttctgctcagccacccctgcctctccaccagagttaactaatgccagtaccccatgcccacaacaggaatgcctttgggctccactgtcaatttcagagcctcaaaaataattcaaacctagtccctgcttaacccattaagccacctaaccagcagctgggaaattccagcattggatctagacccctgttatccaagattggagaacagtgggacaaagtgctcctctccaccattcctgcgtgtccctggggaagatgagcagagcagagccagacagtaaaggagagggccacgccccctccacaggttacctccttggtactcctgcccgcactacccacagcaaccccgggatgccgatctgcagccacatgtcccatgtgggaggtttctgctgaaagaacttccaactacacatctccccacttcagtataaatttcaaccttccctaattcatgcaaccttttttttttttttttttttttgagacagagtgtcgctctgtcaccgaggctggagttcagtgatgcaatctcggctcactgcaacctctacctcctgggttcaagctattctcctgtctccgcctcccaagtaactgggactacaggcgtgtgccaccactcctggctagttttttgtatttttagtagagatggggtttcaccttgttggtcaggctggtctcaaactcccaacctcaggtgatccgtccaccttgggcacccaaaatgctaggattacacacatgagctactgcacccggcctcatgcaaccttttaataaacataaaatgtcattagaaacttccagtcaggcgcggtggctcacgcccgtaatcccagcactttgggaggctgaggcgggcggatcacctgaggtcgggagttcaagaccagcctggccaacatggagaaaccccgtctctactaaaaataaaaaattagccaggcgaggtggtgcatgcctataatcccagctactcaggaggctgaggcaggagaatcatttaaacctgggaggtggaggttgtggtgagccaagatctcgccattgcactccagcctgggcaacaagagcaaaactccatctcaaaaaaaaaaagaaagaaagaaagaaagaaacttccaaataaatgttgtgacacaaaaaaaaaaacccaaacaatattcattatagagtatgcaaatgaccatgccccacccccagcagattctgatagactcccttgggtgggaatccttgtccaatatattgacacttccctttcctgtcagtatagcccagcccatgcgtgtactcacgagcggacgatggatgacacaagtacacagagggacggaatccctgcatggtgtggctatgggcaaatgtggccactgtctagattgtgcaaatgtggtggttctctggggccacagagcacacttggggacctgttcatggtgaggtctcaactccggcctctaggaacttgaatgaggacaggagggtcagagggagagcctaggaggctgagccaaggagcgtggagaggagagacagggtgaagatggcggctggctttctggaagcaggtggcctttggtgcggtcagcattcgtgccagccccctcttctctgatcctctccatgtgtctctctcctggaatcccagaagctgcccctgactccccattaactgcctctgcccctaccccctaggtgatgcttctgggagacacaggcgtcggcaaaacatgtttcctgatccaattcaaagacggggccttcctgtccggaaccttcatagccaccgtcggcatagacttcagggtgaggtggctgcaggcacttgcttccagcagagagccagggctgtggctcaggcatgggggggttgcccccaccttgctcaccctggctcccagggactcccgaggctcatgcctggagggcacacaacccgctcccccaagaccacagaggtggccgggtcaaaggagactgggcaaggttggctccttgcccaactataggatgcaaaaaaatgagactgagtcttcgattccagctccattcctgggggacttctcccaagcagagcagccgcaggcacggcataagctgaatatcttggcccacagagcccctgctcattgctctcctacctgggcccctttggaaaggcctcaaaggtcaatcagtctttctggagttcccagaaagcacagccctgcactgggtttaagagctgggcttgggccgggcatggtggctcttgcctgtattcccagcactttgggaggccgaagcggtcagatcacaaggtcaggagtttgagaccagcctggccaacatggtgaaaccccgtctctactaaaaatacaaaaattagccaggtgtagtggcacgctcctgcagtcccagctactcgggaggctgaggcaggagaatcgctcaaatccgggtggtggaggttgcagtgagctgagatcgcgccactgcactccagcctgggcaacaaagtgagactgcgtctcagaaaaaaaaaaaaaaaagagctgggctggccatgttgggagacagcagctcaccagggaccctccctctcaccttgacgactccatcttacaaatctgcatcagggatgctagacgctgcacacctgaagtgttcaatagagaaaaggtctcaccctggcaggtggggctctacagcttcaagcaggcagaaagcgaacacttccttcactagagaattagtgggcagctaaagaaaaggtgctgctgcagatgtagcctcaggtccccaggatgcaggcaaacaccccatctccaggggctcggtcacagtcccaaggctaggctccaggagagggagaccgaagtgggaaaagggcagggcctccagcagcaaccagccctccagccctgggctgcctgatccctggagagagccaggatgtttctcaggctcctcttgccctgctgttgtgagaaggcagttacagtcctcagaagggacgactccacagtggaggtgtctgggtatggggttcctgctgccctgatggtatgatctggctggagacggttctggggctcactgcacccactctaggcctggagagggaacaagacaggacgtctgcagagctgaggagccacatgactcctgccctcccatcctctgcctttttctctttcagaacaaggtggtgactgtggatggcgtgagagtgaagctgcaggtgagaccagaggctggagttggggagggaggatggaggacctgcccttccttctcaccctgaaccacaggaggcctgcagccctgccctccgcctggggcaatttcctgtggggcccacgggaggaaatggcttttgtttatttgacatctgcagaaaaagcagttcccaggcaccctctcatctatgaacagcagctccaaatgccttcagacaagcttagcctccatccatctcctccccagttgccagggctttatctgctcttaggagattggacatccccaacccctgagctaggggagaggagaagattctttttttttcttttcttttctttttttttttgagatggagtctcgctctgtcgcccaggctggagtgcagtggcacaatctcggctcactgcaacctctgcctcccaggtttaagagattctcctgcctcagcctcctgagtagctgagactacaggtgcatgccaccacacctggctaattttttgtatttttagtagagacggggtttcactgtgttagccaggatggtctggatctcctgacctcgtgatccgcctgcctcggcctcccaaagtgctgggattacaggtgtaagccaccgcgctcggctgaggagatgattttgaacgagcttgagaaatcagtaactgctactgtccaggtcattggatgctcaggggctcatgagaacctaaagaagaaaacagccccaccttcccacagatatctcatacaacaaagcaggcctgctccacccagcacattccttgcacctgcctccttctgaccatttctccatcccatcccttcccagatctgggacaccgctgggcaggaacggttccgaagcgtcacccatgcttattacagagatgctcagggtgagtccctcgcaccctccaacccctaccccagccccttggtagcatccgtgctgctgcctaagtcccctctgtgatcctctcccctccagccttgcttctgctgtatgacatcaccaacaaatcttctttcgacaacatcagggtaggtcctcccttcccctgactcccacccataagcagccaaggcaaggtctatgcaggctggggttgcttcctgccctgtggaaagcgggtggagcgtggagtcctcctgccttctgaaaaacacctacttgtgactcagaagtcatatctgctgctttgtatttggtggccatgtgggcatgaaggccaagcaggctgttgtgaccctgtgccacctgcatagccctcactgtgattcacgagtgtgtttcgtgacaaagtgttcagaacagcccccactccaccctggataattatccacagagaccaagggaaaaacacaaccagaaaagtccacacatacatccagggcaagttgcaagaaagtgactcagtcagacagagtgagtggttgtatcctcacaaccaaactattatagagacaaaaatttgataaattcaagcaccaattttgttcacgacattgtataggtttcatgaatcccctgacctcaaggacagtttgctgataagcaaactaggagaataaaacgtttatatagaaagaggaaaatccatggcactcatactcctacctccaaccccatgctcatggcagacatcactaatcaatcacagtacttttgatcactgaaacccttatgtggtcttagaatctttaacaggacactccaagaaatcactgctgacagccaactgatttgtgagataaggtctccatgcatctggatcttccatagaactgatagttgcacagcataaaatggtgagggtggggccattgtgggttgagccaccaaggaaggccatccaggcctggatgggccagaacaaaggtacagatgagagaacgcacagggtatcgtgttcaaggtagtgagtaactgaggatagtcaaacggagcagaagaagaaaggggcagcaggaggaagagaatgccagtctcgcacgccctctcccacaggcctggctcactgagattcatgagtatgcccagagggacgtggtgatcatgctgctaggcaacaaggtgagtggctccggggcagggtcagcccagccctgcacttcctcagccctagccggccccataaccacccaagaacagttatctaggcatccttcctgaaaaggactctgcagcctccagctcaggggtcagacatatctggaggcttctgcccatcccatctgccccttccagggaaagtccaagttgttgcctgagaaatcaaggggtgcccagttctcagcccccattagagcagagtgaacagggtcccaggtcaggggctaagagtgcaaagggttagccccaactgctgtcctattccaagaccctttaccaaaggtgagatcccagagctgggagctacactgggcagaaaccctggccccaggccaatcacacctgcctgcagtcccttgggccaccagcagagggcaggcaacgcctgcttctggggcaaaatatgggcccgctggggcggaggcctccttccccagagtgacccatttgggcttgacaggcggatatgagcagcgaaagagtgatccgttccgaagacggagagaccttggccagggtaagtgattgtctgtgggacagggtgaagggtgggggcaacccgacgctggccctgaggacactctctcccgggcaggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 377 - DNA, 18657 bp, Homo sapiens
tggctcattaaaaacaacacaaatttattctcctgcaattctggaggccaggagctcaagatcagtttcaatgggctcaagtcaaggcgtgggcagggctggtttcttttggaggctccaggcaggggaatccattcctttccctttctggcatctgaaggctgcggcattcatggcccctgctcacgtcacacccacgtccacttccatcatcactttgtctctacctctttgaccttctggcctctttcttatgaggacccttgtggtgatattttgggcccacctgaatcagcaagaataacctctctatctcaaagtccttaacttacatacatctgcactgtccctttctgccacagaaggtaacagtcacaggttctgaggattaggacacagatatctttgggggccattattcagcccataacatgtggtaggcaataaataaaggttcattgtattacgataatggtacttcatgataataatgataacatttttctcattatcatcttcatcattcccatgaaagccccagagcatatccctagccccctcctcaactatgtaggagaggaggggacgtttagaaaaccccaactcctagaagccccctgagacttggccccaagcccaacccagagctaggggcaatgctggctgatcaggcagaggcaccagtccccgggttggtcctgatgaggggagcagggggcagacggtcgatgaggcaggagtgtgctcacagcctggggtccaagaaggagcctggagtgcaggctaaggcctgctgatggtgctgtattccgtgggctcctcagggcccctgccggggaggtggctactgaggtggcccatgttgcagtaggtcggttcctgatcctcagcacccaaggtcagagatgcataggaaatgtcctccttcggcaaggaagcctgcagcaaaggcgggctccaggtcagagaggacggcaggaagtgacggtcacggggcagaggagccctcggaggaggatagtggggatggaccattcagggcttctaatcccactcaagccctccagcttcccccttcactctgccaagcaccctgagcttcaaccacaacagaacagattctcccccaaccctgcaccagtgcagcacatttcctgtggaatcccaagtcactcagcctgtctgggactctgctgcccacgtggggactgtgtttgccagtccctgtgtccccaggactgagacttgcctgtgggagctcctaggcgagtcctgcagtgactatggctttgccccacacctgcctcctctatgcccacatgagcaggagaaagcccaccctccaacggggtgcaacggcaggcctgtgtccccctgccccagcctcacagcagcccccatggaggacgcaccatggtgacatattccacttccacctggtcaacctgggcagaggaaagcttcgtggtagccttttgcggggaggttccggccagctgcagggtcaggtctgcatagcagaggtcgccctccaggggctgcagtacctgggacagggaacacaggctggggagtcacaagatctgtctgtggacacaggttccttttccacggtgggacgggacgagagcctctccacttccccaggtgcccctctcccatttccctccgtgtcctccacttctcaggctcctgtacccctcagcccttgtccccctggctgtttccaggccctcagcccccaggccctgcagggtgccatgaggacaggatactttggcacaggacttctctgatattttggaccttctgagagatggaaaatgaggaaggggaaagaagctgcctggtctctctggtccgaccttgggggctatcttacctgctctggggacatcccggctgctaaaagacaaacaacaattcagaattagaaagcccattccccagactcacaagaacccccaggtctagggaagagaaatatggaagaaaagaggtgaattgggtccaggctcagagacagggacctggttctaattctgattcctcagatgacacagtctgtgacattcgtcatgtcacctctctgacctttcacttctccaccaggaaaagagggacaccccagccccctgctccccacatcatagaactgtgcactcagctgatcgggtggccctgccagccatcggctcccctgggagtaagtttgcttctgcagaatcccaactcggcctggaattccaccatgtctctctacctgattcatccttcaggggtcaattcaaagtcatgcctgccttctgcagctacccaggctgtctaatccccctcccgggcccccggggggcacttgctctatgtctgtctcatcatcttcgtcctactgaattctagttagtcctcaggtgggctgtaagctgcagggtggctgggcctgtcccttccttacaacctgggtgcttggctgtgctgagcaggtggtgctccatcagtaaaagttgtctgcagagacaggaatgcaccaagctgtcccccaaccccgagtagaatgtgcaagctgggtcggcacagtagggaccgattttgtttggtttggtttggtttggtttggtttggtttggtttggtttggtttggttttgagatggagtttctctcttgtcacccatgccggagggcaatggcaccatcttggctcactgcaacctccacctcctgggttcaagcgattctcctgccttagcctcctgagtagctggaactacagatgtgtgccaccatatccagctaatttttttgcatttttagtagagaaggggtttcaccatgttggccaggctggtctcgaactcctgacctcaagtgatccacccgcctcaacctccctaagtgcggagattataggcatgagccacgacacccagagattggattggattgtttttccactgggaccgattttcaggtggttgctggtccctgtcttctttctcccctccccagccaccagccccacatccctgccctagggacaacaaagaaatggggggttttcccctggtttcaaaagtctagatgctggagaacacagaaagcacttagaccttaggccgtgggcaatacatttgggagaaaaagcgatgaataaaagtcaggctctaattttgaaaaagcatcacagaaaacaaactaacagagagtcaggctcccctcttcccaggcgaaagatttcccaggctgtggggagggagaagtgttggagggaaccctgtgagagttaggacccagctgttctagaagagaaagaggtacaattgtgtgagaatgtggaagtgaagccacattctcacacaactggggttttgttgaggccaggcctcatgatctgtgagtgtagactcctgcgccaagaggctcctccctgaagagctagttcacaaagggcaagtaggtcagcctgggaaagtccagtgggcaagggagggacagaaggaaaggccattccaatttcctgatcagacttggagggctgtgtgtgtgtgtgcatgcttgtgtaatgtgatgagtgcacatgcactgtgggatccatgcagtgtgtgtgcccatgatcgcgcatgtgtgtgtgcatccactggtgtgtttgtgtctgtttctccctccccattccatgtcagctcagtacctccttgacaaccacatagacccaactctagcgtctagtctagacaccccagactggaccacccacctaagaccattgccacctatgccatcaagagtcaatccaggaaagagacagggaggtggatcagagagaagagaaggggaaggacggaggtgcagggcaggcggcgaatgccaaaacctcctggggctcccctgcaagctccagggcgccccccggtcccctggcactgccagctgctgagggcctttgggactgtgccatttcctgattgtgtgggtaatcccttggaccagatagctcccagatgccacatccccagccacccggcccagtctcagcccagcctcacccaggtcctctcacctttctgctggtacttcatcatcctccaagccaagagtgaggcggccaccaaaagcagcagcaatatggtgaagatgaggggcaggaggacactgagcttcaggagcttgtgcctagaaacaatggcaagcgtcccctgcatcccaggctcaccacctgcctctcagcccaatcccacccacccagcagcaggggagggccacacacctgatgagctgcaggtctgtagtttgcagcctgggaaccctcactcctggggatcctcaaagatgggtttacaatgagtacacatagacacaaagaagggaatggaacaagagacaccagggcctacttgaggatggagggtgggaggaagcaaagaatcaaaaaactacaaactacctattgggtactatacctattacctgggtgacaaaataatctgtacacaaaaccccggtgacgtgcaatttaccgatataacaaatctgtacgtgtacccctgaagctaaaataaaagtttttaaaatttaagaattttaacaaaagatagttgtttttggttttctttgtttttcatttttttgacacagagtcttgctctgtcacccaggctggagtacagtggcatgatctcggctcactgcaacctccacctcccaggttcaagagattcttctgcctcagcctcccaagtagcggggattacaggcacccaccaccacacctagctaatttttgtatttttagtagagacaggattttgccatgtaagccaggctggtctcgaactcctaacctcatgatccgcccacctcagcctcccaaagtgctgggattacaggcgtgagccacagcgcccggccttaacaaaagatagtttttaaaaggagaaaagggttccatgaggtggttttaatgtgtctagaagcctaacagaaattgtagggcagcagactcctaaaacacctcctgcctctacacctgccctctctactgggttgaatagcgtcctcttcccctcgaattcacatccactcagacccgtgaatgtgacctatttgtggatgtaatcaagttaagatgaggtcatagttgattagcatgggccctgatccagcgactggtgtccttacaagagggaaatttggacacataaacacacacaggaagaagaccatgagacgacagagacagggatcagagtgatgccgccacaagaccgggaacacaaaggatcgcaggcgcccaccagcagctggaacagaggcatgagacagactctccctttgagcccccagggtggcaacagccctggtgacaccttgatttccaattcctggcctccttagctgtgagagaacgtatttcttttgctttgagccactcgtaacggcggccacaggacactgacaggccctactgtagtggatcattgccacagcagccggggggcctgtgaaccaaacgtcaaagcacacccctctctttctcaaaattctgcaacaggccaggcacagtggctcatacctgtaatcccagcaacttgggaggctgaagtaggcaggtcacttgaggtcaggagttcaagaccagcctgaccaacatggtgaaactccgtctctaccaaaaaatacaaaaattagctgggtggggtggcgtgtgtctgtaatcccagctacttgggaagctgaggtgggagaattgcttgaacccaggaggcggaggttgcagtgagctgagatcgcgccactgcactccagcctggtcgacagagcaagaccctgtctcaataaataaataaataaataaataaataaacaaacaaacaaacaatcaaaataaaataaataaataaataaatcccgtaacagccccatttcagcccatgaaaatggccagggctgacaatggcctccactcctgcctacgactcacccctgcctgcttcactccagcctcacttcctgctgctcctcaaatattccaggcacatccccacattacggaccttattccagttgcatttttctccaggaacatgctccctccagagctctgtgtggctcactttctcacctcttccagtctttgctcaagaatcactcgactgagcgcggtggcttacacctgtaatcccagcactttgggaggccgaggcaggctgatcacatgaggtcgggagttcgagaccagcctggccaacatggcaaaaccccatctctactaaaaatacaaaataacagccgggtgtggtggtgcattcctgtaatcctggctactcccagctgcttgggaggctgaggcaggagaatcgcttgaacctgggaggcgtaggttgcagtgagccgagatcctgccactgcactccagcatgggtgacagagcaacactccgtctcaaaacaaacaaacaacaaaaaaaactgttgtgggctgggctggattgtacaccaccacccccccaccccaatccatatgttgaagtcccaccctttagtatctcagaatgtgattgtatttgaagataggatctttaaagaggtgattgaggttaagtgaggtcactggggcaggccctaatccattatgactggtgtcattagaagagatcaggacacagacacacgcagagggacgaccacgtgaacacataggaaaaagatagccatctacaagctgagaagactcagaagaaaccaaccttgtggaccacttgatctcagacttttagcctccagaattgtgagaaaataaatttttgtgatttaagcccccattctgaggtattttgttaggggcaacccaagcaaactaatataaggattatctccttcatcactggatgtgcagaaatttgagaaagaaattcatcagtcaattaattgtgtcaaccctatttggttacactaattagctctagattgtaagtacctcgagggcaggcattttgattatttggtccattcttgtaccctttttaattcccttaaacagtgacaggctagagtgagtgctcaagagttatgtgttaaataaatgagtgaacaaaccatctcatgctaatcaaaggccctaatcgggcacttacataaggcttcgattcataaaataataaataaataaataaccttaactattacttattcaaagcagtttggtagaaaataaactttcaaatcagagggtatcctgtattgatttgcttaggaaaaagaaaaatagggacaaagcaaggtggcttatgcttttaatctcagcactttgggaggctgaggtgggcaaatcacttgaggacaggagttggagaccagcttggccaacataacaaaaccccatcgctactaaaaattggccgggcatggtggcttacgcctgtagttgcagctactcgagaagctgaggtatgagaatcacatgaacctgggaggtggaagttgcagtgagctgagattatactactgcactccaacctgggcaacagagtgagaatccgtcaaaaaaaaaaaaaaaaaaacaattagctgggtgtggtggtgggcgactatagttcccccagctactcaggagactgaggcatgagaattgcttgaacatgagaggcagaggttgcagtgagccaagatggcaccatgcactcaagtctgagctacagagcaagactgtctaaaaataaaaaaaaagaaaactttaaaaagtttaatttaaaaaaaaaacagaaggcaaatgggagagggggagtagaagggtctcaggtggttagaataccggggacctcccatagggattttgtggcaaggtcccagcaaaaggagaacttggcacttggcagatctaaaaacaaagtcaagagggccaaggagagtgaaaggaagaaattaaaggggacgttcctcttctagaaagcccagctgactgcagatggttgggcagggcactaagaggcatgacctgagctatggtgtagagcccagagacttccatccaagctccagcaccacccttcactgaggaagggactgaggctcagtttcttcttctgtaaaatgggaacatttgtatctgcccattcttccacatggggtggttgtaggaaaggtcaaagaaaacaaaataatgcacaggaaagccttttgtgagctgtcagttgctctagagatgtgagaaactataggcatcactgttcttgccataatagtaatcagaggaaaattaagggaaacaggacttccccaagccctcctttccttgtcctcccagaagttgaaccaagagtcatccctgcggctccatgaccccacgcccacactcacatgagacacactgtcctcactgactgccaactcatcggtctcccacactgagctccacggggacagtccatgtctgtgtccccagagctcagcacggtgcagccatgtagaagttattataacacagtaaaagtggggcgaacgaatgaatgaacctacaaacagcactgagctgcagaatgaaggatctgtggagactgaaaggacaccatgtggcctgacagcaagtgggaagggctcccagcttcctcatcctcaccaaggagcatgcaggtcccagacaaagctcaggctggaaaatgggacttcaaagagttctccattggaggagtttgggccaagtaggccacagtggaaccagagctggcttacctgttgtccaagtggtggccggtcagagttggggagctgctagtttcttcttgggtgactggtgctgtaaacgtagtggaggtaggcgtggtgggggcaggagtcgacgctgtagttgatgcttggtgtataaaccagatcacagatgcccctgcccatgagcccacccgcagccctgcacacagctctgagcctgggcgggggtctggactgctactatgggaaggggctgcagcctggaccactcatgtctccctggtctctaggagactccagagcctcataggcaggtggggctgggcagggtccagggaggacgctgagctggccctgggagggttagagggggctgggaagagcctaagggcagctggagaccagctgaacttgagcaacctgctgcttatgacagtgccttggtcaatctccacccccagccctatttatccagcaaaaacaggagcagagtgggaacttgcacagtgaccctagatctgtgacatcaaaggtcaggaccagccctgaatgaaatcatcatattcaggaagaactttgactttgggcaagttacaaaacttcaatgatggggatgcccccttctcaggggtattgtgaggacccattgagacaatgcacgttcagcactttgcaaactagaatatgccccagaggctccgggtgcaacctggggccccaaggactgtggtgctccttccatgccacaagggccctcgagccatcctgcttatcttctgagggacagcagaacaagcccaacaaataaacccatgcaaaccgaggcactgggacccctgagctaacgctcccaggagtgtctgcattctagaaggacataggaagaaatatcattaagtccacacacacaaatggctcatggtgggatgtcagggaccaggaatgcagccgtttgactgtgaagacctttctggacttgggaattagaccccagcaccccgactatgctgagcctctttttcccccaggttagatatggaatgggagatgggaacagcagctatgaagccccagcccagaactccaccaaaagcaggacacacctgggcaccagaggtctccaaaaagcaatggcaaggactggggtctctgggtaccatgggaaggcatccctttggcccatgggctgaaactgggaccatcaccttgtcctcaggcactgagctgtgcagaggtaaaaaatgtgcctagaaaggcttaatcccgtcgtggagggagccctgggagccatgggggcattgaagagaggccctgctcccccagtcccaggtggtcagtcagggttctatgagactcgggactcaagtgatagatcactcagtgacaattaaatcacttgagtaggacctcagagaccaggacagagcaggccctgagagacacacacatatatacactccctcttacctgggtcaatggtcacttgaactgtgaccccaaggtcatttccagttttctcaattccacaccagtaagtgtcagcatcagttttcatgagatcctccatggtcacagtgaacgtgcggtttttctgattgtccttgatggacacccggtccctcttcacctcctgctctgacccactggttttaacaaggatcttgcagtcacgccaaatagctcctcgacaccaccacttcaagtaggtctcccagcctgatctgtaaacacactgcacggtcaaggagccccgctccaagccattcactgttgttggaccggtgatttgagtgacaatggagtagcctggaaaacacaaattcatgtgctgtcacctcccaccccaagggcagggccacagctttctgtttagggaatagctcccaaatccaagtttcacaggttaaataacagtcaaggaagaaatacaccttccgcagacaaaacttttgtccttcagctttccactgggtcaaagccaccaggaaaatcactgaagagcacaacaacggatccccccaaaaataaaaatattggcataagcaataataacttcctgcagttcacccctctctccaccctacggccaaggtaatctgtatatttcaaggaatgtccttttgcagccatctttgtgttagtccagtgtggtggggaggaaataccaggagacccctttccacagggtcttaccttgactcttagcactgatgaccctcatgaggtcgagctgaggcagccacatcagatggctgtggagaggctgtcctggtggtcctaatgatttctagtggttctggaataaaccaccctggatgaatgcctttgaagttgatcaaaacagcaacggcaactggtctccatgtgctataggatccatacaacacagatcccactttctttaatgaattgctttgacccctttgtcaaattgcaaatttgtggatttcccattctgttccattgatctatttgtccacctttctgccaatcctacattctcctgattactatcaccttgtagaaaagcaggtattatagacagtaaggcagtatttacttttttttttctttttctctttttttcttttgaaacaggctctcactctgtcgcccaggctggaacacagtggcacaatcatggctcaatcatggctcactgaagccttcacctcccaggcttaattgatcctcccacttcagcctcccaagtagctgggactacaggcacatgcctccacgcctggctaatttttgtagttttagtagaaacaggattttgccatgttgtccaagctggtctcaaactcccgggctcaagcgatccacccacctcagcctcacaaagtgttgggattacaggcgggccccacaacgcctggcctgtattttcttaaaatacatgttttccttcaaaatcatgtcctttgcagcaacatggatgtggctggaggccattatcctaagtgaattaacgcagaaacagaaaaccaaataccgcatgttctcacttataagtgggagctaaacattggttatgcatggacataaagatgggaacaacaggcagaggagggaaaggggcaagaacaaaacagaggagggaagggagcaagcactgaaaaaactaccaattgggtaccatgttcactatctgggtgacaggtttgattgaggctcaaacctcagcatcatgcaatatatccatgtaacaaacctgcacaggtacccactgactctaaaaataaaaaacattttaaaggaaaaaaaaaatatatatatatatatatcccaaagtgctgcgattataggtgtgagcaactgtgcctggccttttttttttttttaagtaaagaaatatttccctgtatccggaatctttcaaaggtgagaatatgagagaaagaataaaaagaacatatatatataaattcccaacatgaggttgggagttcgagatcagcctgaccaacatggagaaacgccatctctactaaacatagaaaaattagcctggcatgatggcacatgcctgtaatcccagctactcgggaggctgaggcaagagaatcgcttgaacccgggaggcagaggttgcaatgagccaagatggcgccatagcactccagcctgggcaacaagagcaaaactccatctcaaaaacaaaacaaaacaaaacaaaaaccagcagttcaagcacaacaaccaacggcgcggacagagggcctcagtgtcagagagaccctgggaaggggtgaggaccacggcagcctggattggagagcagggtatccatgcgaaggcacagccctccttccactccagcccgggtcctggggaaagaagcgggccctgtgacaagaacacacaatggggaaaggacagtctcttcaataaacagtgctgggaaaactcgacatccacgtccagaagaatgaagccggacctttatctcacaacatatacaaaaatcaactcacaatagagaagatgtaaatgtaagacctgaaacttaaatctctcagaagaaaacctaatggaaaagctccacaacattggtcttggcgatgatgtcttggagaggacgccaaaagcacaggcaacaaaagcaaaactagacaaatgggactcacaaaaccaaagagcttctgcacagcaaaggaaacaaccaagagaatgaagcgacaacctacagagtgagagaaaatatttgcaaaccataaatctgacaaagagctgatatccaaaatacataaggaactcaaacaaatcagtaacaagaaaacaaataatctaattaaaaactgggcaaggaatctgaccagatatttctcaaaagaggagctataaatgggcaacagatctatttttaaatgctcaacatctctgatcaccagaaaaatgcaaattaaaaccaaaagagggtcaggcacagtattcacacttgtaattccagcactttgggaggccacattgggtggatcatctgaagtcaggagtttgagaccagcctaggcaacatggtgaaatcttgtctctactaaaaatacaaaaattaaccaggtgtggtggagtgcacctgtaatcccagctacttgggaggctgaggtgggagaatcgtctgaacctgggaggcggaggttgcagtgagccaagatcgtgccactgcattccagcccgagcaacagagtgagactccatctcagaaaaaaaaaaaaaaattaaaagtggtatatgactgtatatcctgcacatattaaaaagttaataaaccatgaataagataaaaggatataataataaaaggatatttaaacaatgttatgccaatgaatttacaatttgagatggaataaacaaattcctagaaaaaaattatacaggccaggcactgtgagaggccgaggcaggtggatcacctgaagtcaggagttcaagaccagcctggccaacatggtgaaaccccatctctactaaaaatacaaaaattagcctggcgtggtggcacacacctgtagccccagccacttgggagactgagacaggagaatcgcttgaacccaggaggtggaagtttcagtgagccgagatcacatcactgcactccaggctgaacaacagaacaagactccatctcaaaaaaaaaaaaaagaaaaaagaaaaagaaagaaaagaaaaaaaatacaatatgctaaaatcagcacaaaataaatagaaaacctgaatcattccacagctattatatttaaataaatcaaatcccttgtttaaaacttccgccagaataaaactccagacccatacagcttcaatggaaatatttaccaaacacgtaaagaagaaataatgtctattttatagataattttccagagcatagaaaaagaagatgaaatcccaaatccatttcacgagattaacataatcttgatgccaaaacctgacaagggcaaagcaagaaagtattgtaggcaaatatcactcattaacataaatgcaaaaacctgaaacaaaagatcagcatacggaatctggtgatacataaacaggataaaacattatcaccaagttgggtttatgccaaacacccaaaatggtttttaacattaaaaaatcaataaggaggctggacgcggtggcttacaccggtaatcccagcattttgggaggccaaggcgggcggatcaggaggtgaggagatcgagaccatcctggctaacacggtgaaaccctgtctctactaaaaatacaaaaaattagccaggcgtggtggcgggcgcctgtagtcccagctactcggaggctgaggcaggagaatgacgtgaacccgggggggcggagcttgcagtgagccgagatcgcgccactgcactccagcctgggcgacagagcaagactccgtctcaaaaaaaaaaaggaaaatcaataaggaggccaggcacggtggtttacacctgcaatcccagcactttgggagtccgagtcaggcagatcacgaggccaagagatcgagacaatcctggccaacatggtgaaaccccgtctctactaaaaattcaaaaaattagctgggcgtggtggcgggcgcctgtagtcccagctgctcgggaggctgaggcaggagaatcgcttaaacccaggaggcggaggttgcagtgagccaagatcacaccactgcactccagcctggagacagagcaagactgactcaaaaaaaaaaaggaaaaaagaaaatcaataagggtaatatgccatattaacagagtcaaggagaaaaatcttgtgatcatcttaggtgcagagagaagtagtgataggaatcaacgctcattcatgattttttaaaaactcttagcaaactaagagaactgcctttatctgataaagattgtctatcaaaaacctcagcaagcaccacacttagtgcgagacattcatatgtactttataataatttgttaacatggatgttgaagttttatgcacttttttgtacattttattttccacaattaaaaagacttttaggacaccataaaccaagagccaaattattcttttttttttgagatggagtcttgcttggtcgcctgtcacccaggccggagtgcactggtacgaacatgggtcactgcagcctcaagtcctgggctcaagtgatccttttgctgtaacctcttatgtagctgggacgacaggaccacaggcatgcaccaccataccaggctagtatttttttttttggagagacaaggtctcactttgttgcccaagctggtctcaaactcctggactcaaccgatctgcctgccttagcctcacaaagtgctgggattacaggcttgagccatcatgcatcaccagccaaattattcttaacagtgaaatactataggcattcctattgacatcataaacaaaacatgaattcccaatatatataataacatgattctggaagttcttttttgtttgtttgtttttttgagatggagtcaggctctgtcgcccaggctggagtgcagtggctcaatctcggctcactgcaagttccgcctcccgggttcacgccattctcctgcctcagcctcctgagtagctgggactacaggcgcccaccaccacgcccagctaattttttgtacttttggtagagatggggtttcaccgtagccaggatggtctcgatctcctgaccttgtgatccgcctgccttggcctcccaaagtgctgggattacaggcgtgagccactgtgcccagcctggaaattctaatcaatataggaagataaggaaaaacataaaatgtataattatcaaaagggaaaaaagttagagaaaattttttaattttaaatgaaaaagtattttaattcataattgaatttaatagagtggctaaataataaacatgtaaaaatcaatggctttcctataaactgctaataaatagttggaaagtaaagtagaaaagtgctcatttacattagcaataaaagtgtattaaattcctaggaataactttaacagaaacaataaagacttatggaaaaaaagcacagtgaggctgggcgcggtggctcacgcctgtaatcccaacactttgggaggccaaggcgggtggatcacttgaggtcaggagttcgagaccagcctaaccaacatggtaaaaccccatctctactaaaaatacgaaaaaaaaaaaaaaatagccaggcatgctggcacacctgtaatcccagctacttgggaggctgaggcagaagaatcacttgaatctgggaggcagaggttgcagtgagccaagatcgcgccactgcactccagcctgagtgacagagcgagactctgtctcaaaaaaaaaaacaaaaaatctgttcttgccaggcacggtggctcatgcttttaatcccagcaactcagacggccaaggcaggaggatcacttgagcccaggagttgaggctgcagtgagctatgatcatgccaccacactccagcctaggcaacagactgagaccccaactcaaaaaaaataaaaaaccttcctttctcacagaaaacaaacttccggatgggtattttttttcttgggtgttttaaaacgataaattatttagaagagggaaacagggtaagcacacttgctgcttgtgggtggaagttctgcaggagaggctggcaagagctgatgcatgcaggttcacagtggtatccgggctccatgttggcgcccatagctgtgcctgctggcttttctgcccacttcagacagaggtcccaaaccactcccactcccaacacgactctcacatctgctcactaccaaattctctcatttccaggtgtcagaaaaaaagcagccatacctgtcctggtctcactgtgccaatgcatttcataacatctcacccaaagtctgccttctccacttacatgctgaaactcggggccaagtgtccatgagccactccctgctcttcctgtaccagcctagcagtcctggacaagtcactttcttccccaagaccttttctccaatctgtcccaccaggatcttctgaagcatgaggcaaagccgtgctgacctccctcttcctcagacgtgcccagtccaagctcattcctacacaagagccctcgtatctactgttccctgtgcctggaaagctggtcccgatcctgtgtctgatccttttcctaggtctcggctcggacaggcatctgggaccctcttcaggggggttgtttcagcccacctgacttacagcatccccctacctgggtcccactgtaacatatcatcttgttctgttttcctcacagtacttatcacttctcacttcttgaaattatttttttgttttctttctttttttttcttttttcttttttcttttttttttttttttgaaacagagtctcgctctgtcacccatgctggaaggcagtagtgtgattacaggtcactgcagcctccaactcctgggctcaagtgatcctcatgcctcagcctccagcctcccaagtagctgggaccataggcacatgccaccatacctggctaatttttgtactttttgtagagacagggtttccacatgttacccaagctggtctcgaatccctgagctcaagcaatcagcctcccaaagtgctgggattacaggaatgagcctctttccctggcctcccttcatttttaataaaaattgtatgcaccaacttaaggtgtctcctgccctctggctctgcccacatctcagtccctcctttcctctacgtccctgccagtcttatctcctcttgacctttccgtccctcagcaacttctactatttccttctgccccaaatgcctagaaccaccactccctctctgcccagcaaactccctcttccctcctttcaaagtcctccagcctcacctcttccctgacgcctgcccttgctcagaacacctccacgcaggtgacagatcacccagtccaggatcaggcagtcgcctgctctcctgagcagcccatgttcctcctctgcttttccctggccggcggggcctacagtctgtccatttcacatgatcagcccctgggggtcaggaattctgccttgcactggcttcattatgaaggtcatgccctgtattcctgccttggcaacggaaatgctaggtgaatggtgggtatgtggatgaaacgcacaaggctcatgccattaaggacaccttctggccgggtcccttcttccctctctcagccacctcctcctgcttgctaagcttccccaagaagacagacccaggcccgctcacctgagagccagaagaggagcaggtagagtgtcagcaggggcatcttctcttcagacaggtccccgttcccctcagtggagcctggcagcaggaacaaactacagactcccagccttctgctggtactcactctcgcccttgaactt

SEQ ID NO: 378 - DNA, 10516 bp, Homo sapiens
ggaggcgcagcccaggggtccccagctccccgcctcgccacctggggacagcccacggcccggggctcgggcgccgcctgctgtcgcggtgcgcagcgactacgggaactcttccgcagcagacggggtccccgcggcccgctcccccaggggcaagcaagcgaccacaggggaccggtcccggggctggatgtggctcatgtccgaagcgcacggagccgagccggtgttgctcagggaggctgcccgccccttcacgcagaccctgcggctctgcgtgccctcagggaacagcaaggtccgagccggtgtcgtcgagggggcgacgggacggagggaggagcctgaggggtcccggtcgagggaggggaggagtgggcggggcgggggtggggccgttcctgcgctctccttcgcctgcgggccggcactgctcacctctcgtccagggacatgacgggcacgccaggcgccgttgccacccgggatggcgaggcccccgagcgctccccgccctgcagtccgagctacgacctcacgggcaaggtgggtgggcctcttccgtgagacccccgccctcctcggcgctagccccttcctggctgcgtctgggttggactcagcccttcccccaggcagctgcgtctcccagaggagggagggagagagggtcaggacacagcctctggggccgtcccaagctctaggtgtctctgctggcttggtgggggcgggtcgcggaagatcgcaaaaactgagtgatccccccgccggccccaactcagttctcttctgccacactctggcaaatatgagcccccgggagcccatgcttcttggtgagggttaagcgcgcaactctcggggctcaggctgggaagggctgggagatggggaccgaacggagactcggagaggacgtcccctgctggcagaggaactggcgttaatgccattttccgagctaagctcttagttgagatctgacatccaggtttaaggcctgatgtcccccagctgctcccctcccattccacccgctggaggcactgcctcccaccttcctccctgcagtcggaagccgctcctcccagaaggatgttgccagccggcctgcaggtcacttgggaatttttcgaacctgagaaagatttcagtggttggtctttcgcatcccgcacttgagagagctccagggctgctctctggggcttgctccctctacaggggtgtcctgtatggaaacaggtagggacagcagtggactggtctgtcgccttccatctgtgtccttggagtgagcgggtaccagaaactgaaagaactgctgagggagcctagagcttccactcttcctctgcagggttggggatggagtgagggctgtcctggattccgctgcatggccttgaaggagacctgcctctctctgggcctcggtttcctccccgacaccagggctcacccttgctgggagcctcagcctccaccccagtgtttcgggggaagccaccctgcaagtcatccgcccagagccgttgagataggcgtcctgtgtgggcttgtggcaggaaatgggcccctgcaccctcggagaggaggagctgctgttggccaggccccaggctgagggggactgcctgaccttgttgccctgcaaaccagctgggttgtttgcctaggaggtggccaggctaggcagctgtttgtgtttggtggaatcaccgagctgggtgggtagctggcatcgtttgctcaaggcagctgtgatctgtaaagtacacaaagactggccctccctccctccttcctgctccagggctgggacccaggagccagggaggagtgcaggctccagaaagctcctatcccccaccccttcatctgttccctggccaagcggcattggccggagagttggtccccagcctccccgggcctgccccaggggagtgagtccaggaccctctgagaaagcctggcaggagctccttggaccagactaggggtgatgtggcccacaggcagacagttcccaccctgggccactcttccctgggtcttaggtgattcaccacgatgatgggccctagccattaacagactctagaaatacctcaaagacattatccctcctccttctacccactatggaaaccatgccacagaaaggttaaggaatcttcctaaagtcacacagtaggccatttacaaatcaagacccatccttcataccccttctgctcagccacccctgcctctccaccagagttaactaatgccagtaccccatgcccacaacaggaatgcctttgggctccactgtcaatttcagagcctcaaaaataattcaaacctagtccctgcttaacccattaagccacctaaccagcagctgggaaattccagcattggatctagacccctgttatccaagattggagaacagtgggacaaagtgctcctctccaccattcctgcgtgtccctggggaagatgagcagagcagagccagacagtaaaggagagggccacgccccctccacaggttacctccttggtactcctgcccgcactacccacagcaaccccgggatgccgatctgcagccacatgtcccatgtgggaggtttctgctgaaagaacttccaactacacatctccccacttcagtataaatttcaaccttccctaattcatgcaaccttttttttttttttttttttttgagacagagtgtcgctctgtcaccgaggctggagttcagtgatgcaatctcggctcactgcaacctctacctcctgggttcaagctattctcctgtctccgcctcccaagtaactgggactacaggcgtgtgccaccactcctggctagttttttgtatttttagtagagatggggtttcaccttgttggtcaggctggtctcaaactcccaacctcaggtgatccgtccaccttgggcacccaaaatgctaggattacacacatgagctactgcacccggcctcatgcaaccttttaataaacataaaatgtcattagaaacttccagtcaggcgcggtggctcacgcccgtaatcccagcactttgggaggctgaggcgggcggatcacctgaggtcgggagttcaagaccagcctggccaacatggagaaaccccgtctctactaaaaataaaaaattagccaggcgaggtggtgcatgcctataatcccagctactcaggaggctgaggcaggagaatcatttaaacctgggaggtggaggttgtggtgagccaagatctcgccattgcactccagcctgggcaacaagagcaaaactccatctcaaaaaaaaaaagaaagaaagaaagaaagaaacttccaaataaatgttgtgacacaaaaaaaaaaacccaaacaatattcattatagagtatgcaaatgaccatgccccacccccagcagattctgatagactcccttgggtgggaatccttgtccaatatattgacacttccctttcctgtcagtatagcccagcccatgcgtgtactcacgagcggacgatggatgacacaagtacacagagggacggaatccctgcatggtgtggctatgggcaaatgtggccactgtctagattgtgcaaatgtggtggttctctggggccacagagcacacttggggacctgttcatggtgaggtctcaactccggcctctaggaacttgaatgaggacaggagggtcagagggagagcctaggaggctgagccaaggagcgtggagaggagagacagggtgaagatggcggctggctttctggaagcaggtggcctttggtgcggtcagcattcgtgccagccccctcttctctgatcctctccatgtgtctctctcctggaatcccagaagctgcccctgactccccattaactgcctctgcccctaccccctaggtgatgcttctgggagacacaggcgtcggcaaaacatgtttcctgatccaattcaaagacggggccttcctgtccggaaccttcatagccaccgtcggcatagacttcagggtgaggtggctgcaggcacttgcttccagcagagagccagggctgtggctcaggcatgggggggttgcccccaccttgctcaccctggctcccagggactcccgaggctcatgcctggagggcacacaacccgctcccccaagaccacagaggtggccgggtcaaaggagactgggcaaggttggctccttgcccaactataggatgcaaaaaaatgagactgagtcttcgattccagctccattcctgggggacttctcccaagcagagcagccgcaggcacggcataagctgaatatcttggcccacagagcccctgctcattgctctcctacctgggcccctttggaaaggcctcaaaggtcaatcagtctttctggagttcccagaaagcacagccctgcactgggtttaagagctgggcttgggccgggcatggtggctcttgcctgtattcccagcactttgggaggccgaagcggtcagatcacaaggtcaggagtttgagaccagcctggccaacatggtgaaaccccgtctctactaaaaatacaaaaattagccaggtgtagtggcacgctcctgcagtcccagctactcgggaggctgaggcaggagaatcgctcaaatccgggtggtggaggttgcagtgagctgagatcgcgccactgcactccagcctgggcaacaaagtgagactgcgtctcagaaaaaaaaaaaaaaaagagctgggctggccatgttgggagacagcagctcaccagggaccctccctctcaccttgacgactccatcttacaaatctgcatcagggatgctagacgctgcacacctgaagtgttcaatagagaaaaggtctcaccctggcaggtggggctctacagcttcaagcaggcagaaagcgaacacttccttcactagagaattagtgggcagctaaagaaaaggtgctgctgcagatgtagcctcaggtccccaggatgcaggcaaacaccccatctccaggggctcggtcacagtcccaaggctaggctccaggagagggagaccgaagtgggaaaagggcagggcctccagcagcaaccagccctccagccctgggctgcctgatccctggagagagccaggatgtttctcaggctcctcttgccctgctgttgtgagaaggcagttacagtcctcagaagggacgactccacagtggaggtgtctgggtatggggttcctgctgccctgatggtatgatctggctggagacggttctggggctcactgcacccactctaggcctggagagggaacaagacaggacgtctgcagagctgaggagccacatgactcctgccctcccatcctctgcctttttctctttcagaacaaggtggtgactgtggatggcgtgagagtgaagctgcaggtgagaccagaggctggagttggggagggaggatggaggacctgcccttccttctcaccctgaaccacaggaggcctgcagccctgccctccgcctggggcaatttcctgtggggcccacgggaggaaatggcttttgtttatttgacatctgcagaaaaagcagttcccaggcaccctctcatctatgaacagcagctccaaatgccttcagacaagcttagcctccatccatctcctccccagttgccagggctttatctgctcttaggagattggacatccccaacccctgagctaggggagaggagaagattctttttttttcttttcttttctttttttttttgagatggagtctcgctctgtcgcccaggctggagtgcagtggcacaatctcggctcactgcaacctctgcctcccaggtttaagagattctcctgcctcagcctcctgagtagctgagactacaggtgcatgccaccacacctggctaattttttgtatttttagtagagacggggtttcactgtgttagccaggatggtctggatctcctgacctcgtgatccgcctgcctcggcctcccaaagtgctgggattacaggtgtaagccaccgcgctcggctgaggagatgattttgaacgagcttgagaaatcagtaactgctactgtccaggtcattggatgctcaggggctcatgagaacctaaagaagaaaacagccccaccttcccacagatatctcatacaacaaagcaggcctgctccacccagcacattccttgcacctgcctccttctgaccatttctccatcccatcccttcccagatctgggacaccgctgggcaggaacggttccgaagcgtcacccatgcttattacagagatgctcagggtgagtccctcgcaccctccaacccctaccccagccccttggtagcatccgtgctgctgcctaagtcccctctgtgatcctctcccctccagccttgcttctgctgtatgacatcaccaacaaatcttctttcgacaacatcagggtaggtcctcccttcccctgactcccacccataagcagccaaggcaaggtctatgcaggctggggttgcttcctgccctgtggaaagcgggtggagcgtggagtcctcctgccttctgaaaaacacctacttgtgactcagaagtcatatctgctgctttgtatttggtggccatgtgggcatgaaggccaagcaggctgttgtgaccctgtgccacctgcatagccctcactgtgattcacgagtgtgtttcgtgacaaagtgttcagaacagcccccactccaccctggataattatccacagagaccaagggaaaaacacaaccagaaaagtccacacatacatccagggcaagttgcaagaaagtgactcagtcagacagagtgagtggttgtatcctcacaaccaaactattatagagacaaaaatttgataaattcaagcaccaattttgttcacgacattgtataggtttcatgaatcccctgacctcaaggacagtttgctgataagcaaactaggagaataaaacgtttatatagaaagaggaaaatccatggcactcatactcctacctccaaccccatgctcatggcagacatcactaatcaatcacagtacttttgatcactgaaacccttatgtggtcttagaatctttaacaggacactccaagaaatcactgctgacagccaactgatttgtgagataaggtctccatgcatctggatcttccatagaactgatagttgcacagcataaaatggtgagggtggggccattgtgggttgagccaccaaggaaggccatccaggcctggatgggccagaacaaaggtacagatgagagaacgcacagggtatcgtgttcaaggtagtgagtaactgaggatagtcaaacggagcagaagaagaaaggggcagcaggaggaagagaatgccagtctcgcacgccctctcccacaggcctggctcactgagattcatgagtatgcccagagggacgtggtgatcatgctgctaggcaacaaggtgagtggctccggggcagggtcagcccagccctgcacttcctcagccctagccggccccataaccacccaagaacagttatctaggcatccttcctgaaaaggactctgcagcctccagctcaggggtcagacatatctggaggcttctgcccatcccatctgccccttccagggaaagtccaagttgttgcctgagaaatcaaggggtgcccagttctcagcccccattagagcagagtgaacagggtcccaggtcaggggctaagagtgcaaagggttagccccaactgctgtcctattccaagaccctttaccaaaggtgagatcccagagctgggagctacactgggcagaaaccctggccccaggccaatcacacctgcctgcagtcccttgggccaccagcagagggcaggcaacgcctgcttctggggcaaaatatgggcccgctggggcggaggcctccttccccagagtgacccatttgggcttgacaggcggatatgagcagcgaaagagtgatccgttccgaagacggagagaccttggccagggtaagtgattgtctgtgggacagggtgaagggtgggggcaacccgacgctggccctgaggacactctctcccgggcaggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 379 - DNA, 10119 bp, Homo sapiens
gttcctgcgctctccttcgcctgcgggccggcactgctcacctctcgtccagggacatgacgggcacgccaggcgccgttgccacccgggatggcgaggcccccgagcgctccccgccctgcagtccgagctacgacctcacgggcaaggtgggtgggcctcttccgtgagacccccgccctcctcggcgctagccccttcctggctgcgtctgggttggactcagcccttcccccaggcagctgcgtctcccagaggagggagggagagagggtcaggacacagcctctggggccgtcccaagctctaggtgtctctgctggcttggtgggggcgggtcgcggaagatcgcaaaaactgagtgatccccccgccggccccaactcagttctcttctgccacactctggcaaatatgagcccccgggagcccatgcttcttggtgagggttaagcgcgcaactctcggggctcaggctgggaagggctgggagatggggaccgaacggagactcggagaggacgtcccctgctggcagaggaactggcgttaatgccattttccgagctaagctcttagttgagatctgacatccaggtttaaggcctgatgtcccccagctgctcccctcccattccacccgctggaggcactgcctcccaccttcctccctgcagtcggaagccgctcctcccagaaggatgttgccagccggcctgcaggtcacttgggaatttttcgaacctgagaaagatttcagtggttggtctttcgcatcccgcacttgagagagctccagggctgctctctggggcttgctccctctacaggggtgtcctgtatggaaacaggtagggacagcagtggactggtctgtcgccttccatctgtgtccttggagtgagcgggtaccagaaactgaaagaactgctgagggagcctagagcttccactcttcctctgcagggttggggatggagtgagggctgtcctggattccgctgcatggccttgaaggagacctgcctctctctgggcctcggtttcctccccgacaccagggctcacccttgctgggagcctcagcctccaccccagtgtttcgggggaagccaccctgcaagtcatccgcccagagccgttgagataggcgtcctgtgtgggcttgtggcaggaaatgggcccctgcaccctcggagaggaggagctgctgttggccaggccccaggctgagggggactgcctgaccttgttgccctgcaaaccagctgggttgtttgcctaggaggtggccaggctaggcagctgtttgtgtttggtggaatcaccgagctgggtgggtagctggcatcgtttgctcaaggcagctgtgatctgtaaagtacacaaagactggccctccctccctccttcctgctccagggctgggacccaggagccagggaggagtgcaggctccagaaagctcctatcccccaccccttcatctgttccctggccaagcggcattggccggagagttggtccccagcctccccgggcctgccccaggggagtgagtccaggaccctctgagaaagcctggcaggagctccttggaccagactaggggtgatgtggcccacaggcagacagttcccaccctgggccactcttccctgggtcttaggtgattcaccacgatgatgggccctagccattaacagactctagaaatacctcaaagacattatccctcctccttctacccactatggaaaccatgccacagaaaggttaaggaatcttcctaaagtcacacagtaggccatttacaaatcaagacccatccttcataccccttctgctcagccacccctgcctctccaccagagttaactaatgccagtaccccatgcccacaacaggaatgcctttgggctccactgtcaatttcagagcctcaaaaataattcaaacctagtccctgcttaacccattaagccacctaaccagcagctgggaaattccagcattggatctagacccctgttatccaagattggagaacagtgggacaaagtgctcctctccaccattcctgcgtgtccctggggaagatgagcagagcagagccagacagtaaaggagagggccacgccccctccacaggttacctccttggtactcctgcccgcactacccacagcaaccccgggatgccgatctgcagccacatgtcccatgtgggaggtttctgctgaaagaacttccaactacacatctccccacttcagtataaatttcaaccttccctaattcatgcaaccttttttttttttttttttttttgagacagagtgtcgctctgtcaccgaggctggagttcagtgatgcaatctcggctcactgcaacctctacctcctgggttcaagctattctcctgtctccgcctcccaagtaactgggactacaggcgtgtgccaccactcctggctagttttttgtatttttagtagagatggggtttcaccttgttggtcaggctggtctcaaactcccaacctcaggtgatccgtccaccttgggcacccaaaatgctaggattacacacatgagctactgcacccggcctcatgcaaccttttaataaacataaaatgtcattagaaacttccagtcaggcgcggtggctcacgcccgtaatcccagcactttgggaggctgaggcgggcggatcacctgaggtcgggagttcaagaccagcctggccaacatggagaaaccccgtctctactaaaaataaaaaattagccaggcgaggtggtgcatgcctataatcccagctactcaggaggctgaggcaggagaatcatttaaacctgggaggtggaggttgtggtgagccaagatctcgccattgcactccagcctgggcaacaagagcaaaactccatctcaaaaaaaaaaagaaagaaagaaagaaagaaacttccaaataaatgttgtgacacaaaaaaaaaaacccaaacaatattcattatagagtatgcaaatgaccatgccccacccccagcagattctgatagactcccttgggtgggaatccttgtccaatatattgacacttccctttcctgtcagtatagcccagcccatgcgtgtactcacgagcggacgatggatgacacaagtacacagagggacggaatccctgcatggtgtggctatgggcaaatgtggccactgtctagattgtgcaaatgtggtggttctctggggccacagagcacacttggggacctgttcatggtgaggtctcaactccggcctctaggaacttgaatgaggacaggagggtcagagggagagcctaggaggctgagccaaggagcgtggagaggagagacagggtgaagatggcggctggctttctggaagcaggtggcctttggtgcggtcagcattcgtgccagccccctcttctctgatcctctccatgtgtctctctcctggaatcccagaagctgcccctgactccccattaactgcctctgcccctaccccctaggtgatgcttctgggagacacaggcgtcggcaaaacatgtttcctgatccaattcaaagacggggccttcctgtccggaaccttcatagccaccgtcggcatagacttcagggtgaggtggctgcaggcacttgcttccagcagagagccagggctgtggctcaggcatgggggggttgcccccaccttgctcaccctggctcccagggactcccgaggctcatgcctggagggcacacaacccgctcccccaagaccacagaggtggccgggtcaaaggagactgggcaaggttggctccttgcccaactataggatgcaaaaaaatgagactgagtcttcgattccagctccattcctgggggacttctcccaagcagagcagccgcaggcacggcataagctgaatatcttggcccacagagcccctgctcattgctctcctacctgggcccctttggaaaggcctcaaaggtcaatcagtctttctggagttcccagaaagcacagccctgcactgggtttaagagctgggcttgggccgggcatggtggctcttgcctgtattcccagcactttgggaggccgaagcggtcagatcacaaggtcaggagtttgagaccagcctggccaacatggtgaaaccccgtctctactaaaaatacaaaaattagccaggtgtagtggcacgctcctgcagtcccagctactcgggaggctgaggcaggagaatcgctcaaatccgggtggtggaggttgcagtgagctgagatcgcgccactgcactccagcctgggcaacaaagtgagactgcgtctcagaaaaaaaaaaaaaaaagagctgggctggccatgttgggagacagcagctcaccagggaccctccctctcaccttgacgactccatcttacaaatctgcatcagggatgctagacgctgcacacctgaagtgttcaatagagaaaaggtctcaccctggcaggtggggctctacagcttcaagcaggcagaaagcgaacacttccttcactagagaattagtgggcagctaaagaaaaggtgctgctgcagatgtagcctcaggtccccaggatgcaggcaaacaccccatctccaggggctcggtcacagtcccaaggctaggctccaggagagggagaccgaagtgggaaaagggcagggcctccagcagcaaccagccctccagccctgggctgcctgatccctggagagagccaggatgtttctcaggctcctcttgccctgctgttgtgagaaggcagttacagtcctcagaagggacgactccacagtggaggtgtctgggtatggggttcctgctgccctgatggtatgatctggctggagacggttctggggctcactgcacccactctaggcctggagagggaacaagacaggacgtctgcagagctgaggagccacatgactcctgccctcccatcctctgcctttttctctttcagaacaaggtggtgactgtggatggcgtgagagtgaagctgcaggtgagaccagaggctggagttggggagggaggatggaggacctgcccttccttctcaccctgaaccacaggaggcctgcagccctgccctccgcctggggcaatttcctgtggggcccacgggaggaaatggcttttgtttatttgacatctgcagaaaaagcagttcccaggcaccctctcatctatgaacagcagctccaaatgccttcagacaagcttagcctccatccatctcctccccagttgccagggctttatctgctcttaggagattggacatccccaacccctgagctaggggagaggagaagattctttttttttcttttcttttctttttttttttgagatggagtctcgctctgtcgcccaggctggagtgcagtggcacaatctcggctcactgcaacctctgcctcccaggtttaagagattctcctgcctcagcctcctgagtagctgagactacaggtgcatgccaccacacctggctaattttttgtatttttagtagagacggggtttcactgtgttagccaggatggtctggatctcctgacctcgtgatccgcctgcctcggcctcccaaagtgctgggattacaggtgtaagccaccgcgctcggctgaggagatgattttgaacgagcttgagaaatcagtaactgctactgtccaggtcattggatgctcaggggctcatgagaacctaaagaagaaaacagccccaccttcccacagatatctcatacaacaaagcaggcctgctccacccagcacattccttgcacctgcctccttctgaccatttctccatcccatcccttcccagatctgggacaccgctgggcaggaacggttccgaagcgtcacccatgcttattacagagatgctcagggtgagtccctcgcaccctccaacccctaccccagccccttggtagcatccgtgctgctgcctaagtcccctctgtgatcctctcccctccagccttgcttctgctgtatgacatcaccaacaaatcttctttcgacaacatcagggtaggtcctcccttcccctgactcccacccataagcagccaaggcaaggtctatgcaggctggggttgcttcctgccctgtggaaagcgggtggagcgtggagtcctcctgccttctgaaaaacacctacttgtgactcagaagtcatatctgctgctttgtatttggtggccatgtgggcatgaaggccaagcaggctgttgtgaccctgtgccacctgcatagccctcactgtgattcacgagtgtgtttcgtgacaaagtgttcagaacagcccccactccaccctggataattatccacagagaccaagggaaaaacacaaccagaaaagtccacacatacatccagggcaagttgcaagaaagtgactcagtcagacagagtgagtggttgtatcctcacaaccaaactattatagagacaaaaatttgataaattcaagcaccaattttgttcacgacattgtataggtttcatgaatcccctgacctcaaggacagtttgctgataagcaaactaggagaataaaacgtttatatagaaagaggaaaatccatggcactcatactcctacctccaaccccatgctcatggcagacatcactaatcaatcacagtacttttgatcactgaaacccttatgtggtcttagaatctttaacaggacactccaagaaatcactgctgacagccaactgatttgtgagataaggtctccatgcatctggatcttccatagaactgatagttgcacagcataaaatggtgagggtggggccattgtgggttgagccaccaaggaaggccatccaggcctggatgggccagaacaaaggtacagatgagagaacgcacagggtatcgtgttcaaggtagtgagtaactgaggatagtcaaacggagcagaagaagaaaggggcagcaggaggaagagaatgccagtctcgcacgccctctcccacaggcctggctcactgagattcatgagtatgcccagagggacgtggtgatcatgctgctaggcaacaaggtgagtggctccggggcagggtcagcccagccctgcacttcctcagccctagccggccccataaccacccaagaacagttatctaggcatccttcctgaaaaggactctgcagcctccagctcaggggtcagacatatctggaggcttctgcccatcccatctgccccttccagggaaagtccaagttgttgcctgagaaatcaaggggtgcccagttctcagcccccattagagcagagtgaacagggtcccaggtcaggggctaagagtgcaaagggttagccccaactgctgtcctattccaagaccctttaccaaaggtgagatcccagagctgggagctacactgggcagaaaccctggccccaggccaatcacacctgcctgcagtcccttgggccaccagcagagggcaggcaacgcctgcttctggggcaaaatatgggcccgctggggcggaggcctccttccccagagtgacccatttgggcttgacaggcggatatgagcagcgaaagagtgatccgttccgaagacggagagaccttggccagggtaagtgattgtctgtgggacagggtgaagggtgggggcaacccgacgctggccctgaggacactctctcccgggcaggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 380 - DNA, 10119 bp, Homo sapiens; identical to SEQ ID NO: 379

SEQ ID NO: 381 - DNA, 103516 bp, Homo sapiens
tgacacttattatccttcagtctttattttaaataaggcccctgtcctttaccctcccaaagtacttttagacattttccttctgcccagaatcctctgcccggtcccctgtagctagtgtccagacactggtcacagacctccactgagcccagttagagcgctgacctcccatctcaggacttcttggcccttgcccattgccatactctactgtcagattttaaaactgctagaccatgtgccaattcacattgacttgtagccactaggaccctgtgtctttttctattgtgcttgttcatggccaggaatcaacgaactttggacagacaatcagtagactttgggtgtggccttggtgaaggcttcccactttggtgacttgcatgtgcccctctttgttgagggggttttgaagcagcttctgcgtcattgggagctggctgctgcgcccagcctgaggccctggaccccttttgcaccatcctaatttcaacatccagatgtcaattcagaaaattattatatcattctaatgactcaaaacataaaatcccctcttttgtctcatgttgaagagctgatgacatcggacctatcaggtcagacttattttcctagtcagagactgaatggcatattttcaaagcacttcgtctaaattgcatggcacacaccccaggagcccaaagatctggttgttctcttgagatgcagagaggaggcccacaggtggcggaggggtgaaggaggaggagccaccacttccgaagcatcagaatgtcaaaatctaagttttccacgaggtcagcagcaggtgtctcctggtctggagagggcatggaagtggccacaggtctggacttctctgggtggatgtgagggagggtgattgaactggaggagggggctggcttgagaccttcctgttctatgttgggggggatactgagggtccgtctcactgggacgaagagggggcacagatgcaggtatgcccaggtacctgagtcccagccaaagcggcaaagccagacctcccgggattccttgagtttggacaaagggtgtcccgacgacgataaagagccaggagcagagagccctgcatcttgcctggggccccttgtatctctggctcatggcctgtcctgggcacggggaggaagggagacacccgtaataataacagagaccgcactggactatgggggatcacaatgggtttcagtttgattgagagaaaataaggtaagggacacgtgctcgcctgagtctctggagtaagagtcacgccttggagaaggagggcagccaaaggccacgcagaaattgggggttcaaggtttgcccagccggccccaaaggtgtgggggtccacatggcctcacccaggggccagtggggtggctttgctcatttgagggtgtgcagggtacatatgtgtctgccccgggaatccaagtagccccagtgcgctcctgccttgcttccctagagcgagcccacggtaccatagtcctcgtgggatgaatgcatgaatgatgtggaaggagccagaacagggctgcagacaggatgctctctcatagaaggaccccagagaacttcccctctggagcctgtgcggctggttgagtgtaaacgctgagtcatgctcgctgcccagctgtgtggcaagggcactccctaggcactgagcagccaccgccagccctgagggctgcgggacaacagagagccgggcctgcccgaggcacggcccctgaaaagtgtggcccgccaggtggcacctatgttctcttgcccggcgtgggtgactacacagttgtcatttacgggggaagtagggcacagcagaggtgaacatgaggatgatgctgcgtctgggctgtatccagggaaccagctgccggacaaattggaagggaccttcttggcaggacaggtccagttggtggcctgaggtggggttgtggtgggccttgtccccctgcagggctgacccgtgcaggtgggatcatccttcctgaggagctgccctgcccagtcccgttgccttggaggcggtgacatcaggggcccctgagccaccaggttcctccatcttcatgtggccaccacggctgttgcagagtccacggtaagagccaggacgtggcttccaggcaggatggggaagcacctcccactcccacatggacaaagatttctttaaacggagccaccagccatgcctggtagtgggtgccctccctaggcaggcagtgctggctctgctctttcctgggggaagcccactgctcctcctggggcctagtccgtgggacctgcccagccagccttgggaggggcacccctgggcatgtggagaggaggtgatgaggcgctcagatgtcgaggccaaggccaggtaggtggcaggtgagacaggcccttcagacatgagacccgagtgatgtagataagaggtatgttcccctccagcccccgcccccaggcaaaaggggaaaagacacacagagaacaacagaaaacagttggaaaccccaaagggcgcttgatgaagagctggagctccccgccccccgtgctccgggaggaccaggagacctgctccatgggccaaaccgcctttgcccatccctcccctgacccctgctgcacggttccaagggcttggtagggcagcctgaattttccctaactcccactcctaggaaggtcaaattcaccttgtttgcctccttaaaaattcacaaatgcaggactgaggcttttcctgaaaccagagccccggcagccaaggctcaataaaatactgtttgtgtttccaggcactggggtgggagcgaggctcccagttgctcagagttaaccggccctttcccgagtgagaccccgcgagcactcgtcaattctcccatcaccctccatcgccgcctgctgggggggcctgaggtccggagctgctcttcctcctggcagcccagcctgcaggcctagtgctgtccaaccacagcccagagggcaaggcctcccaaagtgggcgcttgctgagcccctggccagcctcccaggaccctcagtccccacagcccccatccagctctcttttacaccttcccctcccccatctcagaacatgggagaagccgggcacactggcgtctgcaggctgcccttgggctgccacggggccctgtttgcccagcacagagcctgccgtgctttgacccagcaagtcccaccgcaccttccagaggcactgtacagcgtgcatctgttgtcagtacagttttatttgctgtggaatccatgagagccggaagcatcgttggggccgtggctagcagagctcatggtgaccagtcctgggcctgaccaatgggtgattacatttaaaaaccaaaacaaaacaaaacaaaataccaagaacagatcacttgccatggacatcagtaatctattggtaatggtggaaatttcatgaaaatttcccctaaaccataacaaaaactgtcctccttaccccaaaagtgctggaggaaagatggttgcatgacttgacctctctttgaacttgaaatgctaccttcctacccggaaatgcgacacactatacttaaaaggccagatggctgcaggctgtttgcacccctggctctgcccagggacacccctctcctggttctaatgctcagacccaggaggcagagtccgcagcccgagggagcttcaaggccgaggggtaggacctgcagggcccacaccacccttctgatggagagctttgcacatgcattcacacacacatgcctggcgggatcgcagaggatgggtctcgtggcaggagtgggcagaatggggtgcattttacagaagagtcacagagaggctcgccctcggcggaggacacacagctgggtgggcgtgtgggagtgcaggtgtgctgactccgaaccaagggagagctctccgtcctgagctcgctgcccctcacgatgcacacggctgatggctgaggtcagcggtctcttccctgagtggcaggtgtggtccctgggacttcataaaccatcctcatgacagttttacacttagagtccccaatgcactcccaggaggtggcctgggcaggcaggcatcattattctcatgttacaggtgaggaaactgaggctgaaggaggcagaaggccacatacccggggagaatcgcaggcagcaggggccaggccccttccacagcactgcctctcacccttctcccgaccaacccccaagggcatgcctctggcttcatgaaccttcgggggaaattagctttctagtttgggggcggttccctctgactggagacaggacagaatgctttcacacccaggaacggccgtgcagcctggcttagaaacaagggacgaagtggatcctgaggctcattccctggggactccaagaatggggcaggcccagctgcgcagccagtcctggctccactgacttaggctgcacccctgcacatatgtgtgtgtgtgtgtgcatgcgtgcgtgtgtgcatgtgcgtgtgtgtgtgtgtgtgtgtgtgtgtgtgtgcgcattttcccaggggacctctcctccttcctctgaggcaaagtggcctgcaggggcccctgcagagcatacagggaggtgcttccttccctctgcccagcgagcaaagggtggagccttggcacccccagcaaccccctccaagggtggagccttggcacccccagcccccaccccgcaagggaaaggggaagctgcacgaggagcaagatttcattccccagagggcacagcttgggcagattcccatcatctaggggctgtgccccacatctatttctgccaaacaagaagcagacgagggggctcaggggggcgggcctcacaggaacggaagcaccaccccacctctattccctgtggcctccaaaagagctgggcaacctctgccagccactaccccttagcccaaggggagtcctcattccagagccagcatcttcatcttgtcctgatgccctgcccacccccgccgagcttcacactgggctgctatggaaaactgaaaggtcagagggtggaggtcctctccctcctggacatggaaacctccccctgcctggcacttcggctggtcaggaacagtggctgctcatggagctgccctcccaccttcagaccctcctcctcccccgcaggggtgggctggggccctccctccctctgtacttgatccatgacttgtgagttctgagtcctcagggccgagacttgagtcagaaccttctggagcagtacgcatttcccctctgcacctggtgaggacaccaggctcctcgcttcctccccagatctctgagtgctcacccgaccccccaaccctggcgggaccttccagggctggcaagcatcgagcctgaccacgttgcctcttgggtgccagcacgcccacatcaaaggtgtcccctcttcccagaggccctgagcaacatcgggcgacgctgtcagcagacattagcagcagagctgcaccacgcatcaacttttaagtatgcgcacacacgtacgccagccaataacattaagtgtcattttaaaaaatgggttaaataagcagcattgctgaggatggccgtgcagggctgattatcccctatttgcacgttctggcggtgggaaggctagaagtctaatgactgaattatcgccctaatgcctctcgctggctgggaataatcccggggcaacagctgccgcggggtttttggctggtttcctctaattgcatccagattaagggagttgtggaggggcggggcttctccatcccccgcggagcagcgtctcctccgccaagccctgaacacccagctcatggcttccgaggtcctggctggtccgagaggtgcagacctcactggggtccgggccagcccatggggagcgtgaggtgcgagcagtgcacggtgggggtggcacttggtgcagagatgcagctgattggtccgggtcaggtcttggggagcagcaggggtgagaagctgtagggccaggagactcagaaggaatgccttctactaggaccttcccaagtgaggggagccctggacctgtctatcctcttcctccctcccaaacacagcggttcaaaggcacgaggtatctagtgaaatgctaggaccagggacgctattcccctggagcaggcgggtggggaaggagtgctccaaagcaggcattattaggacacagactctccagagtcccagttgtttagccctccaaattctcagcctactgccacccgactgtgcagagcggacaataaagtggcaggcctgtcccccaccccttaatgctgagcccagccacgtgacttgctgtggccaaggggagagctgcaggtgtggtgtccaccaaggcttggaaaggcacttgctgtctctccctccgtgcctttggctgtgccatggctggcctgcaggagggatgcaagagaccacagagcagggccaggtccgacctctgcaccatgagcatcccctgggacttaacaacccactggccctaaacaaacaagcccagcctagaccagaagaatcaccctgcccagactgctgactcctgccctagatcagtgctgactgttgcaggccaccgagtgttggcggatttgttacacagtattgctgtggcaatggatataactggtttctagcggagggtcagggcagaagctccagccacctccctagcccagaaaggcaaccctctcttcccagaagcaacatggatgagaagcccaccccattcccaccacaggatcccccactgctagacagcaatggtcggtaccccaggatctgggcactgatggggctccaggacggtctcctcaaaaggctcttaggcagacagacctgggaacttggaagtacctgctggacgacctgggttcatggagaaaagagaagccgagaaggtggaggaggccggtaagtggtgacctccgctttcctgctgaggaacactgctttgaagtggcatggcccagcagtgcccaccctccagggagaaaagctttgagtgggaagaagccttctatcctggtccccatgatggttctcagcacatcaagggtttttctccccagaaggacgcgatggaggatttcaggagggatttggtctcctcgctcaaggagtggctttctgtgcaaatggctcgacacttctaagctggctgggagttctcacagcatagatcgcacacccttttctgtccatctctaaatcccagaaggagcaactgatacacaatcttttggaagagggagagtctgttgggaagacctcattcccacatagaaggcagagagccctgagtgctggctccttcactgtggtcgctctcacgtccgaccacctgagaagctgacttacatatctgagttcacaggtcctgaagggaagtggaagagtctaactatttccaggtgtccttgtcttggttggtcagctaatacactaccacgtccctgggacaaagcagatcattgtcagaggatcttgcaaacacaaacacgcacgcacgtgtgcatgcatgcatgcacgcagggacacacgcacacatcgacccattcaagccccagctggttgctgtatttggtggagttgaccttaaacaacgccaaggaacctcacgtagaagacccccagcaaagaaaaaggcatcagatgcttctccaacagcctgaggctcaggctcctgggcagacagttcccttcgtgtaccaggaggacgaaatgtttaaacggataaacattacaagcgccagctcctcaagcctgactgctcttccgcctctctatccccacatcggttgggctttttatcttttgcttttcttttatggcagatgcctttccatcggcatcccagctgtggctggggacgttttgggaagtgtgtttggctcactccgagagaacgaggtctcaagaggaagtgtgtctggcttgcaaagatgtccctgggcctggacaggaccccgctgtgttctgcagccctcgacgcagtgggtgagtgaggccttcctctcctgtctctgctttcctcattgcctggcgacgctgtctggctgccctcgagggtggagcaaatcctgggacatgttgaaatcctccagggcagccagcaggagagcccagccagcctgcgtctcaggtgcggtggctgcgcgttccactgcagcgtttcaggagctgactttcctctgggtggctgtagatctgacttctgtcacttccagactctaattttgtcattaatatgaaaaggttcctctcatgttgcccaaaagcattttccttaggtttctaccgtcccctgtccccttcacgcccagccccaccccctcccgtgcccagggcctctgaggaggtcccctcaacccctgtccggtgtcgggggcccgacctatctgcggaagccgaagccgtcctgcggcgtctttgggcccttcttgccttccctcagggacttgggggaaggcatctccaccgtgcccccgtagggacagctctccgagccgggatggtggccggtgcactccaccgcgggcatggagccgctgtcccacatgcctgacccgcacagcttacacagatcgtgcaggctgcaggggatccggggcaggaggcggaactggtacagcaaactcctcgcctgcagacagaggacggggggtgaggaggggccgggggacagcctggcagcctagggtccccatgggagtggccaaagacagcaacagcagcaacaacggcctgcacctcgggggctcaccgagtcctggactgagggctctgcctgcatctcccaccatcaccggcaccacggggccctgggtcttaggtggctgcagtgatgggacccacaaggcactcgggctgtgctcacaggtggctcgaggtgaacaaggcccttgaatgggcttcattcaggagggtgaacaggaccaacaccagcacagggccgggtggcgtccagccaagcccacctgtccctttggcagcacccctctcttcttcccccgcaccttgctccaccccccacccccagcagcctctcagctcctgcaggatctgtgtcctgtgccagaggacaccaccgacctcgggacccccgctcagtgccctgaggaccaccagagagctaacgggcagcatctccaggaggcgtctgggaagtgggggagggggccaaagcccaaggtccccagtattctggccaccctgtccccaggtccagcctccttctcagtgttcccagttctgggttgtaagcgaggtaccccagggtagggaacctgtcctgtccgtcagccccggtgaattcgttccctcctcagccagcgagggaggctcctgtgtcagggctggcaccccaggaaagtgaggtgacacagccaggccgagacaggtgctgaccacgaggccttagtggggagcccccagtgctatgggtgggggagggcacgtgctggggggccatggtggggatggggctctgggggcggggcccacatctggggcagcctcacctttctgagaacgagctggtggggtggggctttgggggcggggcggggtggggcccacatctggggcagcctcaccttccggagaacgagctccccgttcatgtgcatggccaggtttccgaagtgcaggagcatctggtccgtggccagctgctgctcgatgacgtcatccccgtagatggccacgatggccacgcagatgaaaaggtggaagtagtccgtctgtggaggcgggtagagttcagacacgggctctgaccgagccccaggccctgcactcagggggaaactgagtgccagggtgcgagtgagggctccagggcgaggggtctgggctcacagcccagctcgggggccgtgtggccctgggcaagctgcaccgcctcttcggccctaagtttccccacctgcacatggggtctgtcccagtacccgcatgcccaggctgctgtgacatccagaggggacgatgctgagctcagcccccacgggctgctgctgctctcctgggtggtgatgtgggtggtctccatgacagggtgggggtgggggggtacaaagagcacccttcctcagaaggcctggcctgtgctcatggggaggactcatttgtaatggtcctgagcaacggtgtgtgcggaagtctgggtcagaactcactccagcgggtcatggaatgcgcctctggcagccacccacgggtcagcctgtcctcctggctccaggccacaccccccaatcatgccccagagatgactctagggtttgtggctagaaaagtgggaagatcctaacagagcgggcacagcagctcacccacagggtggctgaaatgatcgccctgtccttgagcctcttttcgggcatactttgaggactccgcagccctccctttaaagaccgcctcacggggcctgccagcaacgcgctgtgtgcagcaggaagcccacgccaggtcctgacggctgcatcctgtgtgctctccggcctggccgcctcaagacacgccacctttgatgcacacgcgcttccggaggcacaggaaggacgggggcactgggaagtccatgtttagtctcctgacgtcgaccacacaaaccagacggaacggtgtccccggcccaggctgagcggagcacaccatgagggcagaggctacaggtgactcccacgccccagcctgctcctggagagaccatgcaccaggctgcccggctgcttcctctgaactaatctgggacggtcttgttttggctctgacggatccttttgcagtgatttgaactgtggctggtgcgagacacagcggaggggttgcaggaaggtggacgcccagcttctctgggagaggaatgtggggagggagagggagggcacgatctccacagcctgcacagcataggcagatttcagttcccaggacaggcagggcgtagggccgtccagccccaccacatgctgacagcggacggatagcatcaaaagcctttctcgctcaggggtcactgaacagttaaaggcctcacctggcagcaaccttcccattccacagagctcactctcagctcatcagcagcccacccccacccccaccccgtaatactaccaaattgatcgagggatgggaccgaccgtggctaaatcaagcccacagtctgaaaacaacagaaacttgctttgtggacttccaacacaatggcagccaacagagatcccacgtcacgtgggcctcccgctggaattctgactagatctcattacacttgggacacagtaggtgtccatgggaaagggacccatctgccgggccacgcgctgagttcacgggtaacatcagcctgaacgtaaaggaatgagggcggcaaatctgccactgggaaaacgtgcaatgaggcacgattttttttaattcgggagtggtgggaatgaagcctctcagaccgtccatgccgtgcttcccttcgttaatgcagatcgtccaccctgcacgtccacgtccagcaggctgagccaggagggaaacctagacccgggccaggggcgagccgatgaccgcatgcaaaggcggcgtgtggtaccggcactcggtggcttcagactcgctttcatcagacatcagccccctgcggtgtgagtgaggacaggagacgctgacgcaaatgtcttccagcagatgggtgtttgcctccatcttcagggttctctgacggaggctgctggagctgccgtggtggatagagccagctcctgcaaaagggtccagccctcctggatgcgtcgatgtgagttttttttttaaaaggctgatggactcaaagagacttgcttatcttttgacatctccagcttgtccctagtttgggcgttaaggccatgtgacagagccagtgctgtgctccaaggggaatttgctgagaagatgctggtgacggtggacggagagtggaagtcggtatcactgattggggccctctggaggggccgacagggaagtgggatctcaggccctttctctgcacagcagggtaacgggtgagtcggccctcgtggcagggcggtcccgagggggtggagcggtgctggctcacgctcgtgggcaccagcgtcctgggctgctgtggcctagtgtaggccccccacagtgtcactcacactgattggttgtgacaggagggagctcagccccagaaagtggtaatgagtgcagtcagcgggcaatttgcatcgatttcagtgactggggaggcgagctgtaaggtctgaagccagccacgtgggacgggaaggcagtcgccgtatggggggctaatgtgtggctgtgggtggggggcggcgaggcggacaggggcagcaggcagggtggccacggtggttcaggggccatggtcccaacctccccagccctggcccctgccctggtcacctggtagtgggcccagcaggcctcccagatccgcagcgcttcggcctcggggaactcccgcttgaagcacagaaggagccagcggtggcagaagagcatctgcaggccgtcctcgcccagcgagaccaggtgctggtagaagcgcacgtgcgtcagccgcagcagctcgcgcaggtacagctgggggtgaggccgtcacgcgttagttagctccggtcccatgcggcctgctgcccaggaagcccactcccactggggcccttccctgggccaccccagcctggaaaagcacacccaggggcctctacctgctgcatgtgcctgcccccccaacgctccattccgccgctggaatcggctcacacctgcctctgccagttcctcccagatctgactgttccggaggctgtggtgtggtccagggtgaggcagagtgttgtgcccgggcgtggcaggacgctggcagccgctccatggccaggaaggctccccaccctcagtgcacacttgggggctgtttcccacgtccactcctcctggtgaggtgagtggatcatccagggagcccccccacccctcttcggctacgctcacccagatctatcatcttccagagctgttttagggcaggaaggggacgtatctgagccccaggatgctcgattcctgccattaaggtcatctcccaatgatgtgggacaagatcggggctatttctggcagcactcgggcccaggccgctgacttcatcaatgccgctggaaaatcaatctccagcattcagtgagtcacccagccatgcgctgccatgagccgtcagaggcgaatggcgttggacactgtaactgcctccccaagcaatgtggacacccgacgtcacacacacccgttgatgcagagtgagcaggcttggctgggttcagccccccggcccaggtggagttagatcacagctggggggatcctggggcagagctcggggccacatgcccccttcccacacaggtggcccattgttcccacgggagactgcgctgaagctgtgcggccagccctccgccctgtggcctacggccaggtcaagcccactcgtgtggctgacccccttgcagatgctccactcccgccccctgtgcaggtgcctgcacctccctgcttgggctcctttgccttcaaatcctctctgttggcatcagctctcccagcctgtcatcagcgacccactaacagtcagtctatagcagcggtccccaacctttttggcactagggacccgtttcctggaagacaatttttccacggacaaggtagtgcgaatggtttcaggttgaaactgttccccctcacatcatcaggcattagattctcataagcagtacacaacctagacccctcacatgctcagttcacagtagggttctcgcgttcgagcttctgtgagaatctaatgcagccgctgatctgacggcaggtggagctcaggcgggaatgctcgctggcccgtccaccgctcacctcctgcggtgcggccagttcctaacaggccatggaccagtaccagtcctgggcctgggagtggggatcccattctatgagacacactccgtggcctggggctggggaaccccgttctacaagtcacactctgtgtcctggggtggggaccccattctacaagtcacactctgtgtcctggggtggggaccccattctgagacacgctctgtgtcctgggggtggggacccccgttctatgagacacactctgtggccctggccttcaaggccctccatcagctccaccctcactacttgtgacgggtctggtccaggaagaccaggtcactcagtcccaccactgggactgctctgctcagcccagccttagcgacactcagggccagaccccacacaccctggagctgtccccggtgcaggagccctcttgtccttatcacgggcacctcccacagtgctccccgacacccagcgtcctctgctcacaatgccagcttcctggcccagccaggagggtgaatgtctggtgactgcacccggcaggcacttggttgacatgggtgatgtgtgctgagaacagtgagcaggtgccctggctcagccctggttcggtcccacacgctggccctccggcgctgccttacccagctgggctcagccccaccaccgacattcagtgcttcctggtctacatagggctggtccttttgaggaggccttgacgggagaggtgtcagcagggcaccccaggggaggggtggggtgtgaggactgccccagagacctcagggggtttcaggagcccctcctcttcctgtctgcactcagaagccctggctgtgttgactcctgcagggagcagcttagacacacctgaggacccattttctaaggctcagagggggctgggtgtgatggtgccacgtcttccttgccagccagggagcttgggccaggttgtcacgtgcaggggtggaaggccaccagagcggcccacacaacgcggcctctggacctgcagggagtcagagggccatccccggaggccgagataggctaagccgcccatatcccacgggcaagtcctatcctggcgttcccactgcccactgacctacagcagccaagccacgcatcaccacggcaaccccggctacaacgggagaggcaacacgggccctcacatgcccttggacgcacccatccccctgagcctcaccagttgtttctccatgtcctcgtcccggggtgagctgacgaagatcgtgttctgcatcaaacccacaaagcaccagaaggtgtctgactcatccaggacctcggccaagatgggcgccaccaggtccgacatcccttgggaatagccgacggcagggttgtacacggcgtagttcagcaggatcctcctgggaggcggtggagacagcagtgggtggggatgaccctcaccgcggcacactgcccagcctgcagaaccctgggccgtggaccctgccttccctcgcttgccttcacctcagtggaaggcagctgtgccaccatctcagagcccaagcttagcttccagacacacagacccttgctttgcaaaaggtaatggcctggccgggcgcggtggcccacgcctacaatcccagcactttgggaggctgaggtgggcagatcacctgaggtcaggagttcgacactagcctggccaacatggtgaaaccctgtctctactaaaaatacaaaacttagccgggcatggtggggtgcacgcctgtaatctcagctacttgggaggctgagactggagaatcgcttgaacccggaaagcggaagttgcagtgagccgagatcacaccactgcactccagtctggatgacagagcgagactccgtctcaaaaaaaaaaaaaaaagtaatggcctgctattagctgctgtctaggcccagaatcttgagagcaggggttaagggggaacatggctctgattttctgaagggtggactgcctgtgacaaggggtgggctggcagggacatttctgtgggctgctaattttgtgcaattatttgctaggctgtagcagaatgtcacagatgccagcctctggctctgtgtggctgtatgactacgggaccacccacggggagatggagggggtgcatggggaagctggtccatggttagtgtgagccaagcaaggacaggcttggtggtgcccaggggatagaggggctctgtgggcagggacctgggtggcttccctgggatgccatggctctgagatgccaactgacgtagctcatgagtagcgtatccttcacttctggggctttgatgtatgaacctggaagagagcccctgcagaaactcgctgggggctcatccacttcccagagcggtcaggtgaggcttgcagacttgcagatgggaaaggagctggctggggagggagtacctcatgctctccacattgggattgtcttccccccggaagaactggttgttccgatctgtccggaccacgtctttgtccacagtgaactgcacattacgccagaacgctctgtgctcctcgggagtcatggagagcctgtgtggagccgagcacccagccggggtcagcgggtggcacccagaggcatcgtgtggcgcacacactgcaggaagccacccttcctcccaacccccgttccctggacgggagctgggcggctgctgccggctgcagaccctccccggatgcggcggatgggtggcgtgtatccaaggctctccttgatattaactcagcctcacagtctccagcgtcccaggaaggagagcaagttgcagcccagtgggtaatgaggccttggccctggcccagcgttctggaggggagctgagcacagcccaggggcttcacccagtcccagcctcctggagagagagctgagcccagtcccgggttagcagatcccaagtgggacacagtctccggatgccttcacccctccaggccctgctcccagccccagccttcagctgtgggacgtcagcgcctagttaagtctgttgaacgagaattctaaaaccttgacatgtgagctaacgagccccgcagctccgaggcccgagtgcttggtttaatgactgcacttatcccaccctatcactcacgttcctgggagacccatttttgaaagaaactatgggtcacgaaacatattatcaatgctgaattgcacctcaaattgccttttcaaatgacattttcctccgcggctcggcggggtgggccgggctggccccggcggttaccttttctgctggatctcagagtactcctttcgcttctgcagccgcagcgcctcccgctcctccgacgtggactcgtggctgtaatagcgcagcaggaagggccagacctccccgcggattgacacatcaataccgccaaagaaaatggcctggaggaagcggcaaaagttggggaggggataaaatggggcagctcaaagaacccccaaatccccagagatgtgtgttttggtggtttttggtgcgccttgattcagatctctgcaatttgcacatatttacaaggggaaagcagtggccttcaattcccatacaggacacaaacccggctcatttcaatgtcaatgccccccctggggtggcgctcagattaacgtgtcgttctcacgtcatggcctaatccctggttttggaaatgctgcatttcactgcaaacccttctatgcaggctgacacggtatccccccaaaccctcgagggaggtgttgtgttttgtttttttttttcaacgcagcagctttgattgctttatcggtgtgttcacagagagcctcacacaagaaaacggggccctcacgaggaggtggcccgtgggtgcgggcgggcggccaggccccggccctccttccctctcgctcgttcccggttcccggccggctctccgcggggccagctgggcggacccggacctcaccttccgcagcttgtactcctcctccacctggcccagctcattcaggtggttgagccaggcggagacgccgagcctcttgtacatgctctcctcggggtgcgtctcggaggacggcagcttggggcggcggatggagaactgcatgcatgtcttatcgggggcgacctgctggacgggaggaaaactgggcaaaggtcaggatctcagccgcgcggcttcagaggccagcagtgcttttcccaggaataaaagcctctctctcttctgaaaggagggcaagggccgtcccctgcatacaaacccctaaatggcgagtgtaattaggcgcaattaaaatgaaaataccttcatcttaaaatcggtttccctctgcggctctctcctccccggcccactgtgccgccgccccccactctctccaaccccagccgcaaaaacggaatgaatgcctcgttcggcctaacttccctctgccgggagggcctgcaatgaattacatgtgattggccacatacaaagggatcgctgttctgcgagcagggagccagcctgtcagattgcctccgcgagcagtcacgaatccagggcaaaactgcagctgacatttaattcaaaaatcaaaggttgttcaatgtagggggaaaaaaagccatgctactgtaataagggaagccagcaggaggctctgcgggaaggaagggaattttaaaatcggccccatttctaataagcacatacagtaccttaaacagataattaaagagctcttattacatttgtacgtagattgagcaaaatatggcaggaagtcttgtcaaaacatgatttttcaagtgcagggcactgactttaccgaaagccctgggcaaaggtttcaaacccaaagttgctgctctgacggccaaaaactaccgtgggtcacaccccgtaagcccccggggcccggggaccccagacacaggacccaggagggagatggggcccgtggggggtggggagtgtcaaccgctgggcattctggggccgtctgctgggctacctggtctttgagctgcatctcggtgcagtatttccactgctggaacacgtcagacagcttgtccaggccgccgtggtggaagtggaaaaccttgtactggctctctcggctggcaacgaccagctggccgctggtgcaggcctcgtcgctgaagggccattggaagggggagagggaagcccgatgaatatgtaaacacgggggttttatttccaagtataatcagaggccactgtcgccaacctcagaagcaggaaacagtgagtcccagtggagttggctgctagcgggaggggacagaactacaccgaacaaaaaccaccaccccctttgccgaagatggcaaaactgctccttcctggggggccctggagctcctctctggagacctgccagagtggccttctccccaccaccccctgcccggcaacatggtccctgcagtccgggagacctgggtcccaacgctgagtgccctggaatccagttctgagccctggcaggccatgtgctaagagaacctcctgggaacagacctccttcgttgcgtgtgggtggaactctgggagaaccctccagggaaactcagtaaacatccgtcagtgctgtcagcccagccccggctgcccttagatgaaaggctggaatgtggctctgggtctgggaacccccccagcttctggacacgccggcttcttctaagcccgggcctctcattggtgatgtctgcggctgggcagccctgactataaggaggaggatctggtgtggggaatgactgcaggaaactaggcatcgcccacccatcacgaaaggaagggagcctccatccggaaagctgcggcccgtcccgcacaggtggccgagctccagagcatcccccggcgatcagagccgccggcagctgctaccctctgccctggtttggtttcttctcccaagccagagttgcaagcaaccgctggctaccatcacgctgaaggtaggggagtgagttcggtagctcacccagcctgagaactgtcagggagctgcagtggggaatcactgcccacaagatcagcgagggaggaaagcagacgcttgggaagactccatccagggccctgtgtccccaagccgtgcactgcaccggctgcaaagcccaggctgccagggaaaacacacacaggccaactcccaggaggcgcccagagatgcttcctacctgaagaaaaggcggagggagcgcatgtggcccaggtccacgcggaacacgccgcaaatctgctccagggcgcacacccgctgcggctcgtcccagcgtggggtctgcaggaggccgttgctgtccgggaaccgcaggccggcgtcggagctggacggggggctggtggaacaggttatgtgatgatcgccacacttctccctgcccacactacccagagggggacgggggtcatgggggagtcatttaaacctacgcaccaagcttaaacacacatacaggcacggctgaatatgccctgtaaacacctgtgaataaatgaatgtatgaaccccactgcacagttctacttccacttggatgggaaagcattttcatgatcaaattccattccacttcaatagaggcagtaagtcatcatcgtcctgacagccaaggtcacactgactggggttcctcgctgtgtgaccttggccaagccaccaagcctctctcagccttcgttttcccatggataaagaaggcaggagaataacaaggctgggtttccctacagcgtggggctgggctttactaaaactggttgttttgggatgattttagatagcatggggcttccgcgtggtttaaaccagctcactgtattcctgaaaagtactggttcagtttatgcttttggttaggaaacatttgggttctcagtactattaataacatcatcagcatttattaaaacactgactatgggcctggccctgagctaatgcttctcaggtgcttttattgcaattaatcttcacaaaaatcctctgaaatgaatagtggtattaccccattgtaaagaagaggcaactggggcccagagaggttaagtaatttgcccaaggtcacacagctggcaagtggtagagctgagattagaacccaagctttgtggcccatgttctcaccagcatactgtgcagctgtctgcagttcagcagtacaaccccatttattctgttattttttatgagtttgttacattccaaattgcaaaatatcttattatatggattcagccacctcacaggttaaatcttgtctcttgagattttttctttttttcttttttcttttttttttctttttttgagacggagtctcgctctgtcacccaggctggagtgcagtgtgcgatctcggctcactgccacttctgccttccgggttcaagcgattctcctgcctcagcctcctgagtagctgagattacagacgtccaccaccatgaccagctaattctatatatttagtagagacgaggtttcaccatgttgaccaggctagtcttgacctcctgacctcaggtgatccacccgcctcagcctccaaaagtgttgggattacaggcgtgagccatcgcgcctgacactctcttgagatttaatgtctagcaaatgtctgctaaaataaaaccggagtacaggcaagactcagctctggaccccaactgcagcaccccacagagactcagccgcattcaccgcacctgccttcccgtttgagctcagaacataaactattagaggcaatcaatccagaggcacttcctcctccaagaagcaccaggtctaagtaaataaagctcctttggagggttccagcacaatccctccccactgggaacttcacacagagaaacctgactggcctttctagagccctctactgcgtcaggcatagccctgggcctggtgagtggcaggtggcctttcttccccacctgcctaaggaagtcagccgaacaggtcctcccactgctggggcccctgggctctcaaggaaactgagtcaggtaaaactagatcagagatgggcatgtggggccatcacctgaactgccgtggctgcgccgcggacgggcccagaagaccgagggctcctgacatcttcccaagtggaccctgcgggagctgcgcttcagaatcgttgctcacaacacagggcaggtctcgagtctgaggccccaccgcacccatgggtgcccccttctgtcatctgctcattgaaccgcggggctgctgtgactgtgagagctgctgccccgtgtgctgcctgctggcccggcccacccagtggggccatcagagggtggtatcctttcccgcctcctcccccagccttcttaccacacccaacagcagaatcccccaaacctgcttgttcctcccagcacactgtggcccactcaccctacagggcaggccaaggtttccagaaaccagacagaacacagagactcgctttggcagtcacggatggagggccccctccctgctgccgtggccacagaagactggtcccctggagggccggagccgatttcaaaccaggcaagagtccaggacacaggggccaccacacacctcccccagcaacgtgcctccaggcaggagttggcttaaaccctctcgcaaccccttaggggcaaattatttgcattaattaatggattgattcattaattcaagatactgtgcttgggacctacagctggggttccataagctcaaactagagcgaaggtgatggagacctcagttcgctttcattggggtacgtctggcaggtaccccaggccctgtgtggtcatggaggacgaggtctggtgcccctcgaggccggctgctgtggggtgggggttgcatcgtgtctcttcatcttcagctcccagccctggcttggcgcagaacacacagacatttaatactcatgcctgaagtgaaaatgtaaagtgtctgggaattttgaagtcacagaaaaaaatgtttaaagaaaataaactacagggaaaacgaaatatgtacagtgttttatttttgcttatctttctacacacgtaaagcaatttagttttaagaatattcatatatgctgcaaataatttagcttgttcataaaattatgtgatgcattggaactaaaaggatgggttttgcaggcgataactcccaagatgctattacattagaaagatctcacacataaaactagaagacgctaaactttaagaaatgtagcagttcttcatttctatcattttctgaagatcacccaaatgtaaaagcagtaatgaaaaaaagtcagcactatcactggaaaacaaacacaaacactgggttctccctccaccacagtaaactatgccatgtcagatacagagatagagatttaaaagggcctcaaattcttcacagctcatcttatcaaggatagcacctgtctctccacccctgaatctaggtgggccttttttgaccaatagaatgtggcaaacatggtgttaggtgagttctggggcctaggcagcccctcactcttcctcttggcacagtgcaggcaagacagacagacgagagctcatgagagagacacgcaactggcagtcagcaccagagccccgacacctgtcaatggaggccgttccagaccctccgcccacccaagcctcctggtggctgcagcgacctgagtgaactccagggagcccagcgcaacagcctgtcccagcccagcccaaaccaaaggtctgtgagcaaagaagcggttttttgtttgtttgtttgttttttaaagacaaggtctccctctatccccctggctgaagtgcggtggtgcaaacacaactcaccgcagcctcagcctccggggctcaagcgatcctccagcctcagtctcccaagtagctgggactacaggcactcaccaccacatttggctaatttttgtattttttatagagatggggttttgccatgttgcccaggctggtctcaaactcctgagctcaagcgatctgtctgccttggcctcccaaagtgctgggactacaggcgtgagccaccacgctgggcccggtggtcgctttaagttgctgagtttgagggcggtttgtttcacagcaacggatcactgacacacgcaggacaagccagctctcagaaaaagcttgaaggggaggaagaaaccttcaaacatattgagctgtggttctcaaggttaccagggccagattttagcattatttaaaatacctaaactgctaaatttcctcttgcttttcttcatcctgagccttttaagtttgctgaaaaaagtcgatgagaacccagctgtaggtcccaagcacagtgtcctgaattaatgaatcaatccattaattaatgcaaataatttgcccctaaggggttgtgagagggtttaagccaacttctgcctggaggcacgttgctgggggaggtgtgcggtggctcctgggtccaggactcttgcctagatagaaactggcactggccctccaggggaccagtcttctgtggccacagcagcagggagggggccctccacccgtgactgccaaagcgagtctctgtgttctgtctggtttctggaaaccttgccctgccctgtagggtgggtgggacacagtatgctgggagggatgtgtaggtattggaggagtgagcagggcgtgttcggtgtgctgggttgggagaggaggctgtgatgggagaggaggctggaaagaatgacaccctttggtggtcccccataattgccaaaacctggaagccaccaagatgtcctttggtagtgaatggataaataagtttaaataactgtggtgcagccagacaagggaatatattactcatcattaaaaagaaatgagctgtcgagctgtggaacaacacggagggaacttcagtgcgtcttacgaaggggtttactaagtgaagggacccactgtgacaaggctgcaccctgtgggattccaattctaggacactctggaaaaggcaaaaccatggagacagtgacaagaccagtggttgccaggagctggcggggaggtaggaaggtgaagcacggagaacttttagggcagtgacacaccggcatgacaccagagtggtcacggtgacaggtgtctttatacatttgtccagacccataggatgtacaagaccgagtgtgaatgccgacaaactatagactctgggtgacaatgacgtgtgggctcatgagtcgtaacatgtgtcccactctggtgggggaggctgtgcgtgtggtgggggagggggtggatgagaattctctgtacccttcactcagttttgctgtgaaactaaaacagcttcaaaaaataacatctattaaaaaaaaaaaaccaacaaaacaaatgaatagccaaagaaactgggacacatatatgataaagattaacatctttagtatgtaaaaaagtatgtaaattaaaaagaaaaatataaatgcccaacagaaaactggcaaaaggaaaataaaaaaatttagtagagaataaatacaaataatgaataaaatttccaggcccagggtaatgaaataaatggaaatagaaacgggataacatggtggggggatggtttatgaaattggcatcaattaacaaattataaaatctagtgtggtaaaggatttggggaaacagacattctcattcagctcagggggagaaagaatataaactgaccaattttttttttttttttttgagatggagttttttgctcttgttgcccaggctgaaatgcaatggcaagatctcggctcactgcaacctccacctcccgggttcaagcgattctcctgcctcagcctcccgagtagctgggattacaggcgcctgccaccatgcctggctaatttttgtatttttagtagagatggggtttcgccatgttggccagtctcgtctggaactcctgacctcgtgatccgcctgcctcagtctcccaaagtgctgggatcacaggcgtgagccaccgcgcccagccctgaccaaatatttctgaatggcaatttggaaacaagatgccaaaggcttaaaaatgtttatacattttgacttttcacttccattcctaggaatgaatcctaaggacatagccagaggtgcccacaataaaggcatacatgcacagatgcagaaaagcattcgacaaaaatccaatgctcatttatgacaaacctgtctacaaactaggaatggaagagaagctcctcaagctgataaaggcacccacagatattccaccgttagcgtcatactgaatggtaaaagatggaattgttttcccccaagagcaggaacaaggtaagaatgcctctgctcccaccacttctagtccatgctctcacagaggccctggcctctgcatcaggcaagaaaaggaaataaaaggcataaagactggaaaagaaggaacagaactgcccctattttcagttgatacaactgttcatctgaaaaacctcatggaatttataaaacaatctttagaactaataactggatttcataaaactgcaggataaaaggttaatagagaaaaattaattgtattcttaaacagtaacaatgcacaattggaacatgaaataaataaaacattaaatttatagtagcaaaaaaatccccacataaaatacttcggaataagcctgacaaaagacattcaagaacgtcatactgaaaaacacaaaaattgctgagataagtcaaataggatcttaagaaatgcagaaatgcaccatgtccatagaataaaaccgtcaacttggttaagatgacaatcttgccaaactgatctacagattcaacacaagcccaatcaaaattccaacaggaatttttagtgaaaattgataagttgaccctaaaatttggagctagtataaccagagcgactataaaaaagaagaacaaagttggaggatgcatctgactttgagacctacatagctatcatcaagaaagtttggtattggtgaaaagataactatggtgaaataggcaaataatcaatggaacataacagagtccaaaaatatcaattgattatttacaaaagtgcaaagacaattcagtggagaaaggatggcttttcaataaacgatactggatcaacaggatatctgcatgaaaaaaattaacatcaactcttttctcccatcactcccccaaattaactcaaaacggatcacggacctagatgtgaaaccttaactaggaaacttccagaagaatccgtaagagaaaacctgtgtaaccttagaataggcccaggtttcttagatagaacacaaaaaatacaaactgtaaaagaaataataaattggaaaattaaagacttttttttttcatcaaaatactccattaaaggaaacaaaaatgcaagtcacagactgggagaaaatattcacaaaacatatagtcaacaaaaaacttgtatccagagtatgtataagaaactgttaaaatgaaatactattgttacacaaaggtttcttagaccagacaccaacatatgaccataagtgaaaaaaaaaattaatcttcattaaaatgaaaaccttctactctttaagagatattgttaagaaaataaaaagataagccacagactgggaaaaagatatttgccaaatgcttatatgataaagggcttatcatataagtcagtaatatgctttaaatcatcattctatacagaatatagaaaaggtcctcaaaacagtaataagaaaacacaatccaaacatgggcaaaagatttgaaaagacatttcaccaaagaggatattcagatggccaagaagcctatgaaaaggtgctcgacagcattcattattagagaaatgcaaatagaaagaaacctcaatgcaatctaaaggaacatgatgtgatccactacacatctattggaatgactaaaaaacaaatgaatgaggccacgagcaaggcagttcaagcttgtaatcccagcattttgggaagctgaggcgggtgggtcacctgagctcaggagttcaagactagcctgggcaacatggcgaaatcccgtttctgctaaaaatacaaaaaattagtaggcatcgcagtgcacctctgttatcccagctactccagaggctgaggcaggagaatcacttgaaccctggaggcgaggttgcagtgagccaacatcatgccactgcacttcagcccgagcgacagagtgagactctgtctcaaaaaaacccaaaaaacaaaaacccaaaaaaaaaaaaaaaaaaaaaaaaaaaaaacgaaggaatgaaactgacactgtgagtgctggccaggaggcgagcaacagaactctcctacaatgtgacgggaagtcaaatgacagaaccactctggagaactgtttggcagtgtcttataaagtcacacacacccctaccatatgactcagcaatgccccctaggtatttacccaaaatacatggaaaatgttcacacgaaatctgtgtgtgaatgtttatagcagttttattcatcattgcagaaaacaggaaatgacacaaacgtctttcagctggtgaatggctaaacaaacaatggtacatcttaacaagggaatacatacgcctcagcaataaaaaggagcaaactgctgatatgcatgacgatatggaagcatctcagttgtattatgttaagtgaaagaagccagacacaaaaggctacatgagaagatactcagcatcctctgtagtcaggaaaatgcaaattaaaaccacaatgagatactcctactcacctattagaatggctacagtggacaagactgatcatagcaagtgttgctgaggacatggaggaactggaactctcacggactgctggtgggaatgcaacacggcaaaccactttaggaaagcagttcagtaatttcttaaaaattaaacacatgcctgtttccagttattccattcccaagtatttaccaagagaaataaaaacatatgtccacgtgcaaagacttgcacataaatgtgtgtaacagctttatctaaaatagctaagaactggccaggcacagtggctcacgcctataatcccagcactttgggaggccgaggctggtggatcacctgaggtcaggagtttgagaccagtgtgaccaacatggtgaaacactgtatctaccaaaaatacaaaaaatcagccagacgtggtggcgggcgcctataatcccagctactcgggaggctcaggcaggagacttgcttgaaccctggaggcagaggttgcagtgagccaagatcacgagactgcgctccagcctaggcaagaagagcaaaactccatctcaaaaaaataaaaataaaaataataaaataaaatagataagaactgaaaacaacccagggtttatcaacagccaatgcagtaatgaatcgtggtctgtacataccatggcatactactcagctgtaacacgcagtagcatggacgcatgacaaaattattatgctgattgaaagaagcaggacaaaaaacaagcacatactgcatgatcccatttacataaaattctagaaaaggcaaacaaatctagagtgatgcaaagcagatgcaacttttttcctttttccaattattttattgtgttaaaaaatacttatcatcaaatttaccatctcaacctattttttttttttttttttttttttttttgagacagagtcatctcactctgttggccaggctacagtgcagtggcaagatcttggctcactgcaacctccacctcccggactcaagcaattctcctgcctcagcctcccaagtatctgggattacaggtacccgccaccacgcctggctaatttttgtatttttagtagagatggggtttcaccatgttggccagctggcctcaaactcctgacctcaggtgatccgcccaccttgcctcccaaagtgctgggattacaggtgtgacccaccacacccggccccatctcaaccatttttaaatgtacagttcaggtattaaatatatttctaatattgtacaatgatcatcaccttccatttccagaactcttttcatcttgtaaaacaaaagctctatacctattaaacaatagcttccaggccaggcgcggtggctcatgcctgtaattccagcactttgggaggctgaggtgggcaggtcacttgaggtcaggagtttgtgaccagcctgaccaacatgatgaaatcccatctctactaaaaatacaaaaattaatggtggctcatgcctgtaaccccagcactttgggaggccgaggtgggcggatcacctgaggtcaggagttcgagaccagcctgaccaatatgatgaaaccccatctctactaaaaatacagaaattagccaggtgtggtggcatgagcctgtaatcccagctgagacaggagaatcgcttgaatccaggaggcagaggttgcagtgagccgagatcgcgccattgcactccagcctgggcaacaagagcaaaactccatctcaaaaaaaaaaaaaaattagccaggtgtggtggtgggcgcctataatcccagctacttgggggagactgaggcaggagaagtgcttgaacccaggagttggaggttgctgtcagccgagattgtgccactgcactgccgcctgggtgacagagtgggactccatctcaaaaaaaaaaagcaaaaaaaaaagcccgataacttcccattcccccctcacactccaagcaacatcaactgtctgtctcaatgaatctgactactcctagcacctaatctcagtgaaattatacagtattgtctttttgtgactggcttatgtcacttagcacaatgtcctccaggttcatccatgccgtagcgtgggtcagaatttccttcccttttatggctgaataatattccattgtacggatggaccgcgttttgtttatcttttcatccaccaattgacgggttgctctatgttcttatgtgaataatgctgtgaagccatggtgtccagatatctctgtgtctctgctttcaattcttttgggtatatacccagaaatggaattgctggatgatatggtcattctatttttaattttttgaggaactgccatactgttttccacagcagctgtaccaccttacattcccgccagcaatgcatagggatttcaatccctccacatcctcaccgacacttgttagtttttattttttgatagtagccatccttatgggtgggaggtcgtatttcattggagttttgattttgcatttccccgatgattaatgatattgagtaccttcatgtgcttatcgggcattcgtgtctcttctttggagacacgtcttttcaaatcctttgaccatttttgaattgggttgtttggggtttgtttttgtttgtttggttgtttggttgttttttgtgtgtgtctgtttgtttgttttggagacagagtcttgctctgtcgtccaggctggagtacagtggcatgatcttggctgacagcaacctctgttttccaggttcaagctattctcctgcctcagcctcccaagtagctgggattacagacatgcaccaccacgcccagctaatttttgtatttttggtagagacggggtttcaccatgttggccaggctgatctcgaactcctgacctcaggtgatttcgcctgcctcagcctcccaaagtgctgggttacaggcgtgagccaccatatccggccagttgttttttgttgttgttgagttttaggagttctctataaatcctggacaattattccttattaaacatacatgatctgcaaatattttcccgcattctgtgagtgatctttatactctgctgatagtatattttgatgcgcacatttttaaatttttcatgaggtccagtttattttttttattgcctgtgctattggtgtcatagccaagaaatcattgccaaattgcagataagacattggggggacacgaagaaacttctgggggtgatggatctgttcattatcttgattgtgatgacggctccatgagtgtatattatgtccaaactgatcaaattgtgcactttaaacacgtgcagttgattgtacagttatacttcaataaacttgtaaaaaataccaccaatattcaactctcagtactattgctaaattttcaaccataggagaatatttgaatatattgtggcacattcatatgatacaacgccattaagcacttataaaatatttaataaaagtatgtgatgaccagagaaatcctcacactgttatgctgaatgaggaaagtaggttgcaaaactatataaaaatatactatcaatactgttttatatataatatatattgacaggtattttatacctatgcaagtgtagaagtagaaaataatactaaaactataatgtgatcatatctagatggcatgtctataatatactttcaccgcattaaaagaattttctaaaaggcataatgtatcattctgataatcagaaataataagctaattttctgtattaatttttttttgaggcggagtcttgctctgtcgcccaggctagagtacagtggcgtgatcttggtggctcactgcagcctccgcctcccaggttcaagcgattctcctgcctcagcctcccaagtagctgggattacagacatgtgccaccacgcccggctaatttttttgaatttttagtagagacagggtttcaccatgttggccaggctggtctttaactcctgacctcaaatgatccgcctgcctcggcctcccaaagtgctgggattacaggtgtgagccaccgcgcctggcctgtactaatttttaaaaaaagaagcctgtgtttcttttaatattataaaacaaaaaaataataatttagaaaagaaaaaggtgaggcaaaataaccaattatcgtcatggctaccatttattggagcttcctgtgtgccaggagctctcctaattgctttgaagacttccttacataaaccttgtgggtgagacagcactccattttatagctaaggagaccgaggccaggaatcatgtccccgggtttcagaatggcccacagcagggcaggatggacagctaggcgtgacctatgggaagctcacattcctgactcttttggcatatgccttccagagacagcagtcacatcaactggaaaagaagacaacactctaaaaacaacatctatgaaagaatgcctctgaaactgtgtccacttctccccttcacccctgctcctggctcagaaactatcaacagtcagctttgtctgccagtcaagctcccatccatagatgggcactgagcccgccccacacattggcctggtcgcctctttccttgttttccctggcatgagtttcctagggctgctgcaggaaacaccacagctgcatggcttaaagcaacacgaatgtgctctctcacacttctggatgacagaagcctgaagccaaggtgccagcaggccacactccctctgaaagtctaggagactcctcctttgagtccccccagcttcgggcagttcctggcaatctgtggccttccgtggcttgcagctgtatcactccagtctctgctccatcatcacgtggccttcttccctctgtatatgggtctactgtgtctctgttttctctacttagaaggacaccactcactggattagagaccaccctaatccagaatggcctcatcttaactaattgcaaagaccctatttccaagtaagattgcaatctgaggttccaggtggacatgaatttgagggaacactcttcaatccagtataccccttaccatgcccccactagatcacaggcaaacatgacagctcacttcctttccataccccaggacctcctctccccaggatttgcttatgtgggtccctctctctggtcggcctgctctgcctctctctctcttctaattcttcccactctccaaggccccgctcaaacactacttcctccaggttgcttcccttcaatccccagggaagccactaagcaaagtgtctgaaacatacagcaggtccaacatatgctaatttccctttatcccttggaaaatccttagaaacttatcagtcttttttttcatgtgttttgcttttgactttgtataaaagtcatttgttgatacaaaaaccagacgaagacattacaagaatataaaactttagatccatttgaatagacccaaaaatcttcaacaaaatactagcaagctgaacccaacaacatataagaagagttgtacaccatgaccaagtgcggtttatctcaggaatgcatgactggttcaacatatgaaaatagatggatgtaagacactagattagtaaaagaaaagacaggaaacacaagatcatctcaacagatgcagaaaaacatttgacaaatccaacagcatttcaaaataaaaacattcactaaactaaaaacggaaaggaacttcctcaatctaataaatgttatctatgaaaaaccaacaactataaaaaaaaccccacaaatttaagtgtgaaagactaaaagttttcccccatataactgggacaagacaaagatattcactctcaccacttctagtcaaccttgtgctggaaggtctacctgggaaattaggcaagataaagaaataaaatgcaaaaagattttaaaaataaaatctttaaaagaaataaaattttaaaaaggaaaaggaagaagattggaaaaaaaggagtaaaactatctctattaacagatgacatgatctagcatatagaatatcattaggaatctacacacatacacacacagaaaacccactgaaaccaataaatgaagtcagtaagtttgcattatataagatcaatgtctaaaaattaattgtatttctatacactggcaatgaacgacacaaaaataaaattaataaaacaattctcttcacaatacacgtacacacacaagtacaagacttgtgtacttaagactataaaagttgaaacaaattaaagacctaaataatcagaaaggcatcccacgttcatggattggaagacttaatattgttatgatggcaatactctccaaattgatacacagattcaacacagttcctatcaaaatcccagctaccgtttttgcagatattgacaggttgaccctaaaattcatacggaaatacagaggacccagaatagccaaaacaacattgaaaaattaggactcacacttcctaatttcaaaacttaactacaaagctacggtaatcaatatggtgtgataatggcataaggatagacatattgatcaatggaatagaattgagagtccagaaataaatccacaagtttatggtcaattgtttccaacaagcttggtaaaacaattcaattgataaaagaataatctttaaaaaatttttttgagacagggtctcactctgtcactcaggctacagtgcagtggcgagatctcggctcactgcaacctccgcctcctgagttcaagggatcctcatgcctcagccacctgagtagctgggattacaggcgtgcgccaccatacccagttaatttttgtattttttggtagagacaggatttcaccatgttggccaggctggtctcaaactcctgagctcaagtgatctgcctgcttcagcctcccaaagggattataggcatgctgggattcgaggcatgagccgctgcacccaaccgggtgaaagaatagtcttttcagcaaatggcacagagacaactggatagccacatacaaagaatgaagtcagaccataacctcacactgtctacaacaattaacttaaaatggatcaaagacttaagtgtaagagctagaactataaatctcttagaagaaaacatagatactttgatatgacaccaaaaagacaatcaaccaaagaaaaaaatagataaatctgatttcataaaaatttaaaactcaacactatcaagagagtgaggccgggcacggtggctcacgcctgtaatcccagcactttgggaggccgaggcaggtggatcacgaggtcaggagattaagaccatcctggctaacatagtgaaatcttgtctctactaaaaatacaaaaaattagccgggcattgtggcgggcgcctgtagtcccagctaatcgggaggctgaggcaggagaatggcaggaacctgggaggtggagcttgcagtgagctgagatcgcaccactgcactccacagagccagatgccgtctcaaaaaaaaaaaaaaaaaaaaaaaaagagtgaaaatacaactcatagaatgggaggaaaatagttgcaaatcatatatctgacaagggactagtacccaaatattttttaaaaacacttaagatgtaagaataaaaagacaaatgactcaatttaaaaatgggcaaataatttaaatagacatatctccaatgaagatataaatggccaataagcacatgaaaaattctccacatcattattccctggagaaatgcaaatcaaggccgagcgtggtggctcacgcctgtaatcccagtactttgggaggccaaggtgggcaggtcacctgaggtcaggagttcgagaccagcctggccaacatggtgaaaccccatctctctaaaaatacaaaaattagccgggtgtggtggtgcacacctataatcccagctactcgggaggctgaggcaggagaatcgcttgaacctaggaagtggaggttgcagtgagccaacactgcaccactgcactactgcctgggcaacagagtgagactccatctcaaaacaaacaaacaaaaagaaatacaagtcaaaaacaacgttgagataccactccacacccactgggatggctataataaaaaaatgggaaataataagtgttggtgaggaggtcctagagaaatcggaaccctcattccatggtgatgggaatataaaatggagcagccaattgtggaaaacagtttggtaggtcctcaaaaattaaacacagtgttaacatttgaccaagtaattccactcgtaggtagatatcctagataatagaaaatagggccgggcacggtggctcatgcctgtaatcccagcactttgggaggccaaggcaggtggatcacttgaggtcaggagttcgagaccagcctgcccaatatggtgaaaccccatctctactaaaaatacaaaaattagccaggtgtggtggtgcatgcctgtaatcccagctacttgggaggccgaggcaggagaatcgcttgaacccgggaggcggaggttgcagtgagccgagatcacgccattgcactgcagcctaggcaacagaacgagactccatctcaaagaaaagaaaagaaaagaaaatagatgtctatataaaaacatgtacacacatgttcatagtagcattattcatcatatccaaaaagagaaaaatgcccatcaactgatgaccagataaggaaatcgtggcatccatacaatggaatactgttcagctataaataggaatgaagtaccggcctgttacaacacggatgaatcctgaaaacacgatgctaagcgaaagaagccagtcacaaaaggccacgtgttctatgatttcatttatatgaaatatccagaataggtaaatccatagagacagacagcaggttagtggctgccagggctggggaaggaagggctgggctgtgactgctagagtatgaggtttctttttggggggatgaaaatgttctggaatcaggttgtgattacacagcttcatgaatgtactaactgccactgcattgtacactttaaaagggtgacttttatgctatgtgaataaaaggtcactatgcacccgctctctcccgtctgatttatcttgtacatctcccaccaaagggtcttgtacaaagcatggcctcagaaaatatttgttctgcaataaaaagttctgggtgtcccccaccctctcaacctgcagacaacgagacaaggttgccacctgtgtagagcttcattgtggtgggaagtcaggcagcaaacggtaaacgggtcatggggtgctctaagggaatgagcacagggtgggaggtggaggggctgggcacggccactctagagaggtggacctgggggtcctcagtgaagcctgcagaaaggtgaagagctagcagagagcccaggggaaatgcatgcctgaaataagctaagcacatcagagaaagcaccagtccttgtacgagtcccagtgcaaaaacagcgccaccctggaaacggagagtcagcccggtgcaaaaacagcgccaccctctggaaacagagatgcagtttgctcttgcattgttgagttttacgttcctcccagtgtgggaatggaagtgatctcatattgtaaataattttacattaatatacactccctgtatttttattttttatttttttttgagatggagtctgtctccattgcccaggctggagtgcagtggcgctatctcggctcactgcaacctccacctctcgggttcaaggcattctcctgcctcagcctcctgagtagctgggattacaggcgtgcaccaccaagcccggctaatttgtgtatttttagtagagatggggtttcaccatgttggccaggctggtctcaaactcctggcctcaggtgatccacccacttcggcctcccaaagtgctggcattacaggtgtgaggcaccgcacccggcccacactcccagtattttttaagttgcttaacatttgcaagtggtaaataaattcacgttgtggttaaaaattttaaaaagactgaagtgtgcagaatcggcattggaagcctgtcccccaggtcatcctggtctggaagccctgtcccccaggtcatcctggtcagcagttgagtgactcttcttccaaagttcgttctgcaggtttacacacacttgaaggtatcttcccatgttgctggtagacaccattttggaataatggctcaggggcaattagaaaagaagagtctttaacgtattcttcaacttgactcataaaagtagagtcaatcactcttctctacaacagtcaacttctctcaaggaagacctgaggaagctggtgcccgacccaccaggagacatggacctcataggaggtgagctgaggatgtggataatttggacaccacttggactgtgagctgctgggaggtgtcagacaggagcatcccacggggtagggatgggggctctggaaggcttcctctcggagcaggtggcatgggggctggctgtgggggtctttgtggggaagaaagagcctgagtgggtgcagggacaaggaaggtctgcggaggacaggtcggagtgctctgaaaacggccctggcattgatttttaaaaagggtcgctcaaaagaactgaaagcagggactcgaacaggtatgtgtaccccgtgttcacagcagcatcattcatgatggccagaggctgaagcagcccagtgtccatcgatgggtgaatggagaaagaaagtgttgtccctgcatgcaatggcaggttatttagctataaaaaggaaggaaattctttttttttcttccccctgagagggagtcttgctttgtcacccaggctggagtgcagtggctcaatcttggctcactgcaacctccgcctcccggattcaagcgattctcctgcttcagcctcctgagtagctgggatcacaggcgtgtactaccacacctggctaatttttgtatttttagtagagacagggtttcaccatgttggccacgctggtctcgaactcctgacctcgtggtccacccgccttggcctcccaaaaaaaaagtgctgggattgcaggtgtgagccactgcgccctgctaaaaaggaaggagattctgacacaggctacagcatgaatgacacctgacgttacgctaagtgaaagacgccagacacagaaggtcaaaccctgcatgattccactcctatcaggtccccagagcagtcaatctcagaggcagaaagtagaatagaggctgccaggggcttgggggagaggagatggggagttgtttaacgggaacagagtttcggttgggaagatgaaaaagttctggaggtggagagtatggtgatggctgcataacaatgtgaatatacccactgccactcaactgtgcacttacaaatgattaaggctgggtgcggtggctcacacctgtaattctagtactttggaaggccgaggcaggagtggatcgcctgagcttaggagttcgggaccagcctgggtaacatgatgaaaccccgtctctactaaaatacaaaaaattagccaggcatggtggtgcctacctgtaatcccagctgctcaggaggctgaagcgggagaatcacttgaacctgggaggcagaggttgcagtgagccgagatcgtcctgctacattccagcctgggcaacagagcgagacttcgtctcaaaacacaaaaatggtaaattttatgttatagtggtacctccttatccaaggggaatacaacccaatacccccgttggtgcctgaaaccttggatagtgccaaaacctataaatactatgttttccctatacatacacacctatgataaagtttaatctacaaattaggcacagtaagagatgaacaacaataataataaaatagaagtggctgggcgcggtggctcatgcctgtaatcccagcactttgggaggctgagacgggtaggtcacttgagcccaggagttcaaaaccagcctgggtaacacagttagaccccgtctttataaaaaaaattaaaacaaagtctgggcgcagtggcttacgcctgtaatcccagcactttggaaggccaaggcgggcggatcacaaggtcaggagatcaagaccatcctgtctaacatggtgaaaccccgtttctactaaaaatacaaaaaaaatagccaggtgtggcggcgggcgcctgtagtcccagctactcaggaggctgaggcagaagaatggcatgaaccccagaggcggagcttgcagtgagccaagatcacgccactgcactccagcccaggcgacagagcgagactctgtctcaaaaaaaaaaaagaaaaaaaaattacaacaaaaaattatccaggcatggtggtgcatgccatcatcccagctacttgggaggctacagtgagccatgatcacactactgcactccaccctgggcaacagagcaagaccctgtctcaaacaaaaacaaaaccaaaaccctcccccaaaacaatatactgtaataaaagttcattcttaccagaggtcgtagcaacctcagcacagaattctgttctttccttattcagttgagaacttccgccttctcgctaaaaggaagcgctttatggcttctctttggcatatccaaattgtcagcatcactgctctggtgctgtggggccattattcagtcaaataaaggtgacttgaacacaagcactgagatcctagggcagccgatctgatcacccagacagctggcgggatggagggggagggtaggagacttcattactctaccagaatggcatgcaatttaaagctcatgaattgtttatttctggaattttccatttaattttttttttctcttttttgagacggagtctcatctgttgcccaggctggagtgcagtggtgcaatctcggttcactgcaacttccgcctcccgggttcaagcgattctcctgcctcagcctcccaagtagctgggattacagacatacaccaccacgcctggctaatttttgtatttttagagagacagggtttccccatgctgcccaggctggtctcgaactcctgacctcaggtgatccacctgccttggcctccccaagtgctggaattacaggtgtgagccactgtgcccagccccatttaatacttttggattatggttggccgagggtaactgaaactgcaaaaagcaaagctgcagtgaggggggactatatgtattttattgcaactaaaaaccaaaaaacaggtgaaccatagagtttcttggcttcctccaccctaaagcacattcccttatcttccctggctctcccaggctcttctcaggcgtggcacccacacagtagggctagctaaccctggggacccagcaaaggctgcaccaactcacaggtggggctggtaggaggctgggttcacgctcaggtttatcttatgatgctgaggagtttgtggaataggttcaaaaacgttgaaagagggagaagcctgggcgccttgctttcagagtgactttgtggctacctccctgtccgattcctgatttggcctcggtttttgcctttgacctggggttggggccacccccgcagccactgcgccctctataggtaagaaggcccaaggaagaagccctctgctccgtcacctcctcgccatgccgtccccactgccagtgggcgcaacgttacttgcaaggccacaaacacccggaacaatccgccaggccgcgtcactcctcaccctccagcagggctttggatttttggacagcgagttctgtttcattttgttttgtttttccctttgcatttggtgaactccgtgtcaggaaagctagtctttgggattcaaggaagaacaaaacaaacccgatctcctgtaatctacctggattggaacgcccagctttgtacagcctgagctctggccgactggaatttctgccaggtcctattcacacccttggccccagctggctgtgaggtttcctgggaacccttgcctcctacatggcctacttaaaaggctgctgagagccagccaggtgttctttaagcccctgtgaagattccttgatcagttacacaaaaagcttgctcaaaagaatgggaccgggagcaaccgcaatgccctctggagacccagctcctgatttcaaaggatcaacgagtgacagagggttggggactgggggggtcgtgcatgaagacagccaccgcccacaacaggtccaccctgaagtgaaaagacaaatatcatttttcctccagtttgcaaccaactgtgcacagcttcgggacccccagccagcccaaacctgtcgctggctgcccactaacgctcccagcagcccttagtacaatacaaattcaggcaatgcctgcgtctgcccacacctgcagagcatgagccccactttggaatgacggggtctgtgcagagaccgggcagagctctgggcttcaggatggcagcagcagctccggcaggcggctctccaggccacgagatgggcacagaccttcctgcaccctcacagcttctgcggctccccaggcaacggagccagtcagggcatggggacgccaggcagcagtgtcagacttggccattgccaagttctctcttgtccccgccaggcagaacaggtgcacatccaggtcaacctgtgacctcggccttactaacccttgtctaggcaaacctgggagcgagatggaatcaaataagaaccaacctatactgggcagtgattactctaaaagcttatgcaagagccctgctcctctgttggtaccctacatgtcgatgccgagactgaggctcagagaggtctggtcattgctcacaccggcccctgcactgtcccaggctgtctctcttgcagcaagggaaaatggctctttagcctctgttatgttttaaccataaggcattttctcacgcagggctttccaatgttggcccacagacaagaagcccactggacatttgggaagaggagttttagagagaagaggatggaggaaggctagagtcacggtattgtgtgtgcacgtgtgtgtgtttacacgcctgaaacgaatgactgcgtcggtcacatgtgcggtgtgcccacatccttcccaacaaagatgagctcaaaagcgtgagggaaacacaccgtgcaaagaccagcttaggggattctggtgaatgtccagagatccaaacagcaagacccccgccgctcctgactcagcagggatgctggatgcaaactggccctgatacactgggccctggggtcttctccacgtcattatcctggagggtttaagtcccccgaggcaggagccaaagggaacagcaagcttgagatttttctgaagcctcttccgttgacagtgcctttccattcatctgaaacaaactctgaaggactcctctctatggaatcggtccccagaggtggaggctgctgctccatcccagcccctctcatcccatcctctcctgcttcacgcagcccaggtgaggcctgccctgcagaaggctacagggaacacgggatggggcagtttctacctgcctgctgagctgctctggtgacttaaaacaaaagtgtcaggagcctctggcaggaggaagggaggaataaaatccagcattcaacccaagcatctctgttgcccatgaattcatccttttcagtgatccgtccaccagaatatcctactttgcctgggtcatttcacgccttccccaacgaggcgaaccccagcccaacgtccaaagctttcctgaagccccactgcctccaccaccctcagtaagcgaagagaagggaagatgcatggagccccgccccatcccagagacggcccggtgcacagggacgtgcaggtcacacagattacaaggctgaggaggggatgggatgggaaggggtccgtgtggagcagcagcctccacctccgggtctctgactccaacgaggcagagaccaccttccctgacgcctcatccctccacctggccccttcccagcatctgcaacccactggtgtgtcttggtcccccaggcaagggtgatgtctcagccatctctgcaacccttgccccacagggcctggcacgcagcaggatgggggtgacggaggagagagagctctccgcaccttccttcccccacctgtgagacggcgatgagttggctggacgctacgatctctaggaaccccattaggctctaaaatcctggcagtttctaaaatgcacagtaagctaactgttcccagcaaaactgaagcacgtctggcataattagcatcacacacacatgtgcacacggcggtactggactcatccagccgagaggctggactctgccagcttcccgctgaccacagaggcagccagacccagctctggagtctgctcgcagagcccagccggctgtgcacgggagggcgattgatgcggctgccagttcgaagaggcagagcaataaagcctcggcgactgcggtgccttctgctgccggggtgggacccctaagcttttcagaggcctggatgctgaggggggcccacgggaagctggctctattaggctcaagctgccatttctgacataagtggcaatgttaagtgatgggcgcacagccggccggattctgccatcccaggcctagaacctgccccatggtcacggtcgagctcgggagcgccgacatcccgcatgcaccgagacagcctggcttttccagccagagggactgggagcagcaaggccggaaaatacagggccaagcggggcggggatgaatcgcagctcctcgcggcatgggcggcacactcccagagccagagctgctgggaactgggaaggcagggtctccgctccggcgattaactctgccgatctgcaacatcacggctaattagggaaggtgtaaatcactgggaggaagcgggcaggcacatccttcaggttgattaccagcacggtttaggaaaagataaccaggcccggcctttcttctgttcctttgccagccgtgggggcggggtgggggccgtggcgggcgggcaacaatccgcggcaggtaggaggagagaatgtaccaggcctttgagtgctgtttctgttttaattttttcttagtcatatggagtgaccttgtggatttcccagggaaattaagaaaaattccactgaacagatctcacagctgttacgagtttctgagcttccgtgggtcccgtgcatttacgactgtgacgacttagactcaggacgtgcacgtgatgccgtactgggctttttccattcagcgtgattacacggtgttattcattaagggctggagactctgatggcaggaatcatttgtttttctttttcccttaaggcatttgcaaatatgcttggaggcaaagggacgctgggtacatctaataaataaagcaaaataattaatagctcaagcagtctagagaccactcccagttgctcctgaaccaggcttttgagagccaatcgttctgttttcattccctctcgacttcgtccttgaaatacacattactgggaagaaaacagccaagagatttttctgaacccaaaaagaatgtttattttttttcccctagattttataggagcttaacgtgggcaaaccaatgagatgattctaaaccaaagcgccctcgtgggctccacgctctcagcctgtccatcagcagcacacctgggagattctgcccaacctagggaaaggaggagccataggagctgggcagggaaggccagagcacacacgctccggggacgcacacccacgcctagagcacacacgctccggggatgcacacccacgcccagagcacacgcgctccggggacgcacacccacgcccagagcacacacgctccagggatgcacacccacgccctggaccccagcagagggatcaagggctcaggcatccccagtgccgccaatcacgtggccctctcgaggtgaagctgcgacactgtgtggaaacccaggggagatgggagaggcctgaagcgggaggcgggaggaccgcatagctgcaaatgcatctgggcgtgaagacgtccctgtgtcatctctgcaggaccaaacagtcaattagtatccaaatacttttaggggacagaaagacgctcacggttcctgtcgcaggtccaggttattcggtgccataaaaaggcacacgtcgaccttcactgtttcctgcaaacacagctgggacatcagcccggaaaggaatgtaacctgtcaggccgcaaatcccacggttctcactaggagcaggaaaggaccctggtctcccttcacatccaccaaaagctcaccctgactagagaaccaagcagagactgaggccagagaataaccaagtagcaaggaggggaggggtcttcacagacagaggccttgctatgggtgggctctggcttccaggtggtgggctctgcgggccagagcttggggcgcaggaggccaaggtccaggtcccagacacatccattatggccaaacacaagaagccctcaggcctgcccaacacggctgtgggcaccggtgcctccccagaccctctgggcagcccatccttgcacctggaggagcagctcaccgtgccgtggagggtggccgcgaggttcatctgggcctccgagcctcccagcgcatcccactgctctgcagaaacagaataatcaccacccaggctggtggcttcccaacttttccgtgacgttcccctaggcaatttaaaaatggagtgaatactgataataatttgactaaatttaggtgttccccttaggcatctgattaaatttcatgaactctttttcaggcttgcagcccaaattccccttctctcttggcttcacggcacgggcttcttgaccaccatgtagggtcagcaaattccgcctaacaagccggagctttccttccttcccggaggaacaagacactaagaagaggttcccaggggaacatgcagtgggagtctgggccgctacgttgtggggtggtgtaaccagggtttgtccagaaaaagacacagaacccgcaggccctggaggaccctgaagatcaccaggcccagtctgttcctctccctaaccaggacactgtggtgcagacagtgtagggactggcgaagagacacagtgggtggcaggaacggggaacagaaagccagaaccttctagattctgagctgctgggctttgtgacatcccacatggcttggtcccgcctttcagccccccagggttcactcgaaccgcctccgcgcaccccaacagcagagacgtaacgtgcaggactgactggtgcttcccaaaaatcttctcggactcagtggcacacctgggactgcccgaatctgtgccctggtccccgttactgttcctgcaggctggaaggggagcctgtgagttgagccagagctgaccgggagctgctgggaccatggctaggggttgtgacgtgacctgggccccgggaggccctgagggaactggtgggtactctccagcaccccaaccccaaagggcaaacagtcatgataccaatcaccaacatcctttgataagaccttggctactcatttatattcatttaaattccatccacacacttgtcacagcaaagctgaattctgtatctagcccctcgtggcagcagtgacggaaggacagaacttgtttaggcatcgtttcctcgctccctccttaatctccactcggcttttcccatcccctgggcctagtttcaggggagccagcatcttccgcaccaatgcactgcttggcccggctcagaggatttgacgcaaaccaggactggggccctggccgacagaaaattcttagagcaaaatggctgttcaccagcggcgggtatgttcttagaccctccatctgcccgggccctgctgggagaaggcctcgggcctccacctccagcaatcctctaatacctcctcagagctttccggagagaagggaggaagccagggaagctctgggtgcccccgacaagtttaaccccttccttctttggcacacacttcacaaaagaagacaccaggtgaacaagcacgcagagacatattcaagatcgtcggtgataaagaaatgcgcatgaacatgatttttaagccatcctaccagcaacacttcgttttccaaagcggggaggccaaacctccaaagctgggagggctacagtcaaagaagcacctcccacaccggaggcaagggacgcgccaccctcggagcggctccctcggctcttctgtaatctcagcaagaacgtgctcactgcacataacgctgaacctgccacgggcacgaagcagacccacatccgtccctgcagcagcagcctcggcccaacctcaatcccactcctccaagggcgcgccagggaacagcaggacgcggccctccggggcttccctgtgcgcacacacacacgcacacacacacacatgcacatgtattaaagcaaaagtgagattgtgctgtcaacattgtgttacgcctggaatttttcagttactatatccagggccttagccctgtcggtatgcagggataagctgcacctctttttgagggccgcttccacgttttctctaaacattccttatagacaaagacttgggttgtttccattgtcgtttttctttgtgtggtttttttttctttttttttttttgagaccgagtctcactctatcacccaggctggagtgcagtgacacgatctcggctcaccacaacctctgcctcccagattcaagcaattctcctgcctcagcctcctgagtagctggaattacatgcgcccgccatcaagcccagctaattttgtatttttggtagagacggggtttcaccatgttggccaggctggtcttgaactcctgacctcgtgatccacccacctcagcctcccaaagtagggggattacaggcctgagccactgtgcccagcttcatttttctgtaaagtcaataatatcacattgaacttttgtgtgttcacgtctgcacacaatacaccgaacctgtgtgtgcacgtgtgtacaggtaccgtgcatctctttaaacattccctgaggcttggcgtggtggtggctcaggcctgtaatcccagcactttgggaggctgaggcaggtggatcacctgaggtcaggactttgagaccagcctggccaacatggggaaactccgcatctactaaaaaaaaaaatacaaaaattagccgggtgtaacggccggtgcctgtaatcccagctactcgggaggctgagacaggagaatgacttgaacccagggggcggagattgcagtgagccgagatcacgtcactgcactccagcctgggcgacagagcaagactctgtctcaaaacaaaacaaaaaaattccctgtaggcaagaattgggatgttactcattccacttttttgtaaaataaataatatgacattgaacttctttgtgcatgcatatgtgtgtacacgtaaatactgaacctgcgtcatccacgtttgtgcggaatccctgtgtgtgtgcacacgcatccaccccgagcctctgtgtgcagagctccaagcacagacgtgttcatcaaggacaagcgggaagccgggaacagctccatgtccatggaaggggcatgggcaagtgaaatgctacgtccctcaccaacaggccgctgtgcaggcgtgaaacccagtggcggttcagaagacgtggcagcgcgggaggggtttatggcagggcatgaattgagaatggcaagacagaccatgtaatctcagggactctcagctggccccaccccaggaaatgcagtcggtgtgtcttaggaggttgagtgcacattgcagggcccaggggcccctcggaggggctcctgtccctctgcaccaaaggtgtgcacagaagctgtcaaggtgacatcattcacagagaaaaacccaaactaaaccacatggtcatcaacaggagtgtggacaacctggggaacagccatggagacagtgtccccctattggagtgagcacccgcagcacctcaggcacggggagctgagccaccgacggctacaaagacggggacgctttcctagggctcaaagcaaggcagaatgttgagaagtgcacatgtgtgcaaagcctgctttaggagagcaaggaagtgccgcccacggcattccggaaggtggttccttctggagaccggggcacggaacgaccagactggggaggaaggagtggagcactggcctcctaggaagctctagttcagacacagggggcgctgggtcacggggttcatttatgattgtgtttcatggtttacatgctacaaatattctttggcatgtatcaaatatgacaaaatttaaaaaaaatttaaatttatttagagacagggtcatgctctgtcacccatgctggagtgcaggggtatgatctcggcttactgcagccttgatctcccaggcttaagggatcctccctcctcagcctccctgagtagctgggactacaggcaggcaccacagcacctgactatttattttgtattttttacagagatggcggggtgggggggcgggggtctcatttgttgcccaggctgaccttgaactcccagactcaagcccatcctcttgcctcagcctcccaagtagctgggaccacaggcatctgccagcacgcccagccaatttttcaatacttttttgtaaagatgggatctcacaatgttgcccaggcctgaagtgatgctcccacctcagtctcccaaagcactgggattacaggtgtgaaccactgtgcctggcctaaaatcaaaaaaaattttaaaccaagaaagtgaattttatatacagcctgcctgtctacaactctgtaaaataacttaggcatcggaagcaaaaataaaaaataaaagtaaacacaaggctgaaggaaatacaccaaaaagttaacggtggtgagctgggtatggtggggcttcacacccttcttttgtcttttccctatctcccagaatttccttaggagcaggtgctacttttataattaaaaagaaagaaagagagagagagaaagaaagaaaaagaaagaaagagaaagaaaagagggagggagggagtgaaggaaggaaggaaggaaggaaggaaggaaggaaggaaaggagacaaacaaaagccctccaaaacatggaaaacagtaaaggcaaaaaaaaaaaaaacagttaaaaagagcaaaaaccaccctccccaaaacaaaaatagccccaagcaatccctccataggatcaacagggaactaagacaagcaggtgaaaagaccacactgaagtcagacctcagatcataacagaaacaaaaagcaggtcctaaggcctccctctggctcccccccacccaccccaccatcctccagcttcggacacagccctgcgatggagctggggctatgttttgggggctgcgttttggtggtgacacagcatttcccagggctgctgtaatgaaggaccacagaccagaagcttgaaaacaacagaaatgtattgtctggcagttctggaggtcaaagtcaaggtgctagtcgggccgcgccccctctgaaggctccaggcaagagtctttcctgcctcttccagctggaggtgctcgtcctggatcctggaagcccccaagcctgcagcagcatcactcccatctctgcctccatctccctgcccctcctgtgtctgtgtgtccgtccgtgtcttttaaagacatccgttggatttagggccaccctaatccaggaagacctcaactggatccttcccttgatcccatcagcaaagaccctatttccaaataaagtcacattctgaggttctgagtggccatgaatttgcggggaagggagtcactatccaggccacggcagacacagttccccgaaactgaagacgtgtttactcactttttttggacagggaagctcggctgtgggtgcgaagcaggactgccccccaaggccaggcaggtcctcgaggagcatctcccagtccagtctcagcgggcactggcctggcactcacgctcggggtggggggcatcccaggccctgagactggtgctgggtccaagggtccccatccggtggcagccattccgcattgatctccatttgcttttcaaacatgcaattctcataaactgtgctaaatgccatttagtagctaattaactttctgtgtgaagacctctctaattgcgcacactcccccctcggctgggtcctcggggatgcccagctgtcctagagtatttgttctgctggctcccacctcgcagccacaacttcaatgcccacaacaaactgccaatcaaggctgtggaggtcaaaggggaccaaatcaggggccctctgctactaccaaactctcccggcaaagcttaatttaaataagaaagcagaaaggttatgaaaaaccatttttcccaacgaaactcttctgccaggcggcataaggggcgcggccctccgctcttcagaacggctggtgtctgctttgaaaggtcctgactagaatctgtttatattttgactgcactggcatctgccatccctcaaacggagagataatcaggaaataaaagcttttgattagcagctgcatgaatcactgcagtgccaatttcctcgtggtcccaaagtgcgggagggagggcaggaggcggcaagcatgggtgctgggtccacctcacccacttggggcaaagccatctctcactttattcactggtcttggacttggggccccaggtctatatcccaaggccacgttcgcttcataaacgcaaggtgatctctgagcacctcttagacagaagtctgggcagacgcaaatgtgcagcgtttcaaagcaaagctcaagagtggattcctcagtgcagtatcgtcagcgttgcagtggtgggtaagaggccccgggattatttttggagggcccctccctgcagagcaaccacgtgaggactccctaccccaggaccttccaccagaaaaggccaaagagagaccacacgtgccgccccctgccgaagcctggcctttgaaggatgaacggcaaggggtatgtctgccctgacagagtgaccagtacccgcagcacccgagttctttgcctcttattaaagggcagagccaccatggtgggtgaacgggcttcctctcggaaaccaacatcctggttgggttttcccttccaaggaaggctctacacacccggccctcctcagagcctcagcccgcagcgggagatgacacctccgatcaggtccacgggaagatgggggtgaacgagaagcctgaggccgggccggtgggagggcgtgatgcatgggaggagctggactgcggtcagccgtcccctcgcgccctccggtctctgctgctgtgtttacttggctcccttcccgggatggccttgtagcaaatccatctgggatatgttttgtttccacagagggaccctgaattttgaggtggggccacagaacctcccttgagagccagaagagatcagggccaggatgggtcacgggctgtgcccagtgtcgctgcccaaggcagaactggctgcccaccaggggcaggagactggatggtctttccaggccctcatcccaaactcaagcactggagaaaattgttccagagcgtctcggtctgggtgggagcggggaataagcatttctttaaggaattttttttttacttttttttcagactgggtcttgctctgtcacccaggctggagtgctgtggtgacatcacagctcactgcaacctccgcttccacctcttgggctcaagcgatcctcccacttcagcctcccgagtagctgggaccacaggtgcacgccatcacgcccagctaaattttttattttttatagagatggggtctcgctatgttgtccaggctgatcttgaactcctgggctcaagcgctcctcctgcctcggcctcccaaagtgctaggattacaggcatgagtcatcatgcctgacctatttttaaaccagaataagcaggtacagaagtttgcctggtgaccaggagtcatgactctttccgaatgaaggtggggatgggggtagggaatgtccccatgaaggtagcccctggctgggcattttccactcccagccacagcctccctctgcgggcagaaccctgggtgctgcagggagctggttctcagggaaaagggaattaagtcagtactgggagatttgggttccacagagtttaggggctcctacaaacagcggcttacgggctggtgaggaatttcccatcctgaagcttttaaagcagacaaacacatgagtgctgggtgggggcggggtgctgggagatgcagaggctcagaaaaaccctccgaggctctcggattttacgcctgcatgagatttcgagggaagaatcctaaatgtggggaaatgaggttgcccagcaattctgaatgtggtttaaaaaaaaaattaggtgggggagaatgagacgatattcaatatttccttctgattcaaacgaaatacttctaagttcttctctgtgaaagcgtgtgtgtgtttagaagggagagggggatgatagcacgtcctgccagaagccgttttatttactagtttggatgcttcccctgacgcctacctgggaggtgcttgcctggccaccagccagggccgtggctcctcggcaagtgggcgtccgccgagcctttgatgcactctccaaagtcacagagcaaaacaacacgctgaacaaacaccaccaccctgaaaagtcaccagcccatgggcctctccctggctccagctgtggctgatttacccaaactgaaacattttccttttgtcgactgtagagagctatgagtcaggtccaagctccactgggcgtatgcccaaggggcagagggggcagcaaccggacggaagctgcccaatcataagaccatggctgaaagtcaaacgcgcccagagtccacagtcgaccacctcccgctcggcaagccagggtcctggtgaacgcacgtgcctgcgttctgtaccaaacagttgtcaacacacaccagcaacttaacaaatcaactccaacaaaggggaaaaaattaacattaagggcaaaaagactttttctggagggtcctatgcaccagatgttggctctttaattggcagtcaacctcaaagcaaaacttagaaggcccctgcttgttttatcagttagagccacagaaaatcaaagtccaatcccgctaagcatggtgctgtgtagcccggccagccccgtggaagtcctcagcctggtcccgtcttctgggctctgctgggctggacggtgccaccctccccaacccgcacctgcccgccggccccaggccctccctcaggacccagcaccttcagtcctcctgccgagaagaagcctttcatcagtaaaagagaaaacggcttctccaaaggaagtttcttaacttgaaaaaacaccatgattagggaaactcctccatcgtccaagatacaaacacaaactcccaaacacctgtcaatccttctcagggctccacatggcccaaaggacaccccaaatgtggaggaccactcaagaccctcaaatgcagcaccgtgtgccccctgaacagggatccccacattcgatgaaaacaaaattggccagcgcaggaacttttgcccatgacttaagcacagcaaagtccccaaagccagaatccctcccaggacctgcccgacgggttttatcactggacgcatcaaagcccctctcactggtggttggttcagcagagccctgggcctcgggcctgccctgctctgacagctcccacactgtggccttgatcgggcccttttccactctgtgcctgctttgagtaacaggctcccacaaaaacactgtgctggggtatttccaggatgaaaagccacggttcgctttgcctgccatggacagagtcataaatacgagttgtcgttgcctcttcccaacagtctggcatggcaaactggccttgtggagttcggaattgttctagatactgctcatgtattctccagcagctctagctggttctgcccagatacctggcaatgccaaaggccgagaggccaagacactacaacctttgttcaaatacacgaacatcctcaaatacacgaatgtcctctctgcacaagcagagcagcctcagcatcggccctcgcaagtcccaccagagaacggtattgaaaagatgactggggtcaaggggtgcggagagggacccactgtaccctcatggccactctagcgccagcccttctgtaatgaccccctctggattcccaaaagtcagccgaggggtccccaccctcctggggtggctggggtgttgctgcccacccccaggggcaggcctgtgtgcagcatccatgcccagaaacctgcgctcagatttcccagttcccagaagacaacagggagagtctatttttctaagctcactaggtaaagtgttacttcctgatctaatcttgccaggctctggaagcttccgtcaaggttttcccacactccatgtcaggtctctgacatgaaccagctttcagagtctaacgactagatttgactttcagctgctcggacggaggcttcaactcagcctgaactagccgcgtggacagcagccgtagccctcacaaggcgtgtgcggtgacgggtctcgggcgcccagccagcgaggggccggctccaggtggtgggagcccacgcccccggccagcactctggccacagcgcagcacctgccccatgagagcctcctgttgcagcccgggcagaggtgagcctgggcagccacctcccacgtgatttcccaatgcttgaagttcacgaccaattgctggggtggggacaacctacacaggcttacagacctaatccaagaaggcagttctcaaaaggatgggaaaacgtgcaccagtctcacagtcccagtcaccttaaaaggtcttaactgatttttccttctctctgtttattgtggtaaaatgtccataacataaaattcaccaccttaaccgttttcaacgtcgagcccagtggcattataccattcctatttttgtgcaaccatgacaccacccatctccagaactctccttcttcccaaactgaagctttgtctccatgaaacaccagctccccaacgtcccctccctcagcccctggcaccccaatctttccctctctgagcctgacaactccaggggtcgcacacaagtggaatcacacagatttggccccttatgtctggctcatttcactcggcgtaacgtcctcaactcatccgtgttgcggcgcgtgtcagaattgccttcccaaggctgaacgttccgctgggtgtgtgtggaacatgtgtgtgaacacaccgcgtttctctagtcacccgtcgggggaacttggacgctttcaccatgggctactgtggacggtgctgctatgggcaggggtggtcatgtatctgagctccttctctttatttctgacacttctatataaccatgaatcatctatgaaataattttgacaagcaagaggttcacaaagtaaattccagacaaagccaccctggagacccagctgggctgtcccgggggcggtccctgcgtccacgccgggagagcaggaatgacacaaagcaggctgcatctggctgtgtcaggcctcccacccatcccatcagccaggcatctctgctttggggccagaggtcaaacgtgtctgggttccgtgtagtctcaggggaggctgaggctgacgcgaggtggggtggggtgaggttgtgctggaggctctccacctctccacccaccagacacccagagaagaggcggaaagtcagcagggaaggcagaaggctgctaagagtggacaggatgcaggagtggcgtctggctgaccctgaccagggggacctggcccaagtgagtgtgcaccccagcccggccctcagaactgcttgcaggcacttgcgagttaatatccacgtgatttaggattcaccaaaatctgcttggaaggaggcagggaggcaagagggaggtcaggtggggaggcgcgcaggcagtgctgccctccagccacaggcaggtgggggtggggcggggcggggcggggagggggagggcgggggcgtgcaccgcaggcagcggccagccctgggctgatctaggggaagcctgccatctgctgggcaccgggatccctcccggagcaggagtgccacctccacgcagatggagtttgcaaggggcggtgccgccatcttcacagaggctccgggcagctggcgggggtggggggatggttgggggggccgtgttggccaagcccaattctggggtgggagaaaacgagcaacactctgcaaagggccgggggcctggtggcccccccatcctcgccggacctcaatgtcctgcgtacaagcctgtcccggccgtggccaccggctggcttgtgtgctccgcctgccgggaagcgctttccccctcgtggaccctacaaagacgcctctctgcaggctcccctcatgctgcgggcacacaatgcgtcctttcacccggggtgggtctggcggaggcggcccctccccggggtgccccccgctgggcccctgaccccacactccgctgctgttcttggcctgcgtagacccgtccctttcaaccgctgtcaggaaactgtgtggacgaggaatccctgctggtcgcgcccgagaccatctctctgcgtctcctagaaggggaaaccgtgacccacatcaaactgtggccgttggaaaggtgaacacacggagcctggggccggtggggccagggggtggggtatccttgcacccgatgtcacttgacacccgtcccggcagcccgccaggctcggagagagaccgtagctaccaaaaataatcctcccagtgtttaaatatttacagaagcaagacagatcctgatgcctttacaatctactggagtctgccctaaccgccagtccgaggctcccaggagaggccacagcgaccacccacccggttttcggggtcccaggtcgcctctcctctccctgtccctgcctgatatatatcgcagggctcctcctccggtgaccacatatctgccactagccctctccctccttccagaacattcccacttccaactctgctctcacatcaccccagccccagcacctaccttgagacagctctttctgctccagagcccctcggggaaagcctgctttctctgcagagcctgcacctcattttgggaaccagtgaacaaaatgtaacaagaggcatttgtccatgtaaccccattgtccatgtaacccctggggctggtctcgaccccactcccctcctggggacacaagggtgagacggtacagtaccaggccaacaccagtcccagcggatggcacagagatgggcactgctctcagggcctgtccagatgctacttctcatgacagtctatggggtggggagcactagcgccagccccattgtgcagaggggaaactgaggcaatgagggtaataacccaccagcacacagccaggcagagctgggatgtggccaaggacttggctccaggctcccacacttaaagatcatctctgtcaccacctgggggtaataaggtcagggatatgccccaggccgcctgcttccaccagccagtccctttcaaagggcggaggtttccagaagtgtggctgagtgtctgtctgttcttgatggtcagggaaccttactttcaggtccccaaagcagattccctgaggccaggaggcacttaggtggacgggcaccaggagccctgtgtcctctgccttgcaggtgtttagggaacattgttcagactggaaggaagagccacgtgaaaatgccctttctgtttactctgctgggaaggatatgaagccaaacagaaccagctacgggagtctttcgaccgcaagacaaaaggtcctttgcccccactacctgcaactttcagggaagatttcatcaggtgctgggttacattgcaacagccaggcgtggttccccagaggtacggtgtgagctccccaactcaccgggagacaggcgctgccacatcactgcctctgggagcccgtgacctcatgctcagagctctcagaagctcacgtggcctgtgaggcccctgccagggctgttgatgcaagagctggggctcgggagcctcccaagggcagctctgtgtattcagagcagctcagcccctcgagagcaccaggagcccccagcccccatgcaaccaccggccggggttgcgtcaaggcctcccggagcagctgtcaatggtttctgagctgcggtggaaaaggctgacaagtttcatttccctgaccttggacagccctcctgatgcagggagcgcccatccctggggagcactgcctctccaggagcctgaacttccttctttttggttcaggaggtttgaggcacttatttcctccctgtcctgacagttttactagaaaggtcagctttttaaagagctgtcagtccttcggaagacagtcaataacagcatggtttaagacggcccaccagatgcactggctccgcccccatctctttagaatccagctcccttgggggacatacctggctggtgacttctagaatcccagctcagggccgggggggtgccagggctgtgaacccccgacaagaggcaatgaaaccccctcctcctagaggctgcccaaccatcaaggacaaaggaagagggagtccatgaagaagggctggccagagaatattttgttttgttttgttttgtttatttttttattgagacgaagtctcactcttgtcccccaggctggagtgcaatggcgtgatcacagctcactgcaacctctgcctcctgggttcaagcaattctcctgtctcagcctcccaagtagctgggattacaggtgtctgccaccacgcccggctaatttttgtatttttaatagagacagggtttcaccatgttggccaggcttgtcttgaactcctgacctcaggtgatccaccagcctcggcatcccaaagtgctgggattacaggcgtgagccattgcgcccggccgagaatgttttttcaaaaaagcaggtcgccaatctgtgtagactcgtgctggccaaggcagtgaccccaagccacatgtggcatcacacttgagacgtggtctaggtgtaaagtacacgcgaaattcccaggacttggtaaacagagagaatgtaaaacacttcccatcggcggccgtgtatactgatcccacattggaatgatactattttgaacaagctgggtaatttacaaaaattttcacctttttgtttgttttctttttgttttttgacttgtaaaaatgtagctatggccgggcaccgtggctcatagcctgtaatcccagcacattgggaggccaaggcaggcggatcacctgaggtcaggagttcaagaccagcctggccaacatggtgaaaccccatctctactaaaaatacaaaaattagctgagtgtggtgaggcactcctgtaattccagctactccggaggctgaggtaggagaattgcttgaacccaggaggcggaggttgcagtgagctgagatcgcaccacggcactccagtttgggtgacaaactgagactccgtttcaaaaaaaaaaaattgtacctataagacccacacaaatatgcccaactgatattggacaaaagagcaaagcgtctcaatgaaggaagagcagcctcttcaacaaacgacgcgggagtcattgcacatccataggcaataaataaataaataaacctcgaccccgtaaaacttttaggaaaataacaggagaaaaccttcaggatcggccgggcgcggtggctcacgcctgtaatcccagcactttgggaggctgaggtgggcagatcacgaggtcaggagatcaagatcatcctggctaacacagtgaaaccccgtctctactaaaaatacaaaaaattagccgggcgtggtggtgggcgcctgtagtcccagctactcgggaggctgaggcaggagaatggcgtgaatctgggaggcggagtttgcagtgagccgagatcgcgcccctgcactccaacctgggcgacagagcgaaactctgtctcaaaaacaaaaaaaaagaaaaaaactttcaggatctaggactaggtcaggagttcttgagcttgacatgaaaagtatgattcataaaaggcacaactcataacctggacttcatcaacattaaagtcttttgctttgtgcaagatcctgttaagaggatgaaaaaaagaactacagactgggagaaatatttgcaatcctcatatctagcaaaggactagtttctagagtgtataatcaactctcaaaactcagtagtcaacaaacaaaaaatggattagacgatgtctctttgtctctttgggtatctgtcttcattgcagtgaatcgtttgtatacattgttttattacagtcacaaaagaaatcatgtattaacaggaataaaaaagcaggttgttacctgtcactagaacaatattatcgcttctggttgccacaataaatcatattatgactttttccaaaatcctccaaccaaaggttgtccccataagcctttcgatatatattattaagatataagaagatgcttaagagacaaagagatcttccgccaaagaatcagatacctggatggcaaataaacacacaaaacgatattcgacatcacgagccattagggaaatgctgattaaaaccacaatgagatgtcactacacacccatcaggatgcttaaaaaaaataatagtgacaacctcaaatactgatgaggatgtggagaaacaaggcactcgtaaatttctggtgggagtgtaaaacggcccagccactctatgcaacagtttagcaattgctttaaaaactaagcacataggccgggaacggtggctcacgcttgcaatcccagcactttgggaggccgaggcgggaggattgcttgagcccaggagttcgagaccagcctgagcaacatggcaaaaaccctgtctctatttttactagataaaaaacgtattttaaaaaactaatcacacaatcaatccacatatgactcggcaagtgcatttgtgggaatttatcctagagaaacgaaaacttaggttccaacaaaaccccacacatgaatgttcctagtagctttattcacagtcgcccctgaatgggaagccatggttcatgtccatcagtccgtgagcgcgtggaccgtggggtgctgctactcagcagtagaaaggaacaagttcttgacacacaggacagcttggatagagcttcacaggatgatgctgaaccaaaaaaagtccatctcaaagctgacatcatgcagggttccagttacgtaaaattcttacagaggagtggttgccctgtgccagggcagcgtggaggaaccctgcggtgggggagtggttctgcgtctagctagtggtagtagttgccggaagctacatgtatcccagtggcacaggattctaaacacacaagcacagatgggtgcctgtaatacccgtgagacctgtggactgtaccaacctcaatttcctggtttggagagtgtactatgcttctatgcaggatgtcaccatggggggaagtgggtgaagggtgtatagggcctcccggtactttttttttttttgcaacttcctgtagttacttcgaaataaaaacttttaaacgtggctaatggaaaattttaaatcacagaggtggctcacgttacatttctattgggcactgttagcctaaaccgggggatccacaaaccatggcccgagggccaaattgaggctgccctctgcctctgtacagcccatgaacgaagacttttttaaatgaatagactttcttttttagagcgattttaggttcacagaaaaactgagcagagtacagcgagtttcccctcaatgtacacactttcccataccattaatgtcttgcatttgcgtggtacatttgctgtaactgatgagccaatattgatacattatcagtaataactgacgttcagggcttctactaggttcactcttggtgttgtacagtctatggggtttcagagacacagtggcaggcgtccatcattgcagcctcacacagaatagtgtcactgcagccgggcgcggtggctcacgcctgtaatcccagcactgtgggaggccaaggagggtgcatcacctgaggtcaggagttcaagatcagcctggccaacgtggtgaaaccccgtctctactgaaaatacaaaaattagctgggtgtggtggcgggagcctggaatcccagctactcaagaggctgaggcaggaaaatcgcttgaacccaggaggtggaggttgcagtgagctaagattgtgccattgcacttcagcttgggcacaaagagcaaaactctgtctcaaaaaaaaaaaaaaaaaaaaaagacaagaaaagaaaaggaaaaagaatagtgtcgctgcctttggaatccagtatctgcccatttatctttttctcctcttgagcccccagcaggtgttgatctgtttactgtcttcacaattttgccttttccagaatgtcctagagctggaatcatgcagcttgcagccttttcagactggtgttttttgttttttttgagatagggtctcactctgtgacccaggttggagggcagtggtgcaatctaagctcactgcaacctccgcattctgggctcaagcaatcctcctgcctcagccccccaagtagctgggactacatgtgtgagccaccatgcccggctaatttttgtattattattataattttttttttttttttttgtagagacaaggtttcaccatgttgcccaggctggtctcctgagctcaagtgatcacccacctcggcctcccaaagcgctgggattacaggtgtgagccaccgcacccggcccagattggcttcttccacgtagcaatgtacatttcagcatcctccacatctgctcaaggcttgacagctcatttccttttatccataaacaatattcccttgcagggaagcgccaccgttcgcacatccacccaccaccacagggtatcctgactgcttccaccgcgcccgtatgaatgaagtggttacaaacacctgcgtgcaggtttcatgtgaaggatggttttgaacatttttaaatgttgaaaaaaatccagaggagaatatttcacaacacatgaaaattatatgaaattccactttcagtatccttaataaaacgtgaatggggctgggcgcggtggctcacgcctgtaaccccagcactctgggaggccgaggcggggggattacctgaggtcaggaatttgagaccagcccggccaacacggcgaaaccccatctctagtaaaaatacaaaaattagccgtgtgtggtggtgggcacctgtagtcccagctactcgggaggctgaggcaggagaattgctttaactcaggaggtggaggttgcagtgagccaagatcacaccactgcactccagcctgggcgagagagtgagacactgtctcaaaaaaaaaaaaaattaatggaacacagccatgccaattaacatacattgtgtggtggcttccatgctacaagggcagaattgaaaagctgcagccaaaaccatctggcccccaaagcagaaaatacttgctgtctggcccacctgccaacccctggaatagacaattacaattcccaactttgaaagtccaggaagaaaaccaaccaaaatgataacggcaacaccagagggatcaaagatcacaaatatttcccttctgcctttcccccaaatttctttttttttttttttttttttttttttgagatggagtctcactctgttgcccaggctggagtgcagtggcgtgatctcggctcactgcaacctccgcttcctgggttcaagtgattctcctgcctcagcctcccgagtagctggaattacaggcatccaccaccacgcctggctaattttagtactttttagtagagacggggtttcactatgttggccaggctggtctcgaactcctgacctcaggtgatccgcccgccttgggctctcaaagtgctgggattacagacctgagccaccaggcctggccaccctcgaatttctaaaatgaacacaatctcttttgtctctttggaagcccatttctatagtgtctttgccggggccccagcaacctgtctgggactcctgaccagactcactcgctcagctctaggggtcgacgaggctgggccatgaggagcaactgacatgacagaaacaaggagtttctcagggccctgattgtgtttggttttttgctttttgtttttaaccagagtcactgctcagccatcacttgtgctgaaggcttgagctctgcgtcaccctttcctaaaacggggtgatgaccacactgatgtcgggagctgtttctgggattcaggttggcacccatagagcatatgccgcggtgaacagtgctcccccaagattcatgtccacacagaagctcccaatgtgaccttattcagaaatagggtctcagcagatgtcaccaagctaagatgaggtcaccctagatttgagtaggccctatctaatgactggcatccgtatgagaagaagagagggcacacaaagggacacaccctgtccatgtggcaacagaggcaggggtcggaatgatgtggccacaagccaaggaatgcctgcagccactcaaaccggaagagaccaggaaggaccctcccctagaccttccagagggagcgtggctctgcagacaccttgattttggacctctggctccaggactgtgagagaatacatttctcttgtttcaagcacccggtttgtggtcctttgtcacagcagccccaggacactgatacgagcacgtccaacggggctggcaactcagtcaggtacacagtgatgatgactgtctatctgccctgtactgagccctctgtgcagagctttacacgcacggccttcctgaacccccacaatgcccccacttcacagaggagtaaactgaggtacagagtggttcaacaccgtccaaggccaccccctgcgggtcttgagtggagcttggattcacagctgggtctctgaccaaagctcacttacaggcctcacccaaccaagcccgccagccccttctctgcctagacatcatgtgtgagccaaacagccatgccacagttgcacaccagagggctgggcacggtggcatcccagtcgaattctttggcagcccctccaagctcccagagctgaggggcagccagggaggggaccagtgctcggctgggcgcctgcttggcttctccgcctgacagtgagactgctggggcgaggctatgtcctgtggccatttctagactgactatggccacatgccagttcatggggctctgaccagccagctgcccttcccgtaacagcttccctcagacccctggcatcggccactctctgggtgcaggcggagcagctggtggtggccaccttggcttgggcaggggggagtctgggggagggaggaacgccacacagagcctgccaagtgctacagaaacaagacgagattagtctgaacgacacacagaacagattgcagggtgtcgggcaatgggatgttttaaagaaataaatctcagctcccggttacagaagcacaaacaaacccaaacaacagaccttcaggagctgctggcttcccggctgccaggctgcgctgggcccggaggggtgggcgggggttcctggagcatcctcagggggcggcgggcgctctcggggtatccccgggcgccctggttggcccacgaccgggatcaggggtttgatcctgaaatttgggaggaatggaggatgcagccctcccagctcctggccatcccacctccgaggtctctctgggacccagttgtccctcccctgggtggcggcagctcctggatatctgtgctgcacctgcccctggtccctgctgctgctggagtggcccctaagacacgcacggcccaccctccccactcaccccttgcccccttccctgctgtctcttgccctggaccctctcacatgcccttccctccaccccccgcctcctgctcccttcctcatcccctgctttgtgtccccgtctcctgctccaggctctgatttgctgggcagctgctgcgccccggaacaaagacgggaagggcaaagtgtgtcctgattcgtgtgccaccgctcacttcttcgcccacctccaggagtttctaatcctcctcgggcttgcctggagggttgggcagaaaaggaacggcaggaaacgcagaagggatccggaacgagcagagctttgtgagtccagggcgacacccccagggccttccgtgggagctcctgcaaggatgcttcccagcactgggtcctggcccaccaagcgcactggctctagctcattctcagagactggactcttccccgagagcctcatttctgtcctctgtgccgtgtaggaggacaggggccattacaccaacgatgaacgataacgccgttaataattcagccgctgccgctgatactcggtcgacaaggagccttttcctcctaaaggcagaaagcacttagatgccgtttattactgcctcgcacgccctgcggggtgggctggcacctgccagggaagccatgtgaggtggggagcggccgccccatggggtctgctgtccaagcactggccagctccaggtgaacccttgtgccatcgcccccatgacaggggccaccctgagggagtagaggggccttgtcttatcatctcgtctttcccccattactttggacagagagtttttcgggcctgtcctgctgggagggtcgctacgtttctagggtccaccttccatcctcccaggaacattccgtccagacctgtgctgtcaggcatggaggcctcccgctgtgaccaccaaacttcacattcattgaagataaagaaagaccaaagtccagttgcttggccacatctgctgcatttctagggcgtggtggccacacacagtggggcacaggcacaggaccgcgtgcactgcaggacgctctgctgacggcgctggcccaggcactgggaggaccctgtgaggaagcacccgggaacggtggcgcacgtagggaacaccacgcggccttgataggagctctccagagagaaagctcaggtcccagcaggggtcacggagaagaaagtctcttccacctgcaggtgggctggggattcagcaggagagaggagaacattccagctgcgggcagcaaggtgggaagcggctatgcttggggtgaagtgcccagtgtgtgtgcaggaaagggcaagaggaaagtgggagggcagggggtcccggcagcacccccaggtgggcagcacattgctcctggcccttgcccacctgtggccgcgccaacccgcttggactgagtctgacctggcaggaactgcatgacagaaaccacagtaacaagtggccaaactctgaggccaggccacccagcccatcccaacacccaaacaccatcttgcctaggctggccaccccgggaacgcatgccgggaatgacaagaggacccagggagagagagaacgaaacactcacttccccagggggaggccccgctggcggcacgggacccaaggtggcaggccggcggcactggtgtcactggaaggacctcagtgaccagctcgccctggaggcctcttcactagttagcagcgtgcagcgcagtgggagatgcttagcgtccccaaatgtgcaggttctccccttctgtctatttttatacattggttttcattctaagcttaatataatcacagaataacatttttgaaaacagaaaagtaaaaaaaaaaaaaaagtgctcataatcacactaggctaacacgtgggcacaccttcctctcaacctctgccatccactgccgtggccactgaccacaggcgctatccacatttatattcatcagggccgggcacgcggctcatgcctgtaatcccagcactttgggaggtccaggcaggagggtcacttgagcctaggagtttgagaccagcctaggcaacagagcaagagtctgtctctaaaaaataaaataaatgaacggggcatggtggtgcatgtctgcaatcccagctacttgagaggctgaggtgggaggatcgctcgagcccgggaggtggaggctgcagtgagctgtgattgtgctgccgccaccgtatgccggcctgagcaatacggtgagactctgtctctaaaaacgaaacttaaaaacattttaaaattaaaaacaattttattaatccgtattatgtaaaattaaaaattcagttgcacttgcgccatttcaagggttcaagagctgcatgaagccagtggccgcagtgcgggacggcgcagacctgggttctgtctgccctggcagaagctctgctgggcagccctgccctgagagcctcatctgcacctcaggcctcttcacagagtttaactgcaacgggcagaatcataacccgtttcctgctttgcgtctgattcactctaaatttccacactgcaacactgcatggaccatttgacagtccttgtcaataccacatcttctcctatctggcagcaccgagcttctgaacgttttacaggtcacagaccttctgggaagtcagatggtgcctcctcctcatataaaaaaaagtggggtaagatctcaggggttcgtgagcccaggtttgaaaactccctgatccaacagagggaccttagagggaccttagtcggtccacctcctctgccgttggattcttatgttctgctcctttttccccactgtaaggaataccacgatgaacatcttcatgcagaagcgtttgtctttctacttttattttcttttgagacaaggtctagctctgtcacccaggctggagtgcaggggcaccatctcggctcactgcaacctctgcctcccaagttcaagcgattctcgtgcctgagcttcccaagtagctgggattacaggcatgtgccaccatgctgaactaatttttgtatttttagttgagatggggttttacggtgttgaccacgctggcctccaactgccaacctcaagtgatctgcccaccttagcctcccaaagcgctggaattacaggcttaagccacgtgccggccactttggcctttctatctgtaatttggattctttcttaggatgaggtccagaggagacattttcacttagggagcagaatctggtgtttttgttgttcttgtttttgttgttgttgtttttgtttttgacaaggtctcactctgtcacccaggcttgagtgcactggtgcgatcatggctcactgcagcctccacctcccaggctcaagcagtcctcctgcctcagcctccggagtagcagcttggattaaaggtgtgcaccaccacacccagctaatttttttttctttttggtagagacggggtctcgctatgttgcccaggcttgtttcagttctttatccaggtcaccaatgcacatccccggggcagggtcagtggacacggtaccagccccatggcgccccgttattccacaccctcgcccaactggccttttaggctggacggtagcttccagcacagaaaccaagggcaggatgaccagtcgcgcttggtggtcaccctccccagcacacccgagagccttgctttctgacactgaggagggcacaggaccaagatagcccagggctcacccccggctcggggaagctcagggtcttggggtctcagggcggggaggcaggacgacgcattggcgacagcagctctccgtatcaccccatcccccaagtcagcctcgaatactcacttggtcaaggatttccaggccgtcgctggactggggcctggggcctggggcttccaaaggagacctctgggtttagtaggtgggctcaccttccagcatgcagaccccacctggccatactctacaggtagcacacgaatgtgggcagcccgggggatactgccatttctaacccctaagctcttctgtgaactacttgccaaataaccatatacctgggggaccctaggcccccggggtggggtgggggagttgtccctcctggccaatctcagccagacacgcagcctgcacatgcagttcttcagatccaccactagaggggaccctcgagccagcctacctgctctgccctccggggggactcaactccgggttaattattaatagacgccccaccgctcagagtggcgatgggtgcacccgagtcctcaccaacacccctgcctggcgggatggccagtcatctggggtcctcggccctgacacccctccccaccccagagcaccaggagcgctctcgctctctctcgctctctcgctctctttctctctttctttctctctctctctctctctctcagccccttcacagcaggggttctcaacgctacgtgcacttcagaaacccccaggaagttcaaaacattcccatgcctgggcgccaccccagcgatcctagtttaattggtctgggtgcagcctgggcatcaggatttttaaagctgcccagggcattctcatgggcagccgggctggggacgcctgctctacagcgtctaggacaattaaccaccttagccaaggatctccagtcccatcatacgaaggccccgggggatggggatggggcaaggagcaccacctctgcttcctgggtctaccatgtggtgggggccagaagcgcacaggagcaaggaaagaccagggaaatgcagattccagggctcgcccagcccctttcagaatccatgtctgcttttctttttctttctttctttttttttttccagacagagtatctctctgtcacccaggctggagtgcagtggcatgatcacagctcactgcagccttcacctcccaggcttaagccatcctcctgcctcagcctcctgagtagctgggaccataggcatgcaccactatgcccagctaatttttatgtattttttatagagatgaggttttgccattttccccaggctggtcttgaactcctaggctcaagcaatccacccaccttggcctcccaaagtgctgggattacaggcgtgagtcacagtgcccggcctccatatctactttttaaaaataaaaagaaagctctcagcagtctgtcttggagacaggctgttttcactccagccttgcactgaagcacacgcttctggcggggtggggagagtcccatccacatccacctcgtcccagcacaaagctgcaactcgccacgttcagcgagcctcccctggaccgggctgacacaggcctgaggtgcgagccacaccgagcccgcggccatgtggccaagaggcattttctgagccttcatcaggagcagggccgggctgtggtaagcaccccccagcacggtctccgggtggggacgagtcccaggccaggctcgctgaccccataccccaggctggtgctcaaccctcacgccgactctgccctacaagggggttcttggccgcacttcacacccgtgaggcatctgcgttttggatgtgggaggtaatggccacaagatcacacataactcaggatgatgccaggactggaaacagatctgtcggaccccaaaatttactccttcaccaccatctgcctcccagcagctggggacggacaggcggacagggtgtctcagtggggactcgagtgtcagagcagagaagggggccatggggagggccctcctcagcccagggttcgggggaatagagaagcctcccccaaaagctgacatgaaggtgcctcgccccaggagctgagtctcaaacatataagctggccggttaggagagaggggaaggaggaagcctaggtagaggggatccctagccaaaggcatgaggcagagagagccccacaagatctagaggcagagaggacgacgaacttggaggtgtgcacagtggggggtggggaggcaggcagcatcgctcagcagggccagatggtgatgggccttggaccccgagtgaaggagatggtgcttcatcctgaaaatgatgggcggcccccggtgggtcccaggcagagggacagcctggcttccagagtgagtgcacagcacgcctgtccgctgcccactgatgccaatacatccccaccctcagttgtgataaaaaaaaaaaaaaagtgtctcctggcattgccatacaccccctgggcacagactcggccccgggtgagaatcactgctctagaagaacctggagggacctgggcatcagcgtctaaaggctcccccaggaacccccacatgcagccaggttgaagaaccagcaaggcgaagggcggggaaaagcgaaccggggtgcattctcacaatacccccagaaagtggatattaccagcctcatcttacaaacagggaaaccgaggctccaagaaaagaaagaatttcccaggttcacactaaccagtgatgccaggactcaaccggcactcaactccctaactcctaaacttgagctccctacgagatggggctgcgggacagagagctgaccggccagcttctggttgtggttctgccacagaatcctcagccccaagaccgtgggccaaccccaccacctctctgagacacaactgggaccttcccctcgcctgggccctggggatgcagggacacggggacgcctgcaggttctgctgcactgttggcctggcaccaccagggggagctccgactgagtccggcctgcgggacccaggccaggaccagagttcgggccccgcctcccccacacctcctcgggttccctggcgcctgacgccacccagctcagcaagcctcctggcacctggagtcctcagttacggctcacggcttccttttatctgcactctccaataactgagatgaatgttatcggttcaccctggggctctaatggactgcatctttactggagggataaaatcagggaagaacccgtcccacagtcacccctgctgaggccagcaaagcctgtgtccttacttcatgccccaccactccccggcttaatcggcctggggtgaccttttatgctgcagccctggggcagacccagctgggttcacatcccagcttggcccgggcactggctgggagacccctggcaagctgctgaccttctccgagccgccctttccccttcgatagcaggggataataggagggcccacctcacggggcgtggggctgtggaaagcacacacgtaccatccatagcccacggtgtccagcgcccaggcgagacccagaccacccacgtccagcatgcgcccggctcacaccacgagctcaacagttaatgacctgctcgctgactgatgtcggctcttactgttgtctgtggtcaccaccattatttgcccagaaatctaatgagcgtaaggaccacagccggggcataggaaggggctgtggaagtcggatgcaggccccctgtgctggctctggggctccgggcttatgcgaccacacgggcactcaccccaaggccatgagggccctcgtggcaccatgcaaccctccccactcaggaaggtctctttgggttccaaggcccagggaacccaccgcagggcacgggcccaactctagctcctgcaagtgtggccagcaaggagtccagatactctggctggactccccagggtgcatagcggctgccaagtcgggtgaatatggtcaacactgccccgggactacatccatcctccacagctatgagaaagagggaggctgaagcctccggggaccacagggggccaggtcacgtgcccagtgggctgcagggcagagcggggagctggagaccagcacatctgggcttgggccagccctgtgcgtgagcctaatgatgccacccgggcctcttgggcactcgcttggggactgaaaatctcctgcccctccggtgatgggaacagaagggaccaggactcccgggggcttagccttggtcatgggcccatcagacctggtagggcctgtttagtcctagtgagtctcaaggagagagaagaatgtggacaccccgacgcacccttcacagtcctctcagtggggtgtaaagtggggactccctgctgaagcccttgcctcagggaggggctcctgccacagccacggccacagccgcgggcaggtcgggcagatgcctccagcgctcacctggcatcacaggtgacgcaggtgagtgcttcctgcccaggtcaggccttgggggcctcccgagagcccacgcccagaaccaggaactcacctgctgtcactttccagaaacacggagccgcggctctcggccagcgccgcgctgatgggcgagaggcagaagggcgaggagaaggtgtctgagtctgagtcaaaggagctgtctctgctcacgccctcggctgacagttccaaagagccatcctcctccccggcctcgggccgcggctcccgcccctcctcggtgacatcctgcggactgaccgtcgacaagatcccggaggggctgcaagcaggctgcgaggctggctgggcaccatccacccccaagccctgcgccagcttctcctcatcctctggcgcagggctggcgagcatgcggtctggaacactctgggccaccaccaggatgtcctcatctttgggggtcagggtaggccgcagctccgtcggggagggctggtgggaggctcctgagctccgggtgcgccggccccgagggcggggtgccttgcgaacgggggagctctcgggtgtgatgtagcgcagggcctcctcgtcctgcctctggatgcgagagttggggacccatgccaggatgagggtggctcccagcatctcatccttctccatgtacaagcacaggtaacctgtgaggagccagggggatggcacgttagaggccaggaggctgtggatgaggcccttgtggtacctttggcgagctgctcggagaggccactgccctttagtaaagtgccagtccggcctcagatacagcctggccctgagcaaaaacactagagggaaactgtggagcttgaaatgaattccagctatgcgtgttttttaagaacacacacttccggcagatccagggggcactggtccccaagcaccggcctgccatgcgcctttctttttggtttttgggtttgtttcttttttctttgagacagggtctcgctctgtgtctcaagctggagtgcagtggcacaatctcagcttactgcaacccccacctcctaggctcaagcaatcctcccacctcagctcccgagtagctgggactacaggtgcacaccaccacacccagctaatttttttttttttttttttggtagaaataaggtttcactatgttgcccaggctagtctcaaacgcctgagctcaagcgaaccgcccacctcagcctcccaaagtgctaggattacaggcgatgagccacgaactcaggcttgccatgcacctttccaagtacaccaggggctctccctgtgttcagagccctgaccctggccccagggctcacctgcctgcagcctccctgtctgtgtgagcccagcggcccaggtgcccagcttcatggctttacagcactgttaggagggatggaggctggagacttcattctgtttcacaaaaagaattcatacagccaggcgtgatggctcacgcctgtaatcccagcactttgggaggccaaggcgggtggatcacgaggtcaggagatcgagaccatcgtggctaacatggtgaaaccctgtctctactaaatgtacaaaaaattagccgggcgtgatggtgggcgcctgtagtcccagctacttgggaggctgaggcaggagaatggcgtgaacccaggagacggagcttgcagtgagccgagattgcaccactgcactccagcctggatgacagagcgagactccgtctcaaaaaaaaaaaaaaaattcatccaagctgggtggtatttgggccttttccaatcatcagtggcactcatggcatttttttaatgcagattgtttgaggaaggggccacctttgcagatgagcattgatgtcacacacggggttgctggtgacatgggaggagggatttctcctgggccagagcaagtgggtgggtgctcagttctggggggaggtggcatttcctaacccagcaccacgcagtttcaggatatcctgattcctgggcctcccccacccactctccaggcctctacaactcagacccctagaatctcctaagcactgctcctgttgccaaaacaggctgggaaatttggggaatgtcagccagctgggcattaggataacatgagcctgaggctgagaagtgtttccacatcctttgagatcggcaagagggtccgaggtggctactccctggtctctctctctagaacaccctcaggccaggcaacctccgggtcgaggggccgcatcgcccagaacctgcacccctttctagggcactccagggaagcccctgcccacacagccgcagccaaccagccggtggctataaagatacacttatcaaggcagggggacagaacactctctttaaatgtttcattggcataatttaaacttttgtcttgtttaaaaatttatttattcagtattcgattgaaacataatctgcataaagtgcccagatctcactgtaatttataacttttttttttttaatagagatgaaatctaactctgttgcccaggctggtctcaaactcctgggttcaagcaatcctcccacctcagcctcccaaagtgctgggattataggtgtgaaccacctcgcccagatgacaactttactattttgccatcttgtctgggacttctgtctgtactcttgcccaagccaagcaaatgttagggtgtgccggggcaggccacagccaggctgcaggacactggggccctgaaacatccttttagcagccagggaaggggacggcaacaggaagaaatgagaagagagagtccagagactgccctgcagccccacctccaccacacactggcactgtgcagccgagagtcgctcagcctctctgaacaccagcgtccttacccacctaagaggcctgctggggccctggccactcccatgaggttgttgtgcaaattaaataaagcaacagatgaacaaagcaatgcatttatttgttgcaagtcattcacacgaatgacaaggggccaggcaggcctgagggatcactaacccatcttttgtccctccctttggaagcagcagggctgagggactcacccagcctgccatgagccagacttaacaccccccagaccctccttccgggaggacagctgctgttagttacacgttctggaagaggaaccaaatgcactctcacgtgctgtggcccagggcctttagagccctggctcggaaaataacctgggctgtgcgaccctggagcctcgcctgccctggctcacctgggtggtgctcccccagcccctgcagcccctccggcgggtgcacgcagacattgttcttggagtagatgatctctccatccaggacagagggggacccgctgccgctgccaccgggggtgagggtcaggaggtccgaggctttggaggaggccctgcgaaggaggcggcccagagacattgccgggcaagtgtttccatcctccgcatgcgtcggcccgggcagggctcgtcaagacctgcctgggggaggaagagagaggagatggtcaaggttgtggacttgcgttctgtctcacagcagtacgtgtcgcctcggcacccggtgggttctggttaaccacaggagcgtgtcctgctggtgaacagctctgtacagggtaggccacgttctccatcttggccaggccaccctgtccatcgcaggaggctgagcagcgtccctcgcctcaacctgtggatgccaccagcacctcccttcccagtacgaaaactagaacatctccaggctttgccaaatgtgccctggagggcaaaatccctcccaaggagaaccactaagctacagaaactctgttcccaccttagcaatttcacaaaaacctccacaaaaacgtttttttcacaaaaaaaaacgttttcttttctcagtttcccacctgcatcagcacaaatgagcccttctaattcattaaaaagaaataaacaggcaaggcgcactggctcacgcctgtaatcccagtactctgggaggctgaggcagacagatcacttgaggtaaggggttcgagaccagcctggccaacatggtgaaacatcatctctaccaaaaatacaaaaatgagccaggtgcggtggcgggcgcctacagtcccagctactcgggaggctaaggcaggtgaatcgcttgaacccaagaggcggagggtgcagtgagctgagatcacatcactgcactccagcctgggcaacagagcgagactctgtctcaaaaaaaaagaaagaaggaaaatttataaactaaaggattagtatacagaatatataaagaactcctataaattcatggtgaaaaggagcaacatctcaacagaaaaaaatgggtgctccacacaagaggaaaaccaaagaactgataaatatgtaaagagattctcagttccaaacaaaaattcaacacccaacaaaccagcaaaaagcaattttaagtcaaaaaatactgaggatgagggaaaggggagctgtcaccagtcctgtctcctccaatgcgggagcaacatggcagaatctggcaccactgagaaggcccaaagccccctgaaattcctcccttaggaaatacctgagggtggttcttcaaactgcaatttgcagccctatcatagatcctgaaatcaatttagtgggtcaacaccagcataagaagaaaaaaagaaaaaaaaaatagaaaatgcccttgaaccctggccataggtaggctcagcactgggtcagagaacttctgccccgtgaggacacattcatgtgggtaagacgacctgggacgtatgaaatgtatatataatgcgctgtgacctgaaacatgtgatgactctgcctggaggaacccaaggaaacacctaatcaaatgctttgcagccagtttctaccaacaaaaatgaaaccaccaaacctctagatagcagatgagaaccaactagacttctatacacacatggagctcacaaacacacacaccaagccacgccaaggaacgaccgtgtcagtgaagaggcaggcacagctgggcacaatgactcatgcctgtaatccaagcactttggggggccgaggcaggtggatcacctgaggtcaggagttcgagaccagcctggccaacatggcaaaaccccgtcttgactaaaaatagaaaaaaaagttagccgggtgtggtggcacgagcctataatcccagctactcgggagggtgaggcaggagaattgcttgaacccgggaggtggaggttgcagtgagctgggattgagtcactgcactccagcctgggcgacagagtgagactccgtctcaaaaaaataaaataaataaaaaaaataaaagacaggcacagagccacgctgcatcctgatcactgatgggggatgtccaggactctgaccacagctgggctgcgtgcaggccggcttcacaaaagtctgcagaggtcagggggctgggagacgacagccacagaggggcttcaccttcacctctttgaaggaagaaaagacttgaagccaacatgataagaattagcaactgggagtgaataaaccaaatgtggtacagtggaatattatttggccttaaaagaaaggaaattctgactgggagcggtggctcacacctgtaatcccagcactttgggaggccgagatgggcggatcacctgaggtcaggagttcgagatcagcctggtcaacatagcaaaaccccgcctctactaaaaatacaaaaattagccaggtgtggtggcatgtgcctgtagtcccagctacatgggaggctgaagcaggagaatcgcttaaatccaggaggtggaggtttcagtgagccgagatcacgccactgcactccagcctgggtgacagagcgagactccatctcaaaaaaaaaaaaaaaaaaaagaattagtaactgggagtggataaaccaaatgtagtataatggaatattatttggccttgaaaagaaagtctgacgcctgctacagcatggatgaaccccgaaaacattgcgctaagtgaaacaaatcagtcacaagagacaagcactgtaggattctactcgtgtgaggtccctagagcagttaggttcacagagacaggaagtggaatggtgggtgccagggggtgaggtggggggaatagggaggtcatgtttaagggggacagagcttcagcttgggaggatgaaagcgtcctggaggtggacagtggcggcggctctacaacatgatcgtactcaatgccgctgaacctgatacttaaaaatggttaaagtggtaagttttatgttatatgtattttaccacaataaaaaagttaaaaattatctattagtggagggtctccgggtatatgatcttgttctttgaactttctgcattttttacatttctccaaagatccagagctggttgagggtggtccctaaatcaagtccctttcacctccagcacttggctaggctctgggacagagggtgggtgggtgggtggaggggtccccactggctcagcagaactggctcccagcctggcaggaggcagggggcagatgtcagtggtgatggccaccatcccaggaccaggcggctcagcgctctctgcctctctgggttcctctcctctgaccccctccatgcttcagcctcccccagccctgtttgtgtatttccaattgtctccatggctgctgacttcccaagcacaatattccaaagatgttccagccagcccaggagtggccttcccattcccatgtctttcctctgacagatccatcacccccatctccccatctcagagatcccgacgtcaacatcacttgtgaaaatcaccagttctgggggtggggacccagctcagatcctcacctcctcagccttgagccacagacgccctctgcctgatctcaaccgtctccagggccctcatccactcagctctccctagcccacccctttttaggctccctcaacatgtccaatgaaggctgcagaagaaagtcgaccccttggtgcaggggtcagcaaacttgttctgcaaaaggccagagagtaaatgctttggactctctgggccggagagtctctgtcgtgaccactcaactcggcccttggagtgcaggagcagccacagacagtaaatgatgggcatgactgtgacagtgaagctttactgacagacactcaagcttaaattctagatcatttttcacgtgtctcaaaaagaattctttccatttttcaacccccttaaaaaacgtaaaaaccggccaggcgcggtggctcacgcctgtaatcttggtactttgggaggcctaggtgggcggatcacctgaggtcgggagctcgacaccagcctgaccaacatggagaaattccatctctactaaaaatacaaaattagccgggcgtgatggtgcatgcctgtgatcccagctactcgggaggctcaagcgggagaatcgcttgaacccagggggcagaggttgtggtgagcctagatcgctccattgcactccagcctgggcgacagagcaagactccatctcaaaaaaaaaaaaaaaaaaaaaaagtaaaaaccatccttagctcacaggctgtacaaaacaggtggaaggctggctttggcctgtgggttgcagatggcagtgccctggcatagaccatctgaccaaatccaggggattcttctccacctatccaaaccagctctctgccaacctctccaggaagccttctggccactcttggcctaaacacttcatcccacacaggggcatatgacaaccaagtgacgaaacttaattaaaaaaatcacactgcaaactacaaatcaaaaaacatattgtccttcccaataatcacatggaaaagctatgttctgttctaatgttatccagaatagtttaagaattcaagaattcttcaagaattgcaaggtcagttaataagccctgcaagaaaattgctcgccgtcctctagaccagccatgtccaacagaaacactgcaggagacatagatacaattttaaattttctggtaagcaaaaaaaaaaaaaaaagtgaaattaattttaataatttttagcataatatatccaaaatattattatttcagcatatagtcaatatgaaaacattatttctttattttttttttattttttgagacggagtctcactctgtagcccaggctggagtgcaacggtgcaatctcggctcactgcaagctccgcctcccaggttcacgccattctcctgcttcagcctcccgagtagctgggactacaggcgcccgccaccatgcccggctaatttttttgtatttttagtagagatggggtttcaccatgttagccaggatggtctcgatctcctgacctcgtgatccgcctgcctcggcctcccaaagtgctgggattacaggcgtgagccaccgtgcccagcctgaaaaaattattaatgaaatcttttacattctttttttttttttagagacaggttgtcacccaggctagagtgcagtggtgtgatcacagctcactgtattctgaaactcctgggctcaaggaatcctcctgcccagtctcccaaatagcctggactaaaggcacatgccaccaggtcccgctaatttttttattttttgtagagatgaggtttcacttttttgcccaggctggtcttgaacttctggcctcaagtgatcctcctgcctcagccttccaaagtgttaggattacaggcgggagccaccgcacctggcctattttatgtccttaaagtctccaaagtctgctgtgcattttgcacttaagcacgtcaaagttctgctcagccacgttttgggtgctctgtagcctgcgcggtgtccacactggacaaggccgcagcggggctggagcccacctccttctgtgtttcaaatggctctactcagtgtgatcgctccagttgccagagctggctgcacacagctctcagctgcttccccaaatcaaaaccctctttaagtgaaaatgttttgccagcactgaggataatcaaaagaatgtgctggaagctttaaaggagattccgaaatacaagtgttcaaaatacagcattttctcccataccatgacaggcagaacctcactgtggctctgcgaggtgcgtcccaacagtgcagctttacggaggagaagacaggttctgaccactcagggtcatttcgtgagcgggaaaccctgcagcgtgagaccttcgtcccccacgtgcagaactccggctcctccatcacccgccacctgggacaccaggacaacccccccccgcccctcccagattgttctggagagactgggctctttttggagaaatggagcatgtctattaaacattagacaggactgtttgctctctaaaaacaattctccttatttgtaaagtgcatttgctgtttcgcaagaggctatttcatcgaaatccaacctagttcccaacctctggtcaccagcaaactagaagtggagaatccttggcccattttttaaaacttttttttagttatgaaacacactcagagaaggaaaaggaagaatacgtgtcccttaaatcacataatcctaagacatttatgtattctctactatattttgtgccctataatgaatgagttaatgaaaaacccactccttggaattatatcatatcttgctttcagttggatcataaatatattttcccaggtgaagtatacttatgatataacaaactttagggttgaagtacatcccctaaaattcctgtgttgaagtcttaaaccccagtacccaagaatgaaactgtttttgaagacagcatctttatagaggtgatcaagttaccttgaggtcaatatgactggtgtctttataaaaagaggaagttggtagcaggtgcctatatacaaggagagtgctgtgtgaatacaatgatgccacctaccagcaaggagcaggcctggagcagcccctccctcacagcctcctaaggaaacaatcctgccgacaccttgatcttagacttcctgcctccagggctgtcagagagatttctattgctcaagccacctggaccctggtactttgttagggcagccctagcaaacaaatataccacattattaacacatttaaaaagtataaggccaggtgtggtggctcacgcctgtaatcccagcactttggaagactgaggcgggcggatcacctgagatcaggagttcaagaccagcctggccaacatggtgaaatcctgtctctactaaaaaatacaaaaattagccaagcgtaggggcgggtgcctgtagtcccagctactcaggaggctgaggcaggagaactgcttgtactcaggaggtggaggttgcagtgagctgagatggcgccactgcactccagcctgggagacagagcgagactccatctcaaaacaaataaataaataaaaataaaaattataaatgccaaccctccatcttcatagaatcagccgccattgctaggcatctggcttccaactagtggctactgaaataataaactccacattttaatacataaatcttcatctgtatcctcattatttccaggattactgtttccccaggaggataaactggaccccaactcgtattgcccagtgggttccccgaaatgtaagagtgctgccagggatttaaatctccaccaggctgggaactgaaaaatggttttctgactgggcacagtggttcacacttgtaattccaacaatttgggaggctgacgtgggaggattgctcaagcccaggagctcaaaaccagcctgggcagggccgggcacggtggctcacgcctgtaatcccagcactttgggaggccaaggcgggtggatcacctgaggtcgggagttcgacaccagcctgaccaacatggagaaaccccgtgtctactaaaaatacaaaattagacaggcatggtggtgcatgcctgtaatcccagctactcgggaggctgaagcatgagaatcgcttgaactcaggtggtggaggttgcagtgagccgagatcgtgccattgcactccagcctggaaacaagagtgaaactccatctcaaaaaacaaaaacaaacaaacaaaccagcctgggcaacataacaagatcccacttctaaaaaattagctgggggtggtggtgtgtgcctgtaatcccagctactcgggaggctaaggtggatcacttgagcccaggacgtcgaggctgcattgagccatgattgcaccactgcaccccaccctgggtgacagattatcctatatttattagacatttgtgttcacttgtgaattatctgttggtgtgctttgacaatttttctgctggcgtggtggaattcttattatttttaatacagagattaagctgagatggaattttcattgatatgtaagaactctttatatagtaaagatcactacatacacaccatagacacacaccatagatacatacatcacgcaccacataccataggcacacaccataggcacactgcataaacatcacagacacacacaccacacaccacagacacacacactgcacacaccatagacacatcacacacacaaccccataggcacacaccacactctacacacacaccatagacacacacatccaccacagatgcacacataccatgacacacccaggcacacacactatgacacacacacaccatgacacacaaacacacaccatgacacacaccatgacacacacaaacacataccatgacacacatgtatttctcctaatttgttgtttgccttttatttatattacctattttgacatacggaggtttaaaacttttatgtaaattgatggtaactttttcttagtaacttcctttattacttttatacttaatataatcctttccaagctaaagatcgttaaacattggtctatattttcttctatgttcaatgaactacttttaatgtttcaaaagcctaattcaaagcatatatttacctgaaagggactcacatgttaactaaagtatcgagcagttcattgagtgtttatgttgtttttattgctaggccctgtttttattgcttactcagttatctgacaaaaacactgaaatctatgataaattaataaagctgggacgtttatttttatttatttatttatttagagacagagtttctctcttgttgcccaggctagtggagtgcagtggtgctatcttggctcactgcaacctcttcctgccaggttcaagtgattctcctgcctcagactcccgagtagctgggattacaggtgcccaccaccacgcctggctaatttttgtatttttttagtagacaccagagttcaccacgttggccaggctggtctcgaactcctgccctcaggtgatccacctgccttggcctccaaaagtgctgggattacaggcgtgagccaccacgtccggccctgtttttatttttttgaggtggagtctcacactgtcgcccaggctggagtgaaatggcacaatcttggctcactgcaacctccgcctcccaggttcaagcaattctcctgcctcagcctcccatgtagctaggattacaggcacctgccattacacctggctaatttttgtatttttagtagagacggttttgccatgttggccaggctggtgtcaaactcctgacctcaggtgatccgcccgcctcaacctcccaaagtgctgggattacaggcgtgagccaccatgactggccggggacatttattatataaaactttatggacaattttaagaggtgccttggccgtgacccggaggcctatgtggtttggcccacctcatggtccacaccctctcagctgccgcaacgctgcacatgtgacaaacacgtgtgtgagatccacggttctcatactatcacacgctctggtgagagtaatggctcatcacaggcaagatttaccgcgaaatgggacaggcggggtcattttaacttcctccccaggccaccccctccaccctgctgaaagcacctgcaataaaatacgttttcagaaattcaccagatgtcccttccaaagatcaagcccagctgctcccctcccctttatgggcaggcggccctccaggggtattgcgaacgggctccagcgacagctgctcggaggctaccatgggacagtacccgggcagccacagccctccatgccctccttccgccccgcagtcccagcatgaagccacagttccccatgagcccagggcaagctcgtcagagacccttccctgcggaggcccacagcccctgcggccacttcttccccgaatctcaatcctgcttcgtgtggccactgctgaaagagacgctcagtgccacttagagcgcacagcccactggtccaggctgtgcacacccagggacccttccaggcattcctcacctcggtgcaggccaggagcgagaactgctgccgggcccccccccaccggctcagggcgtggctggggtggccctgctcctcggtggcccgcctggccccgctgtgggcttccctcccaccaccccggccacagtcacagcgggttgtgtcaggccgccctcatctcccacctcccaggcccagctggcgcctccagccctggtgtgaatttccattcagggtccaaaatccaccttggcagcgccctcattctgcagctccacggagccctccagccagagaagagaaatctgagtttaacccgatcctgtcagaagagcgggaggaaagagctccggcggacagggctcccaggcccctccaggacgaggttggaggaccaagcgcagaaggtaaggacgcagccctcggcgagtgcgggcggggcccaaatccctcgccggccggctaagcagaagcggcttttggctttccgcgacaaagcgcagctccgggccagacggtcctgcccggccctacccgcagccccggccccaaccagaggccccacttcagcccaccaggcaggactgcagcggggcacgccccacggaccccagccccttggagatcccaaaccccatgcctgctgctcccaccccggaggagtcagaggccgagaagcacacacaccatagaccccacaccacgcacaccatagacacacataccacacaccacacaccataccacacacaacacacaccacagacacacacaccatacaccatagacacacataccacacacaccatagacacacacactacacatcatagacacacacaccacacacaccatagacacacacaccacacaccatagacacacaccacacgcaccatagacaaaccacgcacaccatgcacacaccacacaccatatacacacacaccacacacgacacaccataggcacacacaccacacaccacacaccatagacacacacaccacacaccataagcacacacaccacacacaccatagacatacacaccatagacacacagacacacatgccatagacacacatgccacacacgacacaccatagtcacaccacacatacaccagacaccaagacacacacactacatacacaccatagacacacatacctaccacacactacaaaccataggcacatacaccatagacacacgcactacatacacaccgtagacacacaccacagatacatacatcacacaccacataccataggcacactgcataaacatcacacacacaccacacaccatagacacacacaccacacacaccatagacacaccacacacacaaccccgtaggcacacaccacactctacacacacaccatagacacacacacacaccacagatgcacacataccatgacacaaccaggcacacacactatgacacacacacacataccatgacacacacacaccatatacacacaaacaccacagacacacacacaccataggcacacacaaacacaccaggacacacacaccatagacacacacataccatgacacacacgcaccccatgacacacaccacacacagccaccctctgctctaccagctttgcctctgttctccgacagcgccagtgttgacacgccagaggctgcctgggccccactccttcccagctgtctccaggattagggaagccccaggcggatccggggccgcaggagcctccctacccagcccccatgctggtctgtcttgggtccataaacacaagtcagccacctgtcaccgggcggcaggaagtgcaggctctgtgagctggaggagggggcgcctaggctctgagggctgaataaggggcctggcaaatgcccccggagagccctggagagttttgcagcagtcctggcacctgggcttcggggcccgcctgctgggagcagccgcctgctgggagcacctccttgctggaagcacccccctgccaggagccccccacccccacccaggagcaccctcctgctagagtgccagggagacactgctgcctaatggccaggagcttgcccagggcagtgacttctggtccacttctgtcccttggttgtgtccctaagacccagggaccctggaaggttcacctgtcggtgtcacacggttccttcttcacacagcaggaacagaggtacagagaatggcgtccaggcctccttaaggactctcaatccatgagacaggaagccccacagggaagcagtggccccccgccccctatctcctcacatacagcactctgtaccttctgctcatttttctgtaaacctaaaactgctctaaacaatgaagtccgccacgcagaaactgcacacggatgttgagagcagctttactcataactgccaacactcagaagcaaccgagatgttctccaacagctgaataaataaataaactgtgatacacctaaataatggaggattatttaatactaaaaagaaaggggcggccgggcatggtggctcacgccagtaatcctagcacttagggaggccaaggcgggtggatcacctgaggtcaagagttcacgaccagcctggtcaatatggcaaaaccccatcgctaatttaaaaatacaaaaattagccaggcatggtggcgcacgcctgtaatcccagctactcaggaggctgaggcacgagaatcacttgaacccgggaggcagaggtggcagtgagccaagattgtgccactgcactccagcctgggtgacagagggagactctctctccaaaacaaacaaacatcatcttctgggggaggggggaatctattagtttaaaataaaaagaggcttgagatcaggaagcttgcatccaaagaggtgtggaggaggcgtggacgagggtggagttgtgtggaccaatgccgagaacaggcaggcactagaggcaggctgaacagagcagagtcaaagacaacgtttggttcctggactgagaacccagctgccggcagcccaagttgtctgatgggagagtttcctaatgtccttgaatctgcaagatgcaagactttgaatggcccttgcccacagcagtgtggagcagttgatgcccatgaccttagggacctggagtcctgcggggtttgaggggggcaaagaaaaccattcgtcctgggaggcaaggaagctggatgtcaggaaggctgccccagtatggaactcagagcaagggggacatccaggttcccttctgcgggcctggggctcttcctaggggccagatgccttctcatcagtacacgaacagaggcgggggcagccagcagaactcctaagacacaaaatgagtgaacactggaaagggagctgagacaggcctgcagcaaagaacagacaccaggcttttccaatctataggaaggactcagagttcatcaaaatcaaaatagcaatgcaagatgctcaaagcaccttgtggcaattattacaaatcccctccccaaatcctgagagatgaagatggatagagaagctgaggaggctgggcacggtagctcatgtctgcaatcctaacagtttcgggagtccgaggtgggcggatcgcctgagtccaggagtttgagaccagcttgggcaacatggtgaaaccccgtctctacaaaaaagcaaaaattagctgggcatggtggcatgtgcctatagtcccagatactcagaaggctgagtcaagagaatcgcttgagcccaggagttcgagatcagcctgggggacatggagaaaccttgtctctacaaaaaaactttaaaaattagccaggcttggtggcctgtgcctatagtctcagctactcaggaggctgaggtgggaggatcgctcgaccctgggagttgaggctgcaatgagctgtacttgcgccactgcactgcagcctgggtgacagagcaagaccctgtctcaaaaaaaaaaagaggccgggtgcagtagctcatgcctgtaatcccagcactttgggaggctgaggcggcagatcgcttgaggtcaggagtttgagaccagcctggccaacatggcgaaaccccgtctctactagaaatacaaaaactagctgggcatggtggcaggcgcctgtaatcccagctacttgggaggctgaggcgggagaattgcttgaacccgggaggcagaggttgcagtgagctgagatcgcaccactgcactccagcctgggcaacacggcaagactccaactcaaaaaaaaaaaaaaaaaaaaaagagaagcagctaagggtagatccttgacaataagaaccccccattctcctcaaatgcatccacttcacatttgtattttgaaacggtgatgtccttgttggtttgtgttttcaataataagctcccgagtgcatgacacctccgagacgctccttttataatgtgcctcccagaatgccatcttcgttaaggttccaaatgccttgtttttgttgatggaaaggatagcaatgccaacttggcagttggcacaaagaattcacagatggattgaagccaagatctacaatttgcatcagcttgagtgtacaaaaaaaagaaaagaaaaaaagaatagccgggcgcagtggctcacgcctgtaatcccagcactctggaaggccgaggcagttgcatcacctgaagtcgggagttcatgaccagcctggccaacatggtaacaccctgtctattagaaatacaaaaattagctgagcatggtagcacacacctgtaatcacagttgctcgggaggctgaggcaggagaatcgcttgaacccaggaggcagaggttacagtgagccaagatggcaccattgcactccagcctgggtgacagagcgagactctatctcaaaaaagaaaaagaaaaaaaagaatgattttagaaggcaaaaagtaaaagcgtcaatgctgattctaaaccatcagaccggggcatgatgaccagttgattttttttttttttgagacagagtctcgctctgtcgcccaggctggagtgcagtggcgcaatctaaggtcactgcaatctccgcctcctgggttcaagcaattctccagagtagctggaattacaggcgcgcgccaccacacccagctaacttttgtattttttttagtatagacggggtttcaccatgtgggccaagatggtttcaatctcctgacctcgtgatccgcctacctcgacctcccaaagcgccgggattacacgcgtgagccaccgccccgagccgaccagttgatttctgtgctgctcaaagccattggtgaccagtaggtagggccagatttctgcaaaataggccattgtgtaattcgaaaggaaagaacaacttggccattcctcaacaaaaatacacaggctcataaaacaaaaaactgtgcagaaactcctccaccagagagtcattctttcccagaaacctgcaactctttaagaattagagcaccattgagaagcatggagtcgcagcacctgcagctggcaggggtgttaaactggtgataaaggtagctgaagtctgcttccaggacgagagcgctttgagggggctggagtagggggagctgcctgcaaggtgaagacgtgggaaacctcagaagccctaaggagagaggggcgggcaggggaggagaggggcagcagatctattctttcacaatgctgttgggaactggccaggctgttgggttggagctgacacagggcgcagctgtgagcctgctgttaaccacacatgttcccttcccgtcccctaggagccacttggccactgaaacttggcctggaacagccaaagatttggtgactcactgtgtgagcagtgggggtgggtcttctctagcaaatattcacagggcatgaggttaggacatctactacccaaaattcactgcccaagatttggtgacttataccctagaaaagagagtcctcctcaatgtagaaagtggcaaagtcaccagaaaaccagaaatgagcaaacacagataaagaaatgacacaaccgtctcccctcttgtctccttttgaaagccctcattccacgcgtatgagcttcctacggctgctgtgacaaatgacacaaacttaccagctacaacacaaatgcataaccttacagtcctggaggtctgaaatctggaatgggtctcacagggctaaaaccaggtatcagcagggctggttcctcctggaggctctaagggagagtctgttttcttgctttttccagcttctagaggtcacccacactccttgctctcgaccccttcctgcatcttcaaggccagcagtggccgatcgagtccttctcatacctcatctctctgaccctgactctcctgcctgatcctgcgattgcatcaggcccactcatataacccaggatcatcccccatttcaaggtcagctgctgagcaaccttaattccatccccaacttgaatccgtggccacgtaacataccatatttacaaattccctggattaggacatgggcatctttgggggccattcttctgccaaccacaccaaaccgaggacactgtaaggagctgatttccaactcgcagggcggcctctgacctgctcacccactgacggtgaaccccccacgcagagtgactactcttttagcagtaggatgaggaccgaggcctagaacccaggagaggagcacgcctgggccccgacgtccctgtgagggcagcgagaatggacacaggtgggctacaggttcatgaccaggacctgcccgtggaggctgcctccacctaaggtcttagtttcctgtcctggcctaaagggcttcatcagttcccaaacaggaaaacaaaaagaacagaggtgcaaaagtctcttccagaaccctcctggaggtagcctggagccactaggagagaggtatcaccccagcctcttctcttgctcactctgtgccgtgcaccggcctcagggccaccttgggttaggggccaggatgcagcagtcagcaggacagacctggtcctggaaacccatggagctggcagttcccactcaccagagggacgcagcccatgcccactagtgacaggcaggggcagaggcagaggcaggcagggtgtgggggccacgggacgcagcccaccaccgattattcccatggccatgtcactgccagactgctcaggagcaacacgcactgagcccggtcacctggcacatggccggcagaaactggttcatctgctttgccctcaaagcccaagcaacaaagaacagggaaacagcgacaccttattaaacacgagccagacacacgcaaacaaggatcgcgttgcccccgctgcagaacgtctgctgctggcatgccttggatgaggccccagcttcctccacctgcccagagccaggcaggggccctacccatcttcctgggaacccctggctttgcgggtcaaagggcgatatggaatcttgtaggcagccaggatcaggacccagtccccgggcagcaggcttggggaaggtagctccttcagtctcatcaggaggataatcccctgcggggccgccgtgatttctcctcgcagctgcgctgaacttcaagttacaggatgaattgagaaaataaagatactggctgcacacagaagccacattcaggatacacccggaaagcctggggcccaaagatgagcctctatgcagaagcgagaacgggacatcaagttgtatttaaaatgaagaaactagggcttagggcattcactgcagtgctgggatcttggaccatagggaaagaggacccctgagaggctataacggggcaggaccatcaccaaaacggtggtgagggaaaacctggtggcctgtgtggctgtgactctccttttgcaactgtccagcggtcaccctgattagcacccactccctggaaaaccccaaagcctctgcctccaaggagagaccatctgccatttgtgcacccttgatagtagattgtaaaatcccatttcccccgcaaagagccaaggaggtcaggcctgggagaagaaactcaactcagaggtgagcctggatctgggactaaggaaagactaaacacaaagggtaagggaagatgcagacccagccaggaaatcaaaaactgccctgagtctggctcaggtacctcctacttctatgctgtgcctgtaaacatggaggcctaaagcttctcagcatctgtcagtgaaggagcagtgaatgcaccgcaaaacaaaactgaaactggggggacatattaacaacacccaaaagcaacacaactgatcttgctttggaaagcattttagttacagaaaaggcaaaaggctgtcaaatgacatctgtaaagttcaccctttcccccacttccagaaggctagagtaatgatgaactatattggagcattgaattcaggctcactcaacatgcaaaaagcagtacacgactgaagtgtgcaagccagcatggatgcgggcttggcacccgcagtacgttggcttcatagtgaccaatccagaaagaccacggagaaaatactgccacatctcagcgtctgcagcccatacaggcaagcagacacatgtatcaccttccaacgcctgcacagactcaccgcccaaggctcagcaacagaagggcaggccattccgactggacagtggatttggattatttctcttttctttctgttattcatgtgtcagaagccaccacgggcagaaatcgaacttagtcttacagtggcccgatttctctcatcctttgaggatggttatgtaagttccgaagacagagtaaagaacgtatttcaaatcagatgccaccagacagctcataaaagcagatttattagagatgcaacatcaggtgctcaaaggacagataggataaaaacaccaacaaagccaacaggataaaaaacactgccgctgaggtgaacggaaaaaggcctccaacatcattgccccatatttttgggaagggtgcaaatgtgtgctctctcctgtgcactggcctcattaacagcaatataatgcaaatgcaatacaaatggtgtacaattcgatcataaaatcatcctctgcgctgtcaccttcacatcccagagccacccgcccccggtgcttaatgctggatgaaacaaagtagctaatcttacaagagaatttaggcctgtgacaaaaatcagggtccctcagccagggaagaaggggagctaaaattttcacaggaggtggtgttgccaggcaacctgatcagctctgctccccatagcatcctgcagggacccagcccccggtcaagttgtaaagataagggtacacatacgcacaaatagtaaatcctacatctgcctggaatcactttccacctcatggaccacacaaaggggagtgaggagtcaaagcacaaaaacaaaatgttttgtgtcaatctagttaaatgtggaaaatccaaataacggtcattaataacagtgttaaaatgttaccatttgacattacttaccacatcctaaatggtaactcaggatgtgtcaggaattcaatgcttttcataatccttgcacaaagtctctgaagtaggtagtatagatggggaaattaaggcactggagaattaactaagtgccagaggagttggggtttttgttgttgttttgttgttgttgttgtttgggttttttaggttttttttttaagcagagtctcactctgtcacccaggctagaatgcagaggctggtcatggctcactgcagccctgacctcccgggctcaagctatcctcccacctcagccacccaaatagctgggaccataggtgcccaccagcatgtccagctaatttgttcattttttgtagcgatagggtctctctaggttgcctaaggtggtcttgaacttctgggctcaagtgattctcccaaaatacaggattataggtgtgagctactatgcccagtccaggatttgtatttgaagccagcagtccatctttctacgccatgttcttaaccactgcaccttattacccaaaactgtggacagagaccagtgcaattgtaggtaggttctgcaaactcaatggctttatcctgaagcctgggggatgctttccatactgaagtgaactgagattagcagctagtggtgacatgggattagtcccacctccttgcactgttatgaaccacttggaagaatgtttgtatatgaatggtgggcaccctctgtaagacagagggcaaagttgtacaacggttttctggagctgggacgtcctgggcctaaggcctaattctgtcactcctaactgcatgagcttgggaagttacttctctaagcgtcagtgttcccatctgtaaatgggcataactgcagtcctgacttcatgagcttgttttgtgggttaagtgaattcatgcatgataattaggaactactaacgcaatcaccaaaattgctagaggattaaataattccacagataaaaactttttttttcctttttttttttttttttgagacatagaatgttgctctatcacccgggctggggtgcagttgcacatcttggctcactgcaaccttcgcctcccgagctcaagcgattcccctgtctcagcctcctgagtactgggattacaggctcacgccaccacaccgggctaatttttgtatttttagtagatatggggggtttcaccatattggccaggctggtctcgaactcctgacctcaggtgatccgctcgcctcgtcctcccaaagtgctgggattacagccgtgagccacggcgcccagccataaaaactttcgccataaaaactttcgttagccatagtctcaccataaacatgccacttacaaaaaaatatgcgcacaataaccacgctcaggatgcaaacaacatccattaatgaactttgtagttaataccaaaagttactcctcactttattctttatttacaaaagctttcatggttcttaaaagtgtttagtattcaccaattttactgttagcgtttctaatgaggattttctaaaactgaggcatggatttgaaaaagtgttctgatcaatcagtaacagatttggaatggaatctccagcccccagtctttgcgcccaccctctggcaatatgccgcctcacgtgagcatctttaagacggagttccctttttattccagataaaagaattaggagccttctggtagaaaagaaagcagatcttcaggatcaagtcgcagaggctggccaatcagcccagcttctcatttgaacttgacccagacagtaaaacaaactttaccataaggcgagactaacttttgttatgtcttttctattcatttcctatttctgaatcaaatctgaactactttgtggccaatatacgacaccagcttccgagtgtgggaatcacaggatttcaggattcagcggcttccggcaggatcccctaggttatgtttagcaatcttcagttgcctttcctttttttctttccttcctttcgttctttctttctttttctttttttttttttcccaaaggaaagaacaagggagcccaggcggaacggaagtgagtatcccgacacgcggatcttaaacagcccagaccaccaagcccgacaggccgggaaagctgagcgcgcgctgctggggggacgcacactttggaggctgtgtgggcgcgcgccggcaccccacaagttctcatccgtctgctccgccgattcagccagacaaagaccgcaagttccccggtccaccgctccagacaggcggggaccagtctccccgaattaggcccattccgggcccgggcgccctcactcgccgcggggaaaagtccccaggtgcccctccgtgatccaggtcctcccacaacgctcccgctcctgctggcgccccgcaccccgaggacggcggccggaccccggcccctccccggtcccgcggctgcaggcccacgcgccccacgcgccccgcgcgcccccgccccagctccgccgagggggcgctgctcgctgcgcggtggacccctcggaccccgcccccgcggccccgtccgggccccgatacccacccgggtcccgctgcgggggccggattcgcgccggctccgagagccgccaccgtcgcctccgccg

SEQ ID NO: 382 - DNA, 18515 bp, Homo sapiens
tgacacttattatccttcagtctttattttaaataaggcccctgtcctttaccctcccaaagtacttttagacattttccttctgcccagaatcctctgcccggtcccctgtagctagtgtccagacactggtcacagacctccactgagcccagttagagcgctgacctcccatctcaggacttcttggcccttgcccattgccatactctactgtcagattttaaaactgctagaccatgtgccaattcacattgacttgtagccactaggaccctgtgtctttttctattgtgcttgttcatggccaggaatcaacgaactttggacagacaatcagtagactttgggtgtggccttggtgaaggcttcccactttggtgacttgcatgtgcccctctttgttgagggggttttgaagcagcttctgcgtcattgggagctggctgctgcgcccagcctgaggccctggaccccttttgcaccatcctaatttcaacatccagatgtcaattcagaaaattattatatcattctaatgactcaaaacataaaatcccctcttttgtctcatgttgaagagctgatgacatcggacctatcaggtcagacttattttcctagtcagagactgaatggcatattttcaaagcacttcgtctaaattgcatggcacacaccccaggagcccaaagatctggttgttctcttgagatgcagagaggaggcccacaggtggcggaggggtgaaggaggaggagccaccacttccgaagcatcagaatgtcaaaatctaagttttccacgaggtcagcagcaggtgtctcctggtctggagagggcatggaagtggccacaggtctggacttctctgggtggatgtgagggagggtgattgaactggaggagggggctggcttgagaccttcctgttctatgttgggggggatactgagggtccgtctcactgggacgaagagggggcacagatgcaggtatgcccaggtacctgagtcccagccaaagcggcaaagccagacctcccgggattccttgagtttggacaaagggtgtcccgacgacgataaagagccaggagcagagagccctgcatcttgcctggggccccttgtatctctggctcatggcctgtcctgggcacggggaggaagggagacacccgtaataataacagagaccgcactggactatgggggatcacaatgggtttcagtttgattgagagaaaataaggtaagggacacgtgctcgcctgagtctctggagtaagagtcacgccttggagaaggagggcagccaaaggccacgcagaaattgggggttcaaggtttgcccagccggccccaaaggtgtgggggtccacatggcctcacccaggggccagtggggtggctttgctcatttgagggtgtgcagggtacatatgtgtctgccccgggaatccaagtagccccagtgcgctcctgccttgcttccctagagcgagcccacggtaccatagtcctcgtgggatgaatgcatgaatgatgtggaaggagccagaacagggctgcagacaggatgctctctcatagaaggaccccagagaacttcccctctggagcctgtgcggctggttgagtgtaaacgctgagtcatgctcgctgcccagctgtgtggcaagggcactccctaggcactgagcagccaccgccagccctgagggctgcgggacaacagagagccgggcctgcccgaggcacggcccctgaaaagtgtggcccgccaggtggcacctatgttctcttgcccggcgtgggtgactacacagttgtcatttacgggggaagtagggcacagcagaggtgaacatgaggatgatgctgcgtctgggctgtatccagggaaccagctgccggacaaattggaagggaccttcttggcaggacaggtccagttggtggcctgaggtggggttgtggtgggccttgtccccctgcagggctgacccgtgcaggtgggatcatccttcctgaggagctgccctgcccagtcccgttgccttggaggcggtgacatcaggggcccctgagccaccaggttcctccatcttcatgtggccaccacggctgttgcagagtccacggtaagagccaggacgtggcttccaggcaggatggggaagcacctcccactcccacatggacaaagatttctttaaacggagccaccagccatgcctggtagtgggtgccctccctaggcaggcagtgctggctctgctctttcctgggggaagcccactgctcctcctggggcctagtccgtgggacctgcccagccagccttgggaggggcacccctgggcatgtggagaggaggtgatgaggcgctcagatgtcgaggccaaggccaggtaggtggcaggtgagacaggcccttcagacatgagacccgagtgatgtagataagaggtatgttcccctccagcccccgcccccaggcaaaaggggaaaagacacacagagaacaacagaaaacagttggaaaccccaaagggcgcttgatgaagagctggagctccccgccccccgtgctccgggaggaccaggagacctgctccatgggccaaaccgcctttgcccatccctcccctgacccctgctgcacggttccaagggcttggtagggcagcctgaattttccctaactcccactcctaggaaggtcaaattcaccttgtttgcctccttaaaaattcacaaatgcaggactgaggcttttcctgaaaccagagccccggcagccaaggctcaataaaatactgtttgtgtttccaggcactggggtgggagcgaggctcccagttgctcagagttaaccggccctttcccgagtgagaccccgcgagcactcgtcaattctcccatcaccctccatcgccgcctgctgggggggcctgaggtccggagctgctcttcctcctggcagcccagcctgcaggcctagtgctgtccaaccacagcccagagggcaaggcctcccaaagtgggcgcttgctgagcccctggccagcctcccaggaccctcagtccccacagcccccatccagctctcttttacaccttcccctcccccatctcagaacatgggagaagccgggcacactggcgtctgcaggctgcccttgggctgccacggggccctgtttgcccagcacagagcctgccgtgctttgacccagcaagtcccaccgcaccttccagaggcactgtacagcgtgcatctgttgtcagtacagttttatttgctgtggaatccatgagagccggaagcatcgttggggccgtggctagcagagctcatggtgaccagtcctgggcctgaccaatgggtgattacatttaaaaaccaaaacaaaacaaaacaaaataccaagaacagatcacttgccatggacatcagtaatctattggtaatggtggaaatttcatgaaaatttcccctaaaccataacaaaaactgtcctccttaccccaaaagtgctggaggaaagatggttgcatgacttgacctctctttgaacttgaaatgctaccttcctacccggaaatgcgacacactatacttaaaaggccagatggctgcaggctgtttgcacccctggctctgcccagggacacccctctcctggttctaatgctcagacccaggaggcagagtccgcagcccgagggagcttcaaggccgaggggtaggacctgcagggcccacaccacccttctgatggagagctttgcacatgcattcacacacacatgcctggcgggatcgcagaggatgggtctcgtggcaggagtgggcagaatggggtgcattttacagaagagtcacagagaggctcgccctcggcggaggacacacagctgggtgggcgtgtgggagtgcaggtgtgctgactccgaaccaagggagagctctccgtcctgagctcgctgcccctcacgatgcacacggctgatggctgaggtcagcggtctcttccctgagtggcaggtgtggtccctgggacttcataaaccatcctcatgacagttttacacttagagtccccaatgcactcccaggaggtggcctgggcaggcaggcatcattattctcatgttacaggtgaggaaactgaggctgaaggaggcagaaggccacatacccggggagaatcgcaggcagcaggggccaggccccttccacagcactgcctctcacccttctcccgaccaacccccaagggcatgcctctggcttcatgaaccttcgggggaaattagctttctagtttgggggcggttccctctgactggagacaggacagaatgctttcacacccaggaacggccgtgcagcctggcttagaaacaagggacgaagtggatcctgaggctcattccctggggactccaagaatggggcaggcccagctgcgcagccagtcctggctccactgacttaggctgcacccctgcacatatgtgtgtgtgtgtgtgcatgcgtgcgtgtgtgcatgtgcgtgtgtgtgtgtgtgtgtgtgtgtgtgtgtgcgcattttcccaggggacctctcctccttcctctgaggcaaagtggcctgcaggggcccctgcagagcatacagggaggtgcttccttccctctgcccagcgagcaaagggtggagccttggcacccccagcaaccccctccaagggtggagccttggcacccccagcccccaccccgcaagggaaaggggaagctgcacgaggagcaagatttcattccccagagggcacagcttgggcagattcccatcatctaggggctgtgccccacatctatttctgccaaacaagaagcagacgagggggctcaggggggcgggcctcacaggaacggaagcaccaccccacctctattccctgtggcctccaaaagagctgggcaacctctgccagccactaccccttagcccaaggggagtcctcattccagagccagcatcttcatcttgtcctgatgccctgcccacccccgccgagcttcacactgggctgctatggaaaactgaaaggtcagagggtggaggtcctctccctcctggacatggaaacctccccctgcctggcacttcggctggtcaggaacagtggctgctcatggagctgccctcccaccttcagaccctcctcctcccccgcaggggtgggctggggccctccctccctctgtacttgatccatgacttgtgagttctgagtcctcagggccgagacttgagtcagaaccttctggagcagtacgcatttcccctctgcacctggtgaggacaccaggctcctcgcttcctccccagatctctgagtgctcacccgaccccccaaccctggcgggaccttccagggctggcaagcatcgagcctgaccacgttgcctcttgggtgccagcacgcccacatcaaaggtgtcccctcttcccagaggccctgagcaacatcgggcgacgctgtcagcagacattagcagcagagctgcaccacgcatcaacttttaagtatgcgcacacacgtacgccagccaataacattaagtgtcattttaaaaaatgggttaaataagcagcattgctgaggatggccgtgcagggctgattatcccctatttgcacgttctggcggtgggaaggctagaagtctaatgactgaattatcgccctaatgcctctcgctggctgggaataatcccggggcaacagctgccgcggggtttttggctggtttcctctaattgcatccagattaagggagttgtggaggggcggggcttctccatcccccgcggagcagcgtctcctccgccaagccctgaacacccagctcatggcttccgaggtcctggctggtccgagaggtgcagacctcactggggtccgggccagcccatggggagcgtgaggtgcgagcagtgcacggtgggggtggcacttggtgcagagatgcagctgattggtccgggtcaggtcttggggagcagcaggggtgagaagctgtagggccaggagactcagaaggaatgccttctactaggaccttcccaagtgaggggagccctggacctgtctatcctcttcctccctcccaaacacagcggttcaaaggcacgaggtatctagtgaaatgctaggaccagggacgctattcccctggagcaggcgggtggggaaggagtgctccaaagcaggcattattaggacacagactctccagagtcccagttgtttagccctccaaattctcagcctactgccacccgactgtgcagagcggacaataaagtggcaggcctgtcccccaccccttaatgctgagcccagccacgtgacttgctgtggccaaggggagagctgcaggtgtggtgtccaccaaggcttggaaaggcacttgctgtctctccctccgtgcctttggctgtgccatggctggcctgcaggagggatgcaagagaccacagagcagggccaggtccgacctctgcaccatgagcatcccctgggacttaacaacccactggccctaaacaaacaagcccagcctagaccagaagaatcaccctgcccagactgctgactcctgccctagatcagtgctgactgttgcaggccaccgagtgttggcggatttgttacacagtattgctgtggcaatggatataactggtttctagcggagggtcagggcagaagctccagccacctccctagcccagaaaggcaaccctctcttcccagaagcaacatggatgagaagcccaccccattcccaccacaggatcccccactgctagacagcaatggtcggtaccccaggatctgggcactgatggggctccaggacggtctcctcaaaaggctcttaggcagacagacctgggaacttggaagtacctgctggacgacctgggttcatggagaaaagagaagccgagaaggtggaggaggccggtaagtggtgacctccgctttcctgctgaggaacactgctttgaagtggcatggcccagcagtgcccaccctccagggagaaaagctttgagtgggaagaagccttctatcctggtccccatgatggttctcagcacatcaagggtttttctccccagaaggacgcgatggaggatttcaggagggatttggtctcctcgctcaaggagtggctttctgtgcaaatggctcgacacttctaagctggctgggagttctcacagcatagatcgcacacccttttctgtccatctctaaatcccagaaggagcaactgatacacaatcttttggaagagggagagtctgttgggaagacctcattcccacatagaaggcagagagccctgagtgctggctccttcactgtggtcgctctcacgtccgaccacctgagaagctgacttacatatctgagttcacaggtcctgaagggaagtggaagagtctaactatttccaggtgtccttgtcttggttggtcagctaatacactaccacgtccctgggacaaagcagatcattgtcagaggatcttgcaaacacaaacacgcacgcacgtgtgcatgcatgcatgcacgcagggacacacgcacacatcgacccattcaagccccagctggttgctgtatttggtggagttgaccttaaacaacgccaaggaacctcacgtagaagacccccagcaaagaaaaaggcatcagatgcttctccaacagcctgaggctcaggctcctgggcagacagttcccttcgtgtaccaggaggacgaaatgtttaaacggataaacattacaagcgccagctcctcaagcctgactgctcttccgcctctctatccccacatcggttgggctttttatcttttgcttttcttttatggcagatgcctttccatcggcatcccagctgtggctggggacgttttgggaagtgtgtttggctcactccgagagaacgaggtctcaagaggaagtgtgtctggcttgcaaagatgtccctgggcctggacaggaccccgctgtgttctgcagccctcgacgcagtgggtgagtgaggccttcctctcctgtctctgctttcctcattgcctggcgacgctgtctggctgccctcgagggtggagcaaatcctgggacatgttgaaatcctccagggcagccagcaggagagcccagccagcctgcgtctcaggtgcggtggctgcgcgttccactgcagcgtttcaggagctgactttcctctgggtggctgtagatctgacttctgtcacttccagactctaattttgtcattaatatgaaaaggttcctctcatgttgcccaaaagcattttccttaggtttctaccgtcccctgtccccttcacgcccagccccaccccctcccgtgcccagggcctctgaggaggtcccctcaacccctgtccggtgtcgggggcccgacctatctgcggaagccgaagccgtcctgcggcgtctttgggcccttcttgccttccctcagggacttgggggaaggcatctccaccgtgcccccgtagggacagctctccgagccgggatggtggccggtgcactccaccgcgggcatggagccgctgtcccacatgcctgacccgcacagcttacacagatcgtgcaggctgcaggggatccggggcaggaggcggaactggtacagcaaactcctcgcctgcagacagaggacggggggtgaggaggggccgggggacagcctggcagcctagggtccccatgggagtggccaaagacagcaacagcagcaacaacggcctgcacctcgggggctcaccgagtcctggactgagggctctgcctgcatctcccaccatcaccggcaccacggggccctgggtcttaggtggctgcagtgatgggacccacaaggcactcgggctgtgctcacaggtggctcgaggtgaacaaggcccttgaatgggcttcattcaggagggtgaacaggaccaacaccagcacagggccgggtggcgtccagccaagcccacctgtccctttggcagcacccctctcttcttcccccgcaccttgctccaccccccacccccagcagcctctcagctcctgcaggatctgtgtcctgtgccagaggacaccaccgacctcgggacccccgctcagtgccctgaggaccaccagagagctaacgggcagcatctccaggaggcgtctgggaagtgggggagggggccaaagcccaaggtccccagtattctggccaccctgtccccaggtccagcctccttctcagtgttcccagttctgggttgtaagcgaggtaccccagggtagggaacctgtcctgtccgtcagccccggtgaattcgttccctcctcagccagcgagggaggctcctgtgtcagggctggcaccccaggaaagtgaggtgacacagccaggccgagacaggtgctgaccacgaggccttagtggggagcccccagtgctatgggtgggggagggcacgtgctggggggccatggtggggatggggctctgggggcggggcccacatctggggcagcctcacctttctgagaacgagctggtggggtggggctttgggggcggggcggggtggggcccacatctggggcagcctcaccttccggagaacgagctccccgttcatgtgcatggccaggtttccgaagtgcaggagcatctggtccgtggccagctgctgctcgatgacgtcatccccgtagatggccacgatggccacgcagatgaaaaggtggaagtagtccgtctgtggaggcgggtagagttcagacacgggctctgaccgagccccaggccctgcactcagggggaaactgagtgccagggtgcgagtgagggctccagggcgaggggtctgggctcacagcccagctcgggggccgtgtggccctgggcaagctgcaccgcctcttcggccctaagtttccccacctgcacatggggtctgtcccagtacccgcatgcccaggctgctgtgacatccagaggggacgatgctgagctcagcccccacgggctgctgctgctctcctgggtggtgatgtgggtggtctccatgacagggtgggggtgggggggtacaaagagcacccttcctcagaaggcctggcctgtgctcatggggaggactcatttgtaatggtcctgagcaacggtgtgtgcggaagtctgggtcagaactcactccagcgggtcatggaatgcgcctctggcagccacccacgggtcagcctgtcctcctggctccaggccacaccccccaatcatgccccagagatgactctagggtttgtggctagaaaagtgggaagatcctaacagagcgggcacagcagctcacccacagggtggctgaaatgatcgccctgtccttgagcctcttttcgggcatactttgaggactccgcagccctccctttaaagaccgcctcacggggcctgccagcaacgcgctgtgtgcagcaggaagcccacgccaggtcctgacggctgcatcctgtgtgctctccggcctggccgcctcaagacacgccacctttgatgcacacgcgcttccggaggcacaggaaggacgggggcactgggaagtccatgtttagtctcctgacgtcgaccacacaaaccagacggaacggtgtccccggcccaggctgagcggagcacaccatgagggcagaggctacaggtgactcccacgccccagcctgctcctggagagaccatgcaccaggctgcccggctgcttcctctgaactaatctgggacggtcttgttttggctctgacggatccttttgcagtgatttgaactgtggctggtgcgagacacagcggaggggttgcaggaaggtggacgcccagcttctctgggagaggaatgtggggagggagagggagggcacgatctccacagcctgcacagcataggcagatttcagttcccaggacaggcagggcgtagggccgtccagccccaccacatgctgacagcggacggatagcatcaaaagcctttctcgctcaggggtcactgaacagttaaaggcctcacctggcagcaaccttcccattccacagagctcactctcagctcatcagcagcccacccccacccccaccccgtaatactaccaaattgatcgagggatgggaccgaccgtggctaaatcaagcccacagtctgaaaacaacagaaacttgctttgtggacttccaacacaatggcagccaacagagatcccacgtcacgtgggcctcccgctggaattctgactagatctcattacacttgggacacagtaggtgtccatgggaaagggacccatctgccgggccacgcgctgagttcacgggtaacatcagcctgaacgtaaaggaatgagggcggcaaatctgccactgggaaaacgtgcaatgaggcacgattttttttaattcgggagtggtgggaatgaagcctctcagaccgtccatgccgtgcttcccttcgttaatgcagatcgtccaccctgcacgtccacgtccagcaggctgagccaggagggaaacctagacccgggccaggggcgagccgatgaccgcatgcaaaggcggcgtgtggtaccggcactcggtggcttcagactcgctttcatcagacatcagccccctgcggtgtgagtgaggacaggagacgctgacgcaaatgtcttccagcagatgggtgtttgcctccatcttcagggttctctgacggaggctgctggagctgccgtggtggatagagccagctcctgcaaaagggtccagccctcctggatgcgtcgatgtgagttttttttttaaaaggctgatggactcaaagagacttgcttatcttttgacatctccagcttgtccctagtttgggcgttaaggccatgtgacagagccagtgctgtgctccaaggggaatttgctgagaagatgctggtgacggtggacggagagtggaagtcggtatcactgattggggccctctggaggggccgacagggaagtgggatctcaggccctttctctgcacagcagggtaacgggtgagtcggccctcgtggcagggcggtcccgagggggtggagcggtgctggctcacgctcgtgggcaccagcgtcctgggctgctgtggcctagtgtaggccccccacagtgtcactcacactgattggttgtgacaggagggagctcagccccagaaagtggtaatgagtgcagtcagcgggcaatttgcatcgatttcagtgactggggaggcgagctgtaaggtctgaagccagccacgtgggacgggaaggcagtcgccgtatggggggctaatgtgtggctgtgggtggggggcggcgaggcggacaggggcagcaggcagggtggccacggtggttcaggggccatggtcccaacctccccagccctggcccctgccctggtcacctggtagtgggcccagcaggcctcccagatccgcagcgcttcggcctcggggaactcccgcttgaagcacagaaggagccagcggtggcagaagagcatctgcaggccgtcctcgcccagcgagaccaggtgctggtagaagcgcacgtgcgtcagccgcagcagctcgcgcaggtacagctgggggtgaggccgtcacgcgttagttagctccggtcccatgcggcctgctgcccaggaagcccactcccactggggcccttccctgggccaccccagcctggaaaagcacacccaggggcctctacctgctgcatgtgcctgcccccccaacgctccattccgccgctggaatcggctcacacctgcctctgccagttcctcccagatctgactgttccggaggctgtggtgtggtccagggtgaggcagagtgttgtgcccgggcgtggcaggacgctggcagccgctccatggccaggaaggctccccaccctcagtgcacacttgggggctgtttcccacgtccactcctcctggtgaggtgagtggatcatccagggagcccccccacccctcttcggctacgctcacccagatctatcatcttccagagctgttttagggcaggaaggggacgtatctgagccccaggatgctcgattcctgccattaaggtcatctcccaatgatgtgggacaagatcggggctatttctggcagcactcgggcccaggccgctgacttcatcaatgccgctggaaaatcaatctccagcattcagtgagtcacccagccatgcgctgccatgagccgtcagaggcgaatggcgttggacactgtaactgcctccccaagcaatgtggacacccgacgtcacacacacccgttgatgcagagtgagcaggcttggctgggttcagccccccggcccaggtggagttagatcacagctggggggatcctggggcagagctcggggccacatgcccccttcccacacaggtggcccattgttcccacgggagactgcgctgaagctgtgcggccagccctccgccctgtggcctacggccaggtcaagcccactcgtgtggctgacccccttgcagatgctccactcccgccccctgtgcaggtgcctgcacctccctgcttgggctcctttgccttcaaatcctctctgttggcatcagctctcccagcctgtcatcagcgacccactaacagtcagtctatagcagcggtccccaacctttttggcactagggacccgtttcctggaagacaatttttccacggacaaggtagtgcgaatggtttcaggttgaaactgttccccctcacatcatcaggcattagattctcataagcagtacacaacctagacccctcacatgctcagttcacagtagggttctcgcgttcgagcttctgtgagaatctaatgcagccgctgatctgacggcaggtggagctcaggcgggaatgctcgctggcccgtccaccgctcacctcctgcggtgcggccagttcctaacaggccatggaccagtaccagtcctgggcctgggagtggggatcccattctatgagacacactccgtggcctggggctggggaaccccgttctacaagtcacactctgtgtcctggggtggggaccccattctacaagtcacactctgtgtcctggggtggggaccccattctgagacacgctctgtgtcctgggggtggggacccccgttctatgagacacactctgtggccctggccttcaaggccctccatcagctccaccctcactacttgtgacgggtctggtccaggaagaccaggtcactcagtcccaccactgggactgctctgctcagcccagccttagcgacactcagggccagaccccacacaccctggagctgtccccggtgcaggagccctcttgtccttatcacgggcacctcccacagtgctccccgacacccagcgtcctctgctcacaatgccagcttcctggcccagccaggagggtgaatgtctggtgactgcacccggcaggcacttggttgacatgggtgatgtgtgctgagaacagtgagcaggtgccctggctcagccctggttcggtcccacacgctggccctccggcgctgccttacccagctgggctcagccccaccaccgacattcagtgcttcctggtctacatagggctggtccttttgaggaggccttgacgggagaggtgtcagcagggcaccccaggggaggggtggggtgtgaggactgccccagagacctcagggggtttcaggagcccctcctcttcctgtctgcactcagaagccctggctgtgttgactcctgcagggagcagcttagacacacctgaggacccattttctaaggctcagagggggctgggtgtgatggtgccacgtcttccttgccagccagggagcttgggccaggttgtcacgtgcaggggtggaaggccaccagagcggcccacacaacgcggcctctggacctgcagggagtcagagggccatccccggaggccgagataggctaagccgcccatatcccacgggcaagtcctatcctggcgttcccactgcccactgacctacagcagccaagccacgcatcaccacggcaaccccggctacaacgggagaggcaacacgggccctcacatgcccttggacgcacccatccccctgagcctcaccagttgtttctccatgtcctcgtcccggggtgagctgacgaagatcgtgttctgcatcaaacccacaaagcaccagaaggtgtctgactcatccaggacctcggccaagatgggcgccaccaggtccgacatcccttgggaatagccgacggcagggttgtacacggcgtagttcagcaggatcctcctgggaggcggtggagacagcagtgggtggggatgaccctcaccgcggcacactgcccagcctgcagaaccctgggccgtggaccctgccttccctcgcttgccttcacctcagtggaaggcagctgtgccaccatctcagagcccaagcttagcttccagacacacagacccttgctttgcaaaaggtaatggcctggccgggcgcggtggcccacgcctacaatcccagcactttgggaggctgaggtgggcagatcacctgaggtcaggagttcgacactagcctggccaacatggtgaaaccctgtctctactaaaaatacaaaacttagccgggcatggtggggtgcacgcctgtaatctcagctacttgggaggctgagactggagaatcgcttgaacccggaaagcggaagttgcagtgagccgagatcacaccactgcactccagtctggatgacagagcgagactccgtctcaaaaaaaaaaaaaaaagtaatggcctgctattagctgctgtctaggcccagaatcttgagagcaggggttaagggggaacatggctctgattttctgaagggtggactgcctgtgacaaggggtgggctggcagggacatttctgtgggctgctaattttgtgcaattatttgctaggctgtagcagaatgtcacagatgccagcctctggctctgtgtggctgtatgactacgggaccacccacggggagatggagggggtgcatggggaagctggtccatggttagtgtgagccaagcaaggacaggcttggtggtgcccaggggatagaggggctctgtgggcagggacctgggtggcttccctgggatgccatggctctgagatgccaactgacgtagctcatgagtagcgtatccttcacttctggggctttgatgtatgaacctggaagagagcccctgcagaaactcgctgggggctcatccacttcccagagcggtcaggtgaggcttgcagacttgcagatgggaaaggagctggctggggagggagtacctcatgctctccacattgggattgtcttccccccggaagaactggttgttccgatctgtccggaccacgtctttgtccacagtgaactgcacattacgccagaacgctctgtgctcctcgggagtcatggagagcctgtgtggagccgagcacccagccggggtcagcgggtggcacccagaggcatcgtgtggcgcacacactgcaggaagccacccttcctcccaacccccgttccctggacgggagctgggcggctgctgccggctgcagaccctccccggatgcggcggatgggtggcgtgtatccaaggctctccttgatattaactcagcctcacagtctccagcgtcccaggaaggagagcaagttgcagcccagtgggtaatgaggccttggccctggcccagcgttctggaggggagctgagcacagcccaggggcttcacccagtcccagcctcctggagagagagctgagcccagtcccgggttagcagatcccaagtgggacacagtctccggatgccttcacccctccaggccctgctcccagccccagccttcagctgtgggacgtcagcgcctagttaagtctgttgaacgagaattctaaaaccttgacatgtgagctaacgagccccgcagctccgaggcccgagtgcttggtttaatgactgcacttatcccaccctatcactcacgttcctgggagacccatttttgaaagaaactatgggtcacgaaacatattatcaatgctgaattgcacctcaaattgccttttcaaatgacattttcctccgcggctcggcggggtgggccgggctggccccggcggttaccttttctgctggatctcagagtactcctttcgcttctgcagccgcagcgcctcccgctcctccgacgtggactcgtggctgtaatagcgcagcaggaagggccagacctccccgcggattgacacatcaataccgccaaagaaaatggcctggaggaagcggcaaaagttggggaggggataaaatggggcagctcaaagaacccccaaatccccagagatgtgtgttttggtggtttttggtgcgccttgattcagatctctgcaatttgcacatatttacaaggggaaagcagtggccttcaattcccatacaggacacaaacccggctcatttcaatgtcaatgccccccctggggtggcgctcagattaacgtgtcgttctcacgtcatggcctaatccctggttttggaaatgctgcatttcactgcaaacccttctatgcaggctgacacggtatccccccaaaccctcgagggaggtgttgtgttttgtttttttttttcaacgcagcagctttgattgctttatcggtgtgttcacagagagcctcacacaagaaaacggggccctcacgaggaggtggcccgtgggtgcgggcgggcggccaggccccggccctccttccctctcgctcgttcccggttcccggccggctctccgcggggccagctgggcggacccggacctcaccttccgcagcttgtactcctcctccacctggcccagctcattcaggtggttgagccaggcggagacgccgagcctcttgtacatgctctcctcggggtgcgtctcggaggacggcagcttggggcggcggatggagaactgcatgcatgtcttatcgggggcgacctgctggacgggaggaaaactgggcaaaggtcaggatctcagccgcgcggcttcagaggccagcagtgcttttcccaggaataaaagcctctctctcttctgaaaggagggcaagggccgtcccctgcatacaaacccctaaatggcgagtgtaattaggcgcaattaaaatgaaaataccttcatcttaaaatcggtttccctctgcggctctctcctccccggcccactgtgccgccgccccccactctctccaaccccagccgcaaaaacggaatgaat

SEQ ID NO: 383 - DNA, 18515 bp, Homo sapiens; identical to SEQ ID NO: 382

SEQ ID NO: 384 - DNA, 7005 bp, Homo sapiens
tgccactgggaaaacgtgcaatgaggcacgattttttttaattcgggagtggtgggaatgaagcctctcagaccgtccatgccgtgcttcccttcgttaatgcagatcgtccaccctgcacgtccacgtccagcaggctgagccaggagggaaacctagacccgggccaggggcgagccgatgaccgcatgcaaaggcggcgtgtggtaccggcactcggtggcttcagactcgctttcatcagacatcagccccctgcggtgtgagtgaggacaggagacgctgacgcaaatgtcttccagcagatgggtgtttgcctccatcttcagggttctctgacggaggctgctggagctgccgtggtggatagagccagctcctgcaaaagggtccagccctcctggatgcgtcgatgtgagttttttttttaaaaggctgatggactcaaagagacttgcttatcttttgacatctccagcttgtccctagtttgggcgttaaggccatgtgacagagccagtgctgtgctccaaggggaatttgctgagaagatgctggtgacggtggacggagagtggaagtcggtatcactgattggggccctctggaggggccgacagggaagtgggatctcaggccctttctctgcacagcagggtaacgggtgagtcggccctcgtggcagggcggtcccgagggggtggagcggtgctggctcacgctcgtgggcaccagcgtcctgggctgctgtggcctagtgtaggccccccacagtgtcactcacactgattggttgtgacaggagggagctcagccccagaaagtggtaatgagtgcagtcagcgggcaatttgcatcgatttcagtgactggggaggcgagctgtaaggtctgaagccagccacgtgggacgggaaggcagtcgccgtatggggggctaatgtgtggctgtgggtggggggcggcgaggcggacaggggcagcaggcagggtggccacggtggttcaggggccatggtcccaacctccccagccctggcccctgccctggtcacctggtagtgggcccagcaggcctcccagatccgcagcgcttcggcctcggggaactcccgcttgaagcacagaaggagccagcggtggcagaagagcatctgcaggccgtcctcgcccagcgagaccaggtgctggtagaagcgcacgtgcgtcagccgcagcagctcgcgcaggtacagctgggggtgaggccgtcacgcgttagttagctccggtcccatgcggcctgctgcccaggaagcccactcccactggggcccttccctgggccaccccagcctggaaaagcacacccaggggcctctacctgctgcatgtgcctgcccccccaacgctccattccgccgctggaatcggctcacacctgcctctgccagttcctcccagatctgactgttccggaggctgtggtgtggtccagggtgaggcagagtgttgtgcccgggcgtggcaggacgctggcagccgctccatggccaggaaggctccccaccctcagtgcacacttgggggctgtttcccacgtccactcctcctggtgaggtgagtggatcatccagggagcccccccacccctcttcggctacgctcacccagatctatcatcttccagagctgttttagggcaggaaggggacgtatctgagccccaggatgctcgattcctgccattaaggtcatctcccaatgatgtgggacaagatcggggctatttctggcagcactcgggcccaggccgctgacttcatcaatgccgctggaaaatcaatctccagcattcagtgagtcacccagccatgcgctgccatgagccgtcagaggcgaatggcgttggacactgtaactgcctccccaagcaatgtggacacccgacgtcacacacacccgttgatgcagagtgagcaggcttggctgggttcagccccccggcccaggtggagttagatcacagctggggggatcctggggcagagctcggggccacatgcccccttcccacacaggtggcccattgttcccacgggagactgcgctgaagctgtgcggccagccctccgccctgtggcctacggccaggtcaagcccactcgtgtggctgacccccttgcagatgctccactcccgccccctgtgcaggtgcctgcacctccctgcttgggctcctttgccttcaaatcctctctgttggcatcagctctcccagcctgtcatcagcgacccactaacagtcagtctatagcagcggtccccaacctttttggcactagggacccgtttcctggaagacaatttttccacggacaaggtagtgcgaatggtttcaggttgaaactgttccccctcacatcatcaggcattagattctcataagcagtacacaacctagacccctcacatgctcagttcacagtagggttctcgcgttcgagcttctgtgagaatctaatgcagccgctgatctgacggcaggtggagctcaggcgggaatgctcgctggcccgtccaccgctcacctcctgcggtgcggccagttcctaacaggccatggaccagtaccagtcctgggcctgggagtggggatcccattctatgagacacactccgtggcctggggctggggaaccccgttctacaagtcacactctgtgtcctggggtggggaccccattctacaagtcacactctgtgtcctggggtggggaccccattctgagacacgctctgtgtcctgggggtggggacccccgttctatgagacacactctgtggccctggccttcaaggccctccatcagctccaccctcactacttgtgacgggtctggtccaggaagaccaggtcactcagtcccaccactgggactgctctgctcagcccagccttagcgacactcagggccagaccccacacaccctggagctgtccccggtgcaggagccctcttgtccttatcacgggcacctcccacagtgctccccgacacccagcgtcctctgctcacaatgccagcttcctggcccagccaggagggtgaatgtctggtgactgcacccggcaggcacttggttgacatgggtgatgtgtgctgagaacagtgagcaggtgccctggctcagccctggttcggtcccacacgctggccctccggcgctgccttacccagctgggctcagccccaccaccgacattcagtgcttcctggtctacatagggctggtccttttgaggaggccttgacgggagaggtgtcagcagggcaccccaggggaggggtggggtgtgaggactgccccagagacctcagggggtttcaggagcccctcctcttcctgtctgcactcagaagccctggctgtgttgactcctgcagggagcagcttagacacacctgaggacccattttctaaggctcagagggggctgggtgtgatggtgccacgtcttccttgccagccagggagcttgggccaggttgtcacgtgcaggggtggaaggccaccagagcggcccacacaacgcggcctctggacctgcagggagtcagagggccatccccggaggccgagataggctaagccgcccatatcccacgggcaagtcctatcctggcgttcccactgcccactgacctacagcagccaagccacgcatcaccacggcaaccccggctacaacgggagaggcaacacgggccctcacatgcccttggacgcacccatccccctgagcctcaccagttgtttctccatgtcctcgtcccggggtgagctgacgaagatcgtgttctgcatcaaacccacaaagcaccagaaggtgtctgactcatccaggacctcggccaagatgggcgccaccaggtccgacatcccttgggaatagccgacggcagggttgtacacggcgtagttcagcaggatcctcctgggaggcggtggagacagcagtgggtggggatgaccctcaccgcggcacactgcccagcctgcagaaccctgggccgtggaccctgccttccctcgcttgccttcacctcagtggaaggcagctgtgccaccatctcagagcccaagcttagcttccagacacacagacccttgctttgcaaaaggtaatggcctggccgggcgcggtggcccacgcctacaatcccagcactttgggaggctgaggtgggcagatcacctgaggtcaggagttcgacactagcctggccaacatggtgaaaccctgtctctactaaaaatacaaaacttagccgggcatggtggggtgcacgcctgtaatctcagctacttgggaggctgagactggagaatcgcttgaacccggaaagcggaagttgcagtgagccgagatcacaccactgcactccagtctggatgacagagcgagactccgtctcaaaaaaaaaaaaaaaagtaatggcctgctattagctgctgtctaggcccagaatcttgagagcaggggttaagggggaacatggctctgattttctgaagggtggactgcctgtgacaaggggtgggctggcagggacatttctgtgggctgctaattttgtgcaattatttgctaggctgtagcagaatgtcacagatgccagcctctggctctgtgtggctgtatgactacgggaccacccacggggagatggagggggtgcatggggaagctggtccatggttagtgtgagccaagcaaggacaggcttggtggtgcccaggggatagaggggctctgtgggcagggacctgggtggcttccctgggatgccatggctctgagatgccaactgacgtagctcatgagtagcgtatccttcacttctggggctttgatgtatgaacctggaagagagcccctgcagaaactcgctgggggctcatccacttcccagagcggtcaggtgaggcttgcagacttgcagatgggaaaggagctggctggggagggagtacctcatgctctccacattgggattgtcttccccccggaagaactggttgttccgatctgtccggaccacgtctttgtccacagtgaactgcacattacgccagaacgctctgtgctcctcgggagtcatggagagcctgtgtggagccgagcacccagccggggtcagcgggtggcacccagaggcatcgtgtggcgcacacactgcaggaagccacccttcctcccaacccccgttccctggacgggagctgggcggctgctgccggctgcagaccctccccggatgcggcggatgggtggcgtgtatccaaggctctccttgatattaactcagcctcacagtctccagcgtcccaggaaggagagcaagttgcagcccagtgggtaatgaggccttggccctggcccagcgttctggaggggagctgagcacagcccaggggcttcacccagtcccagcctcctggagagagagctgagcccagtcccgggttagcagatcccaagtgggacacagtctccggatgccttcacccctccaggccctgctcccagccccagccttcagctgtgggacgtcagcgcctagttaagtctgttgaacgagaattctaaaaccttgacatgtgagctaacgagccccgcagctccgaggcccgagtgcttggtttaatgactgcacttatcccaccctatcactcacgttcctgggagacccatttttgaaagaaactatgggtcacgaaacatattatcaatgctgaattgcacctcaaattgccttttcaaatgacattttcctccgcggctcggcggggtgggccgggctggccccggcggttaccttttctgctggatctcagagtactcctttcgcttctgcagccgcagcgcctcccgctcctccgacgtggactcgtggctgtaatagcgcagcaggaagggccagacctccccgcggattgacacatcaataccgccaaagaaaatggcctggaggaagcggcaaaagttggggaggggataaaatggggcagctcaaagaacccccaaatccccagagatgtgtgttttggtggtttttggtgcgccttgattcagatctctgcaatttgcacatatttacaaggggaaagcagtggccttcaattcccatacaggacacaaacccggctcatttcaatgtcaatgccccccctggggtggcgctcagattaacgtgtcgttctcacgtcatggcctaatccctggttttggaaatgctgcatttcactgcaaacccttctatgcaggctgacacggtatccccccaaaccctcgagggaggtgttgtgttttgtttttttttttcaacgcagcagctttgattgctttatcggtgtgttcacagagagcctcacacaagaaaacggggccctcacgaggaggtggcccgtgggtgcgggcgggcggccaggccccggccctccttccctctcgctcgttcccggttcccggccggctctccgcggggccagctgggcggacccggacctcaccttccgcagcttgtactcctcctccacctggcccagctcattcaggtggttgagccaggcggagacgccgagcctcttgtacatgctctcctcggggtgcgtctcggaggacggcagcttggggcggcggatggagaactgcatgcatgtcttatcgggggcgacctgctggacgggaggaaaactgggcaaaggtcaggatctcagccgcgcggcttcagaggccagcagtgcttttcccaggaataaaagcctctctctcttctgaaaggagggcaagggccgtcccctgcatacaaacccctaaatggcgagtgtaattaggcgcaattaaaatgaaaataccttcatcttaaaatcggtttccctctgcggctctctcctccccggcccactgtgccgccgccccccactctctccaaccccagccgcaaaaacggaatgaat

SEQ ID NO: 385 - DNA, 421549 bp, Homo sapiens
cggtgcattctgggtcctggcaatatggcgtcctccttgatgggctgatgagatgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggcttttatgaaaaagaggcactgtgagaaaattgaaggctccaaatccttagctcagagctggaggatgaaggatcgggtaagtggattctgaaggcaccccttgaacttggtagtttccccaacaaagaaagtttacagcccgaaaagtgtccttgggaaagcgccgacatttccccctagccacacgttgtaagtcaactagaaagcaaaagccatttcagactgcagtttttggttgaaaatggaaaatgctgttttggttagtcattattcactgggtagtgttaattcaattccaactaagttctaattcagataataaaagttaagcaaatttgaaaatagagcattgcgagtatttacatgctctttggcatactacttagttctgtaaacacttagaggaaggacaacgtgcgatataatctttatacccacatgattagtctactttttaaaatatccaagctgggtgaagtgcagaagtctgatatactatgctaggaaatgagattactggaaaatgttcaactagtaacaaattagtgcaaagttattataaagttacactgaacttcattctagtcttctaaacaatttctcttgaagctagattttcctccttttatgtagtgtcctgttgctgtaacttggaaacaggatttctttaatcgtgagttagggtatgaggcgtcgagacttgggtgcaggttttagggtgtccgcatggtgtttggagtgtggagagtgactcacaagcagctggtaggaaagaaaacagccgaattttgttggatttgtccttcataaaacacccatctatttcctggcctcaaaagcaaaagggtagtactgcttctcctctatgcacacttataatttgtctttttgtaagttattttctccctccaggctgcttttatttgcacatttcagtggtataaaagaggaagttggtgttacaatgtttgattttctctaggcttatgtatatgtttatggaatattattgttttttagtatatgatgttgaacatatataagattacacttctgggctgggcgcggtggctcacgcctgtaatctcagcactttgggaggccaaggcaggcctcccaaaggcaggcggatcacctgaggtcaggagtttgagaccagcccggccaacatggtgaaaccctgtctgtactaaaaatacaaaaattagctgggcttggtggcaggtgcccgtaatcccagctactcgagaagctgaggctggagaatcgcttgaacctgggaggcagaggttgcagtgagccgaaatcgcaccattgcactccagcctaggggacagagtgagactgtgtctcaaaaataaataaataaataaaacttctggtaactctagtcagtcagtcagtagtaaccagttagctactgacttggcttacttctaaaaggttaggaaaatttgtttcatccaaaagcattttaaggagttaaataagttagtcattgggggaggttgtataaattctatcttatggacatctttagtagtaactatatagttaaaagcttttgtggttgctatacatatatgaaaagactttttaaaaaattctttgtggagggcagtttttttgttgttgttattttgaaatgtggttctctctgctgtcctaaacctatgttccaacagtttgaaactgattaatgggtatacgtttgaccttttaattaaaacattaatttgtgaatgatcaacattccctaataagcttttcacaggttgttaagagaaacaaaagttctgtgactcttagtgactactgagattgctgcttagaaaggagctggggagaaagtttgctgtatctgtttttcggtggagaaaatcagcagctaacatcttcagttgagtgtgtgggagtttggaatcttgtcatctcttccctcttccaaaggtcaggtcctttggaatcttgtcatctcttccctcaaggaccgtatcacacatgctataggacagaagttgcaaactcaaatgatattgagtggggatggtagcataagagaatgaaacaggccacatttaagaagaataatggcataggttcaaagataaagacaaatggcagctgacatttggcacagtgtgtgtgacagtttctggagggtgggaacaggggctccctgatgccataactgaaggggcaactgggctatggccaggcctctctctttgtctttgagaagtcagcaaactttttttttcttttattgtaaatattcatactaattcagatttattaccaaacacactgtagtccaacactgcaggctgaacaaccccatttgtggagtgtttttctgtttctttttttttttttttttttttgagacagggtcttgctctgtcatccaggctggagtacagtggtgagatcacacggctcactgcagcctcgacctcctgggcctgagtgatcctctcacctcagcctccccagtagctgagactataagtgtgcgccagtgtgtctggggttggggagtctcactgtgttgcccaggctggtcttgaactcctgggatcaagcaatcctcctgccttgtcctccaaaaatgctaggattacaggcatcagccaacacgctcagcctggggtggtttttttttttttttttttttttttttgagatggagtttcattcttgttgcccaggctggagtgcagtggtgtggtcttgactcactgcaacctccgcctcccaggatcaagctattctcctgcctcagcctcccaagtagctgggattacaggcgcctggctagttttttttgtatttttagtggagatggggtttcaccatgttggccaggctggtcctgaactcctgacctcgggtcgttcacctgcctcagcctcccaaagtgctgggattacaggtgtgagccacagcacctggccctggggtgttttttgaccagtgggttacctacgtaagaatctctgttacccaggcctccaggccacacagtcccactgtgctggacgtagcctccagtctggtggagcagcatgtttgtaaagtgaaatgtgtgggcgtggttgttctgtgctaggagctacatcaactacttcctggtggccactgactgtcctaaatgcaagctgagattttgcttcttcttgtggttaatgtgcaattccatacgcttttattttgtacatatattcattagttcttactggctcctatttagtagccttgctacagattcctcaaattgacatctttaccaaagttgactgactgatgactcccaagaagttttttttgccacccaacacttggcatccttccagagctacagcccttgcccgctctcagttgggattcctgccatctttgttttgaatcagtcttggttttcaaatgccacttttaccacattttaatttctaagttactgttactttaaaattattatcaagttagtttgttgtttggttaattctactatgtatagtgaatgaggcatatatgtatccatagtgtttttagcttgcaattttcaaataactagacatatatgaattgtagttcaaaatgaatcattcacagacctttggctaaaacagatacgtatatatctcccctatttgtgtttttggctcactgcaacctccgcctcttgggttcaagcgattctcctgccgcagcctcccgagtagctgggattacaggtgcccaccaccatgcctggccaatttttttcatatttttattagagacggggtttcactatgttggccaggctggtctcaaactcctgacctcaggtgatccacctgcctcggcctcccaaagtgctgggattacaggtgtgagccaccgtgcctggtctaactgtgatactttatagttatcacagagttcattttcctactggaaagtggacagtggggataactggtctcagatgactcttttgcctggaatatgtgggatggaatgacgggtgcttgagagctattgctctgaaagtgttgacagacatgctatgtctacacacatgtagactgacagacactctgtctacatgcatgtagcacccctggcagacacattctgtgtacacatgtgtggtgtcattgtcagacactatttccatgcatgtgtaggaccactgacaggcatcctatgtctacatgtgtaggggatgaaacggttagatgaagaaggctattttgtaaaccattctctagactcagttgcattgctctgtagccatactttgcccaggtcatggaggaagcagagtagatctgttcaactaatacatggactgccaaaggtttatgcggtcttttcagcaagggtaatagcaatccttcataatctacactaccccctctgctttcctcaccttgcgtcctctccacattccaactgtgccctgttccactcccctgagactggtctccatatggccccagtttgttgctaaatctaaagttctcttctctgtccttctctgttcttatttcacctctcagcagcattccacaatgtggaccatggcctcttcataaagctctttcctcacttgcttctgtgtctccacgaaactcggattttcctcttaggtcactagttgttccttctcagactcctttgctacctgacacctaaatgcaggggcaccccaggaattgatcttggaccccattctctgttctgggtgtgcccctccctagcagatctcatcggggcccatgattttaaatagtgtctacatgccagtgatgcttaaacccccaatctttagttctgatctggcctgaaatttctgtctcagatgcctactgcctgctttttcttagttttctccatcaccgcttgccacaaccaccatccactcagttgttcaagctgtaagtttagagtttatccttaattctttcctctccctctctttatcgccccatccaattcattagaacccatcagcgttacttccaaagcatgtcttacattggcctgcttcattttgtctccactgatgcagccccagtccaggcagccaccgtctcttgtctggacactgcatttgtgtcctgactggtctccctatgtccattcttgccctacaaccagtttttcacatagcagtcagagggatcttttatttattttgaaatggagtctctccttgtttctcaggctggagtgcaatggcgtgatctcggctcactgcaacctccacctcccgagttcaagagattctcgtgcctcagtctcccgagtagctgggactaccagtgcatgacaccatgcccggctgattttttgtatttttagtagagatgcggtttcaccatgttggccaggctggtcttgaactcctgagctcaagtgatcctcccacctcagcctcccagagtgctggattacaggcgtgagccatcacacctggccagagggattttttgaaagtgtgaaggggtgggttgcccctccacacctgtgggtgtttcttgttaggtgggacgagagacttggaaaagaaaaagaaacagagacaaagtatagagagagaaataaggggacccagggaaccagcgttcagcatatggaggatcccgccagcctcagagttcccttagtatttattgatcattcgtgggtgtttctccgagagggggatgtgtcagggtcacaagacaatagtggggagagggtcagcagacaaacacgtgaacaagggtctttgcatcatagacaaggtaaaggattaagtgctgtgcttttagatatgcatacacataaatatctcaatgctttacaaagcagtattgctgcccgcatgtcccacctccagccctaaggcagtttttccctatctcagtagatggaacgtacaatcgggttttataccgagacattccattgcccagggacgggcaggagacagatgccttcctcttgtctcaactgcaagaggcatgccttcctcttctactaatcctcctcagcacagaccctttacgggtgtcgggctgggggacggtcaggtctttcccttcccacgaggccatatttcagactatcacatggggagaaaccttggacaatacctggctttcctaggcagaggtccctgtggccttccgcagtgtttgtgtccctgggtacttgagattagggagtgatgatgactcttaaggagcatgctgccttcaagcatctgtttaacaaagcacatcttgcaccgcccttaatccatttaaccctgagtttgacacagcacatgtttcagagagcacggggttgggggtaaggtcatagattaacagaatctcaaggcagaagaatttgtcttagtacagaataaaatggagtctcctatgtctacttctttctatacagacacagtaacaatctgatctctcttgcttttccccacaaaagtgtgaatcagattctgttacttccttactggtggtctccattggcttcctctgtgcttaaagtagaactcagactcctcttgctggttcacaaagccttcatgatttggcctctgcctgccttttctgcttcttggatagaaactcctggaatgcttttctctctgatctttgcacacctggccccttctcgtcgttcatacttagcatctaggtcccttcctcagagaggcccaccatcaccccatctgaagcagccaccctgtcactcataaaccctcctgatggctatttatttctctgatatttttctccctacttcctcctggagatgtgagcttttcatcataaagcaaggacctagtctagtctatgctagtccatagggcagtgcttggcacatagtagggattcaacaaaactatactgatacaaaatggatagtttacaaaaggcttccacatacattatctttaaggctcaacagcaccataaattacctagggatcattctctccgtgttactgatgaggtaactgacgttttagttgaatggcttacctaaagttacataagtaacatggctagcagtgagaggaagtggaacctgtgcagagggagaaacaaagtttagttcaaaacaaaacaaaacaaaactgtatcataatgtctccactgaaacatttatgttaagaggtcagggggttgaaaatagcagaccagcagaccaacattcagcagacagagaaggatgctcagtctgctcacagcatgtgccctgtgcactggggcttctcctagacccttgcagggatccacaaggtcaaaactgttttcataataatggaacaccattggccttttccactctgttgatacctgcactgacagtgcaaaagtgatgaatcaagacagcggtgccaagctgtactactagttcctgatttctttgccatgcacatggagagaatgtccttgctaataaagcagtgaaaatgatgacttttactaaatcttgactgttaagcacacatctttttcagactgtgtgtgctgctccttctcctgcaggcaaagcccagtggctgcctggaggaggagcatctgctgccttcatggacgcagcacgtcccaaaggaatcaccgacaggccgcctctggatgttgaggcctgtgtccacggcagacgtgtttttgaaaatgaacttagtgagctgtcacttcaaggaatacagctgacagtatttgctgccagtcatgaaatttgaaccttcaagtgaaaattggttttggaaaacttgtatctgccgctgtgagcctggcagcttcccaagacttaaagatgtttctggtgagatccatagtgatattaatgaatggaattaatgttgtagaatgaaatgtgcccacatttggaacagctgcataattcagtgaacaaatatttccagatgaccaatccatgatattataaaatcatccataggtaaaagatccgttcaatgttagaccagtggattttaatgtaatagggtacaaaaagttcaccagaggataggtgtttttttttctttttttttaagacggaatcttgctctgttgcccaggttggagtgcagtggcgcgatctcggctcactgcaacctccgcctcccaggttcaagcaattctcctgcctcagcctcctgagtagttgggattacatgtgcctgctaccacgcctggctaattttcatatttttagtagagatggggttttgccatattggccaggctggtctcgaactcctgacttcaggtgatccacctgccttggcctcctaaagtgctgggattacaggggtcagccaccacaccccgcttgatgttctgttgtgtgcgtgtgtgtatattttttgttgttatttgtttgtttcacagttcactgcatccttgacctgggctcaagtgatcctcctgcctcagcctcctgagtcgctgggactacaggtgtgagtcaccatgcctagattttttttttggattttttgtagggatggggtctcactatgttgcctatagtgagagtttaaatattttattcaaatagattgcaacagatctttaagaaactaccacttactcaattttgttgtaatatcaaataataatattctcaattatttggatattctgatactcctgccattatgtatctttgtgaggccagatttttctcacatacttcaaccaaaacagtgtatttcaacccattgaatgtggcaccaaaaatgagaatccaaggtggggtgcggtggctcacacctgtaatcccagcactttgggagactgaggcgggcagatcatgaggtcaggagatcaagaccatcctggctaacacgatgaaaccccatctctactaaaaaataccaaaaattagccgggcgaggtgacgggcgcctgtagtcccagctacttgggaggctgaggcaggagaatggcgtgaacccgggaggcagagcttgcagtgagctgagattgcgccactgcactccagcctgggtgacagagtgagactctgtctcaaaacaaaacaaaacaaaacaaaacaaacaacaacaacaacaaaaaaaatgagaatccagttgtcttctatgaagctggatattaaagagatttgcaaaaatctaaaaaaagccacctgagacaagtgacaagataactgacaatttttgaaaatatagttatttgtagaaatgttatttatttgaatatataataagtttgatttttaagtgaattcataaatatatcaattatgtttttctgttttaaccttcaatacggaaaatgttgataaatgaaactcataaaaaagctctttgagggtcttcaggaacctttaagaccgtaaaggggccctgctgccagatgtttgagagttattagtgtagttagaagaaagtgggcctcatccttaggaagaagggcttgaggatatcaggtggctggtcagaaatgtcaggcagggccttgaagtgacattagataagaaacataaaggccctaatctgttgccctctttccattcgctctgcctaaagaactgttgaggtctctggacttggagctgggaggatgtttgtgaagagcctgtgtgattgtgagggcagtggccttacatgtggccacctagccctccatcaggtccttctattgctccagatttctagtgtgtgtccggagggagatgcaccaccgcccacccagtagctcttgtgctgggagtggaggaacacccagtctgtctggaggaatgtccactctgtctggcaaggaggaggtggccagaggttcagccaaggtggacagctcacgggaagtgtcctgtctctccagggcgctgctgcctagacagactgacagacacggtagcaccaaattacaatacgcaagtataggtatcaatcatagtaattacaggtgagaatgacattattacggggagcatcttgatttaatattaaataagtaaatcatttgcattgaactgcatttatgaaagaaatcatccacattgaccagcattaaactcccagcagccagtgacttcatgtagttggtgatggggagctgtcccaggattccagctggggagttgttgtgcataaatttgtgttttgaaataccttattggctatggatggagtggggtgattggagaggggcgagactggaggtgggggcaccaagtggagaggagttgtgctaatccaggtgagaagccctgggggctgggcgtggtggctcacatttgtaattccagcacttcgggaggctgagctgggaggatctaaaaagttttttgttttttttttcttaaatctaggtagatactttgtggttcccgagactcacatgagacactcacatcagcgcttgtgtgattgtaagggcagtggccttacatgtggccacacagccaccgtcagggcctcctatttctccagaattctgtctcacctctccaatccctctactccatccacagacaataagatctttctaaacacaaatttatacacaacaattccctagctgggctcctgggcagctccccatcaccaactacatgctgagcccaggaatttgagaccaacctaagcaacaaagtgaggccctgtctctacaaaaagtaaaaaataagccggacatggtggtgcgcacctgtggtcccagcaaattaggaggctgaggtgggaggatagcttgagcctgggaggttgaggctgcagtagtaagctatgattgtgctggtgcactccagcctgagtaatagagtgacaccctgcttcaataaaaacagcaagaaaagaaaccttgggagccacaaaagaggcggctgcagtaggaatggacgatagagcatggatcctactgatttgaagaaggtagaaatagaatgtgaagtggatgggttccagtgggtggagtttgtgggtgtagtgtggactggctggctggtacagttccgctctttttatttgctcttgaaatggatatacttttcattagtgagtctcatgtgagtttcaggagtcacaaagagaccatctacccagattaaaaaaaaaaaaaaacttaaaacatgctggccaggcacggtggctcacgcctgtaatcccagcactttgggaggtcgaggcgggtgggtcacctgaggtcaggagttcgagaccagcctgcccaacatggcgaaaccccgtctctactaaaaataacgaaaaatgagccgggcatggtggcgggtgcctgtaatctcagctacttgggaggctgaggcaggagaatcgcttgaactcaggaggtggaggttgcagtgagccaagatcttgccactgcacttcagcctgggtgacagagtgaaactctgtctcattgttccattctgaagagctgtggaagactcttgagatggataagaacatgtcctcattatcaccctgtggagttctagagctagagttttaacaagatagcatgtggattacacataggaggtgtcctccagtttctgactctatcctcctcttattcaaatgactttaaaaaggaattttgaaggctaaggtgggaggatcacttgaggaaaggagttcaagaccagcctggtcaacatggtgaaacacccatctctaccaaaaatttaaaaattaggcgtggtcgtggatgcctgttatcccagctacttgggaggctgaggtatgagaatcgcttgaacccgggaggtggaggtttcagtgagccaagatcatgccactgcattccagcctgggtgacagaacgagactttgtctcaaaataaatcaataactcaataaatcaataaatacaaaaataaggaggtattttggtcatctacaatacttgtttcaggagagctgaagtttgatacctttttctaagtctaaatatatggaaaatggccaggcacagtggctcacgcctgtaatcctagcactttgggaggctaaggagggcagatcacttgaggtcaggagtttgagaccagcctggccaacatggtgaaaccctgttttctactaaaaatccaaaaatcagccgggcatggtggcagatgcctgtaatcccagctactcgggaggctgaggcaggagaatcacttgaacccaggaggcagaggttgcagtgagccgagatcgtgccactgcactccagcctgggcgacagagcgagactccgtctcaaaaaataataataaataaatacataaatatatggaaaatgccattccagtaaatatttggcattgcaaatcaatgctttaactgtgttctaggctgggcacagtggctgatgcctgtcatcccagcactttgggaggctgaggcaggtggatcatttgagctcaggagtttgagaccagactgggcaatgtggtgaaactctgtctctacaaaaaatacaaaaaattagccgggcatggtggcatgtgcctgtggtcccagctactcggatggctgagtcaaggggatggtttgagtcagggaggtcaaggctgcagtgagctatgatggtgtcactgccctccagactgggtgacagagctagaccctgtctcaaaaaaacccctgaaacccttaaacttgtcacatattggtgggtgtgactgcagagaattgtcatgccttcagaggccgaacaggaaacagctgaagaggagacagtcgccgagaacaagtttgaattttacccagctgtcggtatatttttcaggtgcgtttattgttcttgactagtactttttgtattttaaaatgttgatgtaatttcaaactgacggaaaacctgtaagaatagtatcatgagcttccctatagcctttgcccaggtttgcagattgtttacatctcgccttgtttactgtcaccctccatttacatattcagactgagctggagatgctgtcccccttctactcctaaacaccgtgtctgtctccttagaggaggccattttcttacgtaagcacagtgcagttgtgagagtcaggacctgtatcatggatatgtgctcccggccctctgtagttcagaaggtcaggtgttgctgcctgcccagcaatgccctcattatgccccgcccgtcacccaggatcacacgttgcatttggtggtcgtgtctgtgtagcctaccttaatctaaagaagtctctcagtctgttttagactttcttgaccttgatttttttaactgtgaatttaccatctcaaccatctttcagcacacagtttagtggcagcaagcacacccacatgcttgtgcagccaccaccagcatccaccaccagcagccatctccagcagctttccatcttcccagactgaaactgtctccattaaacaccaactccccattccccttccccagcccttggtaaccgctcttctgctttctgtctctgaatgttttggccttgcatgtagtagaatgtcctgaatttgagctgcctagtctttcctcatattcacactgagatggggcattttgggtaatgatgcacctttgtcagtgaatcccatcaggagcacacgacggtgctttgtcccagtactgtcatgctcatttgatccattaccttcaagccgtttcttgctgagtggtcgcctcctgactgatgctgcccttttgccatacctgtttgggagcacgtcctgactttccagcacaaccagagggcccaagctcactctgtgccctccctgccccagtcctggaattagccttttctccaaggagcctggttcctgttagtggcgaatggcattgagaagccacgaacgtgtgcatttagagctgggctgtgtgctttgcccttggtgtggcatgcgtctcccgttggttggccctctgagcaggagagagaggatggcgctctgtcttgtttacctctgtttctctgtgtatgctggaaccatggatgtgtagagagagctccagtccagctcctcaccatgatatgttcagcccttcccactttgcctgctaccactccctacccagccatgggaaaccagctccattgtcctcatttaatcatgggctcaaagctggaatgcacagaagggagcctcggaatggctaacgctggccacttgggaaagcaaatgctgcaagaggttgacttccttgttttctgaggtaaacgttacatatggtgaaatgcacagaccccagctatctgaacaattggctcatgctgtctagaaatgtcagcattagtcagtgttttgtgggaaatcactgttgttttacatagatggcactgcacgtagggtgcatggggtgaaggggacggaagacgtggtcatggccctgtaggaatttacatcttataagagaaaaacaacatccttacccacagctgagtgaaaagcacagtgcagtcatgatctgcccttgagtaacaaggtagcgatttcaggaattctgcagctggacattgagatggtgtctgttctgcaccagagacttggctgagctcctagctggatgggctgtggagtccatggtggctggacgaagatctgtgtgctcaggtggagtggttgcgggagcagggcggaggatggacaatgaattcacaagtgactgatgtatagaatttagtcattcagctactatcatcgagccccttctctgtgctgggcactgggctaagtgctgcggataccatggggagtaattcctgcgttgaaggtgttttccagtctatcagggcagatggatgacagtgcaggaggcagggtgtgaggtggtggtggctggatgggccggacggagaaaggccttctggaggtgggagctctaagccagtagctgaaacagaatggaagggagtggggtggaaggttcagctggaggaacggggacgtgcaggagctgagaggtgagtgagcagggtcttcagggaaacgccactgggggcctcctgcaaggggccttcccttgtgctgtgggagccgcctcatgcccacccggtgctctgtgcctgccattcccttcccacactgccactccccagcacttggctacgtgttcgttttgtctccccactaggatgttgtatagagaacagggactctgtgttcactgctgagcccgaggctgttcccggggtgactggcggtcaataggtgatcaataactgtttgttgagtcaaggaagggagcagagaccctgagaagagaagaactgagagatctgtgagccggggggctggacaggacagatcctgaccggcttataaggccacaggaatttggattttatcttaagcacaagtaagaaagcttttaaagcagggtggtgacatgttcagaatggcattttattttattttatttttgaaatggagtctcactctgtcacccaggctggagtgcagtggtgtgatctcggctcactgcaatctccgcctcccgggttcaagcaattctcctgcctcagcctcctgagtagctatgattacaggcacctgccaccacacccggctaatttatatatatatgtatatatatatgtatatatatatatatatatatatatttagtagagatggggtttcaccatattggccaggctggtctcaaactcctgacctcgtgatccgtcagcctcggcctcccaaagtgctgggattataggcatgagccacgcacccagccctagaatggcattttattttatttttatttttagtttttttgaggcagggtctcactgtgtcactgaggctggagtgcagtggcacaatcaccgcttactgtagcctcgacctccctggtctcaggtgattctcctgcctcagccttctgagtagctgggactacaggcatgtgccaccatgcctggctgatttttgtatttttttgtagaaacagggttttaccatgttgcccaggctggtcttgaactcctgggctggagtgattcaccacctcagcctcccaaagtgctaggattacagacatgagccaccgcacccagcccaggatggcattttacaaagatccctgtggctgcagactggggtgtgtgagaatgtgtatatgtgtctgagtgtgtacgtgtgtttgtgtgtgactgtgtgaatatgtatgtgtgagagactgtatacatgtaagtatgtatgtgaatatgtgtgtgtgtgagtctgtgtgtatgtgtgattgtgtacatgtgcttatgtgtatgcatgtgtgtttatgtctgtatgtatgtgtgtacatgtttatacgtatgtatttatgtgtcagtgcatgtgtatttgtgagtatatgtgtgtgttagggaggagcatggtgtggggtggggagtctcttgagggtaggaggagatgagggtctggtggcggcttgggctggtagtgacaggcccggcagccccaagagcccctggaagcagaattgcgacccttggtgactgcttgggtgcaggaggatgcagggtgacacgcagcctcctaactggatgtaggagagaaaaacaagatacaccaggcatttggaaagccaaagaacacgtgtttgcttgtgaaaacttaaggaatgttttggtgggatatgttgaaattgttgcctaaaacgatcgctgatcttgtgcccctcagtgtgtggccttcgtttacccctgcttcccctcactcccctgcttgggggctgggtggtcatgacagcctccccagtacacagtgagcatcttttagtttgatgttttcttggagagctttttattttatccttaaaagtagatcagacaaggccgggagcagtggctcatgcgtgtaatcccagcactttgggaggctgaggcggacggatcacttgaagtcaggagttcgagaccagcctggccaacatggcgaaaccccgtctctactaaaaatacaggaattatctgggtgtggtgacgcacacctgtaatcccagctactaaggaggctgaggcaggagaatcgcttgaacctgggaggcagaggttgcagtgagctgagactgcgccactgcaccccatcctggcaacagagcaagactcttgtctcaaaacaaaaaacaaaaacaaagtagatcggacaagcagtttaaagatatatcaaaacaaaagtactgtgaaaaagttaaatcagatttttcctgcattttctgtaagtccttgctgaggtccagatttagttttcagctaggtgtgaccgtcgcctgccttgctgccgatgtcctgaagatgcttcatgttggcacatgtggcttcatcgggtgggctaccatcctgcatcaatagtgggccgtttccatggtttctggtctgttgctggtctggcttggcaggtggcagagcctgggtcagacccgcagtttggcctcagggctcaggctccagagaaccactgtgcagccttttacttcgtacacacagctcttttcaccaagatgtgtttttactgggtcagcaggcatgaatgttttccctgaagagtttttttttttaatttttatttttgagacagggccttgctctgcaacaggctggagtgcagaggtgtgatcatagctgaggaggctgaggcgggtggatcacgaggtcaggagttcgagaacagcctggccaacatagtgaaaccccgtctctactaaaaatacaaaaattagccaggtgtggtggcggccgcctgtagtcccagctacttgggaggctgaggctggagaatcacttgaacccgggaggcagaggttggagaattgcttgaatccaggaagcagaggttgtggtgagccgagactgcgccactgcatttcagcctggataacacagcgagactaagtctccaaaaaaaaaaaaaaaaagataataaataaaaaataagggagataaagttctgttttctttttttgttttgaaatcaagatatttgttttagtcaggttcttttggttgcaaagaagagtctcacttaaatgtccctaagcaactatgttgcctaaggatgcccagtgcatcttaattgctggatgagttgccacaaagtgaacactctcacaaccagatccagaaacagaacagccccgccttgaagatcctctgtgcccccagtcgtgcccacccctccccaggaagctgtgctcctgatgtccagggttgtgtgaccttacttttgcttttggtttctctcgctcagcattgtctgtgagattcatccatgctgctctagtagccatgctcattcacccccttggaccgcagttaactcacctgctgatggacatttgggtggtttccagcatttcggctactaaaattgtgctgcagggaacattcacatgtcttttctttttttttttttggagacggagtctcgctctgtcgcccaggctggagtgcagtggtgtgatctgggctcactacaagctctgcctcccgagttcacgtcattctcctgcctcagcctcccgagtagctggaactacaggcgcctgccaccacgcctggctaattttttgtatttttagtagagatggggttttaccgtgttagcaaggatggtctcaatctcctgaccttgtgatctgcccgcctcggcctcccaaagtgctgggaccacagctcgcatgtctttttgggaacatgtatctaatatgtctctggtgttgattcctaggggtggaattgctgggagatagagaatacaaatgttcagctctaggagataccgccacacccttcttattttattttattttttcatattaaaacaacatttattttaggtttagaggtacatgtgcaggtttgttatataggtgaactcacgtcacagtggtttgtgtacagattattttgtcagccaggtattaagcctagtacccaacagctttttttttttttccggatgtgcaggtttgttatataggtgaactcatgtcacagaggtttgtgtacagattgttttgtcagccaggtatcaagcctagtacccaatagctttttttttcagatcctctccctcctcccaccgtctaccctcaagtaggccccagtgtgtgttgttcccttctttgtgtttgcatgttctcttcatttagctcccacttataagtgagaacatgcggtgtttggttttctgttcccgtgttagtttgctaaggataatggcctccatgttcccacaaaggacatgatcttatttttttgtgtggctgcatagtattccatagcctatatgcaccaccttttcttttctatatgttgatctctggcatgtaccacattttcttatctgatctgtcattgatggacatttaggttgattccatgtctttgctattgtgagtagtgctgcagtgaacataagcatgcgtgtctttatggtagaaggatttctagctttgtgtgagagtcccagttcctccacatgcttgccaatacctggaacgcatgttatcttgaaagttttgtagaaaaacacctacagtccttacccttgagacttgtacagataatactaggaagtgtctcttacatgggagagtctttttgtaactgttggatgactgcgccaatgccatcaatgactttgtgaggtttggtggaataaggagcttggtagaagctggattgctgcggaataattgttaagaaggcaaagggaaggggaggtggtggtcacacaccatggggggtgtaggaggagcaaggtgggctggtgactgaaggaggccacagtaaaacaatgttttctttgagaaggagccagtgcaggggagagtcaaggcaggggagaatgtggtgaagcaagcggcactgctgaggaggggttagagccccagggctgggaggcggagggaggcgtgcactgctgtggaggggttagagccccagggctgggaggcggagggaggcgtgcactgctgtggaggggttagagccccagggctgggaggcggagggaggcatgggtgtgggagctgtctcgctctgtactttgtatctctttataatttgcaaacattttaaaaggtggattaatttccctaatcctgacaaaggccctagcaggcttattttgttacagttgagtaaactgaggctatttggagagcacagccaaccttaccaaattctttgggtgttaagcggcgagccaggagctgcatctagcgctgggacagctttggtgcccggtttctacactgctcttgcttagttttgagtgcagcctttctggcagtttctcattggtttaaagtccctccttatgtggagtcagacaactttgatggacttgaagaattgaagaggcaacatagtttttatctaagagaatgggatttggagtcccactgacctttctccaagctggttccacggctctctacctgtctgctcctggtctgagtctgagtgttttcatcaatcaagtgggtctaagactcctcctgcatagcgcagctgtagggattaagcaggataatattgagaaattccctgggactgcttgactgtagtttaagagcccaatgtttggtgcctgtctcatgccgtggtcagcttctgtgcagcaaatagagatagcgcggtaactctgtgtgtgctgttatggagaggtttcccagatgttactaagtaaaaacaatgcaaaacaaggcacagaacagattttatggtatgaacctatttgtgtttttaaaaaggtatatgtacacataaataaaataattatataaaaaatttatggaaggtatacacttatacacaggtatgggaggtaggggtaggtagaattataagaatgtatattttcctggctgggtgcggtggctcacgcctgtaatcccagctcttagggaggccgaggcaggcggatcatgaggtcaggagatcgagatcatcctggctaatacggtgaaacccctcctctactaaaaatacaaaaaaaaaattagcccagtgaggtggcaggcacctgtagtcccagctacttgggaggctgaggcaggagaatggcgtgaacccgggaggcggagcttgcagtgagccaagaccgcgccactgcactccagcgtgggcgacagagcgagactccgtctcaaaaaaaaaaaaaaaaaaaaaaaaaaaaagaatgtatattttcctgtacttaatttaaaaaacttctgcatgattattttagtgttagtttaaacagcaacaacaaaatattacccttatgatatgttctctattagcttattagctgtacctctttttttttttgagacagagtctcactccatcacccaggctggagtccaatggcatgatctcggctcactgcaacctctgtctcccaggctcaagcgattctcatgcctcagcctctcgagtagctgggattacagatgcatgccaccacatctggctaattttagtatttttagtacagacagggtttcatcacgttggccaggctggtcttgaactcctgacctcaagtgatccacctgcctcagcctctcaaagtactgggattacaggtgtgagccaccatgcccaacctatacctttttgttttattttatttttttttttggtggtggttctaagattttcaatattacatctttaagttatcacagtgtaccttcaaatgatattatgccacttcacatgtaatataagaaccttatagaagaagggtgtactgctctcccccgtccttttgctatcaatgtcatacattttatttccacacattttaaaccccacagtacattgttattacttaaaaaaggtctggccgggcgcggtggctcacgcctgtaatcccagcactttgggaggccgaggcaggcagatcacgaggtcaggagttcaagaccagcctggtcaacatggtgaaccctgtctctactaaaaatacaaaaaaaattagccgggcatggtggcgggcgcctataatcccagctacttggaaggccaaggcaggagaattgcttgaacccgggaggcggaggttgcagcgagccgagatcgcgccactgccctccagcctgggtgacagagtgagactctgtatcaaaaaataaataaaataaataaataaataaataaataaataaaagtccattatcttagaaataaattttaaaataagaatatctcttatattaacccacatatttctatttattttttctttttttttattctgagacagagtctcactctgttgcttcgtctggagtgcagtggtgtgatcttggctcactgcaacatctgcctcccgggttcaagcaattttcgtgcctcagcctcccaagaagatgggactacaggcatgcgctactatgcccagctaatttttttgtgtttttagtagagatgggatcttgccatgttgaccaggctggtctcgaactcctggcctcaagcagtctgcctgcctcagcctcccaaagtgttaggattacaggaatgagccactgcacccagcccacatatttctgtttctaggcttcattccttttatagctctgagcttgaatctggtatattttccttcagtctgaagaactttaactttgcttatagtactggtattttggtcacatgttttctcagcttttgtttgtctgaggttgtccttatttcacctttatgctcctagcactttaaggatgttctgttgtctcaggcttgtcttgttcctgaagtctgctgttggtcttacttttgttctctagtatgtaatattctttttctcctccagctactttaaagatgtttttgtcattggaatttagcagtttgattacaatgtaccttggtgtagttttctttgtgattagcctgcttatggtttgttgacattcttggatctgtaggattatacttttcaccaaaattttggaaaatgtactgccattatttttccagttttcctatctctccccttgttcctcctcaatcttccagagctctatttacatttattttagatgctagatattgtcccactgaggatccccattccctccatctttttttcctctgtgattcagttgaattgtttctgttgcaatgtcttcgcgttctctcatctattcttctatagtatctaacatgctctttattttattgttacagagacaggaggatctcactatgttgcccaggctggtcttgaactcctgggctgaagtgacctcccatggtgtcaggattacaggtgtgagctgcaatgcccagccctaccatgctcttaagccaactcatccgatgtatttcaaaatttcagatgctattttttttctttaaaagttccatttggatttctttcttcgtattcatgctctcttttaaatccttgaacaaatttgtaatattgttttaaaaatcttatctgttatttcctcgtcactctcatttttgggtctagatggactgactttcttgtggttgtggatcaggctttcctgctttttcttacctctagtaatttctgattggatgctggacatagggagtgttacgttgttgagcatctgcgttttgttttctgcatttaaacagtgttgagttttgttctggcaggaagttagtttacttgtagatcagctgccttcttatagggcttgtttgctgtcttttaaaaacaggtctaggccgggcgtggtggctcacgcttgtaatcccagcactttgggaggctgaggcaggagaatcgcttgaacccgggaggtggaggttgctgtgagccgaggttgtgccattgtactccagcctgggcaacagagcgagactctgtctcaaaaaaatgaatgaatgaatgaatgaataaataaataaaagcaggtctaggtcaggattggaaaactatggccccttgcttgtttttataaataaagtcttctggaacacagtcccattgtttgtggatggtctatgttgatttcatgtgacagtggtaaagttgagaagttgaggcaaaatctatatgtcccacaaagcctaaagtatttattatctgcccctttacagcaggaaatttggtgacccctagtctagagaagcctttacttttggtctagtttagccctgtgcctaacgttgtggcctttctgagtctccgtgagggtcgtgggtgcttcatgaggtcccttaattcttcctcgttggagcttgaatgtttctcaccctgctccgcttctcctgcccctgtggctgctctttgcctggcctcctggagtctcaccagcagcacgccctgccttgccttcaggcagggactcaaggagcccagctccgtttctgcctcctccgtgtggctgtctcctccttgttactctgccgctctcattctggctgctgtggccatcatgaactcagacctctctctcctcagctcagtgactgtcacggtctgcatgggcccctgtctccatgcagaaagctcctgtgtcacggggcacacctcatttgtcttcccgctcagggaccacgttcctgtatgactcgttgttcaatgcctgaagaagtgttttatgtattgtgttcagttttctagttgtgtatggtgggagggctaggctgttcctacttagtccatcttttcctggaagtggtagtccccccaagtatgatatagaaggggcaaatgaaagaaagtgccagatagatgaatgatgcgtgacgggatcaccttttattaagtaggttagagtagctgatggttgatttttttatttttattttttatctttttgagacagagtctcactctgtcacccaggctggagtgcaatggtgcagtctcggctcactgcaacctccgcctcctgggtttaagcgattctcctgcctcagcctccggaacatctgggactacgggtatccaccaccatgcctggctaatttttgtatttttagtagagatggggttttaccatgttggccaggctggtctcaaactcctgacctcaagtgatctgcctgcctcggcctcccaaagtgctgggattacaggcgtgagctaccatgctgggcctgatggttgattctttacagtgaataagttgttatgtattaatgagttgttctttcactgaacctaattatcccccccagtggagtttcactttccaacttacacacagcattaatatttaagattacattggtgtatcacattaatagtacagattaaagtttggaagagttcagctttcatgatccctagacaactaatttgcaaggctagatttagagtttctcctttctctgatagaaacatttgcatttcacttgggctttataacgccaggtaggtcagaggttgaaactgaaataattgttaaacacgtaagaggatttaaggataaaatcctcccctgttttggtgttacagatctaaattgggcactcagtcatgtagtgccagagtgcgggatttggctggctaccttaaaggtttagttaattatacagaaatcctctttcagtgttaatcattgttcatgtcctatagaaaatggtctaattgttcttttcatttagctattttgtttaagaaggtcctttctagtctgatttgatttctttcttttttgaaattaggaagtaaagaatacagaaaacatctatttacaattccatcagtatttataaaaacatctgtgtgcccccagcccagtcaagatatagaatatttcagtaccctaggacttctttatgtgttgcaccttgatcccagttactccttttcttaaagaggcaaatacttttcttccttttgttggcaataattatctcttcacttttcttttgagatcgggtctcattctgtctcccagactggagtgcggtggtgtgatcatagctcactgcagcctcgacctcctgggctcaattgatcctctcacctcagcttcccgggtaactgagactgcaggtgcacaccaccacaccaagctaatttttgcattttttgtagagacagggcttcaccgtgttgtccaggctcctctcaaactcctgagctcaagcaatctgcctgccttggcctcccaaagtgctgggattataggcatgagccactatgcccagcctcttcacttttcttaatggttttcctacctgtgcgtctctaaaagttgtacttgcgttttcgtgtgttgcttcttttctcagtatcgtattgataagaatcaggtggttgagaaaaacatttaggtatgctgtagggatagagtaactattttaaattcttttaaacaaaaaaatcaggtgcttgaatatatgttgtttacttctatgtaatatctcatttcatgtgtacatcacaatttacttatccattctactgctgaacaatgttgaaattagcattacatatttattttagagactgcgtctcactctgtcacccaggtgggagtgcagtggcaccatcacggctcactgcagccttgacctcccacggtcaggtgatcttcccacctcagcctcccaagtagccaggactacaggcaggtgccatcatgcctggctaatttttctttgtatttttttgtagagatggggttttgccatgtttcccaggctggtctcgaactcctgggacaaatgagcattcttatatattctggtacacctaagcaggcataggatataagataattatatattttcttcttttttttaaaaaaatgcctgttcaagtcttttgcccagttttctgttgagttgtgtttttcttactgattttaggagcttttatatattttgaatatgtattataaatacctcccagcctgggcaacatagtgaaaccccatctctcaaaaacaaacaaacaaaaaaagtagccgggcatggtggtgcacacctgcagtctcagctacttgggaggctgaggcaggaggatggcttgatcccagcagttccaggctgcagtgagtcgagatcgcaccagcacactccagcctgggtgacagagtgagaccctctctctaaaaaaccaaaaccaaaaacaaatctcaaaatctttccactcggaggcttgttttttcatgttccttatggggtcttttgacattctccattttaatatggtctgataatcagtctgttcctttaaaggttggtgctttttttgcatcttatttaggaactctctttctcccttgatggcatgaagttaatctgtattatctgttaaggctttatgctttttctttcctgtttaagttttgtataaactttgtgtatggtttaaggtggggatctagtttcccatgtggatatctagttgtcttagtagatttttgtgaaaagctcatccttcttcctcagttgcagtgctctgtcgtaggccaagtaggtctgtttgggacttgctgtttatcccattgatctgctggtgtcattggtcagccctagcaccactctgtctgctttaattactagggctttataaaaaatgtgtgaaggaagcacttgtttttcttgagaatgtcttggctattcttgttcttttgttcttcatataggtttaacaattagcttgacgagttcaaagaaagaaaatttggggggtatttgattgggattgcactgagcctatacatcaatttggacagatttgatatcttttcagaattgagacttctggtccacacacatggcatatctcttatttagataggtcttctttaatttccctgaattaagttatatgcttttccctgtagaggtgttgcccatcttttgttggaattcttttaagtacttgatattattttgatgctgtcctaagaggcaactttaaaaaatttaagtttttagcctgttatttggtaggtatataagagtaaaaattattttttatattgctttatatgcagcattcatgatatctccatgtcatcaggagccctggcagccatgcacacagcttcctgcccccttgatcctgaagagtgtgtaaggctgctggggatcggatgcagttatgtaaggggtgtggatgcagaggagccagccgtggtttcatgctggtcttgagtgtcattctaatcatgaggccaccttacacccctctactccaggacatcccacagatcagaaggctcatgggaacccagatggagaaccagctcctagcactggccttccccatttatcttaactggtgcatttccagggcagcagggctgcaagagtcagccctacagctgtctgcccacatgcctgggtcgggggaagttttgggcttcatgtcaattcttgagttcccgagagttcgtgtccaggttgggaataacttgtcccacaaatgcctggtagaacttgcccataaggtcatgtaatccgaaagtgttgtttgtaaaaaaatttttaaagttctgatttaagcttttaagatggttttttttttcttttttctttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttagtagagacggggtttcaccttgttagccaggatggtctcgatctcctgacctcatgatccacccgcctcagcctcccaaagtgctgggattacaggcgtgagccaccgcgcccggccggttttttttttctttttgagtcagttttggcaagttacattttaagaagactttgtctatttcatctaggtttcaaatttataggcataaagttgtttgtaacatcctcttgtgatctttttaaagtcaatgggactgtagtaatgtttcctttttattcctgacattgagatttgtgcgtccactcttttttgttgttgtttttttgagacaagatcttgctttgtcacccaggctggagtgcagtggtgcgatcatggctcactgcagctttgaactcctgagctcaagcggtcttccccgcttagcctcccaagtagctgggactacagatgtgtgccaccaagcccagcttatttaatttttttttttttttttgtagagacagggtcttcttatgtttcttaggctcatcttgaactccttggcctcgagtgatcctcctgccctggcctcccaaagtgctgggattacggatgtgagccaccatgcctggccccctagtttattttatatcttattatttccttttttctactttccttgggtttgttttattaccttttccgccattcttgagggggagattcttgagatgagtacttaccttattagttttcagccatttgtcttttctagtgtatgcacttagcatttagaaatgtaaatgcttaatggcattcaacaagtagtagtttttaaaaatatatttatgtatttcagagacgaggtctccctgtgttacccaggctggtcttgaatcctggctccttccgccttggcctcccaaagtgctgggattataggcatgagccaccatgcctggctggatatacagtatttttgttcagttcaaattattctctaaattttattttgacttgatcaatttattatttaaaagtgttgtaatttttaaacatagaagactttttctaggatttatttttgatttcttaattgcattttgatcagtagacgtctgtcagcagggcagtagcaggtgcaccgcacgtctgtagggggagccatccacaccgttgccatgtgcgaatggcgccccctcgtgttgtggatggtgtaggttgcaccgctgtgtgcacacgtgtgcatacatgcatgcacacgcttggaatttcagctgctctgtcccttataggcccgtgcgtggtcagtttttgtaaatgttccctgtgtacttgaacacgatgcgtgtctacagctgttggtgccaccttttatacgtgtccattaagtcaaatattttatttgtggtgtacaaatcatttacactttactgatttttttgactgtttctatcagtaacagagaggtgtattaacacttctcaccatcattgtaaatatgtctattctccttattagacatatttagatagaattctctgcccatttgtgcttcatttatattttgaggccatattgttgtaaaactgttgtatcttcctggtaaattggagtctatattgttgtaaagtgactctttatccctaataaaactttttgccttacagtctgttttgtctcaggatagttacaccagttttctcttggttagtgtcagtcttgtttatttgtccttttatataagtcaacacttctgtagccttgtatttttcatatgtctcctataaacagcttgtagttggattaaaacagatcagtctgatgatttttgtctttcagttggagcacttagtctacttacagccattggggcctaaatctgccatctcttttgtgctttctatttgtccttcctgtaatgtttttttaaatgcctttttatagattgaaaatatttaatttcttcccttttactatttttgaagcagtgcactgtttttctcttgtaatggtttcttagaaattacagtaggaatactgaaaaaagtacaacgtccgtcatgacctttattcttttcttagacaacccaagacttaggaaattatttaatccgtttgtttcttgtatgtgagtattgctgtgtacagtattttatttttaacatcccaagttaccatccttgttttcggcagtcattgttctttcaggctgatgcacatgcttttgactcttcgctctcctttcctttagcgtctcagaactttcctatggggccacctactttgactgaaagacttcagaattcttttctcatgacggtctactgatgccacattcacttcgttagtctgaaaatatcttttttgtttgtgtgtttttgtttttttgagacagggtctcgctctgttatccaggctagagtaaagtggcatgaccttggctcactgcaacctccacctcctgggttcaagccatcctcccaactcagactgttgtgtagctgggacagcaggtgtgtaccaccacacccagctaatttttgtattttttgtagagacggggttttgccctgtggcccaggcttgtctcgaactcatgggctcaggcgatccacataccttggcctcccaaaatgctgggattacaggcgtgagctcccatgcctggcctctgaaaatgtctttattcagtcataattctttttttttttttttgagatgaagcttcgctctttttgcccaggctggagtgcagtggcacgatctcagctcgctgcaacctctgcctcccaggttcaaatgattctccagcctcatcctcccaagtagctgaaattacaggcatgcaccaccatgtctggctaattttgtatttttagtagagatgggtttcaccgtgttggtcaggctaatcttgaactcctgacctcaggcaatccatctgaactggcctcccaaagtgctgtgattataggcatgagccaccacacccggcctcagttgtcattcttgaaaggtatttttcctagggatggaattctagagtgatgttttcttttagactttgaggacagctgggacctacaggtgcatgccaccacacctggcaagttttacattttttttatagagctagggtcttcctatgtggcccaggcttgtcttgaactgctgggctcaagcagtccccctgcctcggcctcccaaaatgctggcattagaggcgtgagccattgcgcctgactctccagcttatttacagtcctttccacggaagtcactgaagaattggataagtgtacagtctatacttttcatcaagcaatagataaagaggtagcagcagggtgtcatggccagggtgtcaaactgtgtggaagctgcagtccagctctggagctgggcttcatgcccatctccagtgccattctcttcgaagggccttggacctgcagccttcctggagggagagggtgaatagccaagatgcagaatgggctttctttgtaatctggaagacctacgcttaatgaagcagtgtcagtttgaacacttcttaggcttatgcaaacatgtttaggttattttagctgattgaaggcaaaatatggcctgacgctgtgatgtgcggcgcagtcaaatgcgtcagaccctggctgtgttcacagagtgcagcatccagactgagggcggagatagcctctctgctcatgagctgtctctaaagaagcgccctctttaaaaagattgcacgttacattggaatttattcaaggtgcgtggctgagatagtgaagggatgcaaaccgtcatctgaggaacttaagtcagggagctgggttgtttagtgtggagtaaaggatctttcatgagtgagtggttgggggggtggtacatttcactccagatgtcaacagtcattgcgatgttggcactgctttggtcctgagtttcaagggaggaaattgaaggcttgagaggtgaagtaatttgcagaaggtcccctgaactcaggcctgactgtctccaaagtggcgtgtcagctgagggaacacagggtatcttgcagtcgtgatttctgatcaacacaagctgtccagcttcccaacatggccaaacaacaggacagacgtggctgctttccgtgggctctgttgcttctgatttatgtgtgtcttttctctttgagttgaagcattagaaggtgtatccaccaagatccagtaaagaagacagaaaacacaccaggtatctcaaccaagcggatttaggtggggaactggttttacaggctttcgaggggctgaaagggccaaaaggaaaccttgactgagacggtaactacaggaggcaggtgctgctgctagggctgggggaacaaatagaagaggctggagttacttaaatctagatggctagagaagggacccagtgagctggggcttgggccactgaggtagggacacagcctggcgcttgctggcaccgctgctaagtgcacagtgcaggggcctgggagcagaaggaagcaggagggcatgggggcggccggcagctgggaagggaaccatcctccctcctcgcctgccagcctccctggagggtgctggacaggtttgaacttcatgtggtagcagtaattttaaggttttgttttgtccccttgcaactctccttacttgctttgtccccttgcaacttataactaccttacacaggtactctgcattggtactctgcacaggtactcggggttattatttacatatgggatctgagcctcctgtgctttgcccgagttagggcctcaaggactttgtggatcccttcctgatcttttatttatttatttgtttatttatttatttatttattttgagatggagtttcgctcttgttgcccaggctggagtgcaatggtgcgatctcggctcaccgcaacctccgcctcccgggttcaagcgattcttctgcctcagccccctgagtagctgggattacaggcatgcaccaccactctggctaattttgtatttttagtagaggcagggtttctccatgttggtcaggctggtttcgaactcccgacctcaggtgatccgcctgcctcagcctcccaaagtgctgggatcataggcgtgagccaccatgcccggcccttcctgatctttatggcaagaggtttttgccacaacaacacttcacacctgactgaagcccagagaagcccacgtcacgatggctggaggcaaggaagaggatctagtcttttctctctcccagaggcgggagccttatgtccacatcactgtgagcctgctggccttgcccaaggactattcttttaaactaagagagtaaattaagatatttccgaggggtctgggatccatgtaaatgaaaaagttcaaccttttttgtaagccatgttcttaaaaatctgcatgtggggtagttaagtgtcacttactagagtcgaggatttcagcgcaggtctttttgaagttctgagatgaacttctcctcctctttatacttctcattccaaggatgctgagtgtgggattattcctgatgcagtgctgcctagggagaggagcctcagcacggcatctatcatgggctgctttgcttctgtatttagaaagagaactagaattttaaaataattgacttacaactacttagaaaagaaagggccaaatactatgtgcaatcatggcttcctcacggtcaggcatgtttcctgatctcatctcctttttcaggagactctttggaaatacatgcatatatttcattattgggaattaccaataatttaaccacttttgtgctattagacatttaggttgcttctgattttttaatattataactcatgttatgatgagacagtgtataaatctttgttcagatttctggttattttctcagtatggtttctggaagtgatagaaataactggataaataataaataacctttaggggaattggcacgttttgcaaaattgctgtttgggaagtttgtcccattttatgtgcccgctcgtggggtctgagggaggctttttcctggctcggctgccagccctgggcattgccatttgaaaatacctttgcaattaagtagacgcttgaccgtttcattgttttaattatacttttcgattattagtgtagttgagtatttttacatatgtttatgggtcagtttcattatgtttaattgtttatgcccttcgtccacttgtaagtaaaacagtgaagagtgacccgtgtggggttttttgtgttttgttttggagacagggtcccactccgttgcctggggtggagtgcagtggcataatcacagttcgctgtagcctcgaactcctcagctccagcaatcttcccacctcagcctcccgagtagctgggaccacaggtgcatgccaccatacccggctaattttttatttttattttttgtagatacggggtctccctatgttgcctaggctggtctcaaacttctgagctaaagtgatcctcccatctcagcctcctaaagtgctggggttgcaggcatgagccaccatgcctagcctgtgtggcctttcatactaggtgaatctgtggccacccacatcctgagaattgttttgttcctcttccaacctagaggaaggtccccttggaagtgtggcttggggctctgtgattgaacctttcctattcatcattttcgtcagtgtgttggatacagatttggaaggcgtgattactgagtgctgatgatataaagctgggaaggacaggtactaatgtagatgaaagactcgtgatttactccaatcttgaaaggatgacatgctggcagattgtggtaaaatataacagagatactttgaaagtcctgcatttagtcttccctttctctcccttgctcccttcctcccttgctttctttcttccttccttccttccccctttatttgtcccatcaattgcgtaaatgcaggtaaacatttagccattcctgtgaaagccgctgtgtatgtggtggccttaatcattgtccatttttgggcctgtggatccctgttattctctgcagtggagactgcacatcgggccagtgcatgcctgctattctctgcagtggagaccgcacatcaggccagtgcatgcctgctattctctgcagtggataccgcacatcgggccagtgcatgcctgctattctctgcagtggagaccgcacatcgggccagtgcatgcctgctattctctgcagtggagaccgcacatcgggccagtgcatgcctgctattctctgcagtggagactgcacatcgggccagtgcatgcctgttattctctgcagtggagactgcacattgggccagtgcatgcctgctattctctgcagtggatactgcacatcgggcctgtggatccctgttattctctgcagtggagactgctcatggagcatctgattttcttctggaccttctattttgagctgcattcacagagcacacctgagaaatggtggccaaggggagtgatctaggaccctgagaaacctggaagcagctccccttagggagagttgcagagggctggggatgttgaaggagagagaaggctctggaggaacttggatactcctttccaggctgagaagtgctgccctgggcactagagagggagagctctggccatggcttctgagggccagctgcaagtggacactgccatgggacaaacagcctcatctcactcattgaacattccaggaggaactaaatgacccctctcaggatgtcacgggatttctatgttgctggaaagatgcttgtggtggaagcgtggttactaggtggacctggattcagaggacagctcagctgattcctggcttgtggacttagatgggttgaacctttaaacactcagaacatcagtttcctgtaaggtggggtaagaatgcgtgtgtactgtgattgatgtgaataaaaggagcactgttgccaagtccctgagtgcagacccagcaggttggaaccacttcttttctgttccctgaacaattggactgtgtggacgcagatcctgcttccctgagctgcacggccctctctgatcgcacatacatgtgtgcatctgacacatatgcttgagtgtgagggtgacagcggtcagacaaatgggcttttttttttttttttttttttgagacagcgtcttgctctgttgcccaggctggagtgcaatggcgtgatctcggctcactgcaacctccgtctcctgggttcaagcgattctcctgcctcagcctcccgagtagttgggactacaggcgcccgccaccatgcctggctaatttttatattttcaatagagacggggtttcaccatgttggccaggatggtctcgatctcttgacctcgtgatccgcccgcctcagcctcccaaagtgctgggattacaggcgtgagccaccgcgcatggccaaatgggctgttttaaatctattagaaaaatttttcacaatttttagtctctattattctttctttttttttctttttttttttttgagacggggtcccactctatcacccaggcttgacagagtgcagtggtgtgatcttggctcactgcaactttcacctcccaggttcaagcaatcctctcacttcagcctcctgagtagctgggaccccaggcatgcgccaccacgcctggctaaatattctcagttatactttcagtacacataaaggcagttgtcaaccaagctgtttgttagaaaatgctaactgtggtccctgtccactgcctctttcctgttttttttttttttttttttttttgagacagagtcttgctctgttgcccaggctggagtgcagtggcgcgatcaccgctcattgcagcttctgcttccttggttcaagtgattctcccctgcctcagcctcctgagtagctgggattacaggtgggcaccatcatgccaggctaatttttctacatttagtagagatggggttttgccatgttggccaggctggtcccaaactcctgacctcaagtgatctgcaagccttagcctcccaaagtgccgggattataggtgtgagccactgcgcccagctgttcactgcctctttctgaggcctgtcccacgtgggaccttgtgagctggtggaggcctcttgagggctggcaggagcctgtgctacctctgggcccagcacctatgctcccgggagccgtcccgcctcttgccttcagtcttcatctgtactgtgaggatcatccactggcctcccaacccggtagtgaagggggaataacaaggacgtctctggaaagtgctgcaggttcccctgaggaaagctattgtagagtagaaacgagaatgcacccccggaatcagctctccgatgatatgcaggtgcagctgcctccagccctgccgttggtcaggaggaggcaaggggtacctaatgtgctcttatttggcccatgatgagtggagaaagagacctttgcccaggtgtccatgtcactgaggcagtggcggagggtgtcccccagctctgcagtggtcaccctctgcctcctgtcctcgggcagctgcctgtggctgcaggcggtgaaggtgctgttggttgtttgctcccagacctggctgtggggcctgctctgcagaggtcaggggcatggcgcagggggacccagcagggagctggagccaggcagtgcgggctgagccaggccgaggagacccccgcttttatcttgagtgttgtcatctgatgctgagttctttctcagcagtgaaggggaatcagtgtcctgacttgaattgcactttgatggggtttttagtttctgtgtgttggatttttactgagagctctagagaaactagtcacctgggggtttcagaggagggttgtgaagtgctgaatttttctttgagcttttaaggtcagaactcaggggagctaaaaaaaaatgaaaaaataataatttaaaccttataaggtgactcataaataactgcctttcaagatgagtggaattcttctgggaaaaagccctgtggaaattctcctgaccaccgagaacaaagaggaccactgctataaaaacctccagaatcatcatctgcggatggagggaagactctgccaggagtgcgatttttcctttatgtgttactccgtttaccatgtctcaataaaatggcagagaaagtccttttcctgtgtttcatttttcccacaacctttccccttttgacttctttggggcttccccttatctgagactggcccaccgcagaattcagcttcacgggcctgtccggatggaacgtggacgccatcatgtgtttactgcttttatctcttagccacttagaaacattgttaccatgagaaaatgggaattatgctttgatccttgagttaaatcgaggctgtggtagctggtgagttatgaggctttattaaaataaatgatcttggatgtgttgggtattcactggcaagatgttaccagaactcaaacatttaagataagccacatattatttgtatggattcataaaatatagaaagagcgtgagctggctatggctgggttttgtatcctttcccccaactctgttacacttttctgaaagaaaatgagactttgcttttatgtgaatagctgtagaaagctagggaggggtgccatttggaaattgaattaaaaccaaattatgtaagaatgtggttagttttataatatcctgttcttgtttcagtgctttggtttattattattattattattattattattattattatttttgtttttttttttcctgagatggagtcttgctctgtcgcccaggttggagtgcagtggtgcgatctcgactcactgcaaactccgcttcccgggttcaagcgattctcctgcctcagcctcctgagtagctgagattataggcacgcgccacctcgcccagctaatttttgtattttttagtagagacagggtttcatcatgttggccaggctggtcttgaactcctgacctcatgatccatccgccttaacctcccaaagtgctgggattacaggcgtgagccaccgcggctggccggtttattattttttcctcagtgccgtggaggcgcacagggctgctgcacccgttagggtggccctgggtcctacagccccgggcacacggtgcacagcacttgcgtagggtggtcctgagtgtgcacgctgctacgtcgctcaggcttatgtgccttaagcagttgcatagtttaggcacagtgctgcttctcaaagtgaattctacttggagccacttatatatagattagattttataatgtgtaatatgaagaggagcctggaggtatacttaatttaggaattatattatttttggtttgggttttaaagtatttgaatgcctgttaaaccaattctgtagtggctagaggttcaaaatttgtagtatttatgaaaaatactcattctaagtctgcttccttttataatttaggtatatacactctctgttcagaattcctcaatacaacgcattaaatattgttccgaggtcttctgagccccgttctcagtggtggccgtgagctaacatttccacatctgtcacaatgttgtttgcagtttgtcgggaggcgctctgcagccaggcagatggaggggccgctaggcaggatgttgcgagtctgtgagggcatcaatcccccgtttctggcatagatttaattgtttggttcaactgggaagccatatattaacttctacttcaacccatcctgatctctccacagatgctagttttatacaggcctatttttctctgaaattgagcctgagagacaaaaatccacacttgggctgtcatagattttggtaaattgagtcttgtgactgattggtgcctcctgcctgccccgtgatcctgtatgtagtaaccacgtcgtgatcacaggtcatggattggggaaagttgcctccaaagatgtgggtgtctgtttttcactccactttccatttggccaaaaattcaacacttcagtttctgtttcaaaaaagtaacaaagaattaaaaggaaaaaagcagtaagaaagtttgggccatggtggtgctctggtacccgccttcctgtttctgcctgtgtcgctctggctgggcagggtccgggcatggcagccctcccctctctcctccccctctgccatgggggcctgtggttcagctgccaggcgggaactgaagagcagccccgggcgctgcagcttcctgtcctgcccatcacggtcagggacgccggtgtccgttccttctactccaagtctgtcccgagtttgaatgttcagatgccaccagcagctctttagggtctggaccaaacgtctgatttttcctctactaacctgatatgtttctcatggcctttctcgcctttttgccatgtgtgatagctgttcctgttccttggactggattttcacgggctcgctggcaagcaggtcctgcatagcatgctcagcatgtagctgtgctccgcgtctgccggatgaacacacgagccggtcatgggccacgtcagcaatgttctcgacctttgtaagcttcgagaatgtgctgtgtgtacagaaggacgcgcagccaagtatgcggtggaatatccagaaacaacacggggcttgtcgggtgcagacggggcgcctcaccggcccggcgcagccccgctcgcccctctggcctcccccgcagttcccctttcctggttgtgcagcatgcactcgcttgcctttttcttttctcacagttttatcaactgtttgtgcatccccgaaataatacagctttgcctggtgtggaaacgtatataaacattatcatagtatctgcgctcttttgtgtcttgtaagacacccgagatcgattctgttgccgtgtgtagcggcggttattcttgctgttgtcgtgagccattgaatacagtgtcgaacacttgggttgcccagtgtgtgtgtatgatgaatagtgctgctataagtgtttttatatatgaattttggttagcacctgtgtggattttcgggaggtagttgcctaggagtggaattgcgtagtaatcgggttgggttttagctgaggttgtttctgctgcaccacactccggcccacactgttacgcatttttactgtgttcattcctgtgggtatgtattatatcatggctgtaatttacttccccctggccccgactttgaaaagttgtatttatttatgagatacaatgtgatgttttgatagatatatacattggggaatgattaaatcgagcttattaacaaccatcaccacacatatgtatcttttttttttttggtggtgagaccatttgcaatctctttgcaattttaaaatatatagtgttattaactatagtcagcatgctgcatagtagatctctgaacttactctctgtccaactgaaggcttgtgccttttgaccaacatctcccctaccccttccacccactaacctctggtgaccaccattctactctgcttctgtgagtttcgtttttttagatttctcatgtaagtgacatcatgtggtgtttgtccttctgtggcttatttcacttaacgtaatgtcctcctggttcatccatgttgttgcaaatgacaggatttccttcttttttttaatggctgagtagtattccatggtgcatgtatatcacattttctttatccattcttttttttttttttgagatggaatctcgccatgtcgccccggctggagtgcagtggtgtaatctcggctcactgcaacctccgcctctcggggtcaggcaattctcctgcctcagtctcctgagtagctgggattacaggtgttcaccaccacgcctggctaatttttgtatttttagtagagatggggtttcaccatgttggtcaggttggtctcaaactcctgacctcaggtgatctgccctcctcagcctcccagtgttgggattacaggagtgagccaccacgtctggcctatccactcattttttgttggacaccttggtacattccatatctcggctattgtgaaccacactgcaatgaacatgggtatgcagatgtgtcttgaacatgccgatttcaattcctttggatatatatacccagaggcagaattgctggattctatatggaagttctgtttttcattttcattttcttcatgactaatgaaattacacaccttttcatactcttactggtgattttgttaggatcttttgtgatgtacctgttgaggatttttgcccttttcctgttgtattgtttcttattgatttgtaggaattctttaaacattctggataacgtccttttaaaatgtgtttatatgtggaacatttcttgtcctgtgaaacatctctgtgatgcaatatttcagtctttttatggtctctcttgataaacagaaatatgtagttctattctagtttaatgtgtaagtgctttccctgtgttttatgcttgtgttgaaatattttccaaccttaaggtcaagattttgtcccataatgtaccctaaaagcttcatagttttgttttttacatttaggtccctaacgagggtgactgccagtccctgtgtgcccagggcagtcctagggatgaataattaccatgtattaataatcacgccagtctatggcccatccggcattggctttgcatatggtatgaagtaagggcccagttttgctctgttgcatatgaattttaatttgtcccagctcctttcacttgcagggactatgatgactcctctgcaggccgtctttgcgggaactaagggctgagacgcgcctgggtctgtttctggccctttgtgctgttccgggggtacttctctctgtgtgccagcttcacactcctgtctctgtggctgctgatggtctgaaaaagcacatctccccatttggatcctccagagtttcttgactccctgtgtccctttgcatttccatagaaattttaaaatcggtgggtcaagttcactgagaggcagaaaaacatattgaggctttgattgtgatttaatcatatctgtaggtccatagatcatttaggcagagacttgacatcttttcaatattaatttttctaatttttcatgtagaagtttttcacatcttttgttagatttattcttagatacttttgttagatatattcccagaattttaaaatgctattttgatgagtcttagaaattgtgtgttgtttgttctggtgcataggaatgcagtatacagttttcgttttgttttttttcaatcgactgatttgtatccagcaaccttacagaatattttaatttgaatattcacatatttatttggatttctataaacacagtcatggtcttctgtaaataatgacagtccctcctaccccatctttatactttctctcttttttctatctgtgctacactgaccaggactagtgttgaataaatgtgggggcatccttaacttttttcttatcccaaaggggaacacatttaccctattaaatacgattttttgagctaatttcgtaggcaatctccatcagattaaggaaggtttctttcttgcttataagcgttatttctttaatgagtggttattgaattttagtaaatgcttttttgtgcatctatcaagatgatcatatgctttttctcctttaatttgttagcatggtaaagtaggcatgcaggtatgcgcacatgcgtgcacacagtgtctttaatggttgagctgtgtgttagcatggtgaaggaggcatgcaggtatgcacacatgcgtgcacacagtgtctttaatggttgggccgtgtgttagcatggtgaaggaagcacgcaggtatgcgcacatgcatgcacacagtgtctttaatggttgagccgtgtgttagcatggtgaagtaggcatgcaggtatgcgcacacacgtgcacacagtgtctttaatggttgagccgtgtgttagcatggtaaagtaggcatgcaggtatgcgcacatgcgtgcacacagtgtctttaatggttgagctgtgtgttagcatggtgaaggaggcatgcaggtatgcgcacatgcgtgcacacagtgtctttaatggttgggccgtgtgttagcatggtgaaggaggcatgcaggtatgcgcacatgcgtgcacacagtgtctttaatggttggggctgccttgcatttcaggtataatctgtctacactttttatgcatttctgggtttggtttaatatttttgtaactctttttttaaagtaagtgacctgtaattttttcctgtacagtttttgttgggttttaacaccaaggtcatgctattccaaaaatatgagtttgaggagtgtttttctattttttttctgcctctggcttttagcaagatttgtagaacttccagttactcatctgggtcttgagttttctctgtggaatgatttttttaaattatgatttgtttctaaaatgattatcatgtcttctatgcctttatgagtcagttttggtgagttgtgtttttctagtacttgtctttttctttgttacttaaaaagtttagtggcatagagttgttcaaagtcacctcttgtcaatgtggatagttctctcttttagaattctgtaccgtggttttgcctgcctgcctgcccagccccctcccctcccctcccttcccttcccctcccctctcctcccctctcctcccatctcctcccctctcctcccctctcctcccctctcctcccctctcctcccctctcctcccctctcctcccctctcctcccttcccttctgttcccttcccctcctctccttctttcttttctttctctccttcttttttttggagacagagttttgttctttctttccttcctttctttttttcttttttttttggagatggagtgttgctctgtcacccaggctgtagtgcagtggcgtgatctcggctcactgcaacctctgcaacctgggttcaagtgattctcctgcctcagcctcccgagtagctgggactacaggcgcacaccacaacacccagctcatttttgtaattttagtagagatggggtttcaccctgttgcccagggtggtctcgaactcctgagctcaggcaatccacctgccttagcctcccaaagtgctaggattacaggcttcagccaccgtgtccagcctttctttcttgattagtcttactagagcaggcatggggatgatagtgaaaatgttgctttttatgaataaagcacagaagtgtgtgcagtgcacaaacagaaacatcatatacctgcgatgtcaacatttcatgggagggggattagggaaaagattaggggaaagattgggcgataataaaatagaggttgagagtcactgcatgagaggctggttcttttcagggaaccagcttgtggctttgtggatcttctttgttatctgtttgctttcattctgtcagctttggatccttccttccttttactttctctgggtctgtcttcttgtgatggatgcttactcatcctcagctttctttcttctcttacatttgtattaatggctatacttttccctcccagtgcagctttgctttttcccactgggttttatttgtctctctcatttgaagtaggctggagcgagtgtggcctagttcagaaatagaaggctggtttggctgtagctgtgagtgaggaggagagcagtagattaggtaggagagagaggcctagactaaattgtgtctgggcttgcagacctgggtaaggaactaaatacaactcaggtgtgctagagatccgctgtgtggtttcatgcagggggtgttgtgatctgctttatatttaagagactagagtaagggatcgtaggggtaggagtggaagggagaagagtgctcagaggctgctctagtgcaggggcaagacgctggaggcttgccctgggtgtgatggcggtgggaggacaggttctggatttgtgtgcatctgggaagggaacaggatatgactgcccagttcagcaagctcgtttaggatacttttattgggcagctcattaactgttctctgtggcccagtggatctcagtaagctggagctttgtaattttcacttatctctatgattgtttagtgtcctaacagaatgggagatttatttgggtaaagagggcctagaaacatttaagtattcccgtgatgctggccataaatacagaaaatttggtgcagtatgtcttcacattcctacaaatttagtgtagttcagttctcaaaccatgctggtagtatcctgggggtcttcaggacccttttgggggtttgtgaggtcggttgctaggacaggcctgcgtttccctggcgcctggatctgcactgatggcgggcgcaatggcgggcagtgctgtcggagtcttagtggctcccagttgacccagtcgttgcatccatgatagcctcataactggccgcaaaaacacactacttgtgtcaaatctgggcccttctgcacgtgtttttaccccactgagtgcctttgcacagactgcgatctgctggttgctgagggacaggcactagtgggatccgggaggggcctgttggttttccccgtgggatgctgcttttccctgaaagaataagagacaggatgaagtgagcttgtcacttcaaggaaaacaactgatggcaattgttgccagtgataaaaattgagctttcaactgtaaattaaattagaattttaaaaaacctgtgtcttccacggtgaacttgtcaggttaccagcctgttctgaggcctgttctgatgagaccgcggcggccatgctgggtgtgtttgatgctgcagaagagctctgcacagctcggtgagcccatctttccacatgaccagtgcgtgctgttacaacaccatgtgtgggtaaagagccacttcaagcaccagctaggacagagggtctcaatgtaacagagtatgaaaaagctactgaaacagtttccttatccaacaaaccgcttgtggagttttggtgtgtatcaaacaatactgacaattatttcaaaagactacgtatacatgtgcagctccatatgtgatgctggattttcttcctgtgcttcagttgaatcaatgtattacagcagattaaatacaattgcaaaggtgagaatccagtgacttctattcctgagccagacagtaaagagatttgcaacaatgaaaaacattgccactcttttcactaaaattttttgtttgggaaaatagtttcatttttaataaaaatgtcattcatgttaacctgtaacaggctttttattgttaatttgaaatgaattaatacaaatgagaagaccctcatttcaatgtataacatggtaacatttggtagtgataattgggaaggggcgtctttggactcctccgtgattctaaagagtgtgaagggaccttgagactgaaaaatccgagaactaccggtttatagaagtggaagcatttagtgatattgccgttcgttcctttctttccttccttcctttctttttttctttcctctttctttctcttctcttctcttttctcttttcttttctttcattttgagacagagtctcgctctatcacccaggctgcagtgcagtggtgcgatctcggctcaccacaacctctgcctcctgggttcaagccattctcctgcctcagcctcccgagtagctgggattagaggtgcgtgccaccatgcccggctaatttttgtattttgagtagagatggggtttcaccatgttggccaggctggtcttgaattcctgacctcatgatccacccaccttggccgcccaaagtgctgggattacaggcgtgagccaccacgcccggccgtgcagttctttaaacgtaggaaatgacctttgagttttgagttcgataccagcgtttctactattaaaggtggactttctctgtcaatgttcttggaatcttatgctttccacgaagtccttgcacttgtgcagaactgtatccccttagccatgtgaactgcacggagcaacgctgttgcaggatttccttctgcctcactcagaacatatgtgctctgtgtgtgaagaagctcgtcaggctgtgagcacagcacaagaataaagcctttagaactcagcagagagaaccagccattactgaaaatggaatgttttaattaaaaatatccatcaccgggtggctcttcttttcctttatttctcaagtgtggcaaatgttaataacagtggctgcactgtggctccatggtaaattgccagttggtgagtaggatttctcccatgaagcttagagatgaacccctgcaacatctgttcttgtgacaacgaatcccttttttactttggcttatgcatatttcagaggttagagacaggaggctccttctaaaagtgttcagtaactgcctgggctgatgtgtgtgcctgagagtcagagagagagagggagaaagagaatgggggctaaggggaacaagaagggagagagagagagagagggagagagaatgggcactagggagaagagaaagagagagagagacggggaatgggtgggagcatatgaattcattggtaaccctttcactttcttttcttcctgtattaattgatgggttgaccttattaagtgggttgattttggggtttctactgcagtgtaacaatgagcatgcagatggattttctgattgtttacaaggaaatcaacctttacactagctccagcttttttcttaaacatctagttctattagaaaaaaagcaaaagcacagcagatagaagtcttgaagcctgcagtaaaacactgtggctttccattgtgaggacgtgcctgttctttattacacacaggctgcttctgtgatctgctgagttgggcagtgtcatcttagcagacagggtttttccccccccttagatggggtctcgctcattcgcccaggctagagtgcggtggcatgatcatggctcactgcagcctcaacctcctgggctcaggtgatcctcccacctcagccttctgagtagcagggaccacaggtgtgcaccaccaacatctggctagtttttaaaatatttgtagagaccagggctctctgtgttgcccaggctggtctcaaactcctgggctcaagcaatcctccaacttcggcctcccaaagtgttgggattttgggcatgagccatcgtgcccagtggcaggagggtttttatgtacatgtgcttgccctttgtcaggggggtggggtgtggctttggttttgatattttcactggtactgccaggctattttgattcttcttataggagtcttgaccgtcaaccacctgccatgctgtttgggatgcagtgttttgaggatatccctggggactttactaaatggacctatacaagttgataggccttgacaacttttctcttactgtagtttttgttttattaccatttaaaactaaaggctagggagatgagccgtcctagattgaacgtgcttattagcgtggatatgttgtgaagaaatgcacgttggaaaacatggtcctccagaagcaattaacttggcagctattttgtttacattttctatgattaatatttacattttattttaagaaaattggttttttgctgccttgatctcatgctcacattttcctggttgagattggaaccaataagtaaagaaaattgacctatcaacccttttaaatgttagaaacctaagtcagagagaactgtgttaaaagaactgtgtttatctttttggttaaacctgttgtaacactgtgtggttaaattttccctttgtgctctcttcccctaatcgttcaaaggatagtgggcactattaggttcgacttttttttttaaatgtttatcttagtggtgggtcctcttatgggctagtcatttgtgggcataggttggggtgtgcagggtttatggctaattataggatcatatgtagtggttctctgtgatcaggagaaggataccaaggtttctattttacttatttattaggttgtgtaacttttttcttttattcttttatgcttgatgatggtgttggtgtttaggaacccctgtttagaaagcattttggagaaaacctgatgcaattttaattttgatgatgtcaatatctcattagataaggccttgataaaataacacctttttctcttatttcaatggatccaaagagaggctagcttggaagtggagtggtggtgatcaggaagggactcaccaccacgccacagggttgtcacatattttcctcaaagcaaaatgtaatttcctcttaaaagaggatttagatcctggcattttagcagctgtttttaaggcctggagctttggtattcctggctgttttgggaggcagtgctggacagccgattcgttcagcaggtgttgattgtgtgctgacttttgtttggcagtatttggtctgacatgggagggagtttgcaagaagcttacagcatcatttcatatggttggaaccccaagtgtgggactagcacacctaaaacagggacgcacagaaagggaaggcagctgtgattaaaccttgaagctcgtagtaccaagctcaagcctcggcatttggcagtaggagaggtgcagaatggttgggagagcctcgtagaggggatggaacttgagctgggacttgaagaaggctgagagaagggacagggaatgcggagtttagggagggtgttcacagagattttgagaggaaaccgagcatggctttttcatggaactgtgtgagtgtctgcatggcttgggtggggatgactaacttgactcaaattactcatccctgggccagactgcggtagcctggggaccaggtgaaggaatctcaaccttatattgtaaaggcaatggggagcagtgaaagttttaaataggtgaaagataggctttgttttctcttttctttttcttatcctttttgtttgtttttgagacagggtcttaccctgttgcccaggctggagtgcagtgcgatctcggctcactgcaacctctggctcctggctcctcagctacctaggtagctggaactacaggcatgtaccttcacacccagctaattttttgtttattttttgtagagacaaggtctcactatgttgcccaagctggtctcgaactcctgagtttaagccatctgcctgccttggcctcccagagtgttgagattacaggtgtgagatgctgtgcctggccatgttttttttgtttttggttttttttttcctaaagattcatctgactgtatgtggtgtttcacacctgcaatcccagcactttgggaggctgagaccagttgatcccttgagcccagcagttcaagaccagcctgggccacatagtgaaatgccatctctacaaaaaaattaaaaatattagctgggtgtggtggtgcacacctgtagtcccagctacttaggaggctgaggtgggaggatctcttgagtccatcaggctgaggccaccgtgagccgtgatcatgccactgcactctagcctgggcatcggagtgaaaccctgtctcaaaaaaaaagattcgtctgcttgagatgtggggcgtgtggaaggaagtagaccagtggatacggtcacccaaagcatgatgggaattccagatactatatgatgccatttcaacatggaggagtagaaatggtgatgaaggtaaagagaccacagcagagaggcgtctagaaagaaattaatggctctgacaacttatttaatagaagtggtggggtgtggggcagcccaagataacaaatgtaattttcagggcaattcatggatggaggaagaatcaattcagatttctgggttgtactgtttttgatattgtattctaagatggtcattgcttcttattaggagacaaaaaggtttttaaaaatgtgaaggtcatctgcagttttttggggtgagagagtcctcaggaacgttcgcatttgcagatgcccaagagccttgagtccaagttgctgatcttttgcgcagggtggttctgccgcagtctgcgaggcttctggagggcctcgtgagcttgcagctctgtgatcctgctgacaaactggtttctttccacatgtggaatctgtgttttccctgcatggagcagtgaatggggatgtgaaaggcaccggacatgaagctgataccgtcacagtagaatccagaagagctgctcagtaaaacagcttatacattaactgttcagacgctagaaaaggcttgtattgcttattgaccttaaactttcttgattctttctatctatctatctatctatctatctatctatctatctatctatctttttgagactgggtcttgctctgttgcccaggctgaaatgcagtgttgtgatcactgcagcctcaacctcctgagctcatgcagtcctcccaccccagccccccgggaagctggcagatggtgttgtcctcacatggccacaggcaagctcttcttataatgtgaccttgacacttctgccattgtgagtagggtccctgttccctcccgttgaatctgggctgactcgggactgtagaccaggttataaaaggctctcccctggatctgctggggcgtgtgctgtgaggaaaccccgcagccatgcggtgaggccctgtgaaggtgagccaccatgcagtgattccagcccccagaagacactcacccccagacttaagtcttcccagctgaggccccctgagacctgtggcgccctttcctaattcttgaccatgggacctgtgagcataatgaaatgattgttttgtgctgctaagtaaagggaggtttgttaagcagcagtggataacttgaacatgttttggaagctggagccaggtgtggccataatcaaatcccaatgcctgcagctctggctttgggatggggtgttgggcagaagcctccgggcctccaggagagtgctgctggctgcctgaagggcctcctagaaggtaatagggtctagtattttagcctgtgggtggcacatgatgactgtccctgctactctgccaatgtgagaaggcactgcagacggtgtccaccacatgggtgccctggatttggtcctcagcaggctgggcttggcctactggctgccttttgcctaccccggaaggaaaggagggaacgtgtcattgcacgctggaggaaaggggccccttgttaggtggtggtgggaagcctggtgtcattgttgctgtgggaaagaggaaagtatgtgtgtatttaatgaacttgctcatctagtttaggagatttccaggcagaaaattcaaagtgccacctggcttctccttggtgtaaaggaagaggacttcctgggttcaaaaataagactgtttctcattcccagcctcttctccaggctcctcaagtgaagaaagggcttccggcaaaatgcatctggactgggctgtgagctccgttcctaaggcttcagattgagatccaagtgcagtgtctggcctttcagctggaggagaggcctgcagattcttgcattaaatcccgtctggcctctaagagtccaaagggcgttgtcatgccacagcctcttctgggagcccaggaggtaaagggcttgtctctttatgggtgtggcttgtctaatggaggagattatgagttaatacacaaaaaggccaccaagtgtttttaaagaaattatgtgtctgcctggactgaaaggagcagaggcaatacaaaatgaaaataagtctttgggcccccagacttctgtgaggaggaagcaggctgtgaaaatcacccagctgtaaatgtggggtacttttcatggaaaatgaagtatatctgagaaggcggagctgagatcccagaaaacaagccccaggtaccaggacagagccctgatggaggtgctggcgctgtgtgcctgcctcgagtggctgtcctgggtgggacattgtgtgtggggtgtgggtgtgtctgggtcagctctttagacctggattgggaagaacggggatggaagaggggtggacttgaggaactgcatgttcctgcacacaggcttctcagctgggcagggtttaggtgacgagaccccagacttcaagctgatagcagtaatcggacaggccttgggggccctggggaggtgtcaggttcattttgcatgtgggaggatgtgacgtgtggtggccagaggatggacagtggcagatcgtattttccagagatgaccgcagcagcatctcccgccgcacgtgccctctctgcagtgtaactgtgaaacgcctcccaagatgaccgcagcagcgtctcccgccgcacgtgccctctctgcagtgtaactgtgaaacgcctcccattgagaggcgaagttgctgttctttcccttggatctggatgggctgtgactggatgggaaatggcgctcttggctggtgtgctgaggacgacataccgttcacctggttctctcagaacccaagaccagccccatcggagaggctgccagaggaggccatgggaggaggtggtttctcattaacagcgaccaccactgtcagccgccagatgtgtgagtggtgaagcttctggtggtgccagtgccagccactgagccatcaccggcctttgcatcttgcctgctgaggacccggacattgtggagcagagacagggtgtcccctcccttcccttcctgaattcctgcccctgcaggaaggagaaaatgattgctggccatcactgagggttggggacctggctgtgcagccgcagcgccggcgggccgctctcccacatctcaggggcacgcaggttccgtgccagggatggctggtcaggccccgcagatgggcagaacttctcatcccacacatcccagccttctttaaacttccctggcagattattttatggttttgctgctgttggtgaagatggttcagtctttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccggacagaggggctcctcacttcccagtaggggcggccgggcagaggcgcccctcacctcctgggcagggcggctggccgggcggggggctgacccccccacctccctcccggacggggcggctggccggtcggggggctgaccccccacctccctcccggacggggcggctggccaggcagaggggctcctcacttcccagtaggggcggccgggcagaggcgcccctcacctcccggacggggcggctggctgggcaggggggctgacccccccacctccctcccggacggggcggctggccgggcggggggctgacccccccacctccctcgcggacggggcggctggccgggcagaggggctggttcagttttcttttctttttttttggtgggggggagttttataactttatttgatgtatttgatgatcagcgattagttctcatccacattgactgtctgtagatttttgaacatggtaacaggtacataggtaaccaaagtatagaacttatttggtgaatcttcatcctcattacattttctggataaccacgcacggatgcggtaggggacattccttattcctttggcccagacagctttgttgagcctggtgtcaatgcacacatctggagttgccatctccttcatgtcaaatttccgaatctctctgagtgcccaaggggcacgcttcatgaagcccactccgtggacgcgctggtgaatgttgatggtgtcttctcgggtcaccacctcgctgattgcagaatggccgtttttcttctcgccatccttttctgcgggagccattctgccgggtccaagttggaaaggaaaaggacagttgagttttcttgggttgtccattggatgatcatcccagatgggttctttgtacttctcgtgttcacatggtttagggatgtttttctgatgagtggtggaaagtaggaactattcatggtggctggatttggcgcctgtctccctcatcatgctgtttatttttgtcatgaaaaacatctttatcaataagattaatctcacttttacccagacaatgtaacctgtagacttcgttgagtaaaattggaaataattttaaatctaatttatcttgttgtcaaaccaagagaaacctatcaagaaaccgctaaagcagtgagagctcagaatgaggaggtcgtggcataaaaggtgatttttctgggagcttcacatctaggcgatggtctaatttgtactaagtgcgaacacgcattgaattcagggaactgggaaagcacgcgtgtttgaccctgcgcgctttgcaagaagctcgtgggggttggtgcatcctttgaagggttaagggaacgaggggtgaaaagttgattattgtttggttgtgcaaatgtggtgctgggtggagtccccaagaccacttcctgcttccaggatttactgggagtactcacaggactcaggatctaatactcatgggcatgatttattacagtagaaagataacgaagcaaaaccagctaggcgaaagggtgcatggggtgaggtctgaagggaaccaggcacaagtttctgaaagccccgcccccatggaggctcacaggaggggctaatttcccccagaacaaggtagaccaatacaaggtagtgaaatgttgccagccaaagaagcgcatccgagacttagcccccagggtttttactggaggctggtgacaggtagcctttgccaaaatcccagccttctggcaggaaagcaggcattcagcataaaccatattgttggaaaacagttgaggcacagcgaaccccacttactagttagggtggtgggaatcctccagaaatccaagtccgcagaccccagccacgggccacccctgtaagcagggctttgaaaggagggctgctggggcctgctttcttaaccctcttctgcacagataccaacttatcctttcctttctgattaatgtctctcaaacacagacgggggaataaaaacctgaaaacaagcgaatattgacatgtacatcaccactttcaatcagctattttcaaccaagtgctgaagtataatacagttgtagtcacaaaggggaagtagcaggtatgttgcaagaaaaaacttattagaattgtatgttaacttggatagaaacagaacttttctgagcttatgtgctgtgcagatacagaatgctggcagagttacttctgtgagaacatcattgaattacaattaaatattaagtacctataaaatatctttgcattacaaaagtggttaaagtaactttctcagtcttcataaatgtagatagtatctttggacaaaataatgagttagtcttttgatggaacaggagaagcaggagaaaattgttccaggagcagggttgctgacgatgctgtccctgttggtccagaaggtaaaatcctcctgtattagtctgttctcacgccgctaataaagacataccagagacagggtaatttataaaggaaagaggtttaatggaatcacagttcctcatggctggggaggcctcacaatcatggcagaaggtgaatgaggagcaaagtcgcgtctcacatggtggcaggcaagagagcttgtgtaggggaactcccctttataaaaacatcagatcttgtgagacttattcaccatcatgagaacagcacaggaaagatccatccgcgcgattcaattacctcccaccaggcccctcccacgacacgtggaaattatgggagctacaattcaagatgagaacacagagccaagtcatatctttttttttttccccttttttttttgagagggtgggtcttattatgttgcccagctggtctttagctcctgggctcatgtgatcctcttgcctcgtcctcccaaagtgctgggattataggtgggagccaccacacctggctgattttctcttatgggttggagtaaggtatggccaagacggttaagacgatccatgtcctgtgggatggcccatgtttcaccagcactcagatgccctggggctcggggcttatgggcagttttgctaattctcaaagttaagttttcagctgggtgaagaaggaagaaaggctgtttcgttgaactcagtgttgaggagagcagtgactgacagcagtggatgtgctctcatcctcctgcttttactgggagaggggctttgtgatggcaggtgtataacctctcaggttttatttcttttacattaagaaaaaagaaggtggggaggtggtgggtgacagagcaggtgatacgtgagagtcagtgaaaatgcactgctgggagctagagagcctgcgcagggtttttccgttactgtgtccgtgatgagttgaggaaaccgtgtctcagttctggaccatggccgagaggaagtgcatagtcttaagtctcttatctagtgatcatcaacacaaatggggcataccggctgcaaaacagagttgggtaccagtgaggcctagaccacctgggcgtttctcttccagagctacagttcctaggtgtaaaatagagctggtgatatacaccttgccaggttatttgaaaatgcaaagcacccagcacagtgcctgacacatgggaggcagtcacagacccatctgtgctcagttgctcatgacgaatgcccgttatgtctcaggcacggactagctgtgcagtaagagggagctctgagtcagacggagggtggatttgctctttgggcactggtgtagctctggatctgattgtccttcattatctaggttttggaaatgtgagtcattatgtaaagcttgaggtgttggtaggtgctaggtgaatcaagtgtggtggtggtgttttctatgcgtgtctcttaccaatagacttttgtttttgttttttgagatggcgtctcgctctgtcgcccaggctggagtgcagtggtgcgatctgggctcactgcaagttccgcctcccgggttcacgccgttctcctgcctcagcctcccaagtagctgggactacaggaacccaccaccatgtccggctaatttttgtattttcagtagagacggggtttcaccatgttagccagggtggtctcgatctgctgacctcgtgatccacccgcctcggcctcccaaagtgctgggattacaggcatgagccacggtgcctggcctttttttttttttttttttgagacagggctttctgagactccaggagtggtctatcatgccctgctaatttttttattttttgtttcttttagagatgagtgttatgttgcccaggctggtctggaactcctggtaccagtaaactttttaggaggtttccgttagcttttgaaaattttttacctgatctttaaaaatgaatgcagttgtgtagcaatttttaaagtgattgacagttttttcccaccctaccttttcttgattgaagcagttgattaaggattttgggagtggtcctattgtttcttgtatttttctgatttttgttttagtgatgacactgtgggaaatcatttgtcaggggcaaatttcaatcttctgtctgaatggatctgtctacttatctgtccatttatttgttcactactgtttacctgtctgtccaaccacctacctacccttccgtctggccatccatccatccatccatccatccattaaagttctttttgggggtgtgagtatccgtttaattgcactgcatatctacctacaagtcatacctcttagcaatcagcaggcaatgaatcgggccattccctggttgaaattcaacttgagatttctagagggagctactcaggttaaggatgcattatctaacaagaaaaatgaatctacagtaggtcgtattacagatgcagcacatgaaggcgcccacacattacttcttagcagctgagtgtgaggtgcatgcatgtgaggctcagaccccacggtcttagggcatccttcaacttttttttttgaagaggagtctcactctgtctcccagactggtcttgaacgccccccttgcctcaagtgatcttcctgtgtcagcctcctaaagtgctgggattataggcgtgagccaccgcgcccagctttcttcaacctgaaaactatttaaacattttattactctgtagctgttggcagtaccagattttatttacaactgaaggtagttttggatctaaaaccacagttttggtaatgttcaaaaaatggatcatttagtggttttaatgtcatgtatcaatcgttttcagagtatcttttatattgctcttctgtatatgttagcttactagttgattagtgtttctgtaacctgtcctgctttctaatctagccactaagtggttggatcaggatttatactcagctatgcctcctttaaaactgatgttttgtccctcatctccctaaagtttttaatggcatatatgtgtatatatgccatttatatatatatatatatataattatttttaagttcattttgcttttatatctccccgattttttgacattgtttgtttagagaaatttggccacagtttttagcactgggtgctgcaggatgagggctggacctgctgcttggagctgcagtcctcatcaggtacctgctcgttgtaccacctgcaccaccacccacatgctccccaattttttaaagttaattaaaccccgtactgaaggtaaaaatatgtatacataatttttattataatgctacttaaacatataaaacccaaggctaggcataaattccttatggttagaggaattttgtgcagctgtaaatcccaaacatacaaattcagtccaactacaaaggcagtaaatgaacacaattaatttaatgtgacaaaaggatgtagttttgctgacggtgtattgctaatgttgggtttcatgatacagtgtatttgtatttaagatttttgcttgctgtcacttaattcttttgattttgagagtgatagactctctcatttttcagtttactgagcagggttcccccactcctgccacctgcccctgcccgacggcgcagcacagtgacagcgacttttcttgtgtccatctcccactttgttcaaatggcagcaaataggaatttatgatctcatttccctcctttccttaggagaaaagtaatattctatatgcattattctgcaattttcttttttcatataacagaatattctcgaggtcttccctatgagtgcatggaaaactttgtgggccatcattggagttgccgtctttacagccgttgttttttctaacaatgtatactctaatctcattagaggtttgtcaccgataatccagattacgtcttctttggccctcaaacaaccctctgaagtaggtggcggtgggggtatcaggaagagaagaaactgagattcagagaggttaacggacgtgactgaggcgacagatggaagtgtgtggggacgtggcccaccctaggtctgtgtgcctagacaaaggctgggtgcattgctgccttctcagggccactgccgcctgctgagtccagcatgttcggggcactttccccccttcttggtgatggtgcgctgaggcccacccgcagtagctgaccgtgttggtcttgaccgtgttggtcttcagagtcctttggtgtttattgagtgcccttgggcagatgcgggaacaggtgcttctgcgcgtggttcagatggaaccgctatagtctgcagataactgagcacgaagctgagggtggtcagacgcctattagtcgcaaaatttgctgacccaatgtgagagtcgggaatgaacaatgccttttactgacctaggaggtgttacaatgacaagaagaagtcagagtgggcaggaggcactaggccaggagaggagagagttgggaggaggaagtggccatgctgcaggtgccctaacagatccagggaagcatggagagcacagcgcgacccgtgtggagagggcatcactagcctgcctcgggctgcagggggcggggagcacatgcggcgtgcagacctttccttaggtttgtgctgggtgctctgctctcaggcccacagaattctgcactgtgagcagcgcaggtcggaagaggcatttggaaatgacacgctctgtccaggaactgcagtaaacgttctagctgttaatattcttccttctggcagatggtgggtttcacactgagttaagtagcttcacgactgctagtggctggaagcttccagattagtagtttaagccagaaaacaatgttgatacgtcttgagatgtgtataaatcatttgatttggctgggcagggtggctcacacctgtaatcccagcattttgggaggctgaggtgggcagattatttgaagtcatagttcgagaccagcctggccaacatggtgaaaccccatctctactaaaaatagaaaaattagccgggcatgatggcgcacgcctgtaattccggctactcaggaggctgaggcatgagaatcgcttgaacccaggaggtggaggttgcagtgagctgagattgcactgctgcactccagcctgggcgacagagcgagattctgtctcaaaaaaaaaaaaaagtttaaggtgttggttgtgtgtgtgtgtgtgtgtgtgtgtgtgtgtgtgttaagagagccattgtaggctacatgcatgtggtaatagactttaaagggtaaatggaaaatggtagcttacaactgacatttagccaattgaaaagtgtaggccagggtgtagatagcacattcccctgcagtgcctgctgggtcctggaacgaggccttccagcaagtcggttctcacgtcaagggcatgtcctgagggttatggggccttggccatcagggagagaataaggttttctcattttcgacttcaactaatggtcatagagttgcttttcttttcatttattggtttactgtcctttcctcatcctcctctatctctgcgtcctcctttatctccagctcttctcctcctcctctttctcttcctccttctccttctccttccctccttgcatttgttcatctttaccacattcattatacacccagcaaaatgtgaaacctttcatttcctgttcctggtacatgcagcaaaagcttgattatacaacattatgatgatatagacagaaaacacgtctgaattgtgttcatggaatatgtagcattcccatggttgtcaattactgtagctcattacggtgagcaagtatgtcttgttagtaagaaggttcagggagttgagatgacggggctgagatgctgcctgctgtctccatggtatgggcaggtaatggtgcagggggcgtttatgaactggtgtggaggtgcctaatagggaccctgtgcttgaggaaagggcagaaggctgatggcctcgtggctgtactcccgggtgcttcttgctgggcggctctcactgagtgggagtgaatgggaagggaaacttcctgatgtgatccttcagctgaacctagggatgatctccacgacagtagaccctgaggagcaccccgtgccacccaccaggagaagcccagaggaagtgataccctccctgacttgttagagtgcttctcttgaaggaaagaaaacccagaaagttctttttgacttctgtcgtactgaaggtatcatcatcttagacaccaatttagcatgaagggaagataatgtgtcagacacttgaatattgttgcacgtctgcttttccaactgaattttcgagtgcagatatatgtgcagtctgtttaatataatgggttttcgatcttgtcctttcttggaaagtaaaatgctttttattacctggaaactaatttcaagcaatagattgcatttttcctgggagtcttgtggtcagttttgtttttccaatgcagattgcctccaaatctttattttgaaaacttttcacacaattggaagacctgaaagaatggtaccatgaacacctcacactcaccactttgacacaaggcttgtttgcattttgtcgtatttgctctttctgtcacacttttgtttgtttttgaatcatttgaaagtaagtagcacatgttattattattattattattatttgagatggagtcgcactttgttgcccacgctagagtgccgtgatgcgatctttgctcaccgaaacctctgcttcctgagttcaagtgattctcctgcctcagcctcctgagtagctgggattataggcacgcaccaccacacccaactaattttttatttgtacttctagtagagagggggtttcaccatgttggccaggctggtcttgaactcctgacctaaagtgatttgcccaactcggcttcccaaagtgttggggttacaggcgtgagcaggagtgagccaccatgcctggctagtgattttcttcctgaatactcctgcacacatctcataagaattcaaacatcattcacccgtctaaccataataccaatatcactcctaagaaaattgaccatacttccacaatattatctaaatagttcgtctatattgaaatttcttcagctgtttcaataacatcttttatagctgtttttttttttttaaaaaaaacaaaatctactcattatgtttgtttctttagtcttttctaaatgcagaggtttttccccccctgtaaatgacacagacttcttgtggaagggtcctgctgcttgtgttggagaatgtcccacttaggttttgctgagtgtttcctcatggcatcatttcacttgtcttttcattccctgcatttcctgcaaactggaagttcaatctagaggtttgattgtatccacattaagtctttttggcaagaacgcttcataagtgttgttgatgacttcacattgcattacaccaggaagtgatcagtctttaacttagaagatttgctctcactctaaaataggatagttttaaaaataggcatcttttttaagggaagtgttctcactctttcacccaggctagagtacaatggtatcatcatagctcactgtaacctctaactcttgggctcgagtgatcttcacaccttaccctcccacgtagctgggactacaggtgtgcaccactatgcctggctaattaaaaaatttttttgtagagacagggtcttgctgtgttgcccaggctggtcttgaacttttgagctcaacagatcctcccacctagacctcccaaagtgctaggattgcaggtgtgagccactgttgggcctaatatatgaatcttaatgtttactctgtcttcacacataactgattgtctagttattaaattctgtgttgtaaatctgacttgcttagcttccagtgtcgaattatctgaagccattctgattttcagcctttgctttgtggctcatttgttctctgaagcctgtgtcttatgtacaaagaaaggtgtaaatactcttcttcgacttttaattgaaactgatttggaaatcatttgtcacaacctgggcaacatagcgagatcttgtctctacaaaaaatacaaaaaaactagcttggtgtggtggcacccacttgtggtcctagctacttgggaggctgaggtgggggcatcacctgagcccaggaggttgaggctgcagtgaaccgtgatcacgccactgcactccagcctgggaggcagaatgagactttgtctcaaaaacaaacaaacaaaacttttgtcaaagatgtaaggccataatgtggatggaaattttaaggggaaagtaaaatatataagcgtgtatgtatagttataaaaagaacctaaagcatctcaaagtccatagtccgtcagcatcagcgtctgtccacagagccagggtccccccttggatgcatctcctgtaagatgaaggcccccctgccctggtgtgatgtgtggccttcagtgatcatcatcatcctgtccgagagtcctgctggctctgcttggagaacctggccactttcctgcctctgctcctggcagcctccgtggcccgtcacttcttgtttgcctgtgaattctctctccagactcgagtgacactttgccttgcaaagctttccccagtgctgtcagacagggttagttctaagtctttcctgggagatctgtggcactctgggcatttctggaaggaaacttatgtgtgtctcttgtccctggaagggacagggcacatcttgttcatcagggcaccgcagccccaggacctgactctgatgccacaagcatttaatgaagacgttcaaagtgaacattcagaatctctgtctcttcatacttcttttcttgtgcttatatttagtatgtagtaacattcatatatggacactttcaagaactaacaggacacaggtgctgtctatggttgaatgacgctgtgttggactcgggctgggctgtgtgttgtgtggacacaggtgctctctatggttgaatgaagtggtgttggactcgggctgggccgcgtgttgtgtggacacaggtgctctctgttgttgaatgaagtggtgttggactcgggctgggccgcgtgttgtgtggacacaggtgctctctatggttgaatgaagtggtgttggactcgggctgggccacgtgttgtgtggacacaggtgctctctgttgttgaatgaagcggtgttgagactcgggctgggccgcgtgttctggataagtggctgtggagcacgatgaagcgtctatcgcagcatcatctctgcacccagatgtggccgtgctgagtggattcctgccccagatcttgggaagaaggttggctttcctcctggtgttggtggaaggcctccccggcgacactgctgcactccactggggcctttcattgtcctgtcccttcctgacaaggaaatggctggacactctcttcatgtcagcacccctaggtgctgggggctcaaagataagccaggcctggaagacccacccagagccaggggagcccacccccaatacacatactcaccaagccacatgctgcggttgggggtcccagaggtgtgctcaggccagcctgtggggacagcaaagtggcctccccgagaagggggcctgtcctcagtgtttcagaggcctcaccttgtctcatgcttgaaatatttcctgaagaatgccatttttgaaatttattttctaaagaaaaaaaatccaaatattgaaaggctctgcttgaatttttgtcaacaattactatatcaagaaaatatttctgatttaggtggctccttcagaatatctgattcctgtgttggcttctgcgttgcctttgcaggcctgtgtctgtaggtgaggttttcctgttcagatggagctctgtggtggtaaatgtggccttccttgttttatgttacgtgtttctctcaacttcatgagatcagaccagatagagaatgttaaagaaaaaatatttcgggcaattagaattgcaagaatgtcaagaagaaatatgtgtagtgaatagcaggctgtagaaaccatctcactgctcagatcttaaaatctgtagccaagagaggctttgaagcacccagggaagatgcatgtgccactctgcattttgtaaaattctgaaccatggactttattgtagtgctcgctttgccgacagctgctttagtcgtcgataatccccaaggatacttgcgtgtgctgttgccttcgtcaccaggacttggaggaaactgcagtgttgctatttgttatttcacgttgatatttccttccacctttggccttgtcctgcggtaattcctcatttaggattcctttgaatagttgggtcatggggagagttctgacgttattttactaaggtgaggtttgctaagccatcattcttacgtagatggcagaaaaagccattcggagaaaatatctgagtctgttcccgccaggttaaatagaaaggggatttgccaaggatctccagaagacccgagagccggtccctgacgttatggtaggcttcaagggggcttctgtagctgctgagcaactgagacagtggaggagtcctagaagacctgccaccgcctcctgaagagccaggtgcctctgccacacagctcacagggtgctcacctccctgtggaacgggggcctcgagtctcagggtctagaattggatcttgtaggtgcatctgatcataggaacccaggtcacatgctggccccttagctgcaggagtcaggacacagtctttttttccccaccttagtaagctatgaaccgtagcataagaaattgtcaaatatatggaaggtgttaagaagattatggggaactacagatggcagatgtctgccgtggttccccatggggcatcttaatggacggcttattactaggttttcagctgtgcaagacctttgattcacccatgcctttcatctctgatacccacttagcagcacatgctgttacctattctctttgaaattgagatttctttcttccttgtcccattccactcttgccacacctagctcaggccttcttattccaccgtgacagcttcctggctaatttcccttcctccattctttttcttcccaagtaaatgttagcccttgtcattaatgttagacgtcatcttcctgaaaatatccatttagccaggtttatgccgtggcagctgcagtggggcccggaggcctttcttccaggcctctgttattggaatccacctcccgcgtctatttggagctatggggcctttggaacggcttcatgagatgcgttggcccaagcagaaggctggtacagaagcagaacaaagctctgagcattctgagagttttctgttgagaaatgccatgggcttatgtcttcagcctgcctgggagccctgcatatttttacttgccttggggttgatttgatgaagcctgtaccatgggtaacatattgctggataatgaagagtggaaggaaaattagccctgaatgaatgactcagtcccatgataatgtggctaattttaatttgcatcaggaatagtaaagctgtggcccagtgtgttatcaaataaatctctaaacagccttgaaatcaatccatttattgaaaattgaaaatctttttttttttttttttttttgagacggagtctcactctgttgcccaggctggagtgcagtggcacgatctcagcccactgcaacctctgcctcccaggttcaagcaattctgcctcagtctcccgagtagctgggattatgggtgcacaccaccacgcctggctaatttttgtgtttttagtagagatggggtttcaccatattcgccaggctggtctcgaactcctgacctcgtgatctgcctgcttcggcctcccgacgtgcagggattataggcatgagccaccgcacccggcctgaaagttgaaaatcttgttccatgaaataaattttagaaaattagccagacatggtggcgcatgcctgtagtctgagctactcgggaggttgagatgggaggatccgtttgagccctattgaagcaataggcttcactttgtatcttgaactgggaaggagtggagaaaaaaaaaatattagagccctttgctatacttactttacgaagaccaattatttgttggtttttaaggaccagagttcccaggagtaagtgaaacacgactcgatctcttaagtgtgcccaatactgccagcacaacattcctcacaccggtccagcttgctagttaccttggatactcgcccaagcttcagctgactgcgcaggttattttctatatcttcagggtataaaaacagttgtatagacatacatgcacaaccatgaaaaaaatttttgactattgtggtaaagtcatttttatccccacttctgcccccccatgcttatagaaataacatgtttatggtagatggaaagtgcatacacagaagggccaggtacaaagaagaaaagaagaatcatccacgttcctctgaagaggtcagaatcactcatgacatcttgtgttttcatttggtacgaccttatatttggaatcacagttgtgggtacagttttgtaccctcctcttttcagttatgtttgagcatgtcctgtgccatttaatattctttgagaacatattttttaaacagctctactgagatacaattcacataccccagagttcacccatttaccaacagagttcaccaacagttgcaatctgaaagtatgtttttgtaaaggacatatactattttatcatgtaacactgtttaatatacgccatttaattatgcccttcaacgtggaattttaggcttccataggatacagtttatcgtatttagattttatgctgttgaatgacttggaattaatttgtaagtgtagagaaaaatgaatcctagggctcagagcactgcagcagatcacgtatttttgctctgtgacaaagtatttttattttcactttttctttttttgttaatttcaccccataaggtgtttcgggtagaggcaaatcccacaagtatccttggggattatcgacgactaaagaacagcaaagaaatggttcctagctcctcacgcagtccttggtgggcggtgggctgactggctgcgcacgctaggcctcaaggtagaagcggttcatttagagacccccaggcatagtcgcatggcttcacacacccgcaccagggctgaccatttgtttttggaggaaccacaaaaggattcagtatggaattccttaagaagggagtttctttagtttgcttaaaatagttacaactttttttttttaagacggggtcttgctctgtcacccagggtggagtgcagtggtgtgatctcggctcactgtaacctccgcctcccgggttcaagcagttctcccacctcagcctcccgagtagctgggaccataagtgcgtgccaccacagccggctaatttatttatttttatattttgtagagacagggtttcaccacgttggccagagtgatctcaaactcctgacctcaggtgatccgccaggcttggcctcccaaagtgctgggatgacaggcgtgagccaccatgcctggccaaaacagttgcagtttctataataaactttttttcccccagaataaaactagcacctttaaagtgagctataacgattccttttatgaaacttattttgtatgcagttcttattttgactttcagaaatctaaatttctcaagggtctgtgatgttggaactaaactcataccaagtcccttgtgcagtttgcgtggtgcaggaaggggtgagccaagtgaggactgtagcactcacgtgtgcgaaggtcgccgtgggcgaggcctcctcatccctgaggccgaaattttcctcttctcgtttccttttgatcaggatgttctacaggggtggaggcagattttaaaagcagtgatacatagacagaatttggcctaaaaaaagagtagtacttaaatctaaatgaggcctctggctcaaggtaacgagctgagctcatagattcaagcacctctcccctcattcccaattcccattgaaatgaacaaaggaatataaaaatagagagtctcccaagctaacacagttgctgctggtgatgatgatcttgttttggactgcaggttttggttgcagaaattcagttggatgtgcttcctgcgggtttggtgctcactttgtagcagtgcttggggatggaagtgaggggcaaactggcttttccttctcttggacaacttggttacccgcctccccttccctgcgaggtatatctactctctttgctatgtgttctagtttctgactctctttataaattatgcatttgtgtagcttcggctttgctccgagtttctgcttgatgctgtgaatcctaatgagcgctcccgggaattgggtggctctgccttcagacaaaccaggggatagtgaatgttgtgacctgtgtggccagccccagtcttgctttgtgtttattttccacaactctcagttgttgatgttgggaggataagtgtgagccacactctcagtgtgggggacagaaggcagtgattgggctgctgaacatgtttaatttcttcattctgcatggtgacttaggtgtcactgcacgtcagcctgtgaatttatacccaagcttgtttgtgccacctgatcacctgtatctttttaaatatatatgattttatccaatcagttatgaaggaagactctagtaaggaaatcccttgtgatttgctttgaattctttgggaggtgacaggcgttaataggtttttcacctgtgaggtgacatgctctgagcttacaggccttcgagtggaggtgatctggtctgcaggccctgtgtgcaattctgaaacccagaagctctgaacgctggattatttccacagctcatttggtggcaacgcttggcctgagctggggtgagactggacactcttgattgattccatggagagtggaaatgttaacgtggtgagtgttgggtgctgctccaaaccctcctgggtgtgttaaccctcctgggtgtgttatgtgagatggggcagagggatcacattatcctttcaccaagctgaacactgtggaatttcaaaaccaagctggcaccaaaggagcatcaagaacactgcccaggctgttataataacatcaggaccccactgcttgacggcccccagcctctcccacctggaatccaaagtgccgtggagatctttgagccggggcacaggatccttaggcgtgtgctccagcctttagtgggtgcctccaggatggctgggaagaccagtcatgagtcagaacttcagaatctgaaaaatccttagcacctgagaggtcatctgtctccaccccctcactttaaggatgaggaaactgttcaggagggattgaaatttaccgtcatgtccaaggccatgcattgttagtgagcatttatagttttatagtttctcaaaatgatactcttttcaaattcaaaattaacctatggggatataacgatgtcatcttaaattacattgcattggaggaaaatgtcttaaagtcaaaaaacttatgtaatattatgcagtttttggcacattaaatttgatagcccttacattttaaacattctgtaactgttattaaaaaacattaatcaagagtttttgaaacgaggttgccatagaaatgaaaatacaatgccaaaaagacattttaggtatagctaagaatttaaaaacttactaaatttgaggccaggtgtggtggctcacacctataatcccagcactttgggaggcggatgctgccagatcacccgaggtcaggagttcaagaccagcctggccaacatggcgaaaccccatctctactaaaaatacaaaaagttagctgggcatgctggtaggcgcctgtaatcccagctacttgggaggctgaggcaggagaatcgctagaacccaggaggtggaggttgcggtgagccgagatcgtgccactgcacgtgatcgtggtcaacagagcaagagtctgtttcaaaaaacaaaacaaaaaacttaccaaatttgaaattaggctcacagtgttaaaatctgcagaggagcaagacgtattttttttggcttaaggatatgtgatagtactgtcttttgcccagttttggagttaaattggtagctagatattagagctaacacgttgttctagttcatgtgtgagtgtattcgcgaggtgcttttcttgttttctttaaaagtataatgcaggatgtagggttaggtgtgtattgtataaacaagatgaatgaaattaatttatttcttgtcttcattcttgtctttgtatagtgtagctactttcacacattccagctgagggccatgccttcctattgctggcctgtaaagaagtcagaaatggtctctctaggtagcatttggtgagtcaggaagaccacacttgctgacaggcacagtgaggtgaggcccctagccatcccatgggactaaaggatgattcttgggcttctattaatacttttgtgtaagggactcagagatcttcagagatacttttataattaactagagctactcatttgactgagaatgttaaattttaaaaatttaattagctgcatttgtagaggtggagggaatatgacttgtctaaaatgacagccgaggtagcagaaataggaatcagtcagaggtgttgggaatgccgtatcaccgccctgtgtcggcctctgccgcctccccagccccgagacgcagaggaggaagcagacccagcagccgcagagcctcttcacccagcgagcttgccctagtcctggctgccccacttgctcgctccctggacttgcagccgccccttactccctggattcctcgctgggaggggaacgccaccacctagttcatgtccctgtggtgaaggatgaagtggactgtgcgtctacactgcacggctcagggaataagcactagcacagggagtcaccattgatccgaagtgctgggactgagtcccaaacctggctgtgaatttcccgggggcaagaaagaacagggttgtgtgggaagttactgagcatacatcagcccagaaaaacagctctgcccaccttttcctggggcgcacggagcatgtggataaacggggagaaagcactgccagacaagccccagggcagcggcggtggcacttggccacgggagcagcaggtgggtgtctcagattcggcccgttaatgctgtttcttccacgggcttttgctagaggagcctaacatcagtttaaggcctattctctttgcagattagggacaagataagaagccagtggggaaccagttaagctgtggggaagcacaaggtctattagaaggcttcccttcccacagagggaccctgcagatgactgtaggcaaagccagcctcttcctttaggaagcaacttggaacttgcgccagggtttgaatcaatccctctccatattacagggcatgaaaggaacacccttgatttaaaagtgttgtgaggcaggtgttaacagctgttcaccatggccacaggaagaccacagaaacgtttccaggaaatgtctagttttaagcagtttatcctcaaaggctgagtttgctatacaataattgggatttgggattatggatactgatcacttaaatattggaggatgactaattaaatacagtgacttttgttgttctgatttttagtgctttctcctgataatagatgaaggggccatttgtctcttacgcttcataatggaggcttctgttacatgtctgtgggaagacattcttctcctagtatatccacggaggcagagatgcagttcctttagaaagtgatattattggctgggtgcagtggcgcatgcctgtaatcccagcactttgggaggccctgggctggtggatcgcttgaactcaggagttggagaccatcctgggcaacatgacaaacctcatctctaccaaaaatacaaataaaattagctgggtgtggtggcacaccctgtggtcccagctactctggaggctgaggtgggaggatcgcttgagcccaggaggtggaggttgcagtgagccaagattatgtcgctgcactccggcatgggtgacagagtgagaccccacctcaaaaatgaaacaaaacaaaaaaagaaagtgatataattaataaatttttttaactgttaagagaggaggcactaaaatgcttcctttttcctatacaactttaaattctgttttgaatagagaatcttatctcgatgtgataaagattgtacttaaaatcagtcgccagcatcattctgaacaatgaaacatttatgtctcatgaaaatcaactgcaaagatctccactgtcatcattttgttattattagtgttattttagaagttctggtcaatacgctaagatctaaaaccgaaacaggaggaatgatctattggaaagaatgagacagacttattattcttagataatatagctgtatactttcaaaacctgaaaagaatcaccaaaaagcaattacatttaactaagaatttagtaaaggaactaaccatttttcttatatatcagcaattatcaataagaaactgttatggggaaatacatatatttccctgaaacactcatgaaatatctggaaatcttaaaattaaaaattaaaaatacttttattggtgataattttttacattcatataatcaaatcagagtaattgagatacctatcaccttaaatatttatcgttttcttttttctttttattttttttgagatggagtcttgctctattgcccaggttggagtgcagtggtaccgtctcggctcactgcaaactctgcctcccaggttcaagtgattctcctgtctcagcctccggagtagctaggattacaggtgcacaccaccacgcctggctaatttttatatttttagtagagacgaggtttcaccatgttggccaggctgatcttgaactcctgatgtcaggtgatctgcccgccttggcctcccaaagtgctgggattacaggggtgagccaccgtgcccagcctatcttttctttatgctaggaacattcgaattattttctttaggtatttaaaaaatgatttattcatttatttatttttagagatggggtcttgctgtgttgcctaggccggagtgcagtggctgttggcaggcacagtcatttcacactgtaccctcaaactcctgggctcaagtggtgctcctgcctcagcctcctgagtagctgggaccgcaggtgtgcaccaccacacacttctagctgcttgaaatgtactctcaattaaattaatgttaaccgtactgtcaattaaattaatgttaactgtcatcgctccactgatttatggaacaccaggtcttaggaataatcctaataagaaaggcacaggacttactcgtgaagaaaactataaaaatgttactgagaacagttaaaggtacatttgaataaatggagaaccatattatgttctgtatagaaaaatagaatattatgaggatgttacttcttaacgttaagttaaaattaaacttcattgcaattttagttcagtgcaattttaataaaaatcccaatgggattaaaagattgaagaactgattaatttgaaaaagataagtgaatataaatagctaagtaaaattaaaatttgagggtgaaaaatgacccttccaagtattatgaaatataaagataaattagttaaattaatgtagtactagtagaagtattggttgataggttaatgggatgaatttgattacccagaaatagaattttgtctctgtgagaattaatacatatatctgtgcacacctgtgagtttggggcagattatttaacagggattgacacaactggctagttttatgagaaaaaattaatctttatcttgtatcatataccagaataacatccagacggcttaaagggtcaatgtaaaacagaaacactgtaccaaaatacatgtcttccctcactcagcaggtagttagcacctggtccaggccagggttttgttcaaatgagtggacttgagtctctagcccactgaggagcatccatgggccggagctctgccgggaggaaaggacaggtgtgatcgcagcgttccccagctggctccaccccgatggggagtgtggaaggtgtgttgaggggtatccagagaaggcctccccaagaaattgatctttaaactgagatctgaagagagagtcagagccggccaggtgacccgggggaggggaactcccagcagagggaactgtggatttgagggccgagaggtgagtgtggccaggccgcagtgtaagtacgaggaatgagtagtgagtagatggtccacggagagtgaacaacgcaggcagtgaaggcactctaggagaaccaggcagcatcactgatgtgaacgaatgtaaactaaatcaatacgacagcttttctcattaaatgattgatggttttaaataacaagaattttacatctggtttaatatctggtgggagtgtaaatttgtgtaattttttttgcaaaggaatttggcagaatgtattgagtgcgttaaaatgtttatatcttttgatcaaataattccatttctggagatttatcataaggaagcctgagaatagcccttcctgccacgtccctctcaccacctgtcccctttgctgtgaaaccctgccttcaaagaagggcgttactcctgcactagggctggggtagccaggtgacaggcggaggactggctggagggcaggtgggtagggaaggggctcaatgttctgggggacattttaaaagctggaaaaacacataaacgagttccatattgaaatatttatttatttttttctgttgtgttttcagatgaagacagtcagtgttgccttagttttgtgcctgaatgttggtgtggaccctcccgatgtggtgaagaccacgccctgtgcacgcttggaatgctggatcggtgagtatgcctccctcacgcgctgccacaaaggccgtctggccggctctggcctgggcggggctcgccaagcctgtggtctggtccaggggcccgtctccagctgtgcaaatctgaggggtttttctttctggagtcacatcacctttgagtaatttccgatgcgctcacctgtgattggtagtggagagagtgtttccagaaaaatcaatacagtgatgattattggcttatataattttctactttatttttttatttattattattatttttttgagacagagtcttcctctgtcaccaggctggagtgcagtggcatgatcttggctcacagtaacctctgcctcctgggttcaagccattctcatggctcagcctccttagtagctgggactacaggcacccgccaacacacccagctaattgttgtatttttagtagagatggggtttcaccatgttcgccaggatggtctcgatctcctgacctcgtgatccgcccacctcagcctcccaaagtactgggattacaggccaattttctactttattacacgcccggccaattttctactttatatttgttctgtctggcacacatagtatctatgtacacttaaaaaaaaaatggaatgactgatacctgcatggaaatgtagaagaggtaaatggaaccacttccagcaaagcatcacataatggatcatggcccataataataatggccatcatttgctgaatgcttgtagtgtgtcagacgccactggaagcactttacaatgctcacaacaaccttgtgtggtagggtttttgctaatctccatttgagagctgaggaacatgagacatagagattagtaatttgctcacggttgtcctgtagagctggaatttgaacctatgcagttcaagtccagagactgttttttttttttttttaattgtggtaaaacatagacaacacaaaataccattctaggaattattattattattattattattattattattatttttcattctaggaattattaagtgtacaattgaacgacatgaaataattcataatgttgtgcaagcatcctcactgtccatctctagaaccttttcaccatcccaaacagaaactctgtctccattacacaactcctcattcctgccttcccctagcccctagtaaccgccattccaccatctgtctctatgaatttgtcattctagggacctcatatcagtagactgatatttgtccctttgtttctgccttctttcacttagcataatgcccccaaagttcatccatgtcgtagcatgtgtcagaatttcattctcctgccgcagcctcgcaataactggacttataggcacctgccaccacgcccaggcaatttttgtatttttagtagagatggggtttcaccattttggccaggctggtctcaaactcctgaccttaggtgatccacccgccttggcctcccaaagtgctgggattacaggcgtgagacaccatgcccggccaagatacaatttatatacagtaaagttcacattttttagctgtacatttctttaagttttgacaaatatgtacagccatgtaacaaatgccataatcaatgtatagaatatttctgtcacaccaaggaagttcccttgggtccctttgtaatcgatcccctctcatttctctggcctctggaaaccattgatctgattttttccttttacagaatgtcatttaagtggcgacatatagtttgtagtttttgtatcttgcttctttcctttagcagaatttatttgtgattcatctgtgtagctacgtgcattagtagtttttttcctttattccatttttatggctccctcacaatttgtttatccatttactagttgacagacatttgggttgtttctagtttttggcaattatgaataaaattgctataagcacttgatctttgtgtggacatattttctctggttaatatttaggactgtgattattagctcatatgttaagcgtatgtttaaattttttttttttttttttgagatggagttttgctcttgttgcccaggctgggagtgcaatggcacgatcttggctcaccacaacctctgcctcccgggttcaagcgattctcctgcctcagcctcccgagtagctgggattacaagcatgcgcctccacgcctggctaattttgtatttttaatagagacaggatttctccatgttggtcaggctagtctcgaactcccgacctcaggtgatccacccacctcagcctcccaaagtgctgggattacaggcatgagccaccgtgcctggccaagtgtatgtttaattctttaaggaactgctgaactgtcggttttttaaagatctttaaaaataatgaatgtcttttatatttaccttcatatttattgttttgaggaccattcatttctttccgcagttccaagtttctatctggtatcataatcattctgcctgaagaacttactctaacatatcttgcagtgctggtctgtaggcattaaattttcctagatttctgtttggaaaattcttcattttgtctttgtggttgaaaggtattttttcggggtatgtaattttctgttgactcttttagcactgtcttttaaaacagtcacctgttgtgttctggctagcagtttctgagaagtctgctgtaattctttgtttctctgtatattttgcttcatttttctctggcaatcttcaagatgttccctttatattctcagtagctttatctataacctattagttttttgtttgtttgttttggaatttattctccccacccttttttttttcttttagagatgggtgtctctcaatgttgcccaggctgggctatacttgaacatctgggctctagtggtcctcttgcctcagcctcctgagtagctgggactatggatgcccagtactgcacctgtgaaatttattctttttgggtttctgtgagcttcttggatgtgtagtttgatgtcttcatttttgaaaagttcccattatcttttcaaatatttattgtttgttttctctctcttctgggactcagctctctatgtattgtgctgttagacattgtaccgcagctcttccatgtgtctctctcttctgggactcagctgtctatgtattctgctgttggacattgtaccgcagctcttctgtgtgtctctctcttctgggactcagctctctatgtattgtgctgttggacattgtaccgcagctcttttgtgtgtctctatcttctgggactcagctctctatgtattgtgctgttggacattgtaccgcagctcttccgtgtgtctctgtcttctgggactcagctgtctatgtattgcgctgtcggacatagtaccacagctcttccatgtgtctctgtcttctgggactcagctctctatgtattgtgctgttggacattgtaccgcggctcttccgtgtgtctctctctcctgggactcagctctctatgtattgtgtcgttggacattgtactgcagctcttccgtgtgtttctctcttctgggactcagctctctatgtattgcactgttggacattgtaccgcagctcttctgtgtgtctctctcttctgggactcagctctctatgtattgcgctgttggacattgtaccacaactcttctgtgtgtctctctcttctgggactcagctctctatgtattgtgttgttggacattgtactgcagctcttccatgtgtttctctcttctgggactcagctctctatgtattgcgttgttggacattgtaccgcagctcttccgtgtgtctctctctcctgggactcagctctctatgtattgtgttgttggacattgtaccgcagctcttccatgtgtctctctcttctgggactcagctgtctatgtattgtgttgttggacattgtaccgcagctcttccattgtgtctctctcttctgggactcagctctctatgttttgtgctgttggacattgtaccacagctcttccgtgtgtctgtctcttctgggactcagctctctatgtattgcgctgttggacattgtactgcagctcctccgtttgttctctcccatgtcacaatgagcttttgttagtctgctgataaaccagccaaggaaattctttttctctgatattgggttttttatttctagcatttccattgactattttagtttccatctctaggggaaatgcatattgcctgcctttccttctagagcctctgctgtgttcatcatagttaccttagagtccttgatctatagttcagaaaacagggtcagccctgagtctgagtctcctaattcctttatcatctcttgactgtaatttgcttttccttgctttttttgtgctttataaattttaattgcatgctggacattgtgtgtagaagaacaatagcgaatgaggtaagttgcatagtctatagtttagtaagtagttaactggggttagaatttgttgttgtaatggttatacccactgcaacagcactcttagttcttagagtgattagttggtgcttgtgtcagtcaaggttctccagagaaacaggggcagtagatgtgtgcctgcatgtgtgtataagtatgtatgtatgtatgcatgcatgtcttgtgatcttgaggcagaaatttcttctttctcaggaaaacctcagtttggctgttaaggccttcaactcattggatgaggcccccatattaccaaagaaaatctcctttactttaagttagctgattgtggatgtcaccacatgtatagagtactttcactgtggcacctgggtttgtgtttgattgaattgctgagtgctacggcctggcccagtggacacataaagctgaccagcacagtcctcgtgcattagggtgggtacaggcaggccagggggttttcccagggctcctgctccacccctagcctgagctgtgcctgcccacgtgcctcactgagtggtccctggctttgcctgtctcctggcacaggatttccattgctagttactcagcgccaggctgtggagtggtgggagttctctgtggtcctggtctctctttagtcttaggcaggccctgggcatctgggccttgggcgtagtgcggttgcagtgttttcacctgtcccccagtgatggcaaacgtctgcctcgattcagtgtagaattctgtgcccagggcgtgttctgctcctatcccaggagtaggctgttttgcaccttccctcaccccatcctccatgctcttcacctgtgtcttgggacagtgtgttctatgcccatggtgagcaaggtaggttttgtctgtacctcctcccactccccaggtacaggaatgtgtgcctgttcttgtggactgagggtctcctgctttgcttcctaggggaggaggtctctgggggcaggtggacttcaagcctctccacactctgtgctgcctccagcagatgcttctcatgaagtgggggtgcagtgggggtgcatgcaggagagtgtgagtgccccttgtgcctggaccccctgtgtttccacacggatatgcaagcgcacactggggcctcgaggacacattaccatcttagctggtttcttgtgcagacctgcgctcttcaaagatgggctgtgcatgtgcccgggctttctcggagaggacgggcctgtgggattcggtttgtctgccctgcggtctcagctcccttatgagctcaagaaaagtgatgatgtcagtgattattcagctttctcatgttgataggattggagccactctttccccccagctttctacatcctaagcaaaagcagaagttccctttattgctttaacaaaaactacaaattattctcagcctgggcagcatagtaagagaccatgtctctacaacaaatcagaaaattaggagggcagggtggctgattttgagatgacaggcatgcctgtagtcccagctactctggaggctgcagcaggaggattgcttgagcttgggaggtcgaggctgcaatgagctatgattgtgccagtgcattccagcctgggcaacagagtgagaccctgtctcaaaaaaccccaaattcttctcatctaaatctcatctaatctgaattggaaataaatgttgtttttcctgcattatttggctgtcacactatgtgagggtgttttaggatgacagttccctcaccccttccaggctgcttgtcccccacaccccatgatggagcagctgtgttttgtggctgatttcttcagatgctctcttggctcactgctggctcccggtgactgtgctggttgaaattgacttcttattagccaccatggactctttccacttcatccgtccctcgtcacagctgaatgtaatcagttattttctcttcctctacagcaatgcttatgttaggcttttcgaacaagccttcctcatgcggatccctgtgtgtgctccggggacgggacgcgcaggcccttcggggttgtgtaggtgtcatctgaggatccagttgctcttccctgcctgaggagcctgagcttttatcagagctcaccgccctctcccacacagtctctttgatcagtatttacacaatgttaatgagaatggaaaaactccatgcttctttcttggtgtgaaagatccagcaaatgagatttctaaaacttgagttttaaaagttttcctgcagtttaggaatatcgtctactttctaataatttcaagtgaattttgagtttaggagggcatgtgctttttctaagttggaaaaattttatttggcctttattaaaaaatgggtaggttcctggtcctggtgatggtggttttaacaatatggcataagagaataagaagcctagtgatttgaatcagcacatttgcaggagtgtgtagcagcccacttttattttttagtttatttacttgaaaatttttatttttgtgagataagaccttactctgttgcccaggctggagtgcagtggcgtgatcatagctcactgcagcctcaaactcctgggctcaagccatcctcctccctcagcttcctcagtagctgggactgtagatgtgcatcccccacgcttttaaaattttttatggagacagggtctcactttgttgctcaggctggtctcgaactcctgggctcaagtgatcctcccacctcggcctcttaaagtgttgaaatgaccggcatgagctaccacactaggcccatttttcattttgaaaaaaaagttccaaaagttgcaagtatagtactaagctgtttcctttctgattctctgagagaaggcggctgacatggtgcttcagcacctctgaattccttagtgtgtaattcctgccagccgggagtttctctttccagatgacaacgcagtcaccaaaatcaaggagcattcgcgtggacgtgtgactgccacgtaagcgtccgctgcatgcaggtttgccagtgtcccaggaatgtcctttgtagcgccaggatcctgctcagccatgcgccatcctaacttcctctcactcagtctgaagcagttccacaggcattccgtgaccctcctcaccctggcgcttgaaggtggcagtctctttgttttgtagaatgtctccggtgtctcctaatgattccgtttaggtcatgcttcgctggcaggagcatcacgcagagctgcctgcttcacgcgggctgcaccaggtgatgcggggctgtgatctatccattactggtcatgcagatcttctcacctgattcagctggcgcctgctggacctcatgtgaaattcccctttgtagttgataggtattttcgggaagaagtgctttgagattgtgcaaatattcctttcctcgtgactttcaatttcttcattttgaactcatggcctccattttcattcagtggatttagaatccagtgttatcctttggtgccgagcttgtctccctctggttgttgggaacccattgggccggcttctttggcttctgtcttgtttgcatcattcgtggagcatgtgcttactttgtctcatctagtctttttcccagcctcattcctcttagtggaatgtggtgttagaaactgagatctgggtgccaggtgttctctttgaactggcgtgctattgctcccaggacctctctcgctggacagagcaaggaaatgcatgtgtgtgcatactatgtatgtgtgcatactgtgtgtgtgcatattgtgtgcgtgtgtgcatactgtgtgtgtgtgtgcatactgtgtgcgtgtgcgtactgtgtgtgtgtgcatactgtgtgtgtgcgcatactgtgtgtgcatactgtgtgtgcatactgtgtgcgtgtgtgtactgtgtgtgcgtgcatactgtatgcgtgcataccgtgtgtgtgcgtactgtgtgtgtgcgtactgtgtgtgtgcgtactgtgcgtgtgcgtactatgtgcgtgtgcgtactgtgtgcatgtgcgtactgtgtgtgcatactgtgtgtgtgcatactgtgtgcgtgtgcataccgtgtgtgtgtgcataccgtgtgtgtgtgcatactgtgtgcatactttgtgtgtgcatagtgtgtgcgtgtgcatactgtgtgtgcatactgtgtgtgtgcatactgtgtgtgtgtgcgtactgtgtgcatgtgcgtactgtgtgtgtgcatactgtgtgtgtgcatactgtgtgtgtgtgcgtactgtgtgtgtgcgtactgtgtgtgtactgtgtgcgtgtgcgtactgtgtgtgtgcatactgtatgtgcgtactgtgtgtgtgcgtactgtgtgtgcgtactgtgtgcgtgtgcgtactgtgtgtgtgcgtactgtgtgtgtgcgtactgtgtgtgtgcatactgtgtgtgtgcgtactgtgcgtgtgtgtactgtgtgcatgtgcatactgtgtgtgcatactgtgtgtgtgcatactgtgtgtgtgtgcataccgtgtgtgtgcataccgtgtgtgtgtgcatactgtgtgcatactttgtgtgtgcatagtgtgtgcgtgtgcatactgtgtgtgcataccgcgtgtgcatactatgtgcgtgtgcttctctctgtacacatttgtctcagcgtttctgtacctctctacatgtacattcatgcctcctattccacctcatgggggttttccatatttgtagctccatcttctgacagtgacaaccttggtatcctttgtccttattgtattggctaatgtggtgcctcctcctgtgtgaaccctcttctcctctctgccattgctgctcctctcagacccggttatcctttgccatttcaccccaatatctgcctttctcactgccctggtccaacacccatatggtcacctttctgcagccacacctctccttcttcctctgcacgggctcagggcccagtcagacttgagagctcattccaggccagtgtggctcccatcatcctgagacagatgccagctttgcccagacccaccttgtggctttaggattgttgaagaagggattttagcattttcaacaagtgctttaggtttcaggcctggtcagccgagggaaggatgatacaccagtaaccaagactgggacgggagctgggctggctggcagatggtggggtaccatttcgcacatggtgaggtgcttgtaggaacctccaagcggagccaccatccagtggaaagtggatctggtgggagaagagggctcattgtagactagaggacccaggggaggtcagcgcctagtacgaactagaccagagggtatcgggcagaggcagggccctgagggtgcagagaggggtgccaaagaggaggaccagggtggttctggatgagtgcgtggaggagcttctggtcagcattgtcaaggctgaggtggtgtccaggctgattgtagcaacctgaagagtgaaggcagatgaggtggtgaagcttgtggggcagcttggccaggaaggtgaggagtggggtactagtgttggggctgggctcagtgatgggtttgctctgccttcctcaagatgagaatgacgggggccatggaggaagccaaaacagggattggtgcaatcaaattacttacaaacatgttaccgtttagaaggcagacctcaggattttatatttggtcttagcattttgaggtctattactagaaatcgagatttttgtgttaatcaagactccagctttattccttccagctgtgctacacatttaactgttttgggcctcagtttcctcatctgtaaagtggagctagtgatgccgtgtacctcatggcagggtgggggaattaactgggagcagagacctggtttggtgcagagactggtcctcacctccgccgccccaactctagtccctacttctaccccaacatcacaacacctcaaacaccccgacccctacgtcacagcgcctcaagcatcccgacccctgcaacactgtcttagtctgttgttgctgctgtaacagaatacccgagactgggtaatttacaaacaacagaaatgtatttcacgcagttctggaggctgaggagtctaagataaaggcactggcaggtctgttgtctcttgagggccctgtccatcttccaagatggggctgtaacactgtgtcctgtcacggtgaaagggacagaaaagcagaagtgtgcgtctagttccctccagcccttttatgaaacacgatcgcctcctgaaggccccatctcttcatactaccacattgggcttccgttccaacacgtacatttttggggacatattcagaacatagcactagccccagtatccccactccagatcacccacacccccgcaacacgccccagtaccgccactccagatcacccacacccctccccaacacgccccagtgctgcatggggagcaggggccaaggtgctgcatgagctgcttcctgaatccgtgcctcttccgctgctttctgtagggctgactacgaaagagggctgcagtgaacacacctcactgagccccactgccgggcatgtagccttgcaggacggccgctcactcagggttgaaggtctccagcagattctgggagtagatgcacggtgctgcttatttcgttttacaaattaaacatccaatatgcaggtagcaatgtgtgtgaatccccagtgctttatgtagaaccctgagtatggggttcatttttgggcagggtggggtggagcggaaggtggtctgtgctgatgtcagaggggtctgagaagcttgaaaaataagggtaactgtgtgtgcctgaaccatgcaggaagacagcactccttccagagatgagggagagcagacgtcatgtctgtgagcaaacaaggggcccatgcccagcgtggctctgggtgtcatggcctccctgctaggtcatccggatgaagcctggggctgtggagtcagctcgtgagaaatgggatccaggtcctgagcgtgctggaactggcgagacggggtcacagcacacacctgcgtttccagccctgcccctgctgacggccaagacctcttttcccacccctgctccgcccccctctggataataagttgctgttctagttcatagaagtgacacttgtcccttttcagagaagcaggggagaggctgttttgttttatggcccgacattaaatactacaacagtaatactaaaaacaatcctgctgaagagctgcgcgtgccccactcttggggaactctgctgtggcagcagagtgcggatgagctgcatgctgagcagggagtgtcatttagcggaaatggttttgtgtgccagctaatggtagctgtgtatcagaagaggtgagaatgcaaaggtttgtcagatgtgtggaaattctgtcatcccaagggaacgtttgggaggtcttagctttgtttttctcttcttaatgcaaacacgtgagcattaagagaccttgggtagatgagctgaaaatagtcgtgatcgcccttggcggcggctcgtgggtttacagagcacttgcacagacttcgtcattgattcttgcaaccatttgggattcatagaccagtcaagttggttaacagatattgattaggtggaaacgtatatgttaagcatagtgccatatacaaggaactgtaagctgtgctcttgctttcaaggcactgatagtacacctggggaggtaagactaggatccatgcagtagaacagagaccaatacgaggtcaagcttgaacggcctggaaggccagagaatgctgcggtagagacgtcagggcaggcagtgggaggcaagagcaaagagctgaaggaagagcatgagcccacactctgaggtccgaggggctgggttttcgcacaccagctgggctccctttgggcctggggggtcagtagcacccgttagccacggccagtcacagccgtatgctctgtgcacacagctctgtgcccacagctgaaaccttggctctttggggcttatggtttaaaatgctgttttcttttcttcctttcttttttttttttttttttgagacggagtcacataggctggagtgcagtggtgtgatcatggctcactgtagcctctacctcctggactcaagcgatcctcccacctcagcctcctgagtagctggaaccacaggcatgcaccaacacgctgattaattaaaaaaaaattattgtagagacggggtctcattttgttgcccaggtttaacatactgttttctctgccagttccattggtgtctcaaggtggtatctctgcttcccctctgaaggaatctgaaagaagggggttaactgcttggagcccacctctctcctgtatctactttccaaagtgaggacagttttttaaaacaggacatgttcatcccctcatatctgctgaaaatccgtctagctcttggtttttgtataatacagcaataggcaacacaggaacgtaattttgtagctatgtgaggagtgaggcctagtgttagaacggggccagactgtaaaagatctcgctcctgtacggctcccgtcctagtcccacagacgctgcaagggccgcgggtcccggccgaagctttcctgtcccagatgcctgcagctgtgtggctccaagctttgcgcctgagctgaggaagatcacacgcctctcactgtatacaggactaattattacaaaatagacagggatggcattatggttaggaaaatatagactcattaaaaatcatttctaatttcaaagtagcccctttgctattatgtattttctcagtcaaaaatgagttgtttaaggctacacaactaatgagtggcagagtccttgaaaaccacacagagaaatttgcacttcatctagtaggcagcactcaatatgtcaattaaaaatgtttattaagtgtctgctaaatacacggtacaaagaactacaaagattgtccgagcagtgagtgctggatggggctttcagtgtgaacttttcactgaaggatagcacacagaggaaactgcacctaacccgggtgtatcctaaactgatcatacccatggaccccagatcaaggaacaagatgaccattggcccagaagtcttatcttgtcccctttgggtcccctcccccagctgcactgctgggtctccactcttggcagctttccatctaaatggagcacacagcccgcactgtgggcttctgaggggaggggtcagcctgcgctcatcttcagggtggactgagaagagaaagactaggtcattggtggccctgtctgtgcctggggcaccactctttggggccattgggccagattgaggaacccagctgggaggtgggagagtctcagtagcatcgtgaagggctgcggattgggtgaacatgttagcagtggctggtggagtgccagctctttggaaggtgaaatggataggatgggtaatcaaactgggtacataggaagaagatggagaggtttaaaaagaaaaagctgcaccccttcaggttggctgaatgccagcactatcaataaccttggagcaagtcatttgactgctttaaacttcagcttgcccttctgtcccatgaggtgggttggaccaagttcctttcagtgtaaagttctaagtatcttgaaattcagaggggttatgctgaaaatcttgcaaataggaaaatttataaagaactaaaagttttatgcaaataccatttaccatctccttttccatccacctacccatccatttcattcatcaatttacccacacactcactcgccgctgaagtttcattagttctttcccagattccccttaaataggagctcataaaggaattagaagagaaatgttttataagacacaactacagttttacatttatgatctgtccacttcaccccacatcagactgatactgttgtcaataatatctatcggggaatttaattttagtttatttaaattatacttaatcaaatgctaaatgcatcgtttcatttgacctcattctttcccgtctcttcctctgcttctcatttcagctctcccacccactgccctattcttggaagggaaccatacaattaactgaccacagggattcccagtggataggcggttatagtgccatgtagctggtcacggcctggtgagcagctgacagtggtttcacccctcctgggtgggcaggtatcctgacctgagtcagggcagggagagtggggcccctgccaggctgtctctactaacgagggccgccatgtctctgcaggatgttgtgagggatgcagggaagtggctgcctcctgccaacactggggagagggtgggatgggagaagggcctggactttccaaggggtgaaatccaaggagggggtactccttgaatgggaactccctcccttcttcctctgtccgtggttcactggagagcatgcatagtgtgagccaccgctgaccgtcgtgatgcatggacagttttctgaccatagatgacagccgcgggccgcgaccatgctggttgctgcagttaagtatgggtgactgaactcaacgccttccagccagccctgtgcgtttactttgctcctcctcatgcatgcggcaaggtcgctctttggcatctgtttgttaaagctgttttttgctttcctttgccttgtttgtgtacttcgtggcccctattttttgtttttcagatcccaatccaatcctatcttgtgggtctgatcacagcacagttgatttgggtcactatgatttttttgagaccttagaactttgttcctgagagaaatgaagaccaaacatgtaacgtctgaagtcacagattacggattataacaaatttaccacaattcttccagagaagttagatattacctggtttttaccaagcttttctcagccagaggtgtccattgaattagaaccattgaattagaatttccagaaggttagggcctggcatctctgttttgaaaagcccttgatgactttgacctatctatgggcgaaggccctttccagttgtaaaatcttattaacgtcatgatttttattttatttttttatcagagtaacatacatatagctaaaaaaataataattaaataatgccaaaaactatacaggtggctcttggagatcctgcgggtgtggctctagacgactgcaataagtgagctacatgaacgttttggtgtccagtgcatataaaagttacgtttacactgtactgtagtctgtgaagtgtgcagtagcattgtgtccaaaagaacatacacactttattttaaaaactgaaaaatgttaatgatcactggagccttagcgagttgtaatcttttagcatttaattggctgacggagggtcctgcctcatgtggatggccgccaactaatggaggaggggtggttgctgaaggtaggggtgactatgggaatttcttaaaataagacaataacaaaatttgctgcattgattggctcttgctttcacgcagcatttctctgtagcatgtggtgctgtttgatagcattttacccccaacagacagacctggagtagttggcagatgttttctggaaaatgaatgacatgagcctgtcacattaaggaaaacaactgacagtgtttgtttccactgataaaatttgagatttcaaataaaaaaaataaaatttggaaaccttgtacctaccactatgagcctggcaacttcttttttgttgttgttgttgttgtctttgagatggagtctcactctgtcgcccaggctggagtgcagtggcgtgatctcggctcactgcaacctctgcctccagggttcaagtgattctcctgtctcagcctcctgagttgctgggattacaggcgcccagctaatttttgtgttttcagaagagacggagtttcatgttgctcaggctggtctcaaactcctgaccccaggtgatccacccaccttggcctctcaaagtgctaggattacggtggtgagccaccacacctggccgagcctggcaacttcttagtacttaagacatttctgatgagctcatggtaatgttaatgagtgtggattcttaaaaaaatattggggaatgaaatatacaagatctgtatagttcaatgagctgatattttccagatgatcaatgcatgatgatacaaaataatctatgggtaaaaaatccactcaaggtgcagcaaacagcagtgaattttaatgtcatagcatacaaaaagttcgttgatgtggtttcagatactacatctcatataatctgaaggaaattaccacttgataatttttggtgtagtatcaaacaaaaagagtcatgattatgtaaaatagcattttaagatactcttctgttttctaatgatagatatatgtgtgaggtaggggtttccacatatgcagtcactgaaaccatgaaatgccacaggcgaatgcaaaaatggatgagagtcacccatccttgatcaaaccacatattccagaaattcgcaaaaatatgcaaaaatgctgctcttctactaaacttttttggaaaaaatagttatttttgtaataaatatttatgttaaaatataatgggttattgtttttaaaatgaatgaagaaaaatatttaaaaaatcttagctgaatttcacatagagtagatattgatagattcaacaacataaaccaaagctctttgaggttttcaataattttagagtgcaaaggggtcctgagaccaaacaagtttgagaactgctgatttagagttaattgccctggaacccactcctgaaataaatgggtaaatcctggacatgaatgtacatttgtgaaacggattttttttgtgggaatactgagtgcagatgaaaattaattaaaaagtatcacttctttgtctttttctctcctccttttcctgtacccatgagagccatagtttgaacaggaggaagcatatgctgtcactgcagagctgccttctcagagaaagcctgagcaggagcctgagaataaaacagtgcaagtgcgggaaagctgcaggtgccgaaatacaaatgaacgtgggtagaataacagcattcacttgcccgtgatgttaaaacactggccttcacggcgtgtcagcttgtttgagcaccttagctgttcagtaaatctggttaacactgatcaaccttaggcgttgtgttacttttagtcaaaggtgactttgaagtgtgttatataaggagaaactgtggaagagaggcctagcagaggaggaaatgcagacgtaaagaactttctcttttccattgcttcctcagatcctctgtcgatgggtcctcagaaagctctggaaaccatcggtgcaaatttacagaagcagtacgagaactggcagccaagggtaagtgtgcttcacttgctcttccctttccttcttacagggaaactccagttccttggtttccaacactctttggatccaagtgagaattctgtgcacaccctgcccttgtgtggcatggcgcctgcgcactgcgtttcgtgtgcctgcgttctgcctgctggctattggtggctgtgttgtcttgacagcgtccgcattattgtgagtcttgcattggacagtccaacttattttgcttaagtttgttccagatttttagaaaagaaaaagtattcttttcgctcttaaccatggttttaatttttctcaggaaatgtattttcgataatttttctgcaacctcaactagttaacgctattccgcgtgtcttcagttttcacatagttgagaaaaaaacacccaacagtcaaaagataacacttattatatgctttgcctttgattcaaaagataaggttctttttagggagccagttaccaattagtgtgtgggtttttttttttttttttttggcttatatcttacagttttttgtttgtttgtttaaagaaaagtggcttagaatataactgtgtcaaattgcctttaagatcttaagttacttgtaatccacccaaagacctttagcctttcttattaactggtttggagatttaataaatttaataaaaaactaagaatctgggcacttatggaagtgccctatattcagctttgcatgatagatggactcgagttacctaaaggaaataatgaagaatgcaggttgagaaggtgcgcgtctcctgcaagttttactctccccttttggatgaaagcctcatgaaaacacatgatttatggaaccttttgaacacttatttggttggaattttgatttgtggatcatttatccacatgatgtgggatttagagattccttatacattatttacattcttagagtaagagaacagccaaaaatgaattttttcctgcctttaaaaatgcccttaggtcatttctgctgttgcttccagtcatgagctaattgttaggaagcatctctgtgtcttagggtgtacctttgtgcttgcattgccaacttgtcaagtcaataacagcagacttttgttctttagaaggcagtggcttcatgggttcttgactgatgcctaatggcttgactttttcctctcttaaattggttgcctcttgatggtttgtgtacacatgctgtagcctttttcttgagggcgcagtgcgtttggggatggcatgaggactggagagagatttggatggtggagtcctgtaaaaatgtagttgagatgcctcgtgttttccatagataatagcttctttgaagactttgaaggtaccctagggtctcagcatggtgagacgggcacttgcaggagtgtggggcagagtggcagtattagaagacatggccgtgttggcacatggcatgtcgttaaccaacactatgggaattcagaggaatgcctttctggctacttctggccatctcctgggtttggctttgtacctttgcgttttactagatacctttgtttaaaaaagaatgtaacccaataaattcagatctaccaattgtgttctttctagaatgagtctctgctattaaaactagtttcttcttttccaagaattattagataaggaaatatagcctttcagaatacatgtgtttaatatttcaagatattgtatgtgtattccatttgctctgatttacaattgttttttttgagtgctaagagttgatttactgctggctttattattagtttcgcttggtagatatcagctagttgatgctagctgacaggaaatggaatcttctaaagtggcatctgttatttttaatctaaatttctgtctacgagcagatctctccatggcattgagaagcggcatcatgatgtagggaaggtgacctttacatgtaggtcagtgatgacagccagaaagatgacagtgtagactcagtacaggatggaggattccctgcccatgacagtggcacagttgtattcggacagcgagcacaggtgcaaaggggtgcagtcctctgaatgatctgtagtctgggaaaatttgttaaagttggccagatttcaagaatggatgtgcaaaataattctctgagtaagagatcgtttgaagggctggtgagatggagaatgtgttaagattacaggatgcttcggaaaaggtaccagcgcaggcgggatcccatctgggctggtttataaagtggaatctggaataaagtatccgctgcagcctagaaggaagctgttcttgcacacagagtgggatcttttgtccccattcaggaagcaaaaccacaacaatggacacctaatatttgcttttcgaatgccaacaccattgcattcattttttagtacaataaaaatgtttaaaaatttcctgctactatccatgagcgggcctcatctattttagaaattagcctaaggtaacggatgtcacaggatacctctgaccggctcccaggtgtgagcgtggggctgtgccatatgcactgggtaataatagcacttgccccggtgcgcgtggcacactgctcctcacagctttccgtgggttacaggacagagggagggaggcctggcatagatagcgtggctctcagtgtggggcagacctcatgctgccttctagagtttgcatgaaacaggaggcacttagcaaactcagatgtttgtgtgcaaggggcctggttcctgactgtaaatcagggtcctttgaaacattgcaaggctaaacacgcaccacttgattgcactctacagggctcttgagtttctgcagtaataaagagaggttgatgtgccatctgcaataaaacaatgggggcgttattaaatttcccagaccttcagtggaaagacccatatatctggttttctctttctctgtgtctttattgcaagagtggaaaaccttgggtcatttaatgaaaatgagattattttcattaaagtttgtcggagtcgttgcctccacgctggcatggatgggagcagagtaggaaatgcctgttttctcaacggtagcgtccatccaggaggtgcagaaagccaaccccggaacccccgtcggctgcaccagaatggtgtctggaagcctctgatgatttccttgctggtgctggaacgcttggacttgttcttcatttttctagcttttgatataggtgattccagttcaaaaggaattgagagaaaccatggtgattatatttttttctgaaggctgccagccactatctggcccgtatttccttgcttaggcccattgagcccttttctaaataatttatcagtttgccactgatgaaatgtttcttctgattaaatttaaggctttgccttattaccttgtaggtgtataaatttgtgttctgccagagattggaggaaaatgccgaccgttgtttcagtggaaaattctgcagtaaaacctcactcattccatcataagtctcaaatgaaagttttattgggaaatgggagtaggagattattataaagctgggaccatacagtgaagaatttatctttttagagaatttttctaacaaattggggctactggcagtttagtacaggatggaagttaggagctggagcctgtggaaaaagacaagcaggaggggcctcgctctctgtgtccttctttccccagagagagtggacaacaccagaagcagaggccacacctctttacttggggtgagctttaattcttctggtgccttaaaaataagtttctatgggaatatctatcatttactaaggaagatgaaacagcatggcggtgcctccactgaccaagtctgtccgtcgggcaggtgtgtctaggggaggaggcggaaggcgctcctcagtcatggagccacgttgttgtaggagctcattctcatcttgtccaggtctgcgagtagtgaaggcagcaagtcctgtgtggcggccgtggggcttccagggagctgagcggtcaggttgagtcagtttccatgtggtggacagttcttacttatccatgcacagccctggtttgtggattacagtgaacagattttgaatgtcagcttcccttcagttcaccgtgcttctcagatgtgtcacagttaatttgtggttaagggatgaaagttggttttgccattagataaacatgttttttatagtgcctaaccccaagcagagtatgttcaaggagagaacaaaacagctcccaagatctggtccattagcccagtagaaattgttattgcattttaatgtaaatgacagtcatcctttcgtggtattgataatagagttgtttgtgtgcttttatgagatgctttgaatgaaccgaagctgatgactatacctcctgttgggaggagggggtttggggagcaagggggttgagaaggccagtggtgggcagttttggttctacttaacaggtgtgtcttttggattttaggcacaagtgttatttgcagaactgaatgtttatgtgtaattccatgttgtttaggggtttggagtgaggataattggaatccaggcatcttctccttgtccctgaatggggctgctgcttgacctgtccacctcacagggagtgtcatgtggccatgtgtgacaaactgtgaaacccttggtattgagtgctcacactgctaggtgtggtgggaggcgcctagtcaggcagccgggttggctttggggagcactgcatggatggcttctaagatccacttgtcttctttcccctgggatgattagacaggcctctgctttgtgggcaaagcaattggtatcagcacaagtcactcgcttccttgtgccccccacccccaaatgttttggaatgaattttatagatggatgctgatatggcttggctgtgtccccacccagatctcatcttgaattgtcactcccacaattcccacgtgccatagggggaacccagtgggaggtaatcgaatcataggggcgggtctttcctgtgctgttgtccgtagtgaacaagtctcacgtccctgcacgagctctctcttgcctgccaccatccatgtaagatgtgacttgcgcctccttaccttccgccatgattgtgagaccttcacagccatgtggaactataagtctattaaacctctttcttttgtaaattgcccagtcttggttatgtctttatcagcagcatgaaaatgggctaatacagatgcagtcaagacgcataaatcagtgggttctaccttttcttaggattttcaggctcagatatggataatcggggaagaagcagctaagttgccctaggacagtactccacacctggaggtgctccaaagctattcatggaacagcccaaggtggaccgttactcgctgtgactcctgcttggggcattcacgttgcgacattagttccaaattgacagtccagttcagctggtgaaaatggccctataattgcgattggcagcatcccttggcgtgcggccctgatgccattaccattccatcatccatcccgtcttgctgtctgccctgccgccagccctccctcctcctgcccaaactcacctgactttcttctctgtgggtcctaaggttgggcttcatccaccttgagtttctgtgacaagctgccagtgaggactcatgggcaaaggcagaactgtgggtggatggctcacagcttgcataattcagtacctggtgtgaagcactttgcctgtgtactcattaaatttgcaggacggtacagacaatatcttctggtggtcttggggttaactgtggtgctttgacagtttcacttaactgcttactgcccagaaagttaagaactgttcctatgatcaatgtttttacttatatttttgccttggcctcagcagtgctctcccacttcgtcttccctcctttctagtgcttctcgcctgaaagcttttccacgtgcgtgccgtgttcagtgagaactctgattcatgctcttcagccagaagccttcgtagtcagccctgcccacgcacttcctgccttgccctgtccccagaggccatggtattggaagcagcttcctggaagcaagcttagattatgcgaagcagtttattccggactctttagaccaattgcaccagagcataaaggtgttgtcacctactgctatccctccgaataccttagtgacatgacctataaattcttttaggcacaccaaagacattacagaaagaagaatgaaagaaaggcatggttctgcagcctcctggaggatggcagcctgttgtgactagactcctcagggtttcagtccattagagctggtcccagaggggacccctgctggccagccctgtgttggactcttgctctccgaggccacctaggggattcactagagagcccatttgggattgaagagcacgcgtgttgactagagtgggttgcagcatgggccgcagcctgtttaaacactgcctagggaagattggtggagtccgcctcctcccttctgcctcgtaggtccgcagagtcgtgctgggctcaccgctccttccctttctgggcgggagcgcccctctcactggtaggggagctccctgggaaatgtggtctcctttctaccagtgcactgaggggtggggtggggagagcttaactgtggaaagaatgcgaactggtttagttctggctttgccacttcttagaaatgtaactctggacaaattactatttaaacttttaaaatttgtacatgcaaatgagagttaatggacagaataaaagtatataaagcatttgcaccagggaggccatggtggttggtcatcagatccttacttcccatccctttctgtcccttatcccttcctctccctcatggttgaggtggtggaggcccctcccagaacattctgcccaggagtcttgctgccttaagcccctccccatcctgccttatctctggttttatcctcttgcggggataactgcattcctgactcttcctctattaattgacctacttgaagtgtaatacttttagagagaagtaggggcttaactctgtccttaacaggcctctcgaggatattatctctcatcatcatgttccctttaacaagggagttgtctgtgtgtatgacaaattgcaaatgaggaccccccaccgtcaggctggggactaaaactgtagctcagctgttgtcgtttcacagatctcacgtgccatgtgtgtttcctgagttaacttggggaccgtgatacagagcgatgcggagatggctctgaaggacaggcaggtgccaggcgagggatggaagtgctgcttctaagtcagaaagtggaaggtgtgatgtgttaaagaatggaaagctaaatttggaggtgacgatgaggaacccaccgtatgctcgccatatgcaactaggaagagttgtaaaatcctgctccagccaaattggaaagtgctgatcaagggggaaacgatcaataacagattggagggggacggccacttcaaagtgtctgcggtacttgatttcattttgcaggggaaaccatatgtcacagtggtgttcatgaatttgggtgttcacaagggcttctgtacagctccctcccaaatgtccgcgatttacttgttggtatgacacataatggagatttttttaaaatggacatacgaagcacataacgtcaagttcaccattttaaagtgtacaacttggctgggcgcagtggctcgcgcctgtaatcctagcactttgggaggccgaggtgggcagatcacctgaggtcaagagttggagaccagcctggccaacatggtgaaaccttgtctctactaaaaatatttaaaaaatggccaggcacggtggctcacgcctgtaatcccagcactttgggaggccgaggcgggtggatcgtgaggtcaggagatcgagaccatggtgaaaccctgtctctactaaaaatacaaaaaattagccgggcgcagtggcaggtgcctactgtagtcccagttactcaggaggctgaggcaggagaatggcatgaacccgggaggtggagcttgcagtgagctgagatcacgccactgcactccagcctggggcgacagcgtgagactccgtctcaaaaaaaaaaaattagctgggcgtggtggcgggtgcctgtagtcccagctattccggaggctgaggtaagagaatcgcttgaacctgggaggtggaggttgtagtaagccgagatcacgccactgcactccagcctgggtgacagagcgagactccatcttaaaaaaaaaaaaaaaaagtgtacaactcaattggcttttaacatctttgcaatcttgtgcaactgtcataactgtcataactgtctagttccagaacacttttcttaccccaaagggaaacccaaagcccatcggcagtcatttctcctcccccaggcccaggcagtcaccagcctgccttctgtctctggagatgcctgttctaggtactccacacaaatggagccatacagtatgtggccttttgcgtctgggctctttccttagcatctggaatgttttcaagattcctccatgctattgcatgtatcagtaatttaatccttcttgtgtgtgcatgtgtagagatagggtctcgctttattgctcaggctggtcttgaacccctggcttcaagtgatcatcctgcttcagcctcaactctttctatagctgaaaaacattccattgtatggctagtctacatttctattttatgggttcatctgttgatggacactttcatggtttccaccttttagctatttgaataatgccgctatgaatatgtgcatgctagtgtttgtgtgggcccctgcccactagtggggttgctgggtcatatggtgaccctgtattttacctccctgaggcactcccaatctattttccacagtggctgtactatttgtccatgtctactagcagtgtatgagggctccagtctctccacatcctggccaacatttgtcactttctgtattcttacattgttattattatgatagtcctagtgggtatgaagtggaatctcatcgtggttttggttttcatttccctgatgattagtgatgttgccatcttttcatgtgcttattggccatttggaggagtctctattcaagtcctttgtccattttttagttgggttgtttgtctttattgttgagttctatgagttcaaaatggagacttttaagttgaataaggtataatttctgttgtgaggacttgtttcctttccaaataatatgtgtggtgtctgctgagagcctcatggtaacatttaattcttaaaagagcctttgtcttgatagattggtttcataaaactgttaagaggttcagccaggcaccgtggctcatgcccgtgggaggccaagacaggaggatcctttgagctcaggagttggagaccagcctgggcaacatagtgagaccttgtctctaattaaaaaaagaaaagaggttctttgactattgactatactgatcatatatatactgtataatttaataccaatcccttaagattcctgtgtgtttttgttaggagtcttttggttttcttagagctgtggtctctccacctggagtgtatgtcgggagaaagctcctgtcggggtgagtgcaggcagagtggccgaggagctgggcctctgtgaagtctgggtgcagcttggaggctcatagtggactgggagcttggcaggaggggcggtgcatgtccacaccagtgcccggtctccgccgtgctgcggccctgtgggtctctgctccccactcagcagttacgctgcaggacgttccttcccctccctgtgtgtgagggctgggtccttcctttctgatgtagtcatctttgatgggactccatctgcttgggcccaggggtccccacaggagccagctgtgttcacatcctagtggtccctggtcctaaaccacctcctgactttcctctgttgcttcagcttcagctctctgcccactgcattgtgtcgctggattttcaagattaaattccccccacaagagtgtttgatgcttccctggatggccaggctgtacggccagtgttaaaagacagacaagtgccacccaggggcaaggggagtgtgtggttcaaagtccctgagaacagatgccagatgccaggctcaggtggtgccgtttacttccagcaagaggagagagagggtgcacttgatccagtgccgggtgatggtggcccctaggccagggggtcgcaccctcactttgggctacagtagaaggagattcccccaccccgtggggtcttaaacacagaaaactgggggcatgcctgagggccactgatgcaggtgctaaggcacaacagaggagccatggaggcagaaatcgggaaagacccctcccaggtgagggctgcacgggctgtggtgagggtgctcccctcggtgggctctcggcccagcacgtggaagacggcgcagtccactgccttcccaacccagagaggccgatcagctccgcttagcttcacgtggtcctccgtgtaactggcccatctgtgggttggttctgagggagtgaggctgccctctagaatcacctgtgactggagggctgggtggcaggatttaaagcgcatagcagaaccgggaggattacccatggcttgtataaggaagagtctcttctaaagggttgcatgtgtggcaggctccttaatcaacatgctgcttaccccggactggaacatgccctgaagtcaagtcatttttgtgtagaatttttaattataagttttatttttataaacaaaaatcttagctgaagtccaataaaatccaagaagaaggcacagataatcagggagaagtaactcaagatttgaggaaatcaagagtcataaaagagtgctttgcaaaactttgcagataaattggaaaacttgtatgcgatgcataattttctaggaaaatataaatgaccataattgacctcagaaaagatagtaaagaaaaataaatggataaacatagaagaaagagaaagttaccaaaccattcctcttctaatcctcctccctctgaaggatttcaaacttgaaaagaacacaaaattattgaagacttctttctgttgtaggaagatctctaaaacatagtttctttatctattaatttagagacagagccttgctctgccatccaggctggagtgcagtggcatgatgttggctcactgcagcctccatctcctgggcccaagtgattctcctgcctcagcctcccgaatagctgggactgcaggcacatgccaccacacctggctaatttttgtatttttagtggagacagggtttcactatgttggccaggctggcctcaaagtcctgacctcaagtgatctgcctgccttggcctcccaaagtgctgggattataggtatgagccatattttttgttttttttaaatttatttttattgatttgtttttatatttttagaggggtcttgctttgttgcccaggctagagttcagtgatgcagtcagcttactgcagcctcaacctcctgggctcacgctatcctcttgccatatccttttgagtagctgggactacagatgtgtgccaccatgcccagctaatttttaatttttttttttttttgtagaggtggtgtcttgctttgtcactcaggctggagtgcggtggtgtgatcatggctcattaacctcgaattcctgggctgaagtgatcctcctgcctcagcctcaggagtatgtaggactacaggtgtgagccacagtgccagcttaaaatacgtcaaatttaaaatgcaaaagaagaaagtgtattcaacaggtttagtgtatgcacatatgactgatggagtcagccgttcctgcttgtcatatgtaatgtgtgtagctgggtgtggcatatgtgtacatgggtgggtagatccctagatagatggagggcaagtcggtggatctgcccctcctccactcactcagatgccttagagtgaacacggaagggagacatcagcctgtggcctccttagtcgttctcattttccttcgcctcttggtgtcttgctgtgttgactgattctagttttgaaagcagcatattgggtcaaaatacatttttttttctttgagacagagtcttgctctgtcacccaggctggggtgcagtagcgcaatctcggctcaccgcaacctctgcctcccaggttgaagcgattctcctgtctcagcctcccgagtagctgagattacaggcatgtgccaccacacccggctaatttttgtatttttagcagagatggagtttcaccatgttggtcaggctggtctcaaactccttgtaggtgagccacccgccttggcctcccaaagtgctgggattacaggtgtgagtcaacacgcccggcctcagaatacattttaaatcaggtctgtactgacttcagaatctaactccagaataaaatttgattctaaggggcaacagtaccacaaatgaggcgaagcacagaacatctgtcaccgtgacttggggcagatgcagaatgggactttcacctttttacacaaaacccttctatgtgccttctgttttaaaaccatgattttttttactttaataataggcaactaatttaaaatacctattcaccatgtgtcatctcagagtaggaaggggactgtgaggcagacggagccacttgggacttttgcctttgggttgtgacatttgtctgtaggttctttcacttctgtccatctcatttgtttctgtgccatgcgtgtgacatgatgagctggaaagactttgcatggggcccacgtgagtgctcacatcgaaggggcaagtgttaatcaccctctagttgacagagctgtttcagggatggctagttcctctgtccggaacacttgtattgagtggcagggagccgcggggacactgcccatagcggtgggagagcaagcaggaggggctctgcccagggctgtttcctttgcctttgtttaccagcataaagtattaaaacagctaaattatcatgggcattttaatccaatttctcagcgtttcgtcatttgaagaatagaagtctctttgttttcacagccctgttcttgcttgtttaaatttgaatatatttctattcattcagctgatagaaattctttacttttaaactgagggagaaaaaagaacagattgactagggatcagaatgtgatttcagtgggtctttattgggcccttgttagggaggggtttggacctggggacttggagtctacactgatggcagaagcaagctccagaaaagagcaggctccagctttgcaaggtaaaccttggagagtgtagttagggtgacagccagcacctctccctgctgagtggagagggaatccagatttttaggatcttataacctgatatttttcatgcctttgactcctgtcttggtctgttaggtcttggcttttgatagccaaagtaaccagctgactttccttctttttttttgaaatctcctttactttttcacaaggctgtttctcagtgtgaatatgttgctttcatattcccagagcactcactgaatgcataaaggctaagcaatgcagcagtgatactactaaccagctcttagtttactgggtgacctttggctggttctgtcgagtggccactctacctccagtttgccctgtctggagatgcagccaggactgtagattcccaggggagggctgacttactggggcatttatttactggataggggagtttttaatcttttagttggaatatttagtccatttacatttaatgtagttattgatacactgtgtatctggggttaaatccaccaccctcctatttattttagttttgtctcacctgttctttattttttctcttttcttgatttcttttgcattaagcagtttaaaaaattattccattttctccttctattagtgatgtatcagagaatacataagctacatatttgtttcgtggtaaccctaataaattactacatacccttactgtgagaagtgttgaagttagcacttgcaccacttggccagacagtgcaagaatcttgatgcatttaaccctcctacccacccccctttactttgcatggtgtcaacatcatggggttggagtttctatgtggattttaaaccccacagtatacagtcaatatttatttagatttatctgcttctttacacttattaatgttctttattctttcctgcatttctgtccttctgttcagggtcatgtttcttcaacctgaaaaacatcctttaatatttcttttagggtgaggctgccaacaacaatttagtttctgcatattttacctctatttcatttttgaaggatatttttgctgtgtgtagaattctatgtcaacttttttttaagtttaaaggtgtttttcccttcatctcctttctgttaaaacgtcacactgactgtaagtcttaatattggtgctttgaaagttccctccccgcacccccctgtccagctgatttggtttgtattactttacggagatgttcttagctgtggactacttcatatgtatcctttttggtgctccttgaacctgtggcttgatgtttctaagtactatcacttaagacactggttctctgccattctgtctcccctgctgacgctcattggaataggttagaccttttcaccatgtcctgtacatttctcatgttctgttccgagtttttttcttgctgtaggtcactgatcctctcctttgctgtggggcacagtctgctgtttagccaacctaccaaattcttgattccattgtatttttctattctgtgatttccattcgattctttatcaattccagttctctggtgaaaattttcaccttgttatctcttttcttgtacacatcagctttcagttctagccctccttacatcaacatctttgaaatggggggtgtgtgttgccatcagtctgactgctgctgatggcctggactcagctgttgctgtcagcacagtgtggacttgagggcatgactagacagaggccagtatttgtgccgagagccacagggctcacccgtggagggaatctgagtcccgattgtggaatggtggtggcagcatcacgtcctgcaggctggagcccatgagtggtccccgagagattgcctccgagcgctgttaggagagggaagagctgcactcatgcacacagggtgaccctgggtgaaatgtaggctccatggctccgagggggaagtgggctcagaagagtgggcttctgatctgaatccaagaagggttaggaataccttagccagtttctgtggctgctttttttcttttgaaacaggctctcgctctgtcacccaggctggggtgcagtggtgcaatcacgggtcaccgcagcctcgacctcctgggctcaagtgatcctcccacctcagcctcctgagtagctgggactacaggtatgcgacaccatacctggctaatttttatttttatttatttattttttttcagttggagtttctctctgtcgccaggctggatacagtggcacgatcttggctcactgcaacctctgccacctgggtttaagcaattctcctgcctcagcctcccaagtagctgggactacgggcacgcaccagcacactcggctaatttctgtatttttagtagagatgtggtttcaccatgttggccaggctggtctcaacctcttgacctcgtgatccgccccttggtctcccaaagtgctgagatacaggcgtgagccactgcgcccggaccatctggctaatttaaaaaatttttttgtagagataaggtcttgctctgttgctcaggctggtctcaaactccagggcttaagcaatcctcctgccttggcctcccaaagtgctgggatttgagcatgaaccaccgtgcctggcctgcaggtaatattcttttgtgtatatataagaatttaaatgaggccgggcgtggtggctcatgcctgtaatcccagcactttgggaagccgaggtgggcggatcatctgaggtcaggagttcgagaccagtctggccaacgtggtgaaaccctgtctctactaaaaatgcaaaaattagctgggcatggtggtgggcgcctgtaatcccagttactcaggaggctgaggtaggagaattgcttgaacccaggagatggaggttgcagtgagccgagatcgcaccactgcactccagcctgggcggcagagcgagactgtgtctcaaaaaaaaaaaaaaaaagaatgataaatgagaaacatgtctgagtaagttgataatagctcttcttactaagtatcagataaaaattccaaagagaaagtgttgtgtcgtgtcatgtcatagtttaattggcagttttttccttagtgacatagaagacagtgatggatcgtacaacctttggcaccttagagtttatgaaaaagtagcatctgttctatagaaattatggccacactctgaggagcagagttggggacaagagtggaaggaagagtctgatggtgacacggtctcctgcaggtcttcccagagccccattcaccacccatgatcactccctgccccgtttcccattttctttatattctacccttttgcggcaagggactaacaagggccatgcatgcctggcaacacaggcggtcccatccttcgctcaagccctaagtgacccctgctggccgcactcaatggtaactgactgctggaaggatggtcagccactgtccccaatgcaggcagccccttggtccccccattcccatcgttccccaccccatctccccacccttctctcagcaggagcctcccccataccaccccaagtcagcttcctaaaatgccctgtggctctggctcacctgctggaaacaaggcaaggtcaaggtcaagctccaacccccacccccagcccagctgcccttgggggttttcctctccctctgctgcgtttccttctcttgggcctgctcatctttctcgggctctttttcttctttgtctaagtcttactgccgacctaccacacttaaggttctcttctgctgccatcttctgtcggccctggcccctgagcacgggaccaggattggaagtggcaggggttgagggagttgagttagggtgtaagcgtggctgacttggtgaaatcttaagatttgggggagatctgaagtgccttgctctcaatgtcagtattgattgtggatgggttaggaggaggagaaaaattccaagtctcagcacaaggcgggtggctgtgaggagcagatgcagttcactattgcagagtcggagccggagaggcagaggtggaggccgctgacgccaggccagctctctaggtctcagcagaggagtcgcgcgggagccccaggactcactctccttgctcctagcaggcctcaactaacaacccttctccaccacggtgttgagccgttgatgggggtgatatgagcttgtagatgagttggggagacctggtgttttgcacccgtggcagtggcacgcttcttgggctgttctgctctgctttttatgtccgccgataaggtcggagagtctctccccggcgctcctatgcacatcttgttaagtttcttcttagagcttctgttgctgctgggaaagggatcccccaccaccccccgccccctttcttagtgggttcttaggatggcgcatgagagagttgctctttattgcctcctggttctcccagtatgggtttttatccatccagtggttccaagacagtggctgtgatgaacggagttgccgcgagtctcgtggcatttggaccctgcaccgctcgagattcactgcgctgcacaccagggcctcggtaattcagtcaaaacaacagatttagaggtgtacagaaagggccattctattttccattttgtatatttcatgtctctttaaatctcttaaagcttagaacacccgtttttcatatgcctttctaaaaacttttttccaggcgatttttagatgctatttatgtgtagtaaaatgcgtagatcttgagtgtttagtctgatgagttttgacagttgtatcctcctgcttaatcacactcaaagcaagatggagatcatttccactccccagaaagctccctcagccccctttccagtcagtttctcctggccgaggccagccgccttctgcctcctatcaccagaggctagttttgcccatggaactgaacgccccgatgagttcgtcttgtctgctgcacagacaaaaccaattcacggaggctgcaatattgtagtaaagaaagaatttaactcaaagccttgcaggtggaaggacgggagttttattattactcaaatcagcccctctgagaactcagagactagggtttttatggataatttggtgggcggggctagggagtgggtgctgctgattggttggggggtgaagtcatggggtggggaaaatggtcttctgcactgagtctgcctctgggtggggccacaggatgggtccaggtggggtcagttggttgccagaacgcaaaactctgaaaaacatctccagtcttaggttttgtaatgtgttgttttctacaggagcaattggggaagtcgcaaattttataacctggccacgactcccgagcagcaaggaattatagaaaggcaagctagggatgatggctgggtatcattagtgacatctacatcttagcagaattcaggcccctcacataatcctaatctcatggcctttcatagtcttacaaaggtggtttcagtccctgaaccaggaggggaccagttttagggagggactgttatcatccttgctttaaagttcaactgcaaactaaattcctcccatggttagctgtgcctgcatccgggaatgggtgagggcagccgcctgtgaggttaggagggaggtggaatcagccttgccagccttttctccctgtcataatcttgcccaggtggcctcacttattttttacctttttctacagtgaccacatgtgatgtattcttttgctcttgcgtttggcctcgttcactcagggtgaggcttctgagactcgtccgggcggcagctcattgctgggtgtcccggagcctgcacatccacgcagggtgcatccaccctccctctcccacaggttcacgctgcacctgtttccagtgactggcttttagggataaagctgccatgagtgttggggtgcaagtcttgtgtggaccatatatttttatttctcttgagtgtatgggattgcaggtcattgggtggttgtatgtttccagttacattttgcaagccactctaaattgacaaaaatgacaaaaatcatctctttctttgcaaagccaggcaatctgcagaggaatctttatttacagtttcctccagcactctggagacatggaagcgtaggcatcagtgagctgggaggtatttggttgtctttgaatgaattattaggtgagatattgacattatttcccctcaaacagtccacattcctgaatggcagggagtgaaggcagcctgtgcttatgtttgtgcttattatggagtgtgcacgtggatctatttaccgtgtggaaaataatagaatgaattgcttttacacattactgggcttaagaaatggaaggtgacatagcctttgaaaccccctctgagcccctccccagtcacagtcccctctgtcttcctgagctcaccctgtcctgattgggccttgtgccttcctctgcttgagactggttctgtgcgtgtgcgtgtgtgcaagcaggtgtgtgcacaagatgggctggcctgccctgctttggcacggaagcatcctccgctgggtgtttgttctgaggctcatctcacaaggatctgggtcctcaggctcccactgctctgcatcttccccgtgacagccgcgtgggcatttgctcttgaccctgtggtggctgagacagaaaccttggaggagtcactcacttctgttggagcaaaatgcaggcctcctccagggctgcgtctgggagggacttgggtggtggagtgtttatgacttagcgcagagggctcttacgtgcaaaccatcttggctgtggagcgccctgttgcctggaaggtctgccttctcatgggggctgggcttccagactcctgaaatgtgctgtgaggcttcctattctttcttaatgattaaaaatacgatttcttctttaatgcccagcacaaatgcatttagctgtgtttatttttttccctaagtaacagaagcaatcctgagaaaataattcttacactcagtattgattctctgcttcatgtgctagggtgttccccctcccactgaagttgctgctgcttcaccctctcctcctcgatggcctaccatcctgcagcctcgctccctgcgcctgcccccttctccttctcctccttcccctttcagtgcttgctcttccctcctttccttcttctcttcctcaccccactcttcccccttttctcctcctgcctctctttccacctcctcctccgtccctgctggtctcctaagaagcacttagtagcactcagaatccttgaccttggcaggcttgggaagtgttggttaatgaagggatgtgaagacgaagggagtctgagtctccaaaggaatcatggctgttgggagtttgcttgattaggagatgggccgtttattacaatgtgagttgttaactctaaagtgcctgagataaatttatagtgtttatttgcttcagaaggagttggattttttcttacaaagtgaaatatacttttctaaattttatgtttatataaacataatttatgttgttatagttttaatctgcattactcctcaaaaggaacaaaaatgttttggcttttttctccctgagctgcagagacctttttctcctgcttctgtcctctgtattctccccacccctttctccctcctttcttccctctttttaatctgtcaattaaaatatttgaaaggatatcactgagatctttgggcaaggactttacctgtttttgctgttgtcaaccgagggtgcggtggctcctcccacctgctgtctctggtttttactgggcttcctctccattatcctaattaggtggtttgccggttgttacacatcaaagacctgagtttcctggcgaggagggagggaggcatgggagcccctcattaccggcgtgcatcctaaccacactgcttgttttcttcttgagaaaatttttttcttttcttttccctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttccatgtcctttcctttcctttccatgtcctttcctttccttttcctttcccctttcctttcctgacagagtctcgttctgtcacccaggctggagtgcagtggcgtgatctcggctcactgcaacctccgcctcccaggttcacgccattctcctacctcagcctcccgagtagctgggactacaggcgcccgccaccatgcccggctaatttttttgtatttttagtagagatggggtttcaccgtgttagccaggatggtctcgatctcctgacctcgtgatccgcccactttggcctcccacagctgggattacaggcgtgagccaccgcgcccggccccccaaaaatttttctttagaaatgatataaagtatgaagaactcttggaagatcttcgtcggaaagatgaaggaagtcttgtttgtctcgtaaccctggaggccactgagtatctctccctcccatctgcctgtgcccgtgtatcctgcgtctgttgtgaaatgtttaccatgccttgactgggacttgtgggctgagcagggaggacaaacgttttatttttagtgactgtccctcaaagagctatactttcgatgcctttcaatatgaaatagtaaaaatcttgccatttgatattacctaaaatattactcttctccaaagttggtttgccaaaataaattatgtttattatctactctttctccttgatattatctaaaatattattcttctccaaagttggtttgccaaaataaattacgtttattatctactctttcttcttgctatgagtttaagaagactcttgttccctctccctcgatcaagcctgctgcagacacagaagatggagactagaagaagtgctaggacaagctaccgctgtcttcagggtgaccctgaagagttaggtccttgccgtgagtataggtgaggccgaaacaagtgacccggaatctaatcacagcctgggcagagtgtaggaagggcgcaaggatgaaaatgactgcttggttggacgcagcaaaatgttgattattggccatatatgcgtcactttgctagttgctgtggatataacaataagtgatacctcctactggcaaagaattctaagtctgatagggaaaataaacatcattcattcattcattcagcaaatgtttattgggattccactgtgcttcagcctctgtgagcagcgcccaacattgcccctgctgtagtggtgcagagcctcgtggggagatgggtggccgagcagtccgagaacccacctaaggagtggatggtaaactgaggcagcgccttgaaaggaagaatgctgtctgtgaagggtgatggcgagttctcttgaccagaagccatgcgaattactgcccgtgtcctctgatcgagccttctaggccactaccgtatcctcagagaaggctttatagtccagccaacagcactccaggaattgtctactcaaggaatgcagtaggtggcacttgttgagtgcattctgtgtggttaggacactgattcatcagggcctggattttcccaataaccccgggaggaaggcgttcccgtctccacgtccctttcccagcgtgccagtgctgatggtaggttctgctggatccctgccccggtgcatgttgatctttccagtacagcttgttgccccccagggaggcagggaagtaagtccataccacattggaagagttagacgggtcttggagaggctggagggggacagccgggggaagctccatagaggtggtgacgtctgagctgggagcgaagggagaccagggctgggcaaggtgggcaaagtgtgagcagacattccagtggaagccagaggagcaggctggactctgcatttgttcctactggaataaggaacaggtgtttgagtggatacagaataaggacttgatcgccttccttgctgacaagtgcatcgtgaggtgctcttttttctactcatcccactttcgaagtttctttttcttgactattttgacttaagatgcccagagttaataaagttgcataatttatcttcccatttaaaagatgtcagtggaagtcatagcaaatagtaagcccttcgcacccatgacctttgtttagctgagtctcttgggacaaagataacaagttgttgacacacgggagagaatgttagtattctttgtggtttcatgggacaaatatggaggctccttcatttgcttgatactaactgcagtttggacttaagcctgcagaggtgattggaaagattttcagtgaaatgagtggtgtaattgtgattgtgataatgcaggtgactgcttttcattcattcggttcccaccggcagcctggcatttagaaaaaagttaacctttctgtgaaatcattttagtgggaaaatccacaagggtctgccattctgtcagcaacaaaaatgccgtgggcagaacgaccttcagatgggattctggaaccacagggggtttaatgcaaacagatgacatggaagctgcacagaggaaacgtctggtttcaggcgcgggcatctaacctgccctgttcttcagtgcaggtttcagataccacagcagtaaacagttaccacatttcccttagtgtagcaggcctgaggggtagcggagaggcaggttgggcctccactagacaaagtttatcctagtgagttcttttgggttcaacttgtcaaggagggtggctactgagaggttgcctgataatctccaagtttcttccatctccatccatttttactcattactagcctttataaagtacagagtgagataattttcatcatgttcctaggctggcaggcctgggttctaagtattacttgaggtcatagagcaggcttgtgttctttgtagaaaggcctttgataggtggccgcaggaggtcttcgcgccctgtcccctcagcatgcacttgttctcccagagtcggccatggccattcttccaggcttctggagaaaggacctcctcacaagcagacagcaaaataaaacaatgaccagtgtcagagaagatgacacccccgtctcccatgtttgcacgcctcagcagttctcagccgtatgcctatgcttttacaagtgaaaaccagctctttaggtcacttgcgtcacagggatctcctcttttctgtccagctacctggcagtcattattcctcattgtttattgttagaaaccttttgttcagcagagcggctgccccagggatcacaggcagagcgggtcctgctggagtttagtctcaggacagcggcttgtccgcattcgggtttgagcatgagaatgttgttcccatgatttcagagaagaacaactgttttaaaggtcagattttattctgtccagtattctgtaaaggacgagttgaatatcaatgaaagaaagagctttagtagctgtggcagtgctgtgggtctgctgcctcccgggtgcttctcacaccacagaggctggagagccaggtgcccctgcagccagggctttgctcggggacacgcttgccggaggccaggctaccctaagtgtgcaccgagggaggtggtgggacctgcccgttctgctggctcagcaggagcagccaggggctgggggcttctggggctttctagggcgtgggaatgtgggtagggggcatttcccagctgctgcacaggccactggtcctggcctgccttccctgaaagctgagtccaaattcttcttctcttgcccttgcacggaatctgtaagtcacagaacacccggagtgctgcccttgctgcattaatagcaccagtggtttctggggaacttccctgacctcatccctgttgcatacagtagttcattctttcttttttttgagacggagtttcactcttgtcgcccaggctggagtgcagtggcgcgatctcagctcaccgcaacctccgcctcccaggttcaagcgattctcctgcctcagcctcccgggtagctgggattacaggcgtgcgccaccatgcccggctaattttgtatttttaatagagatggggtttttccatgttggtcaggctgttcttgaactcctgacctcaggtgatccgcccgccttggcctcctgaagtgctggattacaggcgtgcgccaccgcgcccggcccagtagttcactcttaaaacgccttgttatgtttctcccctgcgctctggtgacccccagacctctccatggagggacaatcttctgcaccaggagctcttcccctctgtggatcatctctctttcctcttcccttcctttttttcctgatacttctgatacttattcaaataattcattttttttgttcttcagtcgtcactttcatgtttgatttctgaatgcctctttaggcctggcctctgtctttgctcaaattgtgtatttgagacagtctacaacatcactcaggtatctttagatttgtcttgtctgagtggaattcatcctaaaattggaagctttagatgtacaagagatctgaataatagtttaaaaccattaccctcatctgaaagataaggtggtggggctgggacagagaaagtgacttgctcagtgaaatcgactgcagaccggactccgggtttcttggtttcttgttcactgtaaggtttgaccttaagccagtttcttgtcacaactgtctcatttccgaccataatacagagaacatcacctttaaattgtccctcttttatcaccatccacttagtcaccaggtcctacccgtcccttgtccgtgtcgggaatttgcgccttccctctcctttcccactccttgttctaattctcagtctttatacttaagcctcactgtcatgccactgttgccattagattttctgcttctgacctttttaagccttttaaccatccggagcgttgctgtcagcactcgattttgacatgacgcctgcccgctgcttcgtctttttctatttgtaccctatttttttgatggcactcgctacctctcacacactgtgcagttttcgtatttattgtgtttagggtctcttccccacttgactgtgagctgtaggaggccagaaattgtaatccatttggtaacagatgtacctacagctcccggccaggtggtcatccgcagtccacacacgcattcagctctggtatacgatagatgtgtagtgtagcagcacctggcgtttgcctgtagacgacacacagtagttgttgaatttgtgggacccttgataatcagccccccaactcccccccacattcatttctgattactctgaagcataaaccctccccggtagccacaagggtctcctcggtcaggggaatggattctccctggtcctaggggagcacacgctcgtccttgttaccctctctgtggtggagctgggttgcacactggaacttatcctcgccggggtcagtgatcctggaggtcggttgcctccatattgagcccctaaagcacctggccctgggaagagcgtgggccctggagcgtggcccagtatttcctcttctgttttgctgtatcctgaatttctcttctttttctttcatttctcagagtccaagtcacatcctgcttcctctgggctcaccatctctgccgtgttgctccacgggcccctcctggcctttagtgccctctgcagcctgtgctcttcgtccttgtgctgcccggcagccgatggcctttcctccaggctcggcacagtaggaagcgccaatgttcctgataatcaaatttatgggcgtgcgtgtgagagagagagagtgtgttcctgctgaagcatctcggttaaatcaaaacactctgtaattattgggttcttctttcctcttgccagaacactctctaattattggtttctttcctcctgctcttgacatttgatgtgtctatttgccctctctgtcaatagtgctgagtagaatactgcaggcacaagtcatgtttttgtaacgattttcgacagattagcattcctttaaaaaagaacttaagtcggttggggaagggggtccactcatattacaagggggatactttcaaaaatccttcaaataatggtaagagaagcagctttgcatagttgtgagggaacctggggcttactggagaagtgagcacacttctccaggcatgccatctgcagccttccttttctttctaggctgacctatggtcttctggtcactagtcattccatttggcagtagaatcaccttctcagttttgaaataggtgtaaccagtaggggaaaaggattgtggtgtgcgtggtgttctttgcgcacaaagatgaccgtggaatttttgaaggaggcaattattgtcattgtttaatatataactggaggcttaatttccaagtagctgttgtagcattaaatgtccctggctaggtgccagtagctatttccattgtacattgaatctattgcttctttttaaaatacaatggttcgtaggttgatttatctttattttaaagaaagggctaatatcacaaggtaagtttttgagcagatactatattacgaagtgttctgactcggatactggagaggaacagtggccctggatacctcctctgtgaaggtcaggttaagatctctttatgctcacagtataaagattaggtttggctgagagttacaggggagaggaaataacaattgtgtaactcaaattaaagtttgttcactcacattaagattccctagaagtagtcattccaaggctgtttagtgctccagcatagcaaggcctcgggctcctcctatgtttactttgctgtgcaaaggttctttttttttttttttttttaaatggttacctcattgtccaagatggctgctcaagctccagccattgcatatatgaggggacttcaaaaagttcatgcaaaaaaagaattaaaagataaaaataaaaaacaaacttctcagccaggcgcggtggctcacgcctgtagtaatgccagcactttgggaggccgaggcgggcagatcacgaagtcaggagatcgagaccatcctggctaacacagtgaaaccctgtctctactaaaaacagaaaaaattagccgggtgtggtgacaggcacctgtagtcccagctactttggaggctgaggcaggagaatggcgtgaacttgggaggtgaagctttcagtgagccgagatcgcgtcactgcactccagcctgggcgacagagcgagactctgtctcaaaaaacaaacaaacagacttctcaacataaggtctaacaagatcaagacacttttgtaaatgacgataccacccatttaatctgtccctaaagaacggagggttctaggagtttaactgtgtctatacagtctttttacattattttattttttgagacagaatctcattctgtcacccaggctggagtgcagtggtgcaatcttggctcactgcaacctccacctcccgggttcaagcgagtctcatgcctcagcctcccacgtagctgggattataggcgtgtgccaccacgcttggccaatttttatatttttagtagagatgcggtttcaccatgttggccagattggtgtcaaattcctgacctcaggtgattggcctccccaaagtgctgggattataggtgtgagccgccacgcccagccctctttttacattattaacagaaggaaaaatacgtttcctgtaaagattttttaaagattaggaaacaaacaagtcagaaggagccaaatcaggactgtaaggcagatttttaatgattgtttcccatgaaaactgtcacaaagttccccttgttggatgcttgttttggatgcgagcaatgagcaggagcactgttatcactgtggaggtggagggggctccctggtgacactttcctgggcatttttctgctcaagcttaggctttctcaaacactcgtaacaagcagctgtcatcgttgtttggcctccagaaagccaacaagcaaaatgccttgagcatctcaaagagcggttgccgtgaccttcgctgtcatccagattgctcttgctttgatggagccacttcttggtagccggcgctttgattgtggtttgtcttcaggatctgctgggaaagtcgtgtttcatttcctgtttcaattcttcaaagaaatccttcagggtcttgaccccatttgtttgagatttctgtctaaagctctgctctggtctgcagctcatctgagtgcagcattggcagccatcaaatggaaagtttgctcaactgtaattattcagtcagaattgtgtaagcgcgatggagaggtctgtgatactggctgttgtttgtgttgttaattgtcagtcctcttcacttagggcatgaactagatgaagtcttgccttgcaaattggtgtggttggtctgccactgagagtgtcatcatcttggccctccttaaaattaattgtccacttgaaaactactgatttctttggtgcattgcccccatcaactttttgtaaagcaccaatgatttcaccattctcccacccaaggttcattataaacttgatgtttgttcttgcttcaattttagcggaatttgtgttgctctgataagggctcctttcaaactaatatcttatccttcttactgtctcaaactagatcctgtttacacatgttatggaacaagttagtataagtttattttggggcaaaatgttttttgaagtacgtgcatagttttttttcttgaacatgaaaaccctttgtacatttcacctttccggaaagaagaagtagggaagaagaccccactgttttcctttaaggatgtttcttaaaagttacactcagcactttcacagggaggctggaaaatatctaggtgaccctgtgtgcaaatgaagaactggggattctagttatggaagggtggggtggatactggggaaaacgaacagcctctggcataggcgccatcctggctgatgctgagtttcttcttttctacctgagcttagctaaaatctcgccaccacgcccagaagagaatgcatttgctttggagttttctgtaatccttctgaattggttctaaattggtggccggcgcctgtagtcccagctacctgggaggctgaggcaggagaatggcatgaacctgggaggcgaagctttcagtgagccgagatagcgccactgcactccagcctgggcaacagagcaagactctgtctcaaaaaaaaaaaaaaaaaaaaaaaaaaaaaaaaaaaaaacaacttctcaacataaggtctaacaagatcaagacacttttgtaaatgacaataccacccatcttgggatatgatcaaatatacactaagaatatggaaatgaatcgtcctgacgtggaggtagaatactcaggtgaccagttgcttccaactaggactcagtcacccctggcttcagaagggcaggagacacgctgtgagaagctgtgagagtgttggagatttaggatgattctcagttcgcagattctttgttcagctatgtccagtctgttttgaagcctttccattttcattttaagttgttttttttcttacaaattctgtatagttatttatttctgatttggatgtctgaagtctttttgtatctgattcagctacagtttttgttggctgttcgtcatggtgcctgtttcctaatgtccttttaaattttgacagttattttcctttgaaattgaagtatgtgaaatctttgaagcttgggatgaagttggcttcttttaggactatgaagtttgcttctatcaagtgcttacaggtcctgacagtctgaggttttctatcacacccgggtcaaggccagccatccctcctctctgtttattactaggctgaggggcagaaacttttccttgcagtgccccggtggggtgggtttactttcgggtaaaccttgctctgcgtctgcagccctctgcacacccactcttctggagggatgccctccctcagacaccatgccagcacgggccttgggcgttgcctcctgcccctcaggccgcccatgactgcaacgccccactccagttcatgggctcaggcccgcggaacccggctgctctgctcaccgggctcgggcccgcagaacccggctgctctgctcaccgggctggccccagcttcactgctctcacaccagcacatccgtgaatttcagaacgtgcccctgcctgcttgtctgccccccacctccaagcattttcacttgttagtgagaggaacctggagcctgaatccaccacattgctggacattttgtgcttgtggtctttttattaccgcagatgtgatttccttgcttgtttcttcaagagcctactcttaagaggtatgatgaaatacttttgagagtgtgaatttcactaaatcacaaaatctgaaaggtgtacaagcagacaattctgaaagaaatagaaaatgtagctgagtgtctagtatcaagtgtagccatttctggtgataaattattatacgcattaggtggatagttttgtttactaagaattgaaggtaattctggaaattgataggtcagcaagcctttgcttagtgtgaggctaaggagtttgtcgtgtttatgcaaaatggtaatgtcctactgctgctttatcgatatggaaagttccagtaggttagaagtggttaagtaaagatgaatggcgaatgggatttgattaaatgtaaaagtttctgagggaagtgaatcactgtgtagatggagtcacccccggctattgatttaaatgacagttcagaaatagtatcaaaagaaacaaaatggccagcgtgtcaagaaaccagcagctcttctgttccggggtagccagcaccaggcatcagggcccccgggacctctggacatcagcgctgtgggtcgtcttggaattgacacttgagggcagatgaggcagcaccagctcctgggtgcctctgcacccagtgccctgtctccgcagtgagtgaggctggaccgggtgtgccagcatctggaggggtctgcagggtcggaatactgcatacagttggattttgaggtggagcattagctaattaactgcaaccaaaagtaaagtagcagggtggctgcttctccaggcctggaagcctgcgtggtggctgaactgcggtccccactgcagcagaaccgggcaggcctcagtggcctcaggctctgtccctgtgtatttcatggagaacagagtcagggaggtgcagggctcatcgctagccagggcacagcgggaccaggcatcctgatttgcagcctggtggcctttacctagtgccgcctcatctgacataaagtcacccgtgtgggggagagctgtattttaataatcagtttcaggtagatcccggaaacccaaacatatagaaaggtgagggacttcggttcccacctcctgagcaggtactgcctcgtgccagtggacctgggagggcgggaaggctgctctcaggggcacgctgttgcattatgccatgttgttcttttggttgtttattgtgatgagctcttattgtgataagaaaaataatcattttctcatctttagcagtgaatatacctcttttttaactgccatgttaacgtttgcctttgacagtgtgctctgagagacacaatctatgcttcaattctatgctcttcagctgtcataactcttctccatgtctttgaagtgcagtaaagaaagtgtaacccaaaaactgaacagtaattcctaaacttggcacttgctctccactctggagacattctaggtttcatttgagagggattttggcctgcttaaagcattttaacagcttttcgttggccccagtacaaagtctaaactctttacctgggaggaaaaattgcttttgatctggtccctgctctctaccacagcctcacctcccaccttccctcccaccagactccagcctcacctcccaccagactccagcctcacctcccaccttccctctcaccagactgcagcctgactgctgacatttcagtgtgttccaccttttcaggcgtttgctgggcagttttctcttcctcaacttgttaaattctattcatgcatcgagtcttgctgttgatgtcattttctttggaaactgttcctaaatccttaatcctttctaccttacaaaagaataacaaaataaaccccaagaaagatctactcctttattctttcacaggatatgattcctactccatcattgtcttcaactgtatggtgtgttgttgcgatgatcgtggtagcaggattgatatcagtattgctcactggtctctagtcttctagaaaataagggatggggacttccaggtagctgatgaaatggttgtgtcttaggttcctgtctccaaagtatttcctccagaataatgtagaagaacaagaaggagaaaagtaaactttgtaaaagccatgtcctcagtgtgaaagacacaatatactccaacttgaaaatcgtaaaaagaggtaacacccaatccaacatggaattcctgatgttctccatctccccactaccacaaggctctgtccaccttgggttgtaggtagttgacagaaaattataggtacaagtttgcagcagaaaaagacaaaaaggaaggagaaggaccttttgacatatgggtggatggcgaaaggaagaagaatcagcaggggaaatttagtgtcctgtagacagggacaaccacaggttgggtgtggtggctcatgcctataatcccagcagtttgggaggctgaggcaggcagatggcttgagcccaggagttcgagaccagcctgggcaacatggcaaaaccctttctctacaaaaaacaaacaaatagtattgtacaaatgagtttctggtctcgttaattatactattgttatgtaagacctaatggtcgggcatgttgggttaaggccatgtgtactagctttgcaacattgctgaatatctaaaattatttcaagataaaaattaagaaaggaaagcagtggttatgcctgtttatacttgagccagagcaacgcctgactcagaatagacagtcacccattcacgttttctaacttcagattgtgcagttgtttgttggttcttgggtttttaaataatgcatgaagaaggtggaaggagcggcgccctgggattgcagtatcgtggtgttgagtcacttgcgatctttccggttcagtgactcctcagtgtgcgtggattggggccctccagagatgctctctgtctgtgtgtgtcatcgcagccctctgctgtccatgcccgacaagccagtggctttcactgctgtgtggggtgggggcgatgtttgtgtttgttttattccaacagtggcttcgtttctcttccagggcatttctctcgctcttcacaagaagtggcctctgcttcttctgattattcacactgtccattattgattactccttatcccctttctttcctctgcatgaaaggcaggtctctgccgggcgcagcggctacctgtaatcccagctactcgggaggctgaggcaggagaattgcctgaactcgggaggcggaagttgcagagaatggcctgaaccccagaggtggaggttgcagtgagccgagattgtgccactgcactccagcctgggtgacagagtgagactcccatctccaaaaacaaaaaaagaaaggcaggtcttttgtgaattgacggctaggctcacttcctggagggcagtcggctggctcaggcacagggcgggaggaaagaggcttccgcacagccacgttctcctcattcctcacctcgtagaaaagatttttggggggtggtggttaatcatgttactctaagttttcgtttcctttttactcggctcaggaatagtaagatgcctttacaggcccgtttgaatgcatttaaacttaagaatttctgtcatttttccctccctttttgtttctcttagcttattttttgagcctgcaaactttaaatttttattattctgagaatagcttatttactaacttaaatcctgttttgaaaaaggcaggttgtgaaaaagtaaaccataaatagtttatagctgtaaggagttgaagtgtcttcagaattaatatttatgtatttatttgaagctcagtttagctgttgtcattcaaagttctgcctcaagtatgcccagatcttgtcagttacacagccttcctttctctgctttctcttcttcccaattcttccagcatctcaagaggcagggttaacaattccactcccaggctgggtgaggtgtcctctccacggttccccagagcccagagaggcggagggagccccatggtccctgtcctggagaggaagacctcccccagagtccagagagagggatggagcccccatggtccctgtcctggagaggaacctccagttctcggtcagggccaagacccccaagtgggtcacagttacttgtttttcctcttgccctcctcagcctgctggctcttctgtgcaggacctcagactgccaggctcctgctctcttcctccaggcacatcttctcaccagaactccagccctgcacctcagactccctgttcattgtctcacctcagccccatctcaagtctagaaccccctttctttcttgttgacttattccgttctaactggaatcctagaagagaatgacaggatgatggtgctgtgcctctgaagggggtttgttaaaatactcagaatcagcagggcacggtggctcaagcctgtaatcccagcactttgggaggcccaggtaggtggatcatgaggccaggagttcaagaccagcctggccaagatggtgaaatcccatctttactaaaaatacaaaattagctgggcgcagtggcaggtgcctgtaattccagctactcaggagaggcaggagaatcgcttgaacccaggtggcagaggttgcagtgagccaagattgagccactgcacttcagcctgggcaacagagtgagactctgtctcaaaaaacaaacaaacagacaaaaactcagaaccatgcctagaaaatactcagggctccctgtttgttagataaattgttagatcagccaatgagtgacatattgcatcttgtatgctgcatcccaggggatttagttagtgacagaggagaaatacagctcctttgcaagtggtcctgcgtgccgaggcaaagatccgcgtataaaatcccacgtcgcacgtatgtgctgggctcgtctgtgaacaggttacatggaccctctctagacccagcagatgggctttgaaatgtggccttcgtgttcagctggcatttggttttcaccaggagacaacagcaaacacacaggcggaagaggagagggagcccgtgaggctcattgtcaatacaggggagacagccactcaggacggggcttcaaggcatgcatgggtttgacagaggtgaggggcctggcgcactggagtccaggctcatggagggaggggttggtttggcatcttctctttagcacctgccacgtgttctgcggaggccagttagtgtcagtcagcaaaacaccacctccaaatgctggcagtggagtgtctcgctttatttttttattcagatcgataactcctaggaaaagagcatcttttagagtcacctgaaactaaataaagagcagagtgcctgagttgtggaaacactggtgctgtctgggcctcatggcagaaagttgcggggccgcggctctcgttccgtcctcacactgccctgctagagtgcgtgcgtgctgtgtgcattcctcatgccgctgctgtccctggcaggtgacagttcaggggcacctcgcgctgtgggtgagttctcgagtgctgcggggagtgtagggaaggccggtggtgcggtatcgaggaccaattctgtgtgtgtggttcaacatttctagttctcttacaccttcatgaggtgtacgtctcttacaccttcatgaggtgtacgtctcttacaccttcatgaggtgtacgtctcttacaccttcatgaggtgtacgtctcttacagcttcatgaggtgtacgtctcttacaccttcatgaggtgtacgtctcttacaccttcatgaggtgtacgtctcttacaccttcatgaggtgtacgtctcttacaccttcatgaggtgtacgtctcttacaccttcttgaggttgaatttcatttgattcttaaatatttggctgaaaaattagataataaacgtagttacaatctctcctgtcatgaacactgaggaagaatgaatttgtctaaatattctctcggtgtattagaatattggtaaatgatgtggaatcttcctgtatttgatgtgatataatcttatcagttctttaaaatgatgtagcaggctgaccgttggccccccaaaagattagccacatcatattttctggaacctgtgaatattacctcatgtggtgaaagatgtgattaggtccccccccccaccccaaacaaagtctcgctctgtcatccaggctggagtacagtggtgcaatcatgggtcgctgcagcctcgacctcttgggctcaagccatcctcccacctcagcctcccaagtatctagaactacagacctgcgccaccacacccagctaattgttaaatttttttgtaaagtcaggggtctccctatgtaactcaggctggtcttgaactcctggactcaagccatttgcctgcctcagccccaaagtgctggattacaggtgtgagccactgcacccagccaggttaaggttgttgagagggagagcttatcttggattatttgagtgagccctagatgtaatcacgggtgtccttatgagtgagaagcagaggagctttgagtcagacagaagagaaggccatgtgaagactgaggcagagctgggagtgatgtggccacaggccaaggaacaccgaggcgtgcccacggccaccagaaactggaagaggccggaatggatttgccccagggcctccagagggagcgtggccctgctgacttagtgattttgcatgaatacttgagtctatagagtttgagaacaaggactttctcttacataaccacagtacatttatcaaaattaggaaatataacattgattcagtcctgtgttctaatttgtttcctttttttttcttaaaaaaaagaaaaatagcgtcttgctgtgttccccaggctggagtgcagtggtgtgatccatcatagctcactgcagccttgaactcctgggctcaagtgattctcctgcctcagcctcctgagtagctgggaccacaggcacgtaccactacacccagctaatttatttattttttgtagagatggggtttcaacatgttgtccaggccggtcttgagctcctgggaaccaagccatcctcctgccttggcctcctagactgctgggattacaggcgcgagccaagcgctcagctgatcgaattcatttcttagccagttgtttcagctccgtctgtggcagcctccgcactggcctgggagcggaccccggactacacacggctttttgatggcacttcatcctcctcagctttgctttctcagtctggccatttttgaaggatgcgggccagttcagttctaatcctcagtttgcgttttcctcctgtcttctcccgacaagagcagggcaagcatctgtggcaggagggctgcagaagtgatactggggcttcctcaggtgctgtcggaggtgctgatggcattttgtcccatgattggccatactcattttgaccttgattaagatggcgtccccacatttctccgctgcggagttgttttccctttgtaagtaataaggactctggctctgtgcctaccctgttccttgtgctggttttgcaaccatggataattcttgcccacatcagttatgatcgtgatggttgccaaatgctggttttctgattgtatgtttttcttcccttcgcccccattcattccttcattcattcctttatatcattctaaaataaattcttattttatcccatcaatcatctgctactgtcattgtttattttgatgctccagttgtccctgatttcgctgccaccctccaagctcactcctgtccatgtgttttatgtgttctcttcactgttgagcaattccttgctttcaggcacgacaaggtggagcagcctcatattctacccgcatggctcaagtcctggcatcagccacgtttccaaggagccctggttccttttctacagaatgggacttagaagccaagatgtcggctcctggcattgactccctcatcctcaacatgccgctcagttgcctggtgccacaatacacaggaagtaaattcagaattgccgtctcgtaccatcgtaaacaaactttctcacgtgaattcactatctgttcccagttattttctgcctgtggactgaggggtggagtcaggtgtagatgccatggtcagagttacttgggtgggctttgtcccctctgttccgggctgttatttgcactgtactcaagttcacgtgtttagtttgtattctgttccgttgcagggctctcttatccttgcttatttcttcttttatgagtatgtaagttattaatgtggttctgcaagtcaaaactgtataaagctagagtcatgtcatctccccaatcctgtttccaggctgccttgtgtttcattactttcaggcatatcttgtctttcttttttttttaaataaggagatacatgtttatttatttatttatttatttatttatttatttatttatttatttaatttttctggaggcatagtctcgctctgccgcccaggctggagttgcagtggtgtgatctcggctcactgcaagctcctcctcccgggttcacgccattctcctgcctcagcctcccgagtagctgggactacagacgcccaccaccacacccggctaattttttgtattttttagtagagatggggtttcaccgtgttagccaggatggtctcgatctcctgacctcgtgatccacccacctcggcctcccatagtgctgggattacaggcgtgagccactgcgcccagccatgttattttcttatatcctgctcttacatggcaagatagtatactaggtatgctcctctgcactctgctttttgccactacacagcgtgtcctggaaatcactccatgtcagtttctagggactttctcttccttttttgagagctgtatggcacttcattacgtgagtcaacatcttaacattgtaacattttgcaattacagataataccgcattgtataaccttgttcagatgtattttgtattaaggctgtatcttcaaggtaaatttatagtatcactgggtggaaaaatgtgtatgtagtttttttctagttattgtcaaattcccttcctacctcaggattgtatacccttttccattcccctcggcaacataggagagcgcctcattcggagtcgcccctcattcagggtcgcacctcattcggagtcacccctcattcagggtcgcttgttgcgttttcagtgtatgccagtgtgtgcagtctgggagatgagaaatgctctcggtgtagttttaatttgaattatttttattgtaagtgagttgaggtattgctctgtctcccaggctggagtgcagtggtgtgatcttggctcactacagcctcgacctcctgggttcaagtgaccctcccacctcagcctcctgagtagctgggactacggccgtgtaccaccatgcccagctaattaaaacatttttttttttaatgtaggaatagagtcttgatatgttaacttgaactcctggggtcaagtgatcctccatccttggcctcccaaagtgctgggattacaggtatgacccactgtgcctggctaatatttttgtatattcagggccatttccatatatatatatatatatatatatattttttttttttttttttttttttttttttgctgtgaattatctgacatgtcttttgccatttgcctcatggaatgatttatatttccacgacttttaattcctagtgacagctgctactccccacatcgtggggtgcttcctttgagcttcttcccagctgcctctggctgttgaactccctctagtcgtaagcgtaagatggacccccagagtcgtcctgggagcagcactcggaaatgcccgacaagaaccctatttctcctcatcaggtgggggcactttccagtcctcagagctcttctgacagtgttggtggcctctgcagagggcagggtcatcctgtgcctggagggacataagcatggttagaggctttctagaagggattcaggcctccgacccatctggtgctgttcatttttgagattacgtgtctctaagataaaggattgggaggatgggccatggtttatagagcactggtcactgagtcttcctgtgcccagatgtggggctcagcacttgctatgcataaactcacctgagcttcataacaactttttttttttttttttgagacagagtctcgctctgtcgcccatgctggagtgcggtggcacgatctcggctcactgcaagctccgcctcctgggttcacgccattctcctgcctcagcctcctgagtagctgggactacaggcgcccgccaccacgcctggctaatttttttatttttagtagagacggggtttcaccgtgttagccaggatgcataacacctcctttgaagtagacgcaaccattgttcccagttcacagattagaaaactgagacttaagtgcgtcactgtctagtgcagttctaccctcacgacaaagccatgtttcttccccgtgaatgaagagaaaggtaaatttacagtatttgcctttcgggactcattggtattctctcttgaaacacttcttactgcataattcagagttctcggcagcgtatccatctcttagaaagggctcttcctgggaaggctggaaagaaaggctctcttctaacgaggccggtgtctcaagcactccactaaatatgaagaggtacttgcttgatttttacaaaatcagctttgtgagaggatgagtggtccagcccctcgcccagctgtgtgagtcctgagcacctgcgcttcagagtaaggctgttggacctgggacccttccatgaaatttattttcaatcttgaatgagatttactttaatgggaggccttaaaagcagatgccatgcgagttaaaatcacacagcttattgcatctatcagttccagtcagagctgatggcaaactcttgttctttcagttcagtaaccagagagtggaatctgtctgtctgtgtcttccataaccaaaatacatcaccccacgcaatgcctcctaataactggggctttgtggtcagggtttttgcagggcaggccccttttctgcaggcaaagtgctaatggccagcgcctacactgcaggcctctggcgcattctctgccgagagttctgtccgtcccacttctcctcactgtctagtcttcttctgaccctcccagcctggttcacgtttgctcttcgttaccctcttcctgtttctttctcctgtctctcctcccaccacaccatccctcacatgcaccatggggtgctccttcagattgtcatctgatcgagccacagtcccactcagcccatgtttgtcaggactctgccactggtcacttgtccacaaggaaccactgtctttgagcttcttcctccggtgctcttagcatctgcccacactgtatctatctgtgtccaggtcttgttttctgtgtcattgtttgatgaaaggcagggactcattcggtgagtgggtctcccctgcctctgccccacaccagcacactgctctgcccttggtgggcacccgttggtgtgtgttgagctgggtgttgtacctcggtgtctgcgtggagaaatgcgaacagtgagtgccacagcacagccacggaatggttgtcatcggcttcagaaggggaatgaaaggggcagcaccgtgggtgttgatgatctccgaggctgcctgtttagagcgtcccttccctgagatggaggcgtagcttcaccgtgtagtgtttaagctttaaaacgtgaaatgcagtgaggccgacagtgagttgtaggaagctcagaaatgggatgcccgcactgccttcaattcaccctccattgtccatcgccgctggcatacccaggtcagcgcctgcaggcccctgtctcaaaagatgtggccggcttcttgtcccggtactgcctgaagcttcacctcagcaccgctagcttcacactggccacacccacctccactcagcagtctccatgctgtagcccaaagcatgtagtggcggttgagtacctgagtgggggaaataattaactgggatgcttttattgataagtagtcagatgcctgttaagtgacatttatgaacactcacgtagcactgctgcctgttagccaggcactagtcaaaggacttttgatgtattagctcatttaatcttcacagaaactagaagttagacactatcctctccactcccttcacccccagccccaaacacacacaattttatagccgaagaaacggaggcacaaagaaggtgaagactttgctaaagtcacaaaactggtataagcatgggctttgtgtgtgtccaaagttcatccctcaaccgtttctctctggatcaataattaaaaggtttatcaagaagtctgaaggtaaatggttcagtattgtcaggttctggataagtttctctgtgttcttgacttttccctcatgatgacaagaaggctgccaccactccaaacatcacagcctcacagttgtgctcaaagggagaaagaagaagggacggccgttctcctttgagcacactgtttcactggcttcctgtgggttccactggcctgacttgatgcctgggacactttaagcatctccggtgctatgcgggctgggaagaagtgagctgtagaggcagccagtgttactctctgctccatcccttttttgttaattttgcggttactgttatttaaactagatgtatctctagggcagtggcaggaatcgactccaaggacactgaccagcttggggctgctgcctggcccaggccggcgcatgttggaacacagactctctgcccttccaccccaagcctggtgggcgagtgagtctgcccagagggagtgcctttttctgctttacacaaggcacctcaaggggtagaggtggcctctcctgcagaacggcagctgccctgttgccgttctgataaattgcaagataaaactgaagtgcaaggaaggggcatttttgattttggatatgactttgcctaaaaatggcaccttaaggtgttttaaacatttatcaaacggtttcatatgtatggagtatgtctgtgcagcattcttaaagtgacaggactaccttatgaagtcagtaaatcctttcatctccccagacagccagaagctagtcagcagatgaacacattcacttgtatgttccccttggcaacattattcctagagaggttgcatctgcatcttggagtccgcatgataaatcatttatgtactcacagaaaccatgcactcccccgtgggaagagttctaggtgtagcaggggcggaggacgccacctgctccctgacatccgtctttccgaagccatcgctggagccctctgctgagtgtgggcagtgaggcctcgtcttacgcatgtggtcagaggagataatgtggctagaagtgctttgtaagcgccaaggattgctgttatgaggaatttactagatttcaggctttcatcagatagttagcgaggaagcgcaaaagcacagcatggtctccatgtttgctgacctgcagcgaaaagtcagaaagctaattggaggccattcataggctgattctaccttacaccatcattatactttttgtctataagactggagaagatctttctgagacatatcactatcagtgttttacgcgtatgaaacatatttttctttccttctttatgttcatttttaaaatttttgatcagtgccctcaagcattctcctattcaatagaaaacatatttttctaggtatgataatctttcagatttttggtatgtgtacctttgctaaaaacacatttaatatttctacctgtctggacaccttttaaaaatgtctggctgcaccttggagaaacgcttcatgcaagcagattctaattaaagtaggaaactttactttaccattaagttatatgtaaaagcattctaggggagagtcttttaatcattgaaacattttcaaacgtgtttgctcatttgcttctttatttgtttttatggcttattcatttgtttatttttaaactttttattatgaaaaatttcaacatatacccatcatctatcttcagtcattttcagctgccagttccagtctcctttcatctgtgcccccacccagtccccccttcccactcccctggctgattaggaagcaaatcccagacttcatgtaatttcacctgtcaatatttctgaaagaaatatttactttctctaaagataagtatgcttctaaacacacacacacacatacacacacacacaatgtttgtttgaatcaggatgcaagtgagatgaatgtattgtgagttacttcatctattctgttaatccatgtaattaatccaaaagtcagtccctcaccccagcactctctgtgcacctgtctgcctgtctctttctgcagttgattggttgaagaaactggatcatgtagcctgtagaatttatcgtggtctcgatctcgtcagtggcttctccccccttgccctgggtgagccacactcacctctgctccttggatttcctctcggtggtggacacagccgggctcccctagattctggttcagtcagggaatgtttcatgtgtggtgctgtgtccttactttaggatatctgatagtccctctgtgatattagcagctattgatgatcattgtctggatctatttattagagattatgaaaagatggtgttattgtttcattcctttttttgcaacaggggatctcacttggccacccaggctggagtgcagtggcgcaaacatggctcactggagcctcaaattctcgggcccaagtgatcctcccacctgagacttccaagtagctgggaccacaggcacatgacactatgccttgctaatttttaaatgtcttgtagaaacagggttttgctatgttgcccagactggtttttaattcctggcctcaagcaatcttcctgcctcagcttcccaaagtgctggggttacagatacgagccactgtgcttagctgtccttatttgttaactggagtatctctatataaagaaaccctctcatcaattatttggatagctcaaggtacagtcatagaggaaagccagcatcaatacttactttcctttattaaccagttttcaaaatcgtgtgtgggcttctctcaaaggtgactagtaaggggtgtgtgggtgtgatatgtgtgtgtgcatgtcgtgtgtgtgtgcatgcacgtgtgtgcatgcataggtatgtgtgtggtgtggtgtgtgtggccaccctgttgaaggcactacctactgtattcgtttctcactgcatctctcaaaggtgactagtgtgggggtgtgtgtggatgtgagtgatgtgtgtgtgtgcacgcatgtcagtgtgtgcgcataggtgtgtgtggtgtggcgtgtgtggccaccctattgaatgcatgacttactctattcgttcttcaccgatgtccacgtcgttccatctttgtgttggcccctgagccttgtgatgcagttctcgcggtcctcaattgcttcattttgatatggtatgacaagccagcatgttctgtgccattttgtacttcttctaccctaggcctgaaatcagccacgtgtctgtctccagggagtcttggtttccttccatgggaagtggtatggagagcttaatctgggctccagggctgctcattgacccttgttcagccccctttctctatgggtgtttcaaagataaaatacgaaggcgctcttacacatccaggttcaggtctgcaaggtctgcttactctcatgggtcctacagctgtatctgcttctttccacatggagtgctcagattgttcatgaacaccaacgtaattacccattctcttatcctgcaccacacctggcagtttcagaaagcaacaccagcactgccactgacgcggttactgagagccgctgccgaggcatagccgctgctgaggcactcgcccttccttctcaggttaggcacagatgtcgagtgacattaccctgtatttttatttatttatttttgagacaggctctcactgtggcccaggctggagtacagtagcagaatcatagttcactgcagcctcaacctcctgggctcaagccatcctcccacctcagcctctcaagtagccaagactataggtgcacgccaccatgtctggctacgttatgttatgttatgttatgttatgttatgttatgttatgttatgttatgttatttttttgagatggagtcttactctgttatccaggctggagcgcagtggcatgatctcggctcaccgcaacctccacctcccaggttcaagcgattctcctgcctcagcctcccaagtagctgggattacaggcacatgccaccatgcccagctaattttgtattttcagtagagatggggtttctccatgttggtcaggctggtcttgaactcctgacctcaggtgatccacctgccttggcctcccaaagtgctaggattacaggcgtgagccaccgtgcctggcctaatttatttatttatatttttagtagtgatgaagtcttcctatgttgcccaggctggtcttgaactcctggcctcaagtgatcctcctgcctcagcctcccaaagtgttaggattataggcatgagccactgtgcctggctggattactttttaaaaaaattaattttgctttgtagttatgtaaaatatttcatgagtccaaagttaaatacacaaaatgaagtttattgaaaggagcctggctgctcttcctgtcctggtgagcctattttatcttttcttctgtaggtcaccactgaaatgttttaataatatgtgtaccacatgtgatgacacgtatgcgtaaccttgggtacatttatatacgcacacacgcacacagtgttttctctttagggaagtgctgtatgttgtacatggtttcttctaccttgcttcttgttgctgtattagactggaatccacgtgtcctcattggaatcaaagcttcattgtttcctctaaagcagagtttctccagcttggcccgattggcatttggatcagctaattcatgattgtggtggtcgtgtgctcatgtgctgtgcggacagtcacaggatgtgtagcaggtccccaggccattgccatcagatgccagcagggcccacttctcccagcagtgccgaccgagcctgtctgcagacaacaccagtgcccccgagggcagagttgctcccagcggagatggtgtttctcgggttcattggggggattctgagcacccatttcagaagtggatttggccccatctggaagcaatagcttttctttttggactttgaataataaaccagctattctagttcttgtctgcctcttctgcaaattaaggaaggaaggaagaattgttactgaataatacataaaggaaagagtcgatgattttacaaatttcacgtaactctgcccttactgggcagacacgtgttgagaacattacgagttactgtgaccttgtagtccctttgggttcggtgtacgcaatttcctactctcagcatctgccagcccagactctggcagacttatgccagccctgggtgctgtagggtcagccacccccttccacgcagggtgggcgtccagatggtgctgtgggaaacagcgttttgccaggggccagagagctgactcagatagtgacctggaaaacagactgtggatcaggtgggcacgggcctggaacagggtccctgaaacacccagcaagaggctggggaatgtctggagagcccggcatggtccggagcgtccacgcagccagcagctcacatcctcttgctcctggcggccgatgctctgcgcagaaacgggcttggtctgaacggagagggacattgtgaacttgaaatgaaatctgacaagaaattagaaatttcttcagaaagtaaagagcgctgtcaagaatgcgagctgaagatttgcgtttacagctgtagagcaaatacaggcggctctgacatctcagcttttgtttgccactgctgcagcctcaggtgcctcatctggggcttcattcagagtgggtggggaggcgacaggtcgaggcagttgccccgtgctcacgaatccctgacacagctggtgacctctccaggtgacctcttcaagcctggtcccaggggcaggcatgcccgggcatggccctcgcagatggctttgctggcctggtctggcaaccgttgaataaatactgatttcccacccaggtgaggcgcatggtagatgtttgttctgtgcattgcgttggtcggcctccacagtcgcacaatctctcagtggagtgagagtgtcttccatatgtggggccgtggtgctgaaggcttgtgcgttgagtgcctcctttcccgtgaatgtgttggttctggtgaccagggtggagcctccctgcgccccttccttccatccagcatcaggttcccagttctctgcctgccaggcaggcgtgcacatatggagtgtctgggaacctgcagctgttgatcacggctggtggtagctccgcacttaagtaaggaggagtgattttcccgaggagatgtggtattggtcggagttgctgggaaatcagcagcactgagtgatcaggttgtcgtgagctcctgcctccatccaccccattctggcggttcctggcttcactgcctcttgaagacagcctctctggcactcatgggcatgttggccttctcgaggggaaggggttgagtaactcatggcctgttagtgtgtgccagagactcagcaccacgggcagacacagtgccacgggcagctatatccaaggagggtgagggtgctccccagaagcctctgggcctccgtgggtgtcatcagggtagtgagcaggaagcctgggggctgagctgggctgcctggctttgacatgggcctgtgcggggctggctgtgtggccccgtgagggttactgaacctctctgtgcccagcctcctgtttgtgaggcaggagcgatggcagtgcccactgcatggtggtaagagtgaggcgggtagaatgcatgtgcccaagacagaggctgccccgacccgtgctgtgcgggtcactcacccccacattgtctgccacgggggcccgagcatttccacacgagactttcacatcagccacccgggcagggcccgcgttagtttagttgtttgtggaggagaaaattgaggtttggttttgttcatgacgttgccaggtcgaatggctggtgaatcattgatttggggctgagacttaagtttcccatctctgggcgggacctgtgctctctccctgtaacagtggcctctgttacagaggggcaggtgggtggctcacgtgtgggctcacctgcgtcacttctctccagctcacctccactgcgagagtgcctggggatgcctgccagccacccagagccagcgtcttcccaagcagctgttttacaggaaacaaagcaggatgaccttgggcttcctagtctctgcacgttaccccgaattccagaataatcgtgagaaggagccagtggagtggtgtgacttttgtatttatagacttcttccaaaggtcacctcttttatttctgaaaaacaagtcgcttgaggcccatctttacagagtgacaggagctcaggatgcagaggcaccaaggccagggaggagcgttgggggtggctggagctggtgggccaagggccgcagaccacttttgccctgcatggcctcgtggctgccttttctacctgcgtgagctggctttgatctaccccggacccatctttctgtgaagagtttgcagaggatgctggttacatcttagatggaaattggccgtgtctctgctgtttctgagtgtgcgactctcagagccaaggtggcatctggcgactggccttgttcttgtgagtccctgtagggcaggatagatttttccggcagggctgcagcctggagttcaggcttcctctcccttttaaatttcaaagactcagggttccatttaaacagacaagataagtggcagctttgttttgttttgttttttcattaagagattttggagggggaggaaaccagccttacagtgatagcatcaggaaaagattacacagaatggcatcttattatgaaatattgaaaacatttaaagagcaaataaaatatgcaaatagagtgggacagaatttgtactgcacagcctcttgccctacatctttcccaataaaaatttaactctgaggtccatgttgggacaaaaaaaatgatactgggatagtggagctcggctttcgttagttcaaagcgagcagcatattaatccaagtaagcagaattcccatgtagattcattccacagccttttcttgggtgacgactctgtgcccagaagcaaggggctgactgggacctgagaggcctcttcttagtggccatggcctcccggggcaaggccggctggtgcgtcagagcctggatctctgcagtgggcgcagaagggacacaggaattttctcttggcctctttgctggacttgcagcagggatgccgccgaactcagccgtttgcaggcgggagcacgtgagtgagcgagtgtgggatccagccagcccccccaagcaccaatacaggagcaaactccatgcggggcccacagccagaccaggtgtgtcaccttgaggggaacacggtggcacccaggcaagggtgcccatgaccctgaagccccagagtgggtgttagtgtgctcattagctcttttagttcttccatccacagtccaacagatggtggcatgttagcagctccgtcgccccctggccccatcacgtagggtggctgccctctgccagcaggagcaaagggctagtgtgacagtctttctggtaccagcacttggtgggtcctgagctcttgtccagcatccaagcagaatgcagatgtgcctacagtcagagagtgagcaaggtgaggggttttactgagtgatgaaagagctttctgcagagaggggacatgggggcggtccccccacccgaaggtgggaaaatccctccagtgtgtcttagtctggggcttttgtgggctcagaataggggaggggcaggctgtaggtagtattggaaaaggcaacatttgattggttaaaaggcattattcagaaagaatcaattgggaaagggtgggcaaacgggaataggagttttgctctgggtcttgggttttatccaggacctgccgtctggtctttcagccttcaggctgttatttggcttggaggtaggtttcaccagggacctgcccctgtctgcctaggcatttgactacctcccatcggtatcagaagcaccttgtgagccccagggagctggtgaggaccttgtaagggaggaggagggcggcgtgataggtgcaggtggcggcgtgataggtgcaggtggcaccgtgcacagccacgtcagggacttgggaacgtctgggccaaggagccaccttgtgcagaggcatggagtcatgagagattagccacggtgggaacgtggtgaggacactgggctgagcagagggctcgcaggtggtgctgggcagggagcctgttgacccacccacagagggtttgtctcaggggccggtggcctgactgctgtgcgttaaggaggaaggctctgacagaatggggggacttggagaggggtcattttggaggcctgaaggtggttggggtgtttgactcccatgaaggcagaggtggtacagcgaagtcagagggacacattcctgtgacccactgggcaccagggagatggcaggagcaggagctgagggtagtggtgaggtttctgctggcagagtttggtggttgagtttctgctggctgatttggtggggccagcgagtagacaaggatcccagacgggtgggtgcggggcaaggtggggaatttgaccagatttctcttgaaggtgccctatggggaaacggtgttgtgaaagtaggagggtgaggaacggaggcgactgagggtccacagaggaggatgggccagaggcagaggtgacaggccaggtaggccgagtgagcaggggagccacgtgaggccagtgcgggcgcaccaggcactgggccccatgcagaggggctgccgccccacccccacccaggcctcactgactcctgtgggagccatctaggtacagcaaccacgtggaggatagcgtgaaaagtgacgggacggagcaaagaaagacaccagctcctcgtttgcagaggtttctgcaccgttgtcaccagcatgtggtcatggcctgctccccgggggccattccagccattgatccacattgtcctccagccaaaggaaacaaagcgggaagtggaaagagctggagttacgtgggggcaccttccatcctaggccggcagctggtcaacctcctcagcctcgtcaccgtttaacatcctcccttttgttcttttctccttaatctttatgtttggaaagatttctatagacaaatgtgccgctgcttctccatagccttatctggaacaaaggaaatgtcttttattaccattcatgcaggtataatccgtgaaagacaagcctgttctgccagtcaccaagtcagtccttttccttctgtcttgctcatggaaggctgtcccggccctcacctgactagtggtgcagctcttcagggggtagtgcccatccaattcctggggaaacccaggcgagcctgctggccaggaagcgccagcttgtgtctgattgctaggttaccctgggtgcttcctggatgttcaggcgcccgtgattcccccagcatctgcctcgagcttatgtgcatggagcagcagatccctttgtctgggcagttagattgtctgctaaggaaagtgggtgttggagcaaaagccttgcttcactgctgtactccaacccatcaaaatggaattgtttaaaatgccctcaaaataaaaatagagaccccaagctcttgataaaacagctttctctggagaagctcatcgggctgtgtaaactccaataggaagtatttattcatcatttgtatgtgcacaaatatttatttaatgtcaactgtgaaggctgatgagtaaatcagcaggtagagtccagtaccctggtgcagtgatggggagctagaggtgctgtgcacagtaccctggtgcagtgatggggagctagaggtgctatgcacagtaccctggtgcagtgatggggagctagaggtgctatgcacagtgccctggtgcagtgatggggagcaagaggtgctatgcacggtaccctggtgcagtgatggggagctagaggtgctgtgcacggtaccctggtgcagtgatggggagctagaggtgctgtgcacggtgccctggtgcagtgatggggagctagaggtgctgtgcacagtaccctggtgcagtgatggggagctagaggtgctgtgcacggtaccctggtgcagtgatggggagctagaggtgctgtgcacggtgccctggtgcagtgatggggagctagaggtgctgtgcacggtgccctggtgcagtgatggggagctagaggtgctgtgcacggtgccctggtgcagtgatggggagcaagaggtgctgtgcacggtaccctggtgcagtgatggggagctagaggtgctgtgcacggtaccctggtacagtgatggggagctagaggtgctacgcacagtaccctggtgcagtgatggggagctagaggtgctatgcagcctttggcatggcttcctatccagtgtctggaagagcatccaagaaggatgctttcaacatgataaaagacaagggacatttaacatgatacttgaagaatgaatagaaaatgaccaggcaagacttggaataggacatggagaaaaggtaggaagaaggttctgggcagaaggctggaaagtaggttagaacataatgaggcaaaaggcttaaaagatcctttcttgtggctgaagtgtagactctcagagattatgtctagtgatcaggctggagatcttgcagggactcgtaggtctttctaaagagttttcaaagttagtgggaagacatcaaaggtttctaagcgggagaaggacctattgagttttggagaatggatttggagtgaaacaaggctggaggataagttgggaagttactccaatgatctaagaaatagataagtggtggtggtgatggtggtagtggtggtgatggtggtggtggtgatggtgatggtggtggttatgatggtggtggtggtgatggtggtggtggtggtggtggtgatgatggtggtggtgatggtagagatgatggtgatggtgatggtggtggtggtggtggtgatgatgatggtggtggtgatggtagagatgatggtgatggtgatgatggaagtggtggtgatggtgatgatggtgatggtggtggtggtggcggcgatgatggtggtggtgatggtagagatgatggtgatggtgatgatggaggtggtggtgatggtgatggtggtggtgatggtggtggtggtggtggtgatgatggtggtggtggtggtggtgatgatggtgatggtgatggtagagatgatgatggtggtggtggtgatgatgatggtggtgatggtgatggtggtggtggtggtgatggtagagatgatggtggtggtagtggtggtttggtagtggcttgacctgggtattgatagcacggatagaaagaggtggatggactcagtcaggattgaagaggtagactcaacaggatgcaatgattgatgacataaaaatggaaagggtgaaagacaagaaggtgtcaagggtgattcttgggtttctgttgtccagctgggtgattctcaggtttctgttgtccaaatggttagtgaccccatccatatggattgaggagagaggggagcaagcttaggagggaagacacagaagatgtgcactggacaattcctctctgctgaaaggcctcagacacactgatggattgcttcacatctgggaacaaatgctgtgaagtctctgtgtcctcagcggctccacctggttgcactagggtggaatcatgggaaagggcacaggttatatattcttgccatttattctcacggagaccataatgctcattccatatcaaccgaaaggtagcatttgccatcactctttttggcttttgttttgtttctctgtattttacttgtttttcatcctaacacccttaagggtgagggtaaacaagggctataggaggcgaggccttccagggaaatgccgggcagggaagaaggtcaggtccgcctaaaggtccctcctaccaacatttccctggaaatctttgcatcctacttgagaaggagaggggtagggtgaaactttcactagaccccagatggggccagaactggcctgagtcctgaaatgacatttgttcctccaggacagttctgagagtgttgcaggcatttcggtttgttggatctaaacttgacctgctattcattgctataggatgggaggatggcagcgatatcacttgtactcacagacccagcctagtacgacgccagtgtctttgttagaaactctacagatgtctatgtccagcctgccccagcggcacagggctacccctggtgggattttgtcaaaggggaagacccaccaagtagagcccctgagcccctcctcttcccaggtggccgtctctccttgatccacaccagcggcagtttgtgcagcttcaccagagcttctagcgggaccatgccgccacgagggccactgggagcagagtccctcccatgctcagggctctccagggtctgaagtctgcacttgtatgagaaggagctccaataccaataaaagtctacgtggaaaatgcagaatctgattgcagtagcatttcttaggccttattagcatataaatttaccaggtgtcattttaggacaagagcccgtcactgagaaggaaatgaaatttggagctgcattttccttcattaaaccaagggcccatttttgttttgttttgttttttgttttgttttcttttcttcggttattcattcttttattatcttctgctgtcacatcctccaaaactcctgtgcatatattttcttgcaccttgagatttggcatttcaggaaaaatgcctagcacaataggctgtagtttagagacttgctttgtcattttatatgtccagcagaaattgtcgtaactcccccggatgatcagatgctcccgtgcctctcctgtctctcagaccacacagctattatccctggcattctagttgtgagacaaaaccttaacacaatgtggtgacatttaatttagtgtttctcatttcaaagcccttaaaaatattaattaattcccatgaagccccaggaggcgtattattaatatctgtggcgcctttcatgctagtccattaatgtgccttctctacgcaataggtaagaaaatgaagctaaatccgtttttcgcagccccatgggataagaccttcacagagccagggtcagaaatgatgaatccttaattttattggtgtccctgaataatctaccccgtggccttctgtgtggcgtggaagaacagcactcctgttcaggagcaatctcaggagacagcgaatgattttcctgtggagctgtgacttcagcaatcctagttcgatagctgtgttgaggagagtagaattgagaaaaactgccgcagcagtaatgtaataagtgagatggagcaggaggcacttgacaatttcactagaaaatctcccagcgatctgtgggccctgcagtgaacccagcccctgcagatcgatgggcccgtgctccagggagacagatgtggagatcagcaccgtggcttgttcttattttggggtgccttatctttccgtgcctttgttcttcaccactatgcatgggggatttctgtagccttagcaaccagaaagcagggtggatctgtggaattagactccgaaatctcgagtttagttgacagcgctttttccttccttctgattgcctcgccgtctggcaagctctgcatgtgttcttttctcacctgtatctgcagcccatgactccggaagtctttctgactctgaaaaacatatcctgtgttcactaaggggaagtggttttaatgtgcatgaaaagaggctggcaggcgctcaccccacctggaccctagaccctggagaaggggtgggaagttagcttcagtggacgttcctgataaacgtgagctcaggtggctcacttcccctggcctgactgcagacttgagccaggaacacccattccgccttgtgtgtgagacccaggaggatcaaggagatatcctttagcatccattaaaaaaaaagttttttttgagtcctacctctccatttttgctcttccctacttgagctgtcttaaagcatccctggaggtaggaaaatgcatagaccctccttcccagggccccagtactgccggaggagcctcggtgatggctgcacctctgccctggggcctggagctgggctaacgctttcttggaaaacctctaattgtttctaccaagttagccaggacactttttaaaaagcactttcattaaaaatgcataggtatttgttttaatttacataacggcccagaccaaaatgggatgtggcctgctgcttagactggccattatcacgcctctgattcagagaaaaacctaaatttcatgtttatgcaggtcttatagctgatgcgtttggtttgaaggagcaggtgaactaggtcctctccaggacttggtgcttttttgttgggtgtggagagacatgggcgagatggggctgttgctgctgcgctgatttgaagccatctctccagactgaacccgtcctacgtgtccgccattctttctacctatccacctgaagacggaatgtctagctacctctacttcagacttattttctaatttagaatgtacttacttgagtggatgtggttttggagggcctgtagccaaggtcgtgacagctgaataaaatgtttccttctttgcccccagaactgcgctttcatttatcagctgcccttggtgtgttgtatgggatcagccaacattcaggtatttagaacattaagactcagtggcctggttctgtctcaccaagaacacaaataaacagttgatgaatccatcacatcagtgatgaatccagaatgtgtccatcattttcgtaagtcttagtatgcagagaatctcagatagcaaagcagaaaggatgatgtcacagacgccttgggtacccagcacctggatgcagctgtttgtacacacatactttctgatattatgttgacagtgacttacaccacttcaacctcaggcaggattctatcagtttctttactacaaattgatttgtttctttaataattattgtaattactgtcagtaaaaatctgagtatgactcagcaattagttgctggtaactgagtgtgttgtaatgctggggaaaggatataaaacttgtattttgaacagaaaggcacacatgtgggtgagcagtgtttaccaccacagaatttaccgtctacacagaattgagatagctgcacatgaatgtatagtgagcagtgtaagttaattcagagaaagaaaaaattatttcctgctgaaagggttcaagaaggaattttgtaggagagctgggcattgaacaggctcctccagaacatgtgggtcagattggccaccgcatggctggggtcccccatgggccagtgatgcccacctatgggagcaggtgacacgctgcctcccaggccacgcatcgacacccctcctgtcacgctccgtgcttctctgagcacttcctccttccctgtggccctgggctccctgtgggccagccctgtcctggcagagccccctgtgcgtgtcaacgcacatccttcatagatgaaaatggacttgaagatcccgcgttatcagttggttagctctctctcaagtctccttcgtgactctgctttatttttcgagcagcattctggttctgagcgaggagacactgagaggggagaccactctgtggctctaaccccgcctcagaccagggctccgcactgtcctgcagtggcacagggttgctagccttggattagcttttggttctctaatgggctttgcttgcaggtacaaaaatttgggggaacctggaaaaactcttaaatctcctcatctgaaagatattcatacatctactgatgacttccaaagtacaaggtctagaataccaagaggttttatgttgtcataaattagagttttaatgtatataattaggtgaaaccaaatgtgtatcatatacaacagagtaaccgtgttgcaggaattgggcctcgttttcctgttgttttcctcacatctaattctttttctctggaaatgccagggaacctttctttattttctttatttttatttttcagtagagacgagggatctgactatgttgcccaggctggtcttgaactcctggcctcaagtggtccttccaccgtggcctccgaaatgctgggattccaggtgtgagcccccgtgtccggcaggggaacctttcttaagcatgaatggtgtgccctcctcagggtgtgtcctctctgcttcctttctcagtcacatcagcaggtgcttcgtgtgcatctgtgtgcccagcctgggcacagcgggagcccaggccttccttcaaacgcagcctcccctgcacgttccaaacacttactggcatttttcttcaagtgatgatcatggcattggccttacttattttagttgtttttaaaagaaagttttaaaagtttatcaaagtgatgaacatacacatcactttttaaaaacataatccccacccagaggcaaacccttttagctatttgttctagtggcatatgttggtgctgctttgcactgactcatcaactcagggcatcttccctgactgcctggtgtggccccagcactttcacacccgttgttcccctccccaaccccagaaggtcgtagatttactctgtcggttcttctttgttgggagttcaccatgaaaagtactttgcaggaaaagagcaatgatagaactggagtagctcctcgcatgacccacctgtgcccgttttccagcatcctgccacccagccaggtctgtctcctccttggcccgttctcctcactcaggttctctggaagttggcacagttttactaaaataaaatcagcattcatagcattaggactatgtaaacactgttctcaagcaagccaagtcatgtgtacttgggtctgattctggactttgtgtgtgagttccctgggctgctggtctccgtgcccccagcctcgctgtcttaatgagaggccctaggggagcctgcagtgtctggcaaggccaggttgccctcagggctttctgctgccatgattttctggcccttcgtccctgtttgtttttccctgtgaccttcagtagcagcttagctccttggggtatttactgggaatgcattgaatatgtgaattaaacgagcgagagctgacatcttaagaatgttgactcagcccacccaagcagggagcatcttcccatttgttcacgtcttctgtgttttccaggagagctttgaaaatcttccatgtctgtgttttgcacatttcatgttaaacttattcctatgcattcagtctgctctgtggctttcgagatggggttttctttgccatgatgttcctttgtttattatttgtgtatatcaaggctattgattgttctctgtcagttttagattctgctcattcagggttaagggcccaggcaggaggcggagggaggagctttcagcagggcgattccttactcggtctcttcactcttctgccattgctgccatgtgtacattgcaggctccttcatttgagcaaattctctcttccatgctccagatgttttcagaaggaccgcgtacttctgagaaacacttggtaccccagtggcagctgcgtttgccttggtgttgccatgtgacaggcattacttgtttatctcattgttgttcctagtagttctcaatgtttgttgaatgaatatttataaccatcatgtgtggcagttcttatgtagtgttttgatttgtttttttgagaccatctcactctgtcactcaggctggagtacagtgttgtgatcatggttcactgcaacctcaacctcctgggcttaagtgatccttccacctcagctgggactacaggtgtgtgccaccacacctggctaattttttttttttttaattgtagagatggggtctcattctgctgcccaggctgatcttgagctcccgggctcaaccagttctcccaccttggcctcctaagctgctgggattttcggcatgagccagggtgcctggcattacctggttttatagatggagaaactcagagccatgtgtccaggaccacacagctattaactgcaaacccagaggaaagggtaggggatgagttccaagcattccctggagtccgtggtaaatttcttcatttcttctcctgcaacaggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaaggtgggtgtgccttccagcttccttcccgtttctgccaaaagccatgccaattgcggtggtcggagcaggtcctgcccatccgtagcttctgttaagccattgatgtttactgtgtttcaacaaacccaaatgccataactgaacggaccaggtagtcaggcacaaggaggggctgtttctgtggcagaacgtgttcatggaatgactgccttgaagtgtggtgcgtgtggtttatgttccctctgtaagaccagcagttgtttgtaattctccgaggacagacctcgagagtgtctgccttctagtttgaaaaaattgcacaatttctcaatttcgttagaatctttctttaagcatcggtgattttcttagaaaataaagtgttttatatattctaaagggctaattccaagctgccctgcaggtgcaggctctgggcttccctcctcaaggtcagaatcaccagccttttgcaattccgttgcccaggaccagatgaagtgcttgctccccttctgtagctgttgctgtgggtggtgggtgctgactgtcatccccatcctccagggtgtggtgggtgctgactgttgtccccaccctccagggtgtggtgggtgctgactgtctcctcatcctccagggtgtggtgggtgctgactgttgtccccaccctccagggtgtggtgggtgctgactgtctccccatcctccagggtgggaaccttggtctgtctcagagcagccagctatgggtctcactgcgctctgcgtgatgcatgaaaagcagttcttggagggtgcggtggccccatatgtgcctgagcgtgtctatgagggcactgatttggaatccagcaaatccgagtcccagtttcggttgtgctgtcagcctcctgggcttctgcttccttagtgtggacaccgcctcctgccatcatagtgaggactctgactccgtttcttcacacactgaactctcggttcccgcctaccgtcccgggttcgcagctagcattcggcacaggtggtgaagcagtgtgggcccagagcagagacctcgaggaaggcttctgaccctggacactgaggagtagccagcctcggaagttagaaaggtatccacccagctcctcccgcagggcacagggcagtgccatctctccccgtgtgtatctggataccagcttgattttaattcctttcgttaaatattgagtaaattcaaaacgatcgttgtgaaggaagtaggatttacagaagcaggatgtaatgaaccaccaggcgtgcaccacaggcccctggcgtgtctttctcagctgcagtctctcctttccctgccctcccctgtggcgcctggcacagtgaatttgaatttgtccttccctggctctcctctgtggagcccccggtgtgctggctctcaggcacggcgaatccgggagatcgctgctgatacgctgggcggacgctggcgcgctcttccgcagtgcgctttgctcacttggtcggaggctctgcagattcatgccaccgaccccaggggcctgcagccctgcctcttcccacattcgctgtcccctgccgggaccccgcccttctcagtgccttccctgcagatgggcattgggctggttcccatcttgtttctgctgtaaaccgcgtgagtgtttcagctgcccacctttctctccagcactgggtgttgtcacaggttttttttaatgatagactgtggtgtgctctgattttctctgataaccattaagatcgcgcaccctgtgtccgcccgccggctccctgctgctcaaagcgcctatctgctatccacttctctctgcagtgggttgccttttcctatcggtttgagggaattctttgtattccagacagtaatgatttttatgaattgtgtctctcttctcagaatttatgatgtgattttttttcttcatcttcttacactcctgataacttacaaaacttttttttttttttgaaacagggtctctctctgtcacccaggctggagtacagtggcatgatcatggctcactgcaaactctgccttctgggctgaagcattcctcccacctcagcctcccaagtaggtgggactacaggtgtgcaccaccacacctggctaagttttgtatttttgctaatttttgtattttttgtagagccagggtcttgccatgttgcctaggctggtcttgaactcctgagtccaaataatcctcctgcctcagcctcccaaagtgctgggattacagcgtgagccactgcgccccgctcccagttgtgctttttatttgtccttcttgtcttggtgtgctggccgatgccttcagtggagtgaagtggggactgggtggggagcggggagggaggcatctttgtttctcttgtcctcgcagagggagagtttctgtgttcagtgtatgatgtttgccccaggctttttgtaaaacaaaaacaatcaccattatcgaattaagaaagtacaattcttaatttggttttttaaaaaaattgtgactagatgttgatttgcctcccttggttatttgtatgtgtgtgtgtgtgtgtgtgtgtgtgtgtgtgtgtgtgtgttaaagtggtcacagtacttttctcccttaggctggtgctacgttgaatgatactgtatgaccatctcctgttatacacacctttctttttggattaacctgtgttatgatgaatgatctgtttcatgcatggcttattcagtttgcagccattttgtttcatatattaaatctgtgttcgtgagtgagattggacagggattcttctttgtcttgctgtccttgcctaggcggagtaatcaataactgtggccttagaaaataagctgaggaatgttccttctttgtatatatacttgaatagtttttgtgatgtttgaagtatttgttgtctgaatgttgtggaacttacaaagaaagctctctgggtggtattttgtttgtggagagtttttgacttactgatctagcttctttcatggttaaagggtttttctgttagctttgccaactgacttttgcaggaccttgtccatttctactaagcttcccgatgtgttgacataaactggctcacaatacccctttagaaactcaccagtatcgggggtatctgtgagtgaggtgccttcctttgctcttggtgctgggtatatgtgccttctctcttttcttgttgattattcctgtgaggagtttatgtaccttttatcagtcttttcaaagacccagcttttaccattgttgaccctccagaggatggaaggaacagtaggatgaatacctttatactgttcccctgttgccaatttgacactttttttcttgtcccctgaaccatttgaaagatgcagacatcctgacactaagaacgaggatggctttctgtatcaccacattaccgtcaaattgctcaagaaatggaacatcagttctgtgtcatttactatagagtccatgtttgtgttttcccaagtgtttgcaaaatgtgcactaaattagtaggcatttttttacttgttgattttgttgtggacccagaatctaattaaggtccatgcattgcatctgttccttatgcgtttttagttcctcttgcctttcatgttatgacattgactttttaaatgactttttaaaatttaaaaattttgtcttcttttgggaagttaacatatagttatacatcagtcttttttttttttttttgaggttaagtctccctctgtcgccaaggctggagtaacagtggcgtgatcttggctcactgcagcgtccgcctcctgggttcaagcaattcttctgcctcagtctcctgagtagctgggattacaggcgcccgccgccacgcccggctaatatttgtattttcagtagagacggggtttcaccatgttggccaggctggtctcctactcctgacctcaagtgatctgcctgccttggcctcccaaagtgctgggattacaggcgtgagccaccgtgcccagcagtcttttttaaaataatagacatcattttttttaagagcagttttaattttacagaaaaattgagcaagtttattgagttatatacttccttcccctcattttcctctattgttaatatcttgctttggtttgttatgttttttacaattggtaaactgataatgatgtgttataattaatgatgtccatatttacactagggctcactcctagtgatgtacatgctgcagattttgctgaatgtgtgatttcctgcaaccaccgttaggttgccacacagagtagtggtgtccttcaagtcctctgtgcgccccctcatcttctctcccctagcatttggtcttttccagaatgtcctatagttggactcatatagtatgtagccttttcagacaggcttctctgactcagtaatatacgcttaagactcctccgtgtctttttgtggcttgatagctcattttttacaattactgagcaatactctactgtgtgaatgcaacactgcttctttatccattttcctattcaagggcattttggatactctgaacttctgacaattaggaataaagctattattaacgtgtgcaaatttttgtatggatataagctttccattcatttgggtgaatacctgggaatgggtttggtggatgattcggttagagtatgcttagctttataaggaactgtgaagctgtcttccaacatgtctacgccgttttgcattcctgccagcactgaacgagagtatctgttgctccacatgctcatcagcatttgatgttatcagtgtttggattttagccattctggtgggtatgtagtaggatcttattgttatttcattttcaatttcgtaatgatgtgaaattgggcgtctttgcatgttcttatttgccgtgttatatcttctttgatgaggtatctcttcaggttttttgcccattttaagaatcaggttgtttttcttgttgctgagttttaagagttctttccatatttcagatgccagttttttgtttttgtttttgttttgagatggggtttcgctcttgttgcccaggctagagtacaatggcgtgatcttggctcactgcaacctctgcctcctgggttcaagtgattctcctgcctcaacccccgaagtagcagggattacaggcacccgcctccacgcccggctaattttgtattttttttagtacaggctgatctcaacttctgacctcaagtgatccacctgcctcggcctcccaaagtgctgggatcataggcatgagccaccacacccggcctggatgccagttctttatcagatatgtgtttcgcaaatatgtccacccagtttgtggctgcttgttttcttttcctagtagtggatgttcgctttttgacgagtttggaccagtgatcctccaggatgtcccacattctagtttaatttcttcgctttttcacaagtttttgtcaaaccagattaaaaaaaagcatgatcaaaccttgtgctgtccatagtagatgtattttaaatacaaagacatatgaagtttgagagtaaaagaaagggaaacgatatactatgccaatactagtcatagaaaaccagtgtggctctattaatcagagaaaatagactgcaagatgaggagtattattgatgataaagagggccatttcctcatgataaacaggccagttcatgagccaggcacacaccatcctgagtgtgcgtgcgcttaatatcagagtttcaaaggacatgcagcaaaatgaacagaattaacaggaaaagtatgcaaatccataatcatagttggaggttagaagatcttcttttagtaattgatagattaaactgatagttaaaaattatagacaaaattgatagttaaaaaatttttttttgagatggagtctcgctttggttgcccaggctggagtgcagtggcgtgatctcggctcactgcaacctccacctcctgagttcaagctattctcctgcctcagcctcccaaggaggtgggactacaggcgcccaccaccacgcctggctaactgttttgtatttttagtagagatggggtttcaccatgttgactgggctggtcttgaactcctgacctcaggtgatctgccggcctcggcctcctaaagtgctgggattacggatgtgagccaccgtgcctggccctgtaattaaaaactttcttattgagaaaactctaggcatagtatattttttctagtccaaagcaaaagccagtattaatgtaaaagacctagcaatattatcaatcaccccgacttaattaacatttatacagccgtccacacaactgtagaatatacattctcaagtgcatgtggaatgttcaccatatgctgagccataaagatgtctcaataaagtttgaaagattaaaatcatagagtatattctctgttcttgaaattcaaaattatggaatatctggagaagccccagatacttggaaatgaaataccacatgagtcaaagacaaaatcataaaagaaaataaaaaataattcaaacctaaagataatgaaactatgacacccaaatttataggatttaggtgtaacagtgcttatggaaatgtacagctttaaattcttacatagaaagatacattttagaaatatatttaaaatgaaaatctgtttttttgaaacggagtctctcgctctgtcgcccaggctggagtgcagtggtgccatcaccacccactgcaacctttgtctcctggattcaagcaattcccctgcctcagcctcccaagtggctgggattacaggcgtccaccaccgttcccagctatttttgtatttttagtagagatggggtttcgccatgttggccaggctggtctgaaacccctgacgtcaagtgatcctcccaccttggcctcccaaagtgctgggattacaggcgtgagctactgtgctcagcctaaaatctaatattctgccttaaggaaacagaaaatgctgagcaaattaaactcaaagcagaaggaaagaaataacaaacagcagaaatcaataaaatagagtacaggcaacagagacaacatagctaaaatgtgttttttttgaaaggatcagtaaaagttgacgaatctctacgtaggtagatcagtgaagaaagagagaaaacactttatcaacatcagcaatgaaggagaggatatccccacatatcctataagcattaaaaaggtaagggaatattattaattttatatacatttaaatatgtaattaaatggacagatgccttaaaatacaacttaccaaaactgacctaaaatgaaatagaatatctgaatagccctatatcaatcggcttctttccaaggccatgccaggcatttaatccctgtgaggccaggggctttttattttgtttactgctacattccaagctcttaagatagtgtctgttaccctagcaggtgtttggtaattgtcaaccacatgggtgggtagatgaatggatgtttttatttttatgttttttttttttcaattttttatttttccataggttattggggtacaggtggtgtttggttacatgaagaagttctttagtggtaatttgtgagattttgctgcacccttgtagtcttttatccctcgccccctcccacccttctccccaagtccccaaattccattgtatcattcttatgcctttgtgtcctcatagctcagctcccacgtaacagtgaaaatatacgatatttggttttccattcttgagttacttcacttaaaataatagtctccagtctcatccaggtcactgtgaatgctgttaatccattactttttatgactgagtagtattccatcatgtatatataccatattttctttatccactcattgattgatgggcatttgggttggttccatgattttgcaattgcgaattgtgctgctataaacatgcgtgtgcaagtatcttttgtgtataatgacttattttcctctgggtaaatacccagtagtgggattgctggatcaaatggtagttctacttgtagttctttcaggaatctccacactgttttccatagtggctgtaccagtttacattcccaccagcggtgtagaagtgttccctgattaccacatccacaccagcatctactgttttttgatttttttattatggccattcttgcagaggtaaggtggtatctattgcattgtggttttgatttgcatttccctgatcattagtgatgttgagcattttttcatatgtttgttggccatttgtatatcttcttctgataattgtctattcatgtccttagcccaatttttgatgggatttttttttcttgctgatttgtttgagtttgttgtagatttccggatattagtcttttgtcagttgtgtagattgttaagattttctctcactctgtgggttgtctgtttactctgctgactgttccttttgccgtgcaaaaggcctttagttaaattaagtcccagctatttatctttgtttttattgcatttgcttttgggttcttgctcatgagatccttgcctaaaccagtctctagaagggtttttccaatgttatcttctagaatttttatagtttcaggtcttagatttaagtccttgatccatcttgggttgatttttgtataaagtgagagatgaggatccagtttcattctcctacgtgtgacttgccagttatcccagcaccatttgttgtaaagggtgtcttttccccactttatgattttgtttgctttgttgaagatcagttggctgtaagtatttgggtttatttctgagttctctattgtgttccgttggcctatgtgcctgtttttataccagtgccatgctgttttggtgactatggccttatagtatagtatgaaatcaggtaatgtaattcctccagatttgttctttttgcttagtcttgcttcggctatgcaggctgttttttggttccatatgagttttagaattgttttttctaattctgtgaagaatgatggtggtattttgatgggaattgcattgaaatgagtggatatttttactgaaatgtcatctgatcaccagatgtggcatgcacccctctccttgactctttagtcctcctggtgtggtctgtttttctccacagctttttcccagtcttatgtatattgtctctatgtcaccattaaaatgtgagttccaggataacaaggtctttgttctatgaaccgctttatcatgggtacctaaaaccaagcatctcagaacataggaaatggtaattcaatgttcactgcattctacgctaatgtcataaaagcaacagaatgatccctagagccaagtctttcttggttgtattttcccccactgtgttattccattagtttatcctttcataggtttattttgcacatcacgtggcatgccaccggagacaggcgcgtgttcttccagatctagacagccataagctgcactgtagagcatgcagtcctgttgccgagtctttcagccttcagataggctccctccatcaaaacgaagcctgcagcattacagatgatacactgtcggtacacaatgtaagatttaaaaacatttaaacatgctagttttaactatacttttctttttgtttaatcaccatttattctgttgctggttgttttctcagcctcagcagaaaactgaggttcaggccttaagcaaaatccgggctcagattttccccatgcaccgccctcccttgcattcccctgtctgtgtttcaggcaattaggactggcagctgtagccattaagaattcacgtagcggaacgtttatcgggagaaggattaatccactactcgaatactcccaattagcttttagaccctgtctgccttttcttctttgcaaaaggagaaaggtttttcccacttgatacattttttttctctgctttttagagttccattgtgaccagaagctatttccaccctttgctgtgtacctaggcacaaagctacaaggcttttccctgtgtgtacagctcatggtgccctctctaggtaggatgagctttgctccaggttacctgcctttccttaatttactgaacataaagttggagttttatgtggttttgcatttttggtttaggataatttttaattcttcggtggtcttcctgtggtgtttacaacctaacccctaccctctgccaaaatcatcctcaaaggccatttttgtcttgcactatgttctacccttacccctccggacattaaatagggacataaaatggatcttatcatggagagcacagacggaaagcaaagactgttttgttctgattgttggttataagtctagcttaaagccgaattgcatgatgatgtattgtgataatgtagggaaaatattggccccttcagagagagagagagttgtgccagcccagccatggtgggcaggcaaggttggagggggcctcctggagaaggcggtgcttgctcgggctgagtcttacagaagagaacaaaggcaacagttgtccctgagaggggactggaggggatgatctcagaggaagtagatgatataataaaccagcatggtattcattggaaactacaagcagttctgtgctatgggagcctggagcctgaattgggtttcaaaagaaagaaggccagaaagtgttccaggctaaggcatagagcacctcgcagactcttagggatgtgggcttagataaatccttttgatgccgtgtgaagcctggctctggggagaaaagactggctagagaaactccaggtagaaggccgtcgtatacaagaggccagtggcggcaccctgagtcaggctggtggggcgaccctcaggaccttcctaggacaggtggaggttgagttagagggagcaggtgagacctggactgtgaccaggcaccagaagcgagaagaaggagcttgtgggcatttgttctcaggttgtgagtaggccggaggtccatgagtatggggtcgtgagaagtaggggcagacatgctgcgggcggttcccaaaatacagtttctagagccgaagaaggccaagagagtgaaatctggggagcagaagaggatcctggcaggtgatggggaggagaattgggagaaaatggcatgggggaagccgggaagggtacctgtcagcccgggggaacagagatggaattgatatccattattccaaggagtctggccctttagcaagaagagcactttatattccaagtgaagcagtcctgttcaaaataagcagctccccatttctgagaagatgctgagtacatcttctgccagagaactcagaatgtgaatcagaattctcagccctattaaagtggcatcttctcagggctcgttcctgtaaagccccttaagggcacagccttcctttaaactctcagccaggaactgtggtctcatctggatttgccgccgcagctttccctggactaaagatggacttgtgccaccattctcagaggagggcaaaggacaggggtcagcagattcctcctcctcctgaagggggttcttgaatacatatcatccagaagcagggggtcgtggccccgaaaggtcaggagtggggggaagcggtacttgtgaacagacaactcgggagtatacatcaccagtaaaccccagtcccgtaaaatccgtaaggctgcaagcttattgtcattggtggtggtgtttttggtacttcctctgcccttcttttattacagttaaataattattccatgagcaattctaaataaatattatttaataggatttattggttttttgtttttttaattgggattgtcattatcaaatagatgcctcttgtgttggtatacagttaattgttgcttctgttgaaagatggatcatgggccgggcacggtggctcacgcctgtaatcccaacactttgggaggccgaggcgggcggatcacctgaggtcaggagtttgagaccagcatggtgaaaccctgtctctattaaaaataccaaaaaaaaattagccatgcatagtggcgggcacctgtaatcccagctactcaggaggctgagacaggagaatcgcttgaactgggacttggaggttgcagtgagccgagaccgtgccattgcactccagcctggacaacaagagagaaactgtctcaaaaaaaaaaagatggatcataaagcttttgaaatacactattatcagaaaaatacgtgatttttaaaaagtgatatttatgtcagaccacaattatcatttgttaaaattgttactttattcgtcttgagaatctagcggtgtccaagaaaaagttttatggtaaacttgacctttcttttctgagaaattctagcattttgtgtttgcttacagtagtagaaggccattaacaaaaactccatttctttgggagaagtgctggaaatgtttggagtatttctttatgagagcttaaactttaacaaacaaatgatttccttgatgccaagagatacaaaacctgagagtgcagctgcactgacttcgcgggtgccctgcatttaaaaccacggtcatagcgctgcggtgcccatgcttgagtgcgcccagcatcacctgcaggctcacggagccacagactgccaggccctccctgagcctctgcttctgtggccgtgggtggggcctgacgatttggctttcttgggtgtcccacaaaattgctgctgcggccgcttctgctgctgtctgggttgtctgcctttgagaacccctggtatggacagtgtggtgtgagaggcaagcaggatattcatcttatggtttggggtcactctgcttcttacgtgtcgggagagacacttccccgaccccttgttttccatctctaattttagccgtctagggcagaaacagtcccgggtaaacaccaaggcctcgtgggaggcacctaggaggtgaggaggggctacgtctgccgggtctccaagcaggagtgagaaccagctagacaaggggaggcctgggagtgcgagggggctctggtgacaggaagtagtcccctctgacccggtgacaccgtggggagcaggtgatgtggttccagtgctctgtcatcctggggtcagtaggatgaaagatgtcgtagcagcacaggcagcactgtggaaactgttctcacgactgtgagtcattgaggctcctggacgcggcggaagtgcaagcgggaaaaaggatggcaagttgagtaacctcaggggtaagcaaggaggtgtgagaatcactcacttcctcggcagggcctgcacgcacctggtgcaggagcagcagaagccatgctggctcttcctgctgcgtgtgcatctggccctggaaagaggcacacccagcagcgggctctcctggctcacccggggccgtcagggcgctgcagtttgcaggagcatcctttgggctcttacctcagtcggtggggctgggcagctgggtgtctccagcccatcatgctggaacatgctggaagcttcctcagggtactcgggcttattttggtagtcatacacatgaaatgcactttgggggagaaggatgaaatattttggttaatccactgaaaaaatgaatgttgaggaacacagccagctttcctgttatttattaataggcttaagatagccagaaggacatttctgctagaaagttattgccagctgaaaaagaacaagtcttcattattatccaatttggtatatatatatatatttcaggtttttatgaagctaagggcaaaggtcagctgcttcctattccttgtggattgtgctgctgatgggaacttcctttgacttcacaaatacaagggattggaagtgcattctttgttatctcatatgtaagatgaggcttttaacacgattttcttttagttaattttaaaatattttattataaaattcattttttttcaaatggtgcagataagcataaaataaacaataaaagttcttcctttccttccctccaagcctttgtgtggcacgttcttggcatgttgcaaagtgccgtcatcatcatcatcatcattgagtttggaagaggaaatgataagttttatttttcccttctcaaatttttgaatttgaggtgtcacaggcaatcaaatgaaaataaccaactctctgtagaggtggtagttgcagctgaacatttttgggacttcaatgtttaggcagtatttaaaaccagggagttatatttgattgcctgggagaagatgtggaataagaagaatggaataggcccctgacgataagtttttaaggggagggtggaagggaggggtcccaagctgggaaactttggaagaatgagctgaggcagccggagacctggggagagagtgtgtgtttgaggggagacggcgcatagatgtcaggtggggcaggaatggaagagaccatgggatgcagcatgtgaagaggtgactatgtgttcagtaatttctggagagcagttaggatcaaaactaggtttgcatttttaaaaaacaatttgaaataattttaaatgtacacgagagttgcagaggcagcacagagagttcctgtgtgtccttcatccagctacccagtgtcaacctcttacatgacctcagcacagcgatcaaatctaggaaacatatgttgttacagcactgccaaccacacacagcctccttggtgccagcagccttgccgctgtaatcctctgtatgtcttgtggtccagcccaggcccccacccacattggctgccttgtcctctggtcctcccagcctgggatggttcctcagctgttcttgtctttcatgaccatgacattgtaagatgctgctcaggtgttttggaggatgtccctcactttgggtttgtctgatgtgttctcatgatgagattgaggatcaaagttttgggaagaataatgcagatgggttattctcagtgcatcaggtttgggggtgcgtggtgtgtgtgattcttattactgcagataccaaccttgatcactaggctgaagtggtgccttgtgtgtttctccaatgtgaagttgttattttctttataattcataagcatttgaaggagatactttgagagtatgcagatatcctgtttctccttaaactgccatgccctaattctaacattcatgtgtaattactatcctggtgttctaatggtggtgctgtacctccctatttccttccacgtttagtaactggaattcttctgtatgaaagaattgttgcttctcttgttgtttatttacttggttgtttgtttatatccatatggagccactaatatttattttacttcttgggttataatccattattattatcattatttattttgttactgaaattgtttcaactttgaccactgacacaccttctagcattttctctaccacagccctggatcaaccatttttccaaggatctttggcttttttgagagtgggatttagaaaccaagatgtggcctctttgtgtgctcgttactactggagcattagtgttactaggcctaggccctctccgtggacttagctaagtgatgcatttgtgtgtagtaagctgtaaacacatgcatattgatttgcgtatctatgtacaggtgtggaaactagattttaatgactaaacaggaggtaagggactagggactggaatagactaatctttccagaagtttggtgatactactgaataacactgttttttctagctttctctgtaatacaatttttgcaataaatacatagagagcatgtgattagaggagcctgtctgttggggagacctcgaagaaagaacaaggctaagcagggatgtttagtttctgcaagaggtaacttatgtttgtagataggagaaagggggttgctgaagaaagtataaatcagtggagtaaaggatgagaaatgggaaggtatgagaagattaattcaggacagagatacagcatttgacttggcaagcccaagcactcttctctgagacgtgggagggaaggagaggtgaatacaaatgtggtggagctttgaagctggacatgagagctggttccccttggagcctgtctcctgttaagtgagaagccaggccatgtcctgagaggtgggggccatgagtgccaggatggaagggtcaggagagaggagacatggcaacccaccccttcctcatgtttactgcctggcatagttggcatttttctttatgttgaggaaaatgctgctatgatctgattagtaggtgctaaataccccagtttgtataaagtaggatggtatctttgcagggctaatgaaatggccaaatcaggtttgggtaaggccacctggagatccatgtccttcagctgatggcagtcttcctgtgtatcccagctatccacagagatgcttgcgagttctaccatcgcaacagcggcgaggccaggttctcccatcccaacagtggtgaggccagaaatttccaggctcatcacatctacctgctcagcctgtggtgggttggagttggggttgggacaccccacctgcccttccagagggcgactgtctgcacctgcccagtgtgccccccgttccctcctctgcagtgtcagagctgctgtgcctggatctgaggaggggccgtgggagaagaagccgcccccacgacacttgcgcttgccttttcagctggagcacggggtggcggcaccgtgtcgttctgcccacctcacccactgggatgcaaacttgctgaggccagggcttcttcctgccatgccttgccaccacgccccttgcctcccctgggacatgccgttctcttctttgtactcatctgtttggtatgtgaggggttttgcgttttgtcttctgctctgtaatttaaagggataaaacgctcacatttaacttaagccaaaacccagtttcagtctttccaccagaaatccctgagatgtagaattgtgggaagctccttggaggctggcgggctgctgggctgcccctctgtgggaagacagcctgcaggcttcagtgggctgggctctcccggccatggctgccttggtggctaactcaggctgcggcgacagactggtgaggcaggcggactcttcccctgatgtttaatataacctgacagataaagtggattgtaatgaagaaattatctaaaacccatttctatttctttgtttgaaaagaaaacatggccttgaatatgattcttggagaaaaagaagagacgctttgattaggaattattctctgtacttttagttttggatcaagaagaaatgaaaaccattggccacaagctcttgagtgttccaagcagccttccgtgtatacagggggcttttcaattctgggctggtgtgggttggtgcagtcaggatgacagaggaatattccacaggacaacgaggagtgactctactgtgggcgttgtttctgcccctgcagccggggctgtgaggctgcaggctgccctttgctggtttgcaggggccataattctggcctggagcttgacaaacgacccaggacctctgagatgggaaatgaggtctgcatcccgtgttctaatcaggattcgctatcaaaggtcattttccacactgtggcttaatagagttggttttatattccctgagggatacagacttccaaattgttgcagtctcactaactgtaatgtatacagctcatgtttgaaaggaaatcgcctctcctccaaggcagcggttctcaaccagggaaacttttcccctcaggggacactgggacatttggcaatgtccagcaacctggagattgtcacatctaggtgtgggggtggctgggtggtgctgcggaagattgtgtggtgcacagggcagccccacaaggagcggcccggccccaaatggccctggtgctgagagggacagacgccgctcacagagaagcgaccacagaggcccacatccaagcaggcttcccagagcaggcggggctgggaaagctgttctgtggcgcagcatcccagtggctgttacggggtgaaagcccctcttagaatttaaagtcctagagcagagaccaactggggccatccatggccctgtgccgtgctgcctcctggacgcacgctaggaggtggagatggtccagccccagcaggactgggccacgaggaccctgccggtaacctggtgctcgccgcccacagatcacggggcgtggagggagagactgccagtgctgtcctagtgcagcagtacctcatggttatgacggatcatcttcctgaactttgcatctcagaatttaaaatggagattttgattttgattttggcaaatgtggaaaatagatttcagctcaaaaagcaagacctgagaacatggtgtgttaaaatatctttcatttcatgccactttgcagccctgggaccctcggggttgtacctagaaggtagtaaagatgacagcagcccccgtttcactgatggtggcgcagaggacgttgtgaggtggctgtagggtcaggtggctgtagggtcagggctgggcaagttgtattcagatgctgttcgctaagcccagaacattataggaggtaaataaatagcacgcagtgttctgggggtaaaaagatacacccatgtcccaggctgctgccaaaatcctttctcctgtcagcgtggggggtgatcctgcccaattaaaggacgtcttttggcccttctttcccttggcagcagcatggaagtgggtgggggaggagaggagcatgcttcccccaacccctggggacctgtgagcgcagcctgcaagctccggctccaggaggaagcgtgctcaagtgcacctctgaccacgtcacgctgcgagaacgtgggcgctacacctccgaccacatcgtgctccgagaacgtggacgctgcacctctgaccacgtcacgctccgagaacatggacgctgcacctctgaccacttcctgctccgagaacgtgaactctgcacctctgaccacgtcacgccccgagaacgtggacactgcacctctgaccacatcatgctccgagaacgtggacgctgcacctctgaccacatcatgctccgagaacgtggacgctgcacctctgaccgcatcatgctccgagaacgtggacgctgcacctctgatcatgtcacactccaagatcatggacattgcacttctgatcatgtcatgctctgagaacatggacgctgcacctctgatcatgtcacgcttcaagaacgtgaacactgcacctctgaccacgtcacgccccgagaacgtggacgctgcacctctgaccacatcatgctctgagaacgtggacgctgcacctctgatcatgtcacactccaagatcatggacattgcacttctgatcatgtcatgctccaagaacgtggacgctgcacctctgaccatgtcgcgctggccagaatttggctgcaggacagacttcactggaaaggaaactgggccatgtgctcagctacaactgctttagaagagagagaaaatcagatattagcctagcagtctctaccacactggcatttagataattttcagcttttttttttaccagtcaaaacatctcatgtacaaatgcaagtatttctataggatggatatctagaagtagtcagaaggaatgtgcctttaaaatttttgttaagtacttcccaattgccttccatacaagcttcattaatttacattcccaccattgatggatgagtgccctgcatcctcccacaatggggcattattcacattttatcctgctttccactttgctgaataaaaacagaatggatgaatgaatggatgggcggatggatggatggatgaatggatggatggatcgataggtagatagatagattctcattgtaatttgcatttctaataaagagcatgaaacttagaatcatttttgattcatttttcttctgtgaattgcctgtttgtatgttttgcctgtttgttttcgttttgtcccttgttgatctgcagcagaagtttatatagacacatctaaaaaattctctgtcatgtactgtgtacctcctttcttctaaaattgctagtcattgatatgtctttattagaattatagatttttttatcttactgtatcagtcagtctcaagacttattaggttttgtgacttgcttaattaaggcctttcatatgccaaaataaatgaaaattttcctgtgcttttacatttaggttttcagtccactctggggtgtgtgtgtgtgtgtgtgtgtgtgtaatctcagatagcaaaataccaaatggctggttagagtttccagcatcagttattgaattgttaattccttctttgcagatttaaaatgctgtcctcattagagttacgtatgtgggtctatttctggactctctcttttctgttgatttgtttgtctccctcactaataccatcctgtaattaccatagatttatagtatctttaatatctggcagtgtgagtccctattcattattctttattaatttttttttgctcttgtgcttttttttttctctgtactatataatcatcttgttaaattccgtgaatggaaaaaacccagaaggtattttgattaggcttggactgactttctggattcattaggcaagaattgacatctctagatccttcagtgggtttatttacagagagcatttccaggtgttctattatagagcagtgattataaacagtccaccaaacgcggacagttttaacaacatgtttggcagagcacaggtagaatggggtcctgcccacgatgatgtacgtgtctccacacaccccccacacatctgcgtcgttggtatactgtatcatcatgtctgagatataacttacgtctgagatgtagctgatgtctgaaatgtaacttttgtctgcttctttgctgtgcacggacaaagcttctgcaggcttcctgcacgccatacttccccaggctttgctggatctggccttctgtccctttcctcttgagttataaacaatcctgtaggcagtaccagcggcaggatatgtggcttagctgctaagaaataaactcacttttactgtgactttgatttttgccaatttctgggaatttgatttctgccacagcttcactacttacactcttgatgtccaaggaaaggtaaataatgaacgtgttctgtggagaagaattccttaaaaatgttagctttgcgttcggattgtaagtgtttctcaagtgagatgagaacattctcctctgcatttaccagaatcactagtgtctgttcaggcgctgaacagtatggtgtgttctgaaaaatgtttcactcagcagattagtgttactaggttattgttctgtgactgaaataaatttatacagccaaacccacttataccccttaagtatgatctttcaaaagtcatctcaatgacaaagtgcttatggacctctctgaaattaaagggacagtggcatgcaaatttgaggacccggccaactcttagagctcccctcccttgtaaatgatgtgtgtgttgtgttatataaacccagagatgtgacagagttaaaggacaaatggagacacggagtgaagagcacgtgtgtgagacagctgtgggtccatggagggaggccccgcggcgggaactgaggcagccatggggtacatgagggaagccccacagtgggaactgagacagctctggttccatggagggaggtcccgcagtgaaaactgagacaagtttaaggagttgaccagcagctgaacccagcggcagctgcggaggagcctggggctagggatgatgactttggcagccacctggtgtgggcgctactggagtaaagcagcatcagaggagatgtggagaaattcagtttgatggtttttgttttttgagactgagtctcgctctgttgcccaggctggagtgcagtggcgcaatcttggctcactgtaaccttcgcctcccgggttcaggtgattctcctgcctcagcctcccaagtagctgggtttacaggtgcccttcaccatgtctggctaattttgtatttttagtagagactgggttttaccatgttggccaggctggtcttgaactcctgacctcaggtgatccacccatctcagcctcccaaagtgctgagattcaggtgtgagccattgcgcctggccagtttgctgttttttatagttttgtataaaggctaactcagcgtctctccagccaccaggctcaatgtgtgtgccttttgtaacggtgcagtactcaccagcagcccatattcctgagacgcacatgtaacgagcgcactttgtgtgttttctagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtgagcgctctggtgcttggagagcggtgctgggtttggttttgttttccctgggggtggggtttgggtggggaggttgggaggtgttggacatcctctgaatggagcagggctcagaatgccaagggcaggatggcatattcaatgctgttgagctagggaggcactcagcacactttatttttgaaacataatcttgttctgttgcccaggctggagtgctgtggtgccgtctccagtcactgcaatgtctgtcacctgagcccaagcaatcttcccttctcagcctcctgagtagctgagactacaggtgcacgccacgccaccatgcctagctaatttttgtagtttttgtagaggtggtgtttcgccatgtttctcagcctggtctcaaactcctgggctcaagcaacgcgtgtgcctcagcctgcaaagttctgggattacaggcttgagcactgagcccggcccagtacaaacctacagacttatttttacatctcattttactcagtgtcatttttaatccaaacattaattgataacattcatagggtcgatttgtgccccagcagtctctgcctccaagataaatgtgaaaataaagcagacacatttattttaggagaaatggacccacagcttcagttccaccagtgcctttgttcctgccccggtttctttttctgttgtgttaaaaaaaaaaaaatccccgaaaaccactaagctaaaatgatagaaaacaaacgaaaacagctactgttgtagcgcccacttcaaaaagcggaaagcctgtgcaccgctctgctaatgaagagacattttgcttggttgttttaattaatatttgatgtttgaattaaacagtgaattctgaggacaaattgaagaggcagtttcgattaagaggcctccatcttgtggcctgcacaagagtgtcagaatgaaatattctgcagcctcaagggggtcatgagttctactggttgcagtataggaaattctcaatttaggagcaaaaatgatcttgagtatgtttcctcaagcctttttgaatatattcaattttaatgtattatgttttcacatttcatcatagaaaaatgctgaaacaatcagtaacaaaatttgaaattctgtttggtagattttcacattaacatgtgtacagttgaatattttataattattaattctttatgtggaacaccgcaaaagagtgactgataagtataatgtggtttatccatgaaaaaggatccacatgcaacaagtttgtttgttttgttttctatgataagggaaagaaagatcaaggtttgtatcatcagatttttcccttgctttcaggcatttcatcttggtttacccaggggataggttatctaatgagcattaagaaactcaaagcattgagaggtaatttatttttccttgcatcaagtaataaatatcgcaaaaaaaaggtgatttttttacatttataatatgtaaataaaaatgccaaagaatcctgcctgagttctacaccagatttatgggctggagagtggttaagggaaagaccaatacatcagcctcagttaattaaaacatgttaaatagagacccgctcccctttcagcagaagaccagcacctccagctcatgcataataccaaatgcttgcattccagcgctttgagcatgtgctccggcagtgctgtgtgtgctctctgtgtgttgccagggattaatcagcctaagacactgttcatttcatcaagtgtaacagaaaagattcccatgcatcttttttaggaaaaaaaaatgtttgactcattccacatgaaagagatcagatgaaaaatatgttaactgagttggcgaatagatggcaaggcaatgcgataccgtatgtctttaattagctctgatttttatcttcgttctttaattacaatgtagatcagtcttgtgtgtttctattacacttactattattggctattgttcacttggtctcttataaaaacagtggaaattaaaatgataaaattagctcctagctaatagcttaatgttcattttagtaatttcactatctgctagagaaacagcaatcctgtgtagcctgttagggtttttcttttaaaatattctttgcctctttacagctggtcaaattctttgtaaatttacaatatgttttaatactttttattgtataacatgtgagctgaaagaaattgacaggtgaatgatttgttccagggtttaaaaaataaacaattgattaaatataatgcaagaaaatggttatttggaccagaaagcctccaaataataaacattaacacaaatatgagtgacataaattttaagagatggtgatcagctttcatattcttagtggcacagtgcttgtcctgggaccaggaggtttatttattgtttacttctctctcagaggagtgctgtaggtagagtagaagacgacttcatcaaagcacagatacagtattgcacacacttcaaaccatcagagccggaaaatgacatatctgtcactcagtaatccttcttatatttttattgtgtcatatttctttgtaatttaaaaattaaggataatattcaagtctctccgctttcagtcttcttttataaataagtatattttaccaaattagtatatgccatggtttgaaaaatcaaataatacagaaggtttatgatgaataaagtagtccctggccccacgctttctctgctgagactctatgaccaaaggcacctccttcccctgtttccatttctagttcttctggagggtgtctccttccctgtagatgacatgctgagaccactgcttcttgatttgtcgtttttagattatcagtgggctttgtcttagggtacaaaccaagaacagagctgccattaagttctgtttaaagaagggagaaacgatgtggaagcctgttagcaaagaagtcaattatgtgtagattacatgctggtttaaattcctatgtgttatttgtattcagtagtgaattctaaagagaaaattctagattgaagaggctgcgtcactcacgacgccttcttgcgttccctcttattcactctattgggtttctttatactttgtaaactttgtggtttcaagtaatatccttatgcttttatttctagttttatcagtaatagctcatttcttccattttcaaggctcttagcttccttgtactttcttctgccttttttcttttacagcttctgttatctgcactttctgtgattgtctttcgttctctgaccacgattaacacctctgtgcttgagtggagattgattctataggaagacaagcattaaaccttgtacctgattatgaccacataaatattgctcgctcagtggctagagtactgtgatttccatttttataactgttttcgtttgtttgcttttcctggacatttcctcttttcttcttgaattacctatcgttaccacttcctccactgatagatccacaaggagagcggagagcacagaaggcgccctctcccctcacatcttccaagctctcctgcctcgctcagccgatcgtgcctgtggcctgctccccggcgtcagctggctcccctttgtaattctccaggatccgtccctgtgtctagatcccacttcttcccctctctcgattttctcctttgttctcctaggggaaatcctcaagcactgccctaagaaaggatgtttggcagtctgagaccatcagtatttgaagcagtggaagtaatgaaaaatctcattactgggttttaatcaaatagcagtttgtctttttcactaataaggtctctgaggcaaatgatgacttttcagcagtgccactggggaccaggcatccttagccgactggctttatcctcatgtttgcaatatgcccaccacatctgcaggtgtttcatctgcttgggaggcaggaggaaatggggaaggggcagtgctggccacagctgtctctttataaggaagaacagcccgccctctgtatctgtggcttccacatccttggagtcaactaactgtggctccaagacattcggggaaaaaaaattgcattgtactggacatgtacacttcttctcaccattgttccctaaacaatatagtataacaactacgtttacagcattcacatggtagtagatgttataagtagagatgatttgaagcacaccaaagtctgtgtgtgggttatatgcaagcaccacaccattttatatctgtgcattggcagattttggcatccatgggggtctaggaaccaatgccctgtggatattgagggatgactgcaacaagcagacttcgctttagaccgagttggccagagccaggtcacgtagcaccccaggtgtggttgaggggtgactaaagggagtggacttgggggtggctgtgagatgatccaatgaggaccatcagccacattacctgggtaatgtcatcattctaaccacatccattatcgatagtgtagatatggaattttaggcaattttcactcttccagtggtagccctgttactccttgcagtggatgagtagatgttcttgataagtctgccacctccatccagataaatgccataagaggaatatttatagtcatcgtacacagtatatgtattgactgagttggagagagagaaaaaaagagaattcaaatgttttttaacaacttttatctggatactaaatccttagcctgtaaactagaaaggaaggtgaagtcttaaagaaacagatgctcttggaaacggagcccatgaagtcttgtccgtcagtttcttctagaggatatttctcaagggcagtcacagctcaccgtcactgaagacggcagtcaagcccggagtcaaatctaggcgagtttctcctctttttaatgggaggccagtagcgagttgggcaggcggtaaagataataatgcctttcttctgctgggacagcacgggctccactgccccagtaagtcttgttctgcacatagccatctgcttttggtttagggctggagcataggcaagtttttggtgggagccatggaaatagcctgagaatgacttcctggagagcaggttgctgtgtgtcagaagagtcttgtatgaaagttcagccctggccggtgcggtggctcacgcctgtaatcccagcactttggaaggccaaggtgggcagatggcttgagttcaggagttcaagaccagcctgggcagcatagcgaaaccccatctctacaaaaaatacaaaagttagccagctgtagtggcacgcatgtgtcatcccagctactctggagaccaaggtggaagggtcgcttgagctcagagctggaggctgcagtgagccgtgattgtgccactgcacctcagcctaggcaatagagtgagaccccatctcttaaaaaaaaaaaaagttcagcccatggatcatgggcacaattcacttctccactattcccccgcactctgcaaggcttttctcaggatgcttccgagtaactcgtgtttgtgtggtgtctctaaacacaattgtgtggtccagtcctgccacctgtagcagtacactcccaaagcacagaaacctgtccgacggtcactcactgccacagcgagaagcttgcttgggtccacagcctccccaaggctgcagtgacttaaccgccccccgcccctaccaatgtgaaaacctatacttaaactgataggtgatacattggcctcctgcactgatccccgtagctaaattttatgtcaaataaatattgtaattctgccaaaaatgactaacgtctagaatcttcaagtttcctcaaaaatattaaatgcatatctcacagatctaaagtactcatgttctgaaatcttcttcatttctttgctactcttgtagacaggcacactgcttggctggcatggaattctgcagcaaaaggcagttctcctgctgaaggttgtggttgtagtgattgctgaataccatcagttagttctttgggtacctctcaacaggtgtgtttcttaatcactgtttcctaaattggaatttgtgtgtgtgagtttgcaaatcttctccacggactcaccgtcgtcatggcatttgtgattcagaggagggatctgcggtgccgattccacaggagctcaggctcgcctgtatttctctttcaagcaatgattttcataagtgctttcccctgtaatctcatagttttgtcatttgtaggcagtagggacgtgagctgacatgtgttaggtcacaactttattaattttcaagtgatattaatttttaggtttgaagaagatgctttccccttttctaagttgtctctgtttcctccagcataattttttttcctttggttaatttagattattctctgtcatactggaggtatgtggtgattttattgtttgtcatatttaagaatgaagagaagctgcccatcactgcgtgtctgtgacaggaggcgttggctagagggccttgctcgatgggaagtagggggcgctggctgctgcgctggggactcatggatgcccccatgccgaggtctttatttctctgggctctaaatgactacaccagctgcctttaattttccccagatatgtcagtaactctctttagaggaaaaaaacccaccaccagcctgagtgctttccggcaggggggcggtggtggaggatcattgcagaacacctggcttcaggcacacaggtgagacgccggctgtcctgatggcaggtcttcaggtaatctgtgccttccagcccgcaccactccaggcttgggcatgggggctgccttccacttcccttctctgcatgtgctctggacactttcagttcctcttttttaacaaaagttggccaaagtcagttttgcgtaccttatactttatttatagtaagctgtaagaacccatacttgtgaaggttttcaaaacattagaatatctgctccctggtgttaagaaatgtgtaatatagttgaagcacatatattcattctttctctctctttttctcccccgcccccccgccacactcactccaccaccaccacaatgaccaaggagaagtgcatttttcatttagcagaaatgctgccatttccactgtctatagcagaaggggagttcgtccaaaacatacagtagaaacccctttaattggaatccacagaacggccatccccaaagccccgctggggagaatgaagccactgtgagaggttaagagggtgggggggcagggctggcccttggagtgggctggcgagctgacttgccaaccagaaaggaaataggtcacgggagaaatggggggaaacacaggcccatggaggatgaggtccacgcctgccagtgggtgctgggagggcagccccagggggagcaggcagcaggagatgcccagcccggccccgtgtacctggcaggcctcagcctgtggacaccctcgcctttggtttgtgtgacatttcacagttggtgggacatttgtgccgtttcatccatctttagtctgcgcagctgagctgaatgtggccgccaaagcttttgctgcttctctgtgcccatgcaccatccctttctgtggtttgcacggggagataaaggtcttttttgttggcacctttcgtaactccgagtcctagaatttggaggcttcagtaaaaagaaaagtgatttctctgcataaaaaatttaagaacccttaccgctgatgaccttaaatgaatttcacagacacgtgtcattagcacaggcagcttccagggtgcaactgaagttcccctttcttcacaaatgcttcccccagcctgaaatcttccttggctgaccacatacggcaatctcctacacagcggccttgacaatcatgtgttgtcttgtagcctctcttctactgtcataagcttactttacatttgttatgtaaacctgtcaagaatgcctcacgttaaattgatgctcaggaaggatctatagatttggcttgataaatacatatttgaataaactacctttagttgtcttctttagatgtatccatgatgcattaaatatatttgatcttcaattgatttgtatgaaatgtgagaagaaacaaagaaaacttgattagccataattcatgaaaacgatacactgtttgcagttgtcataaaactgggagctttcccaaaaattcttagagtttaaccttttttttgtttctaatttcatctattttaaagtattgtctgaaattgcttgatattctggaccacagatgatggccagcaccatgggttgcagactggggcactgtgatcccagcaggacccatctgcctggccctgcttgctgtcgcgggaacacctctgccgccaccacggaggccgaggggctcgccccgccccgacgcggaggcagatgtctttcacaaaggatcctggtggcacagggcagtggagtttctggctgaaggtggagcctcatgagaggagaggggcaagtgggaagtaagtgctttcactgaacactgaggtcagaaacacggaagaggtgttcattctcacccatcctctccagcatcacacgataagtccgtctgcgcagaaggcaagggcaggaaacaggcatagagatcagaaaagaagttaggccatcttttcttgaagtgatcacctgtgttgaagtgtcagctgttaagtatcacagtgggatttacaggatactccctccagcagcagccaatacacacacttttccagcgtccatgcggcattcatcaaggtcggtcacatcctgggtcataaaataaacctcaacaagttttaaacagcacagcgtgtgttctttaaccacaagagaatcagctacacgtcaataaacacgagaaaaaactgtgaaaaaaattaaacaacgtatttctaaataatgggtcagaagcctcaagggaaattaaaaaaaaatacatagagttagatgaaaatgaatatacaacatatctgtatttataggatgcagataaatcagtattgaaagagaaatttatagcactaaaatcttatgttagaaaagaggaaagatgacaaattattgatataaattcctacttcaagaaattggaagagtaaaataaactgaaagcagtcagaagaaaggaaataataacagaaatcattaaaattgaaaacagaaaaacaatggagaaatattaaaagctgattctcagaaaaaaaatcaataaaatggatacattcctagcaatactaacaaaatagaaaaatcaagagggagatggaaaaacctctacagatcctgcagccatttaaataataatgaacaactttacactcttaaattcagcaactgagaggaaatggaccaattcctcgaaaacccccagctaccaaaatccaaccaattgaatattctgagtattatctgttcagcaatagataatctgaatagtcatagaatcatgaaagaaattgaatttgtcatttaaaattgtctgaaacataaatctgcaggcatacatggtttcactggagactattgccaaatatttaaaaagaagaagcagaacaccggttttgtacaagctcttccagaagatagaagggttgggaacacatttcaactcattttatgaggccattattatcctaatgccaaaaccagacacaccgttcaaaaaaaataaaaaacagcaaaccaatatctgtcacaaacttagatgccaaaatcctcaaaacaataatagcaaatcagttctagcaatttataaaaggaattatacgctgtgacttagtgagtttttttacgggtgtagaagtctagttcaatgtttaaaaattaattaatgtacttcataccaacagactaaagatgaaaaatcatacgattttaccaattgatgcagaaaactctttcatgcgagagaaaacaaacaaaaaaaaaactttcagtgaactaagaatagagaagaacttcaatttgattttttaaaaaatctgtaaaaacctaacagccgtccttttacttactggtaaaagactgaatgtttcccccttaagattggaagcaaggcaaggatatccattcttatcactgttattcaacagaagtactggaagttctagccagtgcaataagacaagaaaaagacatcattggttatcagggaaacgcaaatcaaaactacagtgaggtgctacctcgcgccactagggtggcagcaataaaacagatgggtaataacaagtgttgacgaggatgtggagagattggaatccttgcacactgctggtgggaatgtaaaatggtacggctgcttcagaagatagtctggcaaggttctcaagatgtgaaactgagggtctccccgtgacccagcaggagagtggcatgcactctagaatagcgcttggcccacactgggcactcagctgacccctgctggcttggctaatgagcagagtaaaaacactcctccctggcagtgtgggggccttccgagtggagggtggtgctggtgtgggggccctccaggtggagggcagtgcaggaggccatggcaggcagtggcagtgcttggactaaggtggtagatgttggcaaggcaattgtttgcatctggggttcgttgtgaaggaagagtgattcgctctggatcagatggaggacttaggcaaaaggagttaaaggcaacaccagtgttttggcctgggtggaatggagcagctgtctcccgagccaggaggaccatgaggctggagggtggatggaggtcttggggtgcaggacacaagagctctgctcaggcaatgtggggtgtggggtcctatcagagatgtttgttcagcatctcctgtaaattaggaagggtgacagggcatacagcagcacgcaagtggacaaaccctggctctactttcctgagaatgcatcagaaggtggtcggtgtcatcctagaacagacaatggctgaagccacgggatggtgacgagcccccatgtggttcgtgtggctggagaggagaggccagtcgaggcctgcgttcggtggtgtgtgtagagtctgggaaaaggagaggcactgacagaccagaccagagaagtagccaggcagttggagggtaaccaggcactcgtggcatcaggaagtcaggaaaagcctcaggaaagccttctagaagtagggacagttagctgattgctgtgctgttgagcggctcacacgaggaggactgaggatggaccgttgtatttgtgcacacggggccattgctggatttaacaaaagcagtgtcaacgcagggtggtgggctctcatgtgattctaaactgttcaagagagggtgggcgatgccatgtggaagctcctgagggaggtttgttttcgtcacatggacattatgagagcatgtgtttgtgctaatgggagtaacctggcagagagggaaaagctgatgtgtgggagggagagagagctcctgagggcggcccttaagtaggtgtgaagggaacaggatccattacacaaggggaggagctggctggaggcggagcatcgacggtggtcattccagaaggggatggcagcacatgcatgcagaggccaggtttggaggaaggatgcagacgcacagcacaatcaagtttaggaggagcaggtacacacacacacacacgtatataagcacatgcacatacagacatgtacacatacacatgcacatagacaacacatgcacacatgtacacgtatactcacctacatttacatacatgtatgcacacacatagacatatatgcatatagacatgcatagatgccacacacatacacacgcacatatacatacatgtccacacatataaacacatgcacatacacatacagccatatacacagagacacacatagacaccatagacacacccacacacatacacatgcatgtgcgcacacatacatgcacatatagacacgcacatgtatacatgtgcatacacacatgcacacgcctatatacacatatatacatgcccacctatacatacataaacatacacatatacatgtgcacacagaaacatggacatatacacacatgcacacatacacacaggtacatgctcatacatgcacatctacacactcacctatacacacacacacacacagcttttggtgccatgccgcagcacattcctagtgcttcacatatgttcctttctaattggtgtttgttttagaaggtggagtgagtacacgtgtctggatccagccttattagattgtctttgcgcactgggaataacacccactttatgctcagctcttactagtgtctccagctttccctctcctccttgttaacagaattggaacccttcctgtcttcccgtctctctcctgaaattagccaaggctctctctcttatgactcagttcattagagaagtaagcagaaacacagcagctgatgatgaacaaaatgtttccgggggtgaaggcacccatctggcagggggcagggcgctcttgcaggttccgccgtgcagagaagaagccacaaggaccgagggaggcctgaaggagatgtctaacctgagccgtagaacgtaagaagttgccagcataaagacaggtaggaaaggcatgtcagtgacagaggcaggagaacacgtgacccacttgtgtggggagctccagcagcgcgttcggagtgctgggcattgccaggtctgaaagaggtcatcagttcttgggaaaggtgcctgcgtgggctagaaatcatggaacaaatcataaagccaagtagtaatttaaacccagatgctactttaattaactcactttgctactttgccctcggcagcaagggttgagggcacagccctggctactagcacagccctggctactagcactgtcctggctacgagcacagccctggctactagcagagccctggctactagcactctcctggttactagcagagccctggctactagcacagccctggctactagcagagccctggctactagcacagccctggttactagcagagccctggctactagcacagccctggctactagcactgtcctggttacgagcacagccctggttactagcagagccctggttactagcacagccctggctactagcacagccctggctactagcactgtcctggttatgagcacagccctggttactagcacagccctggttactagcacagccctggttactagcacagccctggctactagcactgtcctggttacgagcacagccctggttactagcacagccctggttactagcacagccctggctactagcactatcctggttactagcacagccctggttactagcactatcctggctactagcacagccctggttactagcactgtcctggctactagcacagccctggttactagcactgtcctggctactagcacagccctggttactagcactgtcctggctactagcacagccctggttactagcacagccctggctactagcacagccctggctactagcactgtcctggttacgagcacagccctggttacgagcactgtcctggctactagcacagccctggctactagcacagccctggctactagcactgtcctggttactagcacagccctggttactagcacagccctggctactagcactgtcctggttacgagcacagccctggctactagcacagccctggctactagcactgtcctggttacgagcacagccctggctactagcactgtcctggttactagcacagccctggttactagcagagccctggctactagcactctcctggttacgagcacagccctggctactagcacagccctggctactagcactgtcctggctactagcactgtcctggctactagcactgtcctggctactagcactgtcctggctactagcactgtcctggctactagcacagccctggctactagcactgtcctggctactagcacagccctggttactagcactgtcctggctactagcactgtcctggttacgagcacagccctggctactagcactgtcctggctactagcacagccctggttactagcagagccctggttactagcagagccctggcttctagcagagccctggttactagcacagccttggttactagcacagtcctggctactagacacctctgctagagactgcccaaagaatatgccatgagttagctctttctccccctcctgccactggtcagctaagccttccccctaaaaatcactttttgatatagagggtgaagaatttccagtatctcctttagttgactgtgagagaaattagtgtaatttctaattgaccatcttcacagagttgtagaatgatcacagagcatttagaagctgtgggttgctaatagctaaatggctttgaaataatgaatgcttcatttgggggaactcggggtaactgtgacaaaccgttgttatgaaggggctttagctagccttggaagggcaggctggaggcttctgcacgtccttggaagtctccatccaccagaaggagctccttctgctctctcagcctggatgtgatagttgccagcaataggcgcaacttggtttttaaattaaaatctaatatttgatatacataattctatcaacaatatattaaaaatatgatttctgctttgcatctgctctttttggtacactgtgtgtcacatgatagatgccacattaatatctttgactattaatagagttggataagtaatacactgactcctttagcagcctcagcctttctttgaactttgcaaacatggccattgtaattaggtgttgttgaattgagaataaaagttactttaaggcagagctaaaagtgttaccgaggagatgctattttcagaaattacttggtaaagactcctctggagttgttagtaccgtatctcattataaagatgcctcttatatgtatttgagaagggaaagaaggagcccagtgttgacgttttatttagaaaatgtgaggccgggcgcggtggctcacgcctgtaatcccagcactttgggaggccaaggcgggtggatcacctgaggttgggagtttgagactagcctggccaacattggtgaaacccagtctctactaaaaatataaaattatccagacgtggtggcgcatacctgtaatcccagctacttgagaggctgaggcgggagaatcgcttgaacccaggaggtggaggttgcagtgagctgagatggtgccattgccctccagcctgggtgacaagagcaaacctccatctcaaaaaaaaaaaaaaaagtgcagtgcaggtgatccccaccgcccccacagcggtgctttctgcgggtgatccccaccgcccccacagcggtgctttctgcgggtgatccccaccgcccccacagcggtgctttctgcgggtgatccccaccgcccccacagcggtgctttctgcgggtgatccccaccgcccccacagcggtgctttctgcagggagcggacggcaggcctggggcgtgctgcccgcttacctcatgaactgcgcgtgcactgactccacattacccacacgtgggaacaatgcagcagatgtcttttttggatccggttgctgtgtatcgcatcgcaagacttttctggatccttcccaaatcctccagaagactctggagagcattggaagatgagagtctttcttgtgtttgagtccctaggctccccggagaaacccctttgggtgcacgctcaccttaggcttgctgtttgggaaaaccatggctctgggctggaattggtcacttttaggcctgggcactgttcacaagcttggccaatcacaagcactcagccttacacgcaggcctgtttctgaaagatagtttcaattacggggtcaatatcttaggtagatgcaaaaccaaaacagtgtataggaaataactcatctgttgaaatagtttttttttttcccttgggttagcaatcctgaagaacgttcattggcagaaccctttggcttgaatgtcaggatgttttttaaaaatgctaggttctgggtgggtgcggtgggtcaggcctgtaaccccagaacttcgggaggccgaggcaggcagctcacttgaggtcaggaattcgagaccagcctggccaacacggtgaaaccctgtctctactaaaatacaaaaattcgctgggtgtggtggcactcgcctgtgatcccagctactcaggaggctgagggaggtgaatcgcttgaacctggaggtggaggttgcagtgagccaagattgcgccactgcacgccagcctaggcgacaaagcaagactccctctcaaaaacaaaaacaaaacaaaacaaaacctgttggttctaatacccctaaagcaaagagctctcctgtgtactcgtccatgcacccagtagtgtggtgggaaagaaggaattcagcatgcttcctcctgggcctggcagacaggtaccaggtgagtggagcactgtcattgcctgtcacttgctgttggaacctctgcagccagagggcatgtcttcttgtctatacatcaacgtactttggggggcttcttaaataggtggggtttctgtcaatgatcacactgaatggggaaatgaagtttctagtaggcatatttgggataaagctctttctacatctacctgtccgactgctccctcggcaaccacagaatgcttccagtgtccagtgtgctccaggaggcattgggccaagcgcccgtgcatctcagggtgcaggctgagataggcacggcagatgcaaacccagcagcgtctggaccacgggagctttgtctctccaccggacaagacacagacttcttggtccctaaggaagtccccttcaaacctgctgagttctcatgtggctcctgtacactggagactcgccccaccaccccatgccatcctatgttctagtgctgacttggaagaaaggtgggttggtatgaaaagtgttagatttcagaagcttggcacaaatggttggcagcgatggagggactgcagtgtttagaggccatggtgggaggacctgttggatggagggactgcagtgtttggaggccgtggcgggaggacctgttgggtggatggagggactgcggtgtgtgtttagaggccgtggcgggaggacctgttgggtggatggagggactgcggtgtgtgtttagaggccgtggcgggaggacctgttgggtggatggagggactgcggtgtgtgtttagaggccgtggcgtgaggacctgttgggtggatggaggggctgcggtgtgtgtttggaggccgtggcgggagggcctgttgggtggatggaggggctgcggtgtgtgtttggaggccgtggcgggagggcctgttgggtggatgggggggctgcggtgtgtgtttggaggccgtggcgggagggcctgttgggtggatgggggggctgcggtgtgtgtttggaggccgtggcgggagggcctgttgggtggatgggggggctgcggtgtgtgtttggaggccgtggcgggagggcctgttgggtggatgggggggctgcggtgtgtgtttggaagccttggcgggagggcctgttggatggagggactgcggtgtgtgtttagaggccatggcgggaggacctgttgggtggatggaggggctgcggtgtgtgtttggaggccgtggcgggaggacctgttggatggagggactgtggtgtgtgtttagaggccgtggcgagaggacctgttgggtggatggagggactgcggtgtgtgtttagaggctgtggcgggaggacctgttgggtggatggaggggctgcggtgtgtgtttggaggccgtggcgggaggacctgttgggtggatggaggggctgcggtgtgtgtttagaggccgtggcgggaggacctgttgggtggatggaggggctgcggtgtgtgtttggaggccgtggcgggaggacctgttgggtggatggaggggctgcggtgtgtgtttggaggccgtggcgggagggcctgttgggtggatggaggggctgcggtgtgtgtttggaggccgtggcgggagggcctgttgggtggatggaggggctgcggtgtgtgtttggaggccgtggcgggaggacctgttggatggagggactgcggtgtgtgtttagaggccgtggcaagaggacctgttgggtggatggaggggctgcggtgtgtgtttggaggccgtggcgggagggcctgttgggtggatggaggggctgcggtgtgtgtttggaggccgtggcgggaggacctgttggatggagggactgcggtgtgagtttagaggccgtggcaggaggacctgttgggtggatggaggggctgcggtgtgtgtttggaggctgtggcgggagggcctgttgggtggatggaggggctgcggtgtgtgtttggaggccgtggcgggaggacctgttggatggagggactgcggtgtgtgtttagacgccgtggcgggaggacctgttgggtggatggaggggctgcggggtgtgtttagaggccgtggcgggaggacctgttgggtggatggaggggctgcggtgtgtgtttggaggccgtggcgggaggacctgttgggtggatggaggggctgcggtgtgtgtttggaggctgtggcgggaggacctgttgggtggatggaggggctgcggtgtgtgtttggaggctgtggcgggagagcctgctgctcagttctcaggactggttagaaagtaaatttaacgtaggagcaacttaacaaaaagaaaagcttttcattttgggggctttttttgtttgtctttagagatggctttgctctgtcacccaggctggagtgcagtggtgccaccacagctcactgccaccttgaactcctgagcccaagggatcctcccacctcggcctcctgagtagctgggactgcaggcatgcaccactacaccaggctgattttaaacaactttttgtagagacaggggtcttgccatattgcccaggctggtctcaaactccagagctcaagcaatcctcacacctcagcctcttgagaagccaggactacaggcatgcaccaccacacctggctaattaaaaaaaaattttggagtgatggggtctttccatcttgcccaggctgatcttgaactcctgggttcaagtgatcctcccacctcagcctcccaaagtgctggtattacagatgtgagccaccacacctggttatataaaaagaaaacctaaaactagtaaaccacactgatattttttgctatatttctgctatatacatgtccttttgaaaaggaaaataggaatattgaacttagtttttgcgtaaagggccatttcctcccacttaaagttgtttcctttttaatcctctgccagccattcttacgtggccagtggtagtggtgctgattaaaataacacaagtctgccagcagtcccagacagacatcgcaaatggcgccttccacagttcaggactgtgtgcttcactccacggaggtctgcctcagatgcctccctcccagcccctttccggaggccagggagagtgcgtttccaccaagcgcaggagtcagcacttcctcatagccttcccgtgccctcccagcaccaggcacacatggccgctcccacctatcccatccacctgttgtgacgcgggtctgagtagctgcaggtccacgtcgttcctggacccatcatctggcttagtgggcctgtcacagcagacctggaaactaattttctgtgtacagcaggttgcattgccgatgctattttagcttatggagcccagagcccaggaaatggttttaaacatgattttgccttccctcttccctcttgtttaaaaaaacccactccttggtggttcttggtgattgttgcgtggcatgtaaatatccctaatgtcaccgaactgtacatttgaaacagttaacatggcaaattttatgctacaggtaatttatcatcataaaaaaaacctcattcctctagaaattgcagtttttattgaaaaagttaaattatatttattattaagtatatgagaatttgatttgtactctgggtttaatgttcctgtggtagaatgggttattaataaaactagcagtcattagtaccttccagctgagaaatttgagatgttaaaaacaaagtttgtcagagtcagatgacagtgcgttctgtaccatcaccgtggtgcgaggtggctgtgagtgaatacagctctgtgtgtatttcattccgaaagcactgggcgtgctgtctggagagggctcggcagctttcgtgttggcgtcgtaggtgcttggtggagattcagaaggacccagatgggataatggggcaaaagcagccctaaaatcaggggcagtgcccggcactctggacgcatgtgctggcccagctgcagggcagtccgtgtcatctttggggactctgtgtcctcgtcgtcacagctcttttaacatggagctgaaacctcatggggttggtaaaaagcagatgaaatagtatatgtgaagagccgtgagaaatactaagaactacgcaactaaaagtaaggagcaaggaaggagcaaaaatgcagacacagacacattctctccccgtcaagccggggagcgcatcgcagccctcggtgattaaaagccacacactctggacacatctcacccccacccatattcatcgtcacttacaatattcatttacaatagcgcctcctcttcatggaggcctgccacagtctgagtaaacaaaagtgatcttgtccctgtggtattcacaaaacaagccctaggaattgtgtaagtcacaaacagcgtccaggccctggatctgggacgaccagtctctgtcatgcgatgctccagccctcatgctgaccgcttggtccacgaccccgcattagcaggtggcgctctcagtctgaagcctcattctgtaccttgttgttccacatccccagcctagatgggcagatgaggttggcccctacagcagaatgctttccattacagccgaattataggtatttgtagacacgtgaatgaaggagttctgcaagctgtgtggcccggtatgatcggcatttttggggttttctgttttcattcctttagctatctacatgacatgcccaggcatcacatttcagggtaactgaagagaaggcaatgcagattccatctcacagcctgtggtgtgttcttcttgttttgtctgttccctgtctctttctgtccctttgtttcctgctaccctttcccctctcccctctccccacaacaaaggaccagccttgatgatagtgcaggagggactttgcaagccaagctctcccagggcccatggggcctcccttccagcaggtgggccctgcatgcagcccacagtgtctgaggactctgcatccccggaagggaggcattgcttgtgcgcagctgctgtgcctcccccagctgaaagcattctgtttggtggaactggttctgatattttccagctcttctcaattatttccaggagcaggcagagcagtgtgtgtacataatccctcatgtgttatacttattaaattttactggccaaaatgccaggaattcttgtgaacttcattatttctgaaaacgacagcaaaacctcttgtggattaccgaaatggccacatgcaggcaacgtaggtagccagggaaaggaatcacaatctcagtgctagtataattagtccttggtggtataaggatcctgttttgttgaatgctgtggttttttggtaaaacaggaacccacctggtatccatggcagggtatagcaaactcgtgtatcagacagtcctgtcattttttaaacctttgaatgtaatgcattatttaaaaagaaggaagagttacactttcagttagatttcatttggtaaaaagtgaaattttctgtgcattttagtagtaaacaacaattcacttagtgcctttcttcctaaaatggcactgtgatatcagcttcacatatgatacttttacgtgacaagtctcattgaaataaataccaaccggcattactatccctactttaaagagagattaaattttgaattcaaaaacacctcacctttctccctgattacaaaattaatgcacatttgtttgtagaacatttagagaaatccgatgaagatgggaggagataaaatccccctaatcccccactcggggatgagtgctcgctctgtctgtttttcagtctcttttgatgggtcgctttagtcagcccactcaaactcacattttgtggtttgcctttgtgttggtgatggagttcacatcatataacctgaacgtcttcccatgtcattaaacacaacaaaataaggttaggatagattaagattgaacgtttaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgtgcgcctgtagtcccagctactcgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaagattgaacgtttaaaacaaaccgtaagacaccatgaaagacctggtggacagtgatacaatcctggggtaagtagggtcctgcaaagaggaaaaccgggaagaaaacagagttgacagagacacaaccaggctgtgccatcagaagggccttgggaatgagacggccaggtttccaggcttacagtctgtctctggagacagttcagcagcgacgcctctctccagaggactttccagtgaaaactcacagcctgagttgatttattctttccttctgtgttacagctgcagcttactatttggttgtgaccagcagctaaatcacactctcttttcccgaatgttctgcccttcaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggtgagtggcccctgctgtgcccctgggacccactcaactgggctctcccgcagggaccccaacccatgtgggccccaggcattcacctggtcccaggagcccacgtgacagacatgagtgtccccgccttctttttgtgtcattcgggattccaggtggaggtttgggttctactctttgagagctcaagatccttcttccttctgatctgttcgtgggcagctcactgctttgcgatttccaagaacaccctctccttacctttgttcactgcggaggcgtcttagtaccaggataggtcatactggaaactggactttctttcaggggaagaaaaggctgttatgaaaaaggaagtcatttaattccttgcttgagttgaagcgtaatctttcaatgtatttttagcaatgaaaaaagagccatgatttttctgtctccatcctttttaagttatagccgtcgggaacataactgaagaaatgtgtgtgatattccaagatggtagaagccgcatttcagccccaacatccccagcagaacgcacagtgggatatgtgtgtttcctgcctccaaatccaatattctcccctagaccatcttgccagtctttaatatctcctttcccattttatgttttgctgaaaagcttatatgtcgtggctgttaccggctagtagataaatacctctcccttgaggtgccgtgcgaatggtgcagctgtgcagcagacaccgtgctgtcggccgaggacactcttgaggcttctgtcaagatggcctaacactctagacaagtctcctgccttctcacccacagccctgggcggacacggggagctaacagcacagcaaagtaagggcccccagggacaccctgggaggggccagaggggcagggcagcctgaggggggaggaaaacttggccttcctgctctgcctctgcagccaagtccaaattgatcccagaccccagggctgggggttcatgatgttggggtgactgcagcgcagccctcacattaactgtccctaggcctccccaccaaacttgagggctacaggtttccattcagggagagacctccttttagtgttactcaccccaaaatagttggagatgaagggaagagggctgggtgtggtagctcacacctgtaatcctagcactttaggaggctgaggcaggaggatcccttgagcgcgggagttttgagaccagcctgggcaacatagggagaccttgtctctaaaaagaaaatagaaaaatagcaagtgcagtggctcatgcctgtaaccctaatgctttgggaaggtgaggcaggcagattgcttgaggccaggagttcgagactagcctggccaacatggcgaaaccctgtctatactaaaaatacaaaaaaattagctggatgtggtagcacatgcctatattcccagccacttaggaggctgaggtactagaattgctcgaacctgggaggcagaggttgcagtgagccaagattgtgccagtgtactccagcctgggtgacggagcaagaccctgtctcaaaaaaaaaaaaaaaaaaaagaaacaaaaaaagaggggagaggagctgtctggagggggcagcagagagggatctgcagtgtttctgctgtccagccagtacccccaccttacctggctgatgcagacttagcctgaaagggccactgtcctctgcacccagcggagcagagctcacttggcaaaactagacacctgagtagcacagccactacgcagagagaaagctgaaccagggttattgtaaaacaagtgtaatacatacaatcaaagaaataaaggaagacacctgtaacaagatgtgagaacaatgctacagttttaatgccttcccccaaatgtatgtgctggaaacttaatcccccacgcaacagtgttgggaggtgattgcatcatgagggctctgccctcacatttaggttaatgtcactgtcacaggggtaggttagttatgtgagagcaggttgtgataaaagcaagcccagccccttgtgttatcttgcccttccaccttctgccatgggatggcacagcaagaaggtccttgccagatgccactctttgaccttggacctcccagtctccagaactgtaagaaagaagtttctttacttagatgaagagaagctgcttgaaaagtccaagaatacagttaagtaggaggaataagttatagtattccatagtagagtagggagattacggttaacagaaataatttattggatatttcaaaatagcttggagagaagaattgtaatggccccaacacaaaagatagaaggtggagtgagatggtggaatagaagcctccaccagtcttcctgcagcaaggataccaatgtaacaactatcagcacacacagaaagcaccttcatacgaaccaaaaattaggtgagcgctcatagtacccagtttagcttcatgttgctgaaagaggcactgagaggtagaaaaaacagtcttgaaaagataaatgtttgaggtgatgtatgagttggatagatcccagttaccctgatttgatcattacgcattgtatgcacggatcaaaatatcacatggagccccaaaatacatacaactatcatatatcaatttaaagaatacaaaaaaaatttgttataaattactcagtctgtcgtagtctattatagcaacacaaaacagacagacagacaagaaaaagtactataaaagaagaacaaagcagaaataggggtaggtgcactgtaatgtttgaaataaagaacacagtagacaggacccatagcaggagagacactgctggagccaaatgaatggcctggaagactacagtgggggctcacaggaggccatgggaaagggtcgagatgggaaacagaaaagccaggagatgcagagaagggaaatagaggccccagtatgcagactgggggcatcccgtgttgagagaacaagaatatggcagagctgaaaatacctgaagatctcggaaatgcactccccaaaattgggaaagctggaagccctccaactgagagggcttgtgccaaccagaaattaatgggagacctccgacctcagcacatccagtgaggcggaagaccctcttgagggcaccttccctgacgccacgttgtttctgaactgctctccatccttgtttgtttgctctgtaatgtcgaagtcctttctgaacgcagatctcttttcacgtaccagtttatgaggcacacgttacagtgtgcctacctctatttctgcttgtttctcctttcgcattactttctcttgtttgtcttaatctgttttgggttactataacagaatacaacagactgggtaatttaaaatgacaattttttgtattctgtaaattgatatatcatagttgtccatatttggggggtccatgcaatattttgatacctgtatacgatgcattaatgatcaaattggggtaactgggatatccatcacctgaaacatttatcttttctttttaagactgctgaagagacggtcttttggggcctctgtttctcttctctgcatctcctggcttttctgtttcccacctctgtcctttcccacggcctcctatgcgcccctcattgtagtcttccaggatattgtagggcttcagcagcctctcacctttatgagtgttctttttaactctctgtactgtatgtctgatccctgtccaaagaggcttatgagtgcccatttcacgttaccccaggaagagattggtccacctgactcaggagttcatccattcattgcccaaaaactaatttattcagtcccgactgtgtatgtaataagacccatgctaatcactataggagatcctaagaagcatattgccctcaacaaatgtctcctctggttgaggagataagatgtggcttgaaaattcatgatttcaatggatgcttcatgcaagatgaaaatctgaacccttcaaggcaatgtgtgatcaaagaccaagtgaccttatggcaccaagggctgttgtgttcccagaggacagagaaccatggctaagggccacagggtttgagaaagctgcttggaggaggtggaacctgagaggaaggtttcgtcaggagtgcggttgagctcagagagtggactgaagtccaagtccattgtggggtgctttgaatgctgcccagaggaccttgacttctcctgggactctggcacaagagagcccctgaagctgtttgggtagaaaaatgacttcatcagaaccgtgttttagaaagaggatccaagtgatgatagggagaccttggtgaccattaggccattatcatatcagtgcggtcttgagctggtaaaagattagggcagaaagatagaaaatcacccaggggcctgtaggctggagcttctgtagacgcacagtggacactgccgagaaacaggcctcatttctcccatgttcccgtccccgctcccggtttcctgcatgactgctttggtgccccctgactccagaatcaacaccacaccagctctgcctttagactctgcccagaggctctgggctggatactgtatttggtgcgaccctctggggcatttttgcaagttttcaggcagatgggtgggggagcagtgaaggaaggaggaaaaaagacaaagcacaaggggaaccggaaatgacatcgctaccttcctgtgccttccctgccgccccactccagctacctgtcactaaacccagtgcacttcatctagttgacgggtttctctcaggcattttgtttttctgccatgagtgggaaggacttggcttccctccgcgcacagctgtgcactcccaaagacgcctgggccagatgtggcagtgcgtcctgtagtcccagctgcttggaaggccgaggcaggaggatcacttgagcccagaagtttgagaccagccctgggaacacagggaaaccccatctgtaaaaaaaagtaaaataaagaagtatgctttcactctgagggctgctggcctcgttatttctaaaatgggtgcctgccctctgagtagggaatgtgctttctctctaccaaggcatgatgtgtcatcccagtagcccctgaaatccttgtaggagttaggacatagtcagatttttaaaagtaagcatttagtaggaagtgcagtgaaaaacaaactgatacagttaccataagagggactttgaaatcaatatgccacagtggcagacagtggtcatcagataaccactgcctggaacaattgagcggtgtctcaggtggcggctcttttacaataaactgctttctcccatattgaagtgctgaaattaggttgaacatgacattttgctaggtgtctatggcctgtgagtggtaatggactatattcattaaagaattatcaagtgaaatgtgtagttttgtgtgagctaagttaaaaaccaccagggtttttttttttaatggaagagtgagatagtttgtcagacagtaattacgtatgtttttagggttttagttttattttttcattttgaaaagtcaatttttctaattaaaaatgaaagatacattcttttcagaaaattactaaaaagttaaaagtagaaaaaaatcatccaagattttaccatctaaggacaactagtgttcactttttgatgtattgcctgttggtcttttttctgtgcatgtacattttgcactgatgtaagtggacagaatttacgatttcatatccttaacccttcgcattatactagagttccctgccctagatcattagagactcttagtaagtatcattttatatttcactatgttgaagttccatgttttatttagccggagcgtagggctttgggatttaggcgccaggagtatgcgggtgggaaggttcagcctggcactctgatgggagtcggcagacctggttctgtgaaggggcagacgcacttgggttaggcttttcgggccacacagtcccaagtctgctgttgcagcacgaaagagccacaggcaatatataaacaaatgagcatggctgtgttccagtcgagctttcttttttcttttttcttttttttttttttgagaccgagtctcactgttgcccaggctggagtgcagtggcgtgatctcggctcactgcaacctccacctcctcggttcaagcgattctcctgcctcagcctcccgagtagctgggattacaggtgcccaccaccacgcctggctaatttttgtatttttagtagagatgagattttaccatgttggccaggctggcatcaaactcctgacctcaggtgatccgcccgcctcagccttccaaagtgctgagattacaggcacgagccaccgcacccagcctcagtcaagctttctttaaggaaacaggcagttggccagatttggcccaggagctatagcttggcacttcctgctccagaaaagggaactaggattgggctgcagatgacggctgtgcgtgtctgccggtctgcaggtgacctggagaagggcgatgctcgggaaggtggattccctccctccctccctttactatgtaaataagagaaacggtttctaagcacgctgccctcattatgctggcacagctgctacagaatgcggtgtgctgggtaaacaacatacagctttgcttcatttggacaaaatgtgtacatgtgtacttggtggcaagcgtatttatgaatcttatttgatgatgaacttgttggaagacattgttctctaattttttttcatttttgcctgtctttttcatttttggaaactgatttcaataattccaaaatgagcaatgacattactttccacataaatgattatcttactcaccatatacatcaatacactgtaagaatccaaaatatattttttcccttggctgttttctacttctttgattgagtggcataatatcattttagatttattacgcgtctatttgtatactactgaaaattataacccagtgggacttcatttgctgtgggacttgctataaaacagattgatgtctattgcactgtgctgcatgcactagtattgtctattaatgaaaatgataaacattattttggattgaatagaggtcaaaaaacttacttcctttctttcaattaagttgaaggatttccaggactataaatgttaatgatagagcattaacgtgtatttgtcagcgtggaaagtttcgctcctgcattgcccgcaggagacggaagatgcatgggtttcctggcgcgcaggttgggtggaggctcagcgtggctctgtctggccaggctaagtggtttgcagtgcctgtctcatttcagacatttgctgtgacatttgcttcgtattttttcctgatgactcaaccaagaatcattcagaattacctttagaaacataaattcttgtggttttgatgatagagttaaccatgtgttctccaaggagtcttctaaaatacatctgctttgccagagaacacactttcttctgcccgttcagtgctctcgggtcttttgccgcttcctttcaacaacagtccgatgactttgtcttcctgcatatgtgcgaagggagaggagctcactggtcctcccagagggtgaagtaaccgggacacattattgaataaaatgctcttttgtagtatcccactctgtatcttagaccttagtcgtaggcaagtttaatttggaatttgcgtctggagaaacggctttatgacgtttccaagtagagcctcagtatcatggatctcacacagtccccgcggcagcttccaggccgtttccagaggaaaatattttttctccccaaacaagacagtgttctctcactgttccagtctcttgacatatactcaattaagatgaatatcataatgtattgtaatagagctcccgttttaaaagatgacgtgtaaaaaccacctgatggatgcggtaagaaagggaattgaagcagatggaggggcacgggctgctgactccccggctgaaccccgtcctcgggtgctgcaggaaagagtgagattgatgatcctggagggagcccactcagcagcacagccggagactttgctggtcccttgagatggctgagtccccactgggggctggggtgaggggtgaggccggaggagacagtggagctggcgagggccccagggtgcaggcaaggctgagggcactcggctctcctcccactgcccttgataggcatggcctgctgtgctgtgtctggggctcagaaagatggaaaataagagggtggaaagaaagagtttgtcctaccgcccttgtgaaaagagaagtaatccaataataaataaaagtgataaaagacaattggaaatatgaagaagaaacaggaagaaagaccagttggaagcattaagtataaaaaatataattggtgaaataattgaagagatggattgaaaagcaacattatggatagagccaagaataaaccaggaagctgagaagcttgtttgaggagttcccaccaaagggatggagctagaaggaaggggagaaacatgagaggcagagacaaagtttaaatatctaggaaataacattttcttctctctaaaaaaaaacgtagaaaaggagaaaagacaggcttagtaaatagaaagtgtgagatacgatggctaaaatgttttgaaataaagttgtaactgtaaacgaattgaattcacctctcaaagggccatgattcttgtgttggttaaaatcatgatacagcagtctcttgtccatgagacacagatttaaagcaaaacgtttaagcctgggcaaaacagcacgaccctgtctctactaaaaatttaaaaattagctggacatggtggcttatgcctgtggtctcagttcctcgggaggctgaggcaggaggatcagttgagcccaggagttcaaggctgcagtgagctgtgattgtgccactgcactccagcctgggtgacagggtaagacccagtctctaaaaaaaaataataataataaaaaataagaacatgtatttcaaaggttggaaatcagaagatgaaaaagagaaatacgagctaaaagaaagctggggtggccagtcccaatatgacttaaagcagaagctgagataaattattgagaggggcaaagaaaaatgttgtattgtggtaaaacgaacaggaaagcaggaaggtatatactgatgatgactgtgtgcacctgacaacgtggcctcgaacgagataagatgggagctgaagtgtggatggaagcagatgaatgagaagtgtgcttagatacagagacaccaagtacagacaaaggaagcaacgtaaatacgacttttgtcaccgaattaattagccagacctcacagaggcacacaggaccatacatccaacagggaatgtggacatatgtggaccattcacaaaaataaatcatgcgcccgactacaaagaaagctttactaatccggaagaatcagcatcgtgtgaactccgtggcagaccacacgcaatgaagctagaactcagtaacgaaaggacagctttaacaaaagtctgaaaactaaaatcttaaaatccttggattaaagaggaaatattttatattttttatttttttttacatgtacacacttacacatttatttgacttcattgtagaactttgacattaatcccaataactaatctctttatacatattgtttcatcctgacatcaacctgaacagggaaaattgacttatataagcacatagctactatagatgtctttttagaaactgattattgatatatagcagagaaacctaaaatctctttaactaacttgaagtcctgaccgtatgacttcttttgttattttattttattttattttattttattttattttattttattttattttattttattattatacttttaagttttagggtacatgtgcacaatgtgcaggttacatatgtatacatgtgacatgctggtgtgctgcacccattaactcgtcatttagcattaggtatatctcctaatgctatccctcccccctccccccaccccacaacaggcccagagtgtgatgttccccttcctgtgtccatgtgttctcattgttcagttcccacctatgagtgagaacatgcagtgtttggttttttgtccttgcaatagtttactgagaatgatgatttccaatttcatccatgtccctacaaaggacatgaactcatcattttttatggccgcatagtattccatggtgtatatgtgccacattttcttaatccagtctatcattgttggacatttgggttggttccaagtctttgctattgtgaatagtgccacagtaaacatacgtgtgcatgtgtctttatagcagcatgatttatagtcctttgagtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaacgattgccattctaactggtgtgagatggtatctcattgtggttttgatttgcatttctaaagaggaaatactttaaaactgataaaatactcacagccaaatgttagtaatagcacatttgctgtttgtggggtgtatgtagccaaagcaggcgaggatttaatacatttagtcagaaaacaaagattaaaaaaacaagaaaaattaaatgtttgccttaaagagccaggggaaaaatgcaataaacagatgaaaaacaaaatgaagagagcgaatctgaaagatacaggcagccctacgctgtccgtcgcatctctgcatccatagggtctctgcttcatttcctgggagtcctgccagtgtgggagggggcgtccagggcctctgaacactcttctcacagattttcatctgggcacttgctctcagttcttcttttcagagagccagttgtctcagttcttgatacttgctgacagcaggctttgggaggtgagtgcttcattttgactttgcaccgtccaggtcaaaggcttcacttctctcacctctgctgagccacttacgcttgtccaactgtttcttaacgtttggttgacattttacagttacagggataacagtagctagcatttgtcgagcgtcactggagccattccactaatgcactcatctaacaccacacgcctgtaaggtttggactggcgttagtgctgctttcaggatgaggaagttcaggttgcttggagagtagctggtggagtcaggattcaaagctgggtgcccaggctcccgaactgacagcctcaactctgttgttccgcctctctctctcctgcccagcgtctctcatttgccatgatttccttcctggggctctccgtccttgtcctgttctttttctctcgttatggaggaagttgagatcactatcatctatagtctgtcacgtctaaatagaggttaccacgacttacttaacgtggtaaaggctacatcagagctcttcagcaaaccagcctagtggggagactggagacgtcttcccttcgaagctgggaacaaggcaaagattctctctcgcactaaaacagtattagaattcctgacccccagtaagataactccataaccagcagaaggaatgtgaacatttgtaattatctgtttacagtaagggccatctaacatagttcactgattctagcatgtactttttaaattttttttaagacgtgatcttgctttgtcacccaggctggagtgcagtggtgtgaacacggcccaccgtagtctcaacttctcgggctcaagcaatccccccacctcagccccccaggtaactgggactacaggtgtatgccaccattctgactaatttttgtatcttttgtagagactgtgtcaccatgttgcccaggctggtctcgaactcctaagctcaagagatcctcccacctcagccttacaaagtgctggaattacaagcatgaggcaccatgtctggtccttttttaaaaaatagagacagggtctctcccttttacttagatgggagtgcagtgacacagtcatagctcactgcatccttgaactcctgggctcaagtgatcctcctgctttagcctcccaaagtgctggaattccaggcatgagccaccacgcctgatcccagcatgtgcgttttcacacttaacatatctggggtccagaagcatcttacaataagtaacatacctgtttagttggcagttcttttcctttgttaatagtgtatagaaatgcttgcaaaggtccacctagaggtgtgcactgtaccctttcttactgctgtttgtaagctcactgtttgtcactagggaaagaaacaggcaccattacttaactaggtgttcatgtaccggcaataattgatctcaaaatttaatgctatttgtagtttttaattaaaaaactctcaaatgtatggtctaagtttttctttaagtccagaaaaaaaagaatacattaaaccctaagtaagtagaagaaaagaaataataaagagaagagcaaaaataaacagaagttgaccccaaaatttgtaaaaattcatgaaactagttgatagtttttgaaaggttcattaaaattgtcaaaactttttctagagtgctcaagaaaaatagaaggaagatacaaatgactttcatcagaaatgaaagagggcacatccttactgatcctacagatgttaaaagaataaggggccaggtgcgggggctcatgcctataatcccagcactttgggaggccgaggcaggtggatcgcttgagcccaggagttcaagaccagcctgggcaacatagcaaaaccccatctctacaaaatataaaaattactcgtgcgtggtggcatacgcttgtagtcccagctacttgggaggctgaggtgggaggatcactgggaggcattgaggctgtagtgagcagtgcagtgatcacgtcactgtggtccagcatagaccacagagtgagaccctgtctccaaaaatgaaaattataagtaaataaaaggagaataagggaatcattttaatcatgaaggaccatatgccagtaaattcttcatcttagatgcaatggataaattctgtgaaagacacaagttatcaaatctgacagaagaataaaaagaaaatttggataggatatatctgttaagtaaattaaatttctggttaacaaccattcaaagacaaccccgcacccagatatctttactagtgaattttaccaaacctttaagatgaacagaatagacagacaacctttgtgaaatgtttaaatatctgctgaccatattaagttgctgtcccaaggctcggtgtaattagtaatggtaaaagctaagaaaatctttacaaggttactgcctaactgttgactaatttgaccaaattttatgcacctggggccttttacaaatcagcttacttccctaagaaaaagtgttacttgaattttttttttatgattttattttattttattatttttgagacagagtcttgctgtgtcgccaggctggagtgcagtggtgcaatctcagctcactgcaacctctgactccctgtttcaagtgattctcctgcctcagccttctgagtagctgggattacaggcacgtaacaccatgcctggctaatttttgtatttttagtagagatggggtttcaccatgttagccaggatggtctcgatttccagacctcgtgatccgcccgcctcggcctcccaaagtgctgggattacaggcgtgagccaccgcgcctgaccacgtgaatttttttttaagagcagcttgcctttatatttttggttcacgttgggacttaccttctagtcatttactgttggctcacatttcctcttctcccatgtctgtctaacgggagaaccatggagtgcgtgatctcacttggggtctcagtaggccgcttagtgagtcccaaagacttttgtgagagtttgaatgcatccgtgtgtaatgtatctggaggactcaagggtagcaagtatacacagagtatccttttaacataaaaggagcattcagaaaagaattaagactgtgcagttcagcccacagttgggctctcatagctactgagttattcatgtaatcctcggaaatcagcttgggtgaaatactgcacgggaaagagtgctcagccccggcctcactcctgcctgtcccaggcctcctcactgtccgtgtctcatgggaagaaagtcatttgttgtctcctgcttgatgtcatcatcactatgttccagattagcttcaggacttgtttgaaatcatacctactaatcgactgacttatatccccatcacacggtgacatattaactgcttatttgcctctttgtatcttcttcttaaacttctgggcattttagtggcagtttggcttcttgtttgatttatgtgcctaagcgtgctcatgcctccatatttaatcagtgacgttaggtcacattgcatgcaaaaactgtcagtgcattcagctccgtatttaatagcaggcattcatgacccttttttaaataaaaaagcgatcatttgatttgtgctaaactggacagtatattgcggaagccattttcatcctcattttacttgtgctgagatcgaatcgataatgcctcttgatggcatcattgttggaacgccagaaccgtgctgtcacatagacctgtatggagggtggcatgtgtcccacgccagagccatgccatcatgtaggcctgtgtggagggtggcatggtgtcccacgccagaaccaagctggcaagtagacccataaggatggtggcatggtgttgccagccttgttgtaaaatggtgtgaattaatccaggagacgttagcctcttctttggtttctcgttatttgtactgctaagtaaatgttgtatatgtatgttcagtacatagaacaatttaaactggattcagaagccatttcagtgcactctgagactgggcattaaaccttgctttaagtactgtcaccacagtcactgagaacagcccgagtgctgcttacttgcaggttgaaaggactctgtgcaatgagaacttctgagttcccatcctgtcccaggtagccagtaaacacctaagtcatgaaggttatgagacacagtccctgtgtgcccggaaaagagggtctccagggagaggtgctccctctcatcagtgctcttcttggagacagaggagggagtagggatactccttctgcttgccttggaggcagaggcggcatcactgctgttggggtgtcctcgtatcacccgctatgatgagtgaaatttcaccagcaagaggaggtggagaaaggcattgtgaggcactcaccctgacctgctcagaggcctgaacgcatctcgaccagcagcccagtgtggcatctgagtgaaggatggtggccaggacacgagagggagggcggggtccgtgaccatgaagctcgagctggaatttcttctgttggcagtgccttctttgtggtaggtgctgtgcagctgcagggctggcctggcctgcagagccagtcacacgggggtctccacccttgtctcagcccactagtgctgctgcacaggcccctgaaacagggtaatttataaagaacagagttatttctcccggttctggaggctggaagtcccaggtcaaggcatcggtgggtttggcgtctggtgagggctgttctctgcattcgaggtggcgtcttttcccgtgtcctcctgggaggactgctgcatcctcacatagcagaaggcagaaggcagcagaggctatgttcctccagcacccccgccttaaataaggttgctaaaatcccactcaggatggcggagccttgggatgtaaccgtcatctaaagcccacctcttagcactgtcacttcgggtcctcagatccaacaggaattttaggagggacgtgccttctcagcgtagcagccctctgggaaatgaaagcctgtttgagaagacatgttcgtatctcagcagcagcgtggtccgggctctcctgaggaaggtgcccagggcatttggggacacagaggagcaaatttcatccagcaggggcagctcactgtgtgggtgaggcttagaactgggcatggcggtggctgtcggatggacatgcaggttcaggatccaggtatgtctgtcacctaccatttctaatggaggacaacgatatcatcagttgtgaacacatcttctctgttactgttcaagaagccatgctgtttgcattctctaagaggaaaatcgcactgctggtagcaccttcaacctgcaattcctacttacccgcctcaaacgcttcctgtcttcacttttgctgtccgcaagatccccaccttccaatccacaaatgtttgtactcaaatttccccagcagaaccagcaataaagcacagaaagcagctgacctaagcccacccacctctttccttaaatcgggcatcttccccttagacagagtgtctggtttgcgctgctgtcaccactcagcttctcccagcatacagcgtgtgctgcctctcctggcccggggcagtcccctgccttcctgccattccagcagctctcccggaaccatcgaggtgatcgctgccttctgagccgtcagcctcactggcctgtccctaatccttgcccctgaagagtccgctgcagagctgaagcaagggacacccccttcagcacctccttccctgccctggggtctgcggctgcctctctgaagctcccactctctggccagcctctcttcctgcacttggacgtatgttctcccacggctgtgttcttggccctcctcttgacgtacttctgcctgtgagaaactgcagctcatccagcgatcactatcctgacccctctgagataatccctccttcctcacgctctccctctgccagcgctttcctcgtcatatacacctgcataaacctctcatgcctgaaacaaaaggtccaccccagcaagagggcactcccgccgcccgctggccctcctgggcctcattgcctagttctttctctccaggtgcagttaagcttcaggacggaagggggtacctcccaagcctttctgcccttcctgtccagccctcaatattgtaatcaggtctcctcaacctagaacgccccctctccttcccagccccaggtgtttaccctggttgtttgtgtttcttgtttttctgtgtaatggaaggaaggtatcacctgagaggccttaggaatgacacaggaaaccctgctgcctccattcagacttgggtggggtgggggtgggtggaggccagctggcatctcccaggatttctgaaccctcgtgtccctcagccagccaccgccatgcccagctccaggcctcgcccccgatatgggggaagctgttgctgctggatctgacgtgcccgtcttctcgctcgggcaccccagctggtgcgtagcgaggcagtcacagctcactgcagcctcgacctcctaggctcaagtgatcctcccacctcagcctccctggtaactgggtctataggtgcacaccaccatgcctggctaatttttcacattttttgtagaaatggggtcttgttatattggccaggctggtctttaacttctggcctcaagcagtcctccaactgcagcctcccaaagtgctgggattacaggcctgacactaatttctgcacatagaggtgaggaggcacctcgggtatcagggtagtgaatgagtgcctggaccacacaggccagagtcgaaatctgttcacctgccttaatctgccactgtttggctgcttttaaaaaataaatgtacatctttgtcttggattgtcttccttaatatcacatccaaaaactcaatactagcaatttttcagaagacctcgatgttttgggcagcccttagacctccctgtcacttgacccaaatggtgctgggttgaccccagtccagcagggaccaccagtgctgtccccaacatgactggttccccctgtctctccccccacatgcctggacccccttcctctccctccacatgcctggacccccttcctctccctccacatgccctgttccccttcccctcccccccacatgcctggtcccccacccctaccctccccgcccttgtctggtcttcagtgcctccctgatgaggggcagctgcccccattctcctgcggcagcttcaccagccacacggctcatccaatggcttggaccttgtttcattcactaaagcaccagctctagcactgtgaggtcattattgagtttgtaagcaaaaatcttcttaaggaacagactaatgtgtatttaattttcattatgtaccaggtacatattaagactttttgtttcttttaatctcagtaattcctgttttatagttccattatcctcatcgtgtaagtgaaaggtaagtggtggcagccggacatcaaggtgtgaactcgcctggggctgtacaggggcagagccagggctacgatttgaaccggggttttctgacctgagcgctcttctcttcattaccttctgcctcctccttctcaccacttaagtggcttcatgcatgcagggcttttaaaatgagattttctcaaagagccgtgtgtctgcaggtggcatgcgctggcactgggctattgggaggcacagagttgttcctgggtctctcccactggagaaagcagtgtgtttggctgagccagtgacacagggctgcccgggagcggcaccaccactcttgggacaggtgggcaggcgctgttgatgtccctggatgttgtcccttcacctgcagtttgtcaccaaagccccgagggactgtggtagagacacagctagtggggacttctctgttcgcacagagactctgcagttgcagctacatcacactctggtaaatagcgcctctggcagtgggttttaatatccacgttggttgttgaagcagtatattctaggggtgcctgggaagacagtcgtttaaaatgtctctgctttttataggtcagtttttcttcttctttctcactcccttgccaattgttggacttaaagtttgttggaaaggcccttcctttattttgatttgtgcctgtgctttgctccaaggcaggccactgggggcattttttacaccgaggacttggttggaaccgttaaccagtggctggctggtctgtttgtttacaaggcagccccgcagccttgttctgagctggctggctcctagatgttatttggatttgcttcctctggcaccaggccctcctccaggcaggcgcttgggcaggctggtgggactgatgggtagccttgctggggacgtgtagtcactgtggcgctgccagcaaactgttctttctggaagaggaacgcttggtgcctgggtgtgttcagtgtgttctgttgtgcatcagagctccctcagacgtcgaccgcttctgattccctccagacagctcccggtggacacgcagggctatgcggcctgccctgggggctatggtgctgaatcctgacaaaggccctcttctcgggctgtcagaaaggacgaggctgagtcaggctttaatgtaaaccatcactccctgtttttctatttcttcgttgaaagaagcactgatcattgtgttcactagaaacacctcaagtttttaaaaggctcctctcctgttggtgtgactcgagggcgctgtgacatcctgagaaagcggggactctgggagtctggatgtcaagctggtcccgtctccacccgccttgagttctcggttctcgacagcgcccgtgtgatgatgatgctcacgctccggtgtgacacagacggcgcgggagctgcacgggagagtgctttggaagtggaagccgcaatgtcatgtaagctgttgagtatgaattgtatcatatttcacaatccacagagtattctcccttatggtgtcacatttgctcttactaataacccaggacttgtcaaagcagacgtagtgcataaaacatcactgtgttactgatgaggtaccagatgctccgcgtgcggccgtctggggtggacagcttcatttatggcagagccaaacaggagcccggatcttctgatcccaaatcccgtattattttcactattccatgctgcctgccttcaccaacgtgagctgaagttattacatgttatcactttacttgatgccgtgccgtactttacacgagaaccagcttcccgttggggactttacagagctttcggcagggacagtaatgggggcggcccctgggaagctgtgcaaagtagcatttgcggcgccacatcccgcagtgtttcctgaggactcgctgtgtgcaggggaccgtaagatgccacagagaaatcaaggaggctgcggacacagtgtctgtcctcaagtcattcatcattccctttctctgcccctctgccgtggaaggttttcaagtaattaagctgcttgcttatatgcagctttcctccacgggccccgcctgtgcgtagtcgtgctctggcagagtctctgcaccttcctccctcgggctcctgggcctgtgtctgtccgtcctccactgtcttgctgtctgcatcttcatggtgtaagtctggcccctcagccgccccacaagcctggcccggggccaggcttccagccgctgcttcaacccaaaggtggaacacctgtttcctgcagtggagaagatgggaaagccttttctgcagggcttttactcccacttccttcttgttttcagccattttctctgtgctgtttttctcctttcttcctgagactttcccctttgacttgttcttagtcttctttctttctcttttgaacaggtagcggtcttgttatgttgcccaggatagtctcaaactcctggcctcaagcgatcctctcgcctcagctttccaaagtactgagactgcaggtgtcagccccatacccagccagtcttctcttttctttactttgagtttaggcttcttgagttgttttcttcttctcagatgcttcagggggtagctgagaatgttgaaaatactaaagtgcagcagaagcaaggaggcagagccagccctggtttcccactgatgatcaaatttctttttagctcagaaatactggcttatgcctaacccatcaaaggtgcagcattgttgggcacaggatgaaaaacagacagcccccacgtttggctgtcaaaccacatgacccagaaatagccatcattgtaagaaccccagagggagcctttgctatcttttaatttattgcacaaataatattataacagtaaacaatgaaaaggaagaaatgaaagaaaaattacccagaatccactgtttttgctattccatattcttcatacatttgtccatatatgcacataattttacttacttggaattaaatatattttgtattgtttttaatttgaagatcactgattttatattgctattgatattttcaaatttagtattccatcacatttatagacagtattacttaatcatttccctctcataaaattatagtgcttgcaaggagttttttcctgttcatctttgcggtacatagaaccttccttagctgtccatggtagcatgcagctgtagtctcagctacgtggaaagctgagatgggagggtcacttgagcccaacagtttaaagttatgatgagctatgattgtgccactgtactctagcctgggcaacatagcatagagtaagatcctgtctcttaaaagaaaaaaataataatattttcttattttggactatttcttagaatatgtttctgggaataagatcagtaggtcaaagtatatagctcttgatatcttttgccaaacttcctttttttttttttttttttgagatggagtctcactctgtcttcccaggctggagtgcagtggcgtgatctcggctcactgcaagttctgcctcctggattcaagcgattctcctgcctcagactcccaagtagctgggactataggtgtgcaccacaatgcccaatactaatttttgtatttttagtagagatggggtttcaccatgctggccgggctggtcttgaactcctgaccttgtgatccgtccgcctcggcctcccaaagtgctgggattacaggtgtgagtcactgtgcccggcgctgccaaacttctttactaaaaggttgctctaattacacggccccaaatcacacatatatgaaagtgtcattttcaacacaacattattttcagagagaaaatgttccttactttgcatattgcaggggaaagactgtattctgcaggtcctgtacgtgactgcaagaaaggaccagtattacaaggccagagacagagaaggccccacagtgacatctggaccgaccagtattacaaggccggagacagagaaggccccacagtgtgacatctggaccaaatctttttggtgaacccaagtgctgagttattgatcaggaagtgaagggggaggccgggcgtggtggctcacgcctgtaatcccagcattttgggaggacgaggtgggcagattacctgaggtcgggagttcaagaccatcctgaccaacatggagaaaccctgtctactaaaaatacaaaaattagctggacgtggtggtgcacacctgtaatcccatctactggggaggctgaggcaggagaatcgcttgaaccagggagtcggaggttgcagtgaaccaagatggcatcattgcactcccagtcttggcaacagagcaagaccctctcaaaaaaaaaaaaagaaaaaagaaagtgaagggggagcggaggccagtgtgggaggaagagacaggaaaggtcatctggatagtaaagatcacctggtttcatgttatttcgaaatttacggataattttagatatgtggttgaaaactattaaaaacttgaatattcaagcaggactagagaaagtgtctctggtatgtcttcattccagccgtcctgctgtgtgtgaagtggtatctcactgttccgctttgcatctccctaacgactaatgacatcaggcatctttttatgggcttattggcctttgttgtttttttttttgagatggagtcctttgaggtgggaaagttttattttattttggtaaagtccatcttatctattttgttgttgctgtcacctgtacttttagtgtcatgtttaagaagccgttgcttaatccaaggttatgaagtttgacgcctgcgccgactccagcacttttatagctttagctgttacgtctaggcctttggtccgttttgagttaatttttgtaaatggtgtgatgaagtcttaaataagcatagcttggacttttggatctatttttaactttgagaatgttttctgcaggaatggcagaaatagatgtattgctggagtgactttggaactgtataaagaaaaggtgaacgccagaggctgaagagggaaggagctctttccctagcaggtttctgtgtagcgagcatccgtggctggggttaaagtgttatttcattatgcagtttatcaaatgggaaaagacaaaacctaagggcatttgtatctactccataccataaaagtttgccattttactttgatcatataacaactctgaaaaatactgtttttcatggattaatcaaattaccaacattactttaaaatcacaccgagtcactctttctgtgccgcaaggtgctaggccagtgacatctctgatcttgggagccgctgttaggagcctgatgttaatgacagataaaaattgatgtcagatagaaaattaacctccttcagggtatgtgaaactgcttcccctaatcctatgttcttccttagcaaaccgaatgcaacccaggagctctgaagaaggaaaatgatcagctgtttatctgcttggcaccctttggaacagtcattttcccatctcatttgaaagcagcagttagaaaaatcacaaagaaatagtctttctaaagttttccttccattttaattcttttgtgtttttcttcatcacattttccatacaccccacacgattaaagaatggtcattctgcgtttcaaggggcccaggcgggaggatcacttgagactaggagtttgagaccagcctgggcaacatagcaacacccagtctgtaccaaactttcttcaaaaaattagcctggtatggtggtgcgcctatggtcccagcttctcgggagaaggaggcaggaggatgactagagcccgggagttcaccactaccgtgagctgagatcatgccactgcactccagcccacacagcagagtggggcaagacctggtctcttaaaagaataaaatattgactgaggatcaggacggtaaaatcacgagacctcagagaaggaacaactgtcgtggcacctcatgtgcggtgtctggccgcggcgcctgcgaatgggttttgctcttggttgtcttggaaccaaacatctgtgtgctggcatggactggacatcgccaggtgtttggaccatatctttgtggtttagcacaaaaccaagacatacagtttgtacctgtcatagtcactggagaagccgtgctgttaattgatacagaaacacagccgtgggctgagatgcaccttctgagcccatggctgtcctcagcctcatcacagaccccaagctgaatggtcctgccggactaggcatgagggctggagctcatgtgtgcgcccgtaagctggctttccattcagtggtttcaacttctgcctgtagaaacaccaaaattgtccatgaggtaaatgaaaatacatcccaggacactctcactgtcctcccattgtctggtgtcttgttgagggctctggccaggtcaacaggcaactgttttgtcctgtgaaagtgtggcgcctccgtggctttctgggagaaccgaagagagagacttgcagtcggcgaggaactccttggcgcaagcagcgtgcggatctcctcatgcttctgccgtgcctacgtgcactgacgtcgtcacaggtgggggataagattccgtcgcggtcggagttttcctgtgtgaacattgagatgtgcaattccgtgaccgcaggcactgcccctccgacacagtggggttcatctgcttgcggaagcctcttaagggcggttgggagagaccctcagtggcgcatgtctggaggctgctgacctagcgtcgcaaccatagaccaggaacacaagcagataaaagcagcaagtgggacagattgaaccagctcttggcatagtttcccaccccccagctagttcaggagtctgtggacaaactgtgtttcaagcatgttgaacaacgcagtgtgcatttccaagttcattggaaaatctatgtgagttcacttgtttgccaccagaatgccaggagtgagctccgttctcggggtgctcttccttagcccccagtttttgcggtggcttaaggctctgcaggagtcgggggtacccaggctccactccttggcccgactccatgctgttgcggctctcatctgctgtgggaaactcgctcctcgtggacattttccacgcctctggctggatttctgctcagtagccttcagccagcggtgttctcatcgtgtccatctgcttctattaagttaatgggcacagacacacggcccataaagcagctggatcaaaagtctggttcttatcagacgacttaattgataaatgtcgcaatcacaagaagctgaaatgctgttgtgcaatgacttccagaatggtgttctgggcacgtcagcttccctaagtacaactggagccgtcggtggagaagagcggaaagggagagttcagttggtaggagggaggggtccagcgagagacagggatgtacacgaagtctgtttaactttacatattgggtgcagaaaccaccacggtttaaatgcttaggaagacaactggatagacggtggtttgtttctagccctgattctgaactcatctgtcctgaaaaacagttgctgacaccctctgaccctcagaggcggtccgggctagaaggggattagtggaggacatctcggcagggctgctgtaggcggatgttgtccagtcagagcggaaccgtgacctgtgatacgtatacttttcatttttgccgtttatgctatttttagattgtctttattttacatattaggaatttgcacacacgtcaggtgagtcgtaagagtcacagaggaagttccttcttagcctgtggcagggtggatcctgcagctcccttcccccctcaccctccccccggggggcctcactcacacagcccctccggctccctttctttttatgagctttcaccttactctgttttcctcttttcttcctgatttccctaattgagtttgagtcagtgcattgagcgtgcgctctcagttgtcaggggtacacacttgtgtgtgattttttatgtggctgagatgcaccaggatcctgttgcctcagcccactgtggtctttgggtgcagaggagggttcttatgcccagccacttagccagcagggtagctgggggtgagtttcagaaccttctgaacctcaactgtctcccctccagggcaggaaggataataacacacatctaagcggggagggtgataattgtgcccatagtctaaatctttctcagatcctccggtgacattgccgggtggcctgagctaggaggaagggtgaggacttaggcagatggaggactgtgcatttcagttttttgttttaattaatttttttaactgacaagataacttagagggattttttaaattggcaaatagaatcttcagctttgccttcggttccctcatcgtagggtcagctcgtggctgccaccccaagacaacacttcctccccgtggccgccctgcggttcccttcttcccggagggtaccaacgagctaggcctggtgctgccgaaaaggaactcaggaaaaggttccaaaatttttaataggaagaatttcccaagtctaaaatacacagaacttactcaaaaagggccccttcttgtggatatttttaagagtacattttgccacgctgtctcgcgtggggcctctgcagcagctgagacgtttggcagtttcttcaagacttggagtaaaacctcgcctgagatagaatctaaatacactgggcttggatcgcccatttgactaaatttcgatcccaactctagctttcagaaacctccttatagggagagacctattgctatgggaaggcaagagaaattaatgtctgcgttattccagcaaagcccctgcactgcgctggagggacttttgtttgcgtctttgggttgcagaaggggctatgattgtgcgtggcttatcttggtctccagcccagtttagacctccttctagctgatctcttctctcacttgtactttggaagagagtcagggcttggctttgggtcaccaggcgtgcagccatgtcagagctctggagccacctcggttttgtccctgtcacggggattgactgattcttaaatgatctgcgcgaggcggccctggagcctacagcagcaccgttcccccagggtatcgctggcctgtgtttcacatagggtcagctcttcgggggttgtcactgagtagtaagtgctgagccctcctgtccctgtttgcagaggcagcggctggtttctggctggccagtgattcctccaccctgtgaacacacgtggaaattgacacggtggactctgggatgtaggggaaggctctgggtcaagggcatggcttctttatatagaaagaacaagtcagatggcaggaaagatataatggtgggtcatttaagtattggttctttgtaatttaaaagaatcactttatttatttatttttttatttttatttttttttaaagaactgagttttatgggtttgccacaaagccattctacatccccgacaagaataagaataggtgaggacccagcagtcgcatgtgaaaataaacggtgtatttagcgggaaactaatgcctcttgcagccatcaggcactgttttcccttgatcctggaacaccttggtttccggggatctcagccccagccgttgccccatagctgttcctcagcaccgcagtcgtggaagccctgtactgaattagaaccgagcagccctggctctcaaggggtcacggggtgagaggaccagagttctgcaggcattttcacgtgagaaactccagtcctctgtggctgtcccacttcctgacagcttggcttccttcaggcagcctgagtattattcccatcttagctctgtcggtatgtagtataaacacagtccatgttattgatagtttcttaggtaaaaacacattaatatttgaatcgggccaaggagcacggagaatctgaagttgtcgcaaacaagctggctgtaaatgggctcctccagggcaaggcacaccccagagctactgggggaggtggaagcttgctgtgtgttgtgtgtgtgtttcctgtggttgatgctcataagcgttacctccgtggaagaggtttacctttttaggaaagagttggttttctgcttttgcaaatttgtaccaactgttgatcatctcaaggacagtggagaagggacaggcaaggagcctccctttcagtcttggcattcttcgaaaatagaaggtggcttccttaaatgatttcccgacttgactcatcaatgtaggaatgcctgtgttgacactctcttccccctctctctctccgtctctgtccccatcccttttactttttattataggacagttttcaaccattctgtggaacagttgagaggatgataaagtgaaccctgtatatattaaatcacctacattttacaattatttgctctgttgttttgtttttgtgggtatgtttgctaaattacagacaacatgatgttttaccacccaaatacttaatcatttcttttttaaaaaactgacatttttcttataaccaaattatcttaactttttaatgtcttttgaacccaaatggcagagcccttgcaattagccttgttcccgtggaaggtgtattccattgccggccaggctcatgcatccagcaggcgcctaaggggctcctccgatatccagccagctctgacaatggggccgtagcccagaacaaggcagatgggattggctcattatgtgggttggcagaaagctccgatgaggtgttcatctgtatttctcttaccaatggaataattgtttttcctttttgctagcttgcttctgtagcacggagggccactatgaaatagcaaactcttgcacttaatttgtatcttgtcctgcttaccggcctagaagctcctaaatagagtaaacttttctgtacattacaaagtgcagctgtttaacgtttgcaagttaggaaagtcgcttctacttggttttcttctaataatactaaaaggcatactttttttttaaggcaaaggatctcactgtcacccaggctagagtgcagtggcacgatcatagctcactgcagccttaacctcctgagctcaaacgatcctcctgcctcagcctcccgagtcctctgaccatgcccagctaacttatttgtggagatggggactcaactgtgctgtccacgctggcctcacactcgtgtcctcaagtgatcctcctgccttgggctcccagagtgctggaattacaggcatgagccaaaaaaaaaaacacatacttttaaatttagttacaaatatcgcatgatttggcacattaatttcatgtggggatgtttagttctttgggttttttttaacctgctggattaaatgaaatgctgagagttgaagaaattggcttattttcctttttcttttctttttttgagatggagtttcactcttgttgcccaggctggagtgcaatggcacgaactcagctcactgcaacctccgccttctgggttcaagcaattctcctgcctcagcctcccgagtagctgggattataggcacccaccaccatgcccagctaattttttgtatttttagtagaaatggggtttcaccttgttggccaggctggtcttgaactcctgacctcaggtgatctgcccacctcagccccccaaagtgctgggattacaggcatgagccactgtgcccggcctattttactttttttttttttttgagacagagtttcgctctttttgccaaggctggagtgcagtggcgcaatctcggctcactgcaacctccgcctcccgagttcaagtgattctcctgcctcagcctcctgagtagctgggattacaggtgtccgccaccacgcctggctaatgctggttttttttgttgttgttgttttgtttgtttatttagtagagacagagtttctccatgttggtcaggctggtctcgaactcccaacctcaggtgatccacccgccttggcctcccaaagtgctattttaattgtgtatttattgccactctgagctatatttgaaaattccttttgtgaaaaagaatatttaaaaccagacacctccagcagtttgctgtatctctgtatgactaggttaaaatgcacaagtctgtgaaagcttcagtgacaccttcatcagtgtaaattctagagacttcacgtgccagctaaggtgaagtaagccacctacagcctctctgtcccgctcattacaaagaaaagctctggtcaggatacagaaaagcaactaccaaaggctaaaaatgagcagggatattagggactggagtcaaagtcagataaaatatagtgatgaatctctaaatgtaaaacattttatttgggaagcaagatttacagtcgaaggcatacaggcagaccaggtggtcttcagtatatcttgatgaacaaataaaaggttggcagttttaaaaagaggagaactgtttcgtgttgctctttgagaaggttcttcggcactagtgaggtttctggggagctggcaggttcccgactggtgagtgggtgaaatgagtcctcgaatcacagcaggttgtgtcggttgccattagtgaaaactggtttcaagtggcagcaggcagtttccgcggccaggctggcagagaactacattgctggaggaatgttttgtggcccgagtgctttcccccggccccttgactctgactgagttgggtatgacaagaatgacccagtttgtatgatcagctctcacagtgacaatgacagtcatgatggggatgtgttttgagggccttttcctctcctttgccgaggaactgcacagggaatgctgatggcgagacctccagggaagccacttatgtcttcaccactagagaaggggggactctgcatgttggcgagagcaggggggtgccacactccagcacatcgtgtgttcaccttctaaccgggaagctctccttgttcaggagttttcatagagcgtctgtccatggggagaggagtggctaggtggggtgggtggtggtgtcccggaaccagtcccccagggatacccagggatgactgtatatgcccggaccaagtcctgaaggtcatagcagaggccgcttctgcacagtggggtgggagagtgaaagttagactgacgcacttttgcgtgacacatgtctgtatgatttgggtttttatagtgaccgccatttgcttttattctaaaataaatcagcatgattcagtgttgtgtaaaagataaatatgaaaatgctaagctatctcaacatggtgggtttatacaaatttttcacttttttatggtaaatacatgtgggtttttttttaattaggaggaaacaaaggaattttcattctcaaaaatgaaaacagcattcaatagttatttgtatgatatttgacaaggttaccgagctgaacattaatttgttcttcattgttaaaagaaaactctaggcaaattgaatacaacagagtttaattgagcaaagaaccattcttgaatcaggcagccccagaaccagagtaggttcagagtgacaccggcactgccatgtggctggataccattcatgggcagaaacgaaagtgactccggagaatggaagagccgcagcagctggattggctaccgcagggggtctgccttgcttgagcccagttcgaacagttggctgcctgtggtagtctgagactcagctgcctgtcacaagaccaggctgtttatacatcaggttgggttacagttcaccatgtatatggaaccattaggccaaacataaaacatgtacggaggcagcctttaggcgaaacttaatttaacatcataaaaatcttgaagccacttgtttgcgtacccagcctggatccgtcacaattcttgcttcatgccacactcatcactagtccatatttggcctccttttaagcagttaattaacaggtatttttatagcataatgggtttcctcaaaccaccacccaaccaaaacccagcccttgatgatgacctgcgcccaccacgcagggcgcccttgatgcacacgcacctgccgcccccgccctgtgaccaccgccctgagtgccgggctcatcatcccttccatgccctttctacattgctactatgcatctgtgtgtattcattaagaccattacttttctttcagattttaaatttattaaaggctttagtgctgaatgtgattttgaggactcttttaaaaaaatacttttggttggaatgtggacatttcccacttagcattgtgttgctcatgttcctccatattgatgtgtgtttagctagagtacccccgtctaactctgcgaatatgccacactgtgtgcacctgctactccttaatggacacttgagctttttcagcttcttcctttatttgtttgttttgctttgctttggtgtattgtattttatttttgctattaccaacagagatactttgaacattcttttctgtgtgttcttttgaacacatgcaagaatttcttatatattgaaaagcagagttgccggatcatagtgtataggaacattcagttttaagggatcatggtaaggtgctttcccagtggttgtgccattttacactcctacagtggtgatggagacagcctatgatccacatcctttctagttcttggcattgccattcttgtacatttttgctgagtaggtttagaatgatatctcgtgtagcctggatttgcgtttctctcatatcgcatgatgttgaacatttcctcacgttcagtggccatagttatgtcctcatctttgagatgtctgttcatccatttttctattggatttttaatgctcttgtggatttatatctaggttttcaatcctggttatgatggatattgcccccacctttttgcttttcattttaggacgactacaaatgttaacaagtttgtgtgtcatcattacttcatagatccccttcagcgtctcttggagttttctcccctctaactttagcttgtcatctgaaagtgtcttcctcatgagtctttttgtgacaagtcttctgaggccatatgtgcctctgagagtatttttgtcatgctcacacatttgaatgacagtttggctggatacaaaattctaggttttagcttccttttcttcagtaaattaaaaacaccagctgggggtggtggcttacacctgtaatcccagcactttgggaggctgaggtgggtggatcacctgagttcaggagttcgagaccagcctgaccaacatggcaaaaccccacatttactaaaaatataaaattagccgggcatggtggcgggaggctgaggcaggagaatcacttgaacccaggaggcagaggttgccgtgagccaaaatcacaccactgcactccagcctgggtgacagagtgagactctgtctcaaaaataaataaaataaataaataaaaataaaaacaccacttcattgtcttcctgcatcctgtgttaatctgataaaaataaaaacaccgctccactgtcttcctgcatcctgtgttaatctggttcttgtttctttgaatgtgatctactctttgtttctggaagctttgtatgtattttcattgtctttttaatattcttgatcttcactatgatgtacctaatttatgatgttcttcctctgtatatcataagacctcacagaatgtgacgattaaaaaaatcagtataaaagacagaacaatggtcgccaaataataagcactaaataagcaacagctgtgttatattatcattatattcagctttgtgggttttttgagccatttttattacctctgcctttgcccactctttgacctttcattgctcagcaacactctgatgtaggtgaatgaaagaaatcgtataaaatgtgaaaccagttgttagcaattctggtataaagagaatttacatttttggctaaaatgaagtttgcatactatcagtgactgatatatccatgctacgcttattcatatagccatgctataataaagttgcatgatattcccattttaattttttatttaagggaacattatattttcactgaatttataatatgcttatctcccagccaataattatttttataatgtgtaagtctctgtgtactaattccaatatctggccaactatgaatctgtttttattgacttttttctcttgattttagatagtatactatctgttgtggatgaggcattgtagacattctagattctgttattttcttttgggcaattacactgatcttgtagaggcttcgttataggactaggctcttttggctttgatcttagttctaaggtgtggttcataatccctctggggtgtccatgtcctcagatgtgatcaagccctgtagtttggcaggacctgatcttctctgtcttcacagtggcaagcagatgtcaaaatctctactctgcgttttcaaccttcctgctgtcctccacggggatcctgggaatattatcctgtgtgcgtgcccttcaggagccagcctccgactcggggaaggtttacatgagggttttggctcccttcttcctagggcttttgcctgcaatatccaggcagccttgagcatggtctcaacccagtaaggctgctgcctttcagtcgcatgctaacccccacatgacttgtgagtgaggagcacccttgggaaaagccagatgaaagtgattcatgcagagttactctcattttctaagggtcacggcccttccatttcctgccttcctgcctgcatttgtttgttgttcagaattttcaaatggctttttaatattttgtccagagcttatcattattggcaaaaggatgagtctgatataagtgattctgtcattactggactctagaaatcccaatcagtaagtacattatggataaaaagacaaagtagcatggttcgcataggactcagatttgaaaatgcatttcctgtagatcatttttatccacagagaaattctggtttgcctgggaccaccgtaggagctgcatgtgtctgtgctggtgcagaggtgtctgggcatggctgaggagagcatctgcaagtgaagccagcagaggagaccactcagagtggcactgactggctcggggaagcactggggccacacggggcacttgatgccgtgggaaagggctgctctgtagcttcaggcaaacgtgggcctcacttttattttctcagctctttgaacgataaaacactgactactgcagccacaaccaagaatataacttcctctctgctggctgagccaggtatcacttcttgagagagtgagtgtggctggcagccatgcatggggtccaggatgaccagctcagcctcccctcgccctgcagggctgcaaaagtgagactgtcttcacacctctggctcgttgtcttcctggttctggatctctcagttcctctgtgtctttttctcccatttcctatcccactgctatgggtaccctcctgggtccaccatcccccatagaggagtcactgccacgtctcccccgaacgtgcctgacccttgcactgcaccctcccctgggccactgtccttctccatcactcacttccagccaacacttctgccatcactcacttccagccaacagtccgcgagtgtgttttggagatgtgcatacttgctctgcacctgccattatgtttttaaggggtgttatttgttcttaattttaaaagtaggtgaattaaacattttgcatttctcctactaaaaatactgcattgcctttttactctgctgcctcgattctgcccactgtatgccagtagcccggatgggaggagagatgctttcctacctcctgttggcgccacgttagagaaagcctgtccggctccacacgcgctcctaaggatggacctgcgtcagacatgaacccagctctgacctgtaggattttatgattatgaacatgatataattgaatttgcatttcttttgtgtgtcttgaggctactcatttattctactccagcagtctccccagctcacttccttaagaaggaaagaagtggcaggtccagtccactccagcatctcgtttggagactgagctttattaagcatctcggcgctcctctccagggaccgggcttcatgtggctgcaaacggcttctctcctttctcctgacaactcactgtggcagctctgtagtctcacgccttgacagaatggcaatgagattttctttacaaatctaaaagctgccgaattaaggaaatctgagtgtacttgttcaccgtggtagtccctgtccccacctttaactcttccctttttctgcaggcctgttgaatttcctgggtgactgttccattcatgccgttcacattcttttctttctctgcaggttttgcatgcagaaatgtgtcagtctggtgcctggcgtcacactggatttgatagaaaagtaagtaggatttttaagctcttgtggctctctggatctgatgagtttcttttcctttttgaaggctcttgcttctcagaagtactttctatcaacatggcatgttccctttcatgtggctgtgttcttttgttctctgattaaggctgtgtttgtgattgtcacactggggcttagtgcaggagataaccaaacatgggccatatgaaaagaaaaataataaaaagctgaattcctttgaacatttaaaaagtctccagactttaagccaaagcaagaacataccacttcgcatacaaatcatttctgctgccactgaaatgatagctagatcatagctagctcttaccttattttctgaaactgtccctttaatattctgtaactttccatcccctccccccctgtcgccatccagtttccattttactatctcagggcaaactgatttcagaacctgagcgatgaagtgacgggatttagtcaggcctatgaagagtcaatggcacttgcctcccataatccttccagtcccattggccaacccgtctgtccctcgcgtgatctttttggatctgaagtggtgtttcaggacccggagcgtggcctgcactgccttgttctgtttgtttgtgcaccggattcatcgtgactcatcctgagtcatccaggcagtatggaagaactttggagttattttaaaccctttggctcagaaccccatttcttctagaattaacatgcaagataattgttttctacatcttaatatacaaagttatatcttaatattagggcctgaatttactaaattaggcaggaaaagcaaccccacttccaagtttctcttgtaaaaacgtgcttgccttgtgtatcaggggaaaaatgcaagaatattatgtgtaaacgttcatgagggcacggtgagctccgtcgtggttcactcccaccgtggaaggtggctgtgtggccaacaggaaggccggggaagcgacactggtcctgatgtggagtggtctaccagatgtgctaagtgagcagtcctcagcatgggtacctaacagagctcagtgcccagaggctttccaaacagtgcaagctgtgacttagaagactgtttccaaaggctaaacagatagtggaggctctcagaagcatcacgtggaaaataactttaaaaaaaaaatgggactagatgatctgtgctcccctccccttctggttggtttggttccctgacgagactgcagttttgcgaagctgttcttgagatctgtttactggtattgctgtgcgctttctttggggcttttatttccccctctgttttctgagttttagagctctctattacctgtaacgtatatattgcccccgccacccctgcgccctccccacacacacaccggatgcgtatcccaaatctaaaaatccaaaatcaggaatgcatcaaactgtaaaaaaatttttaatgaattaaaaaaaaatagggcatcttgctgtattggccaggctggtcttgaacgcctggcctcaagcgatcctcccacctccgcttctcaaagcgccgggattacaggcgtgagtgattctggccgtgccaggccaaaatcggaaactttttgagcactgatgtgctactcagaaacaatgctctttggagcattttggacttcatgttttcggattagtgataaatccaaaaaacttaactggtaagtataatgcagatattccaaaatctgaacaaattcgaaatccgaaacgcttccggttccaagcatttcagataaagggacacttaacctgtgtatatatattatatatctaatttcttaaataaaccatatccattaatatttcagcagttatattttatccttgctgggttggcttattcaggcagctcttgggtgaaaactgtcttggtgttttctgtttgtcgtgcctccctgtggctatttccatggtttcctctggaggtgggagggccgcagtatcctttctcctccgcctggtagcaggagcccaagccttacccacgcctccatctccgtgtgggacagtgtctcgtctccatcctggatggctgctgtgtgctgtcccatcccccctggtcacctgtgtctgtggctactccggacagagccccccggtcacctgtgtctgtggctactccggacagagccctgccagcgcgtgttgagccacatgagctcagacagcgccacaagctccacatctctagagcaaaaaggtctgttaaaaatcacctagtgatgacaacaaaaatttgttttaggttattgagtcaaactaccttattttactgagagagaacctggtatttagttcacttcagctcctgggtggccttttctgcctggttcgggcagggctggcctagagctcaggtctcaggacagccccactgtcgtctgcccaacacacggaggttttcccttgaacaagattttggtgtcagaacaaccagctgcctccctgtttctttccaaaacttaaaatgtgcacagcaacatgacatcctaagcatgattcacaaaagaaaaaaaattggtaaattggacttcatccaaatgtaaaatgtttactctctgaaagacacgctgatatgaaaagacaagctatagactcggagaaaatatttgcaagtcacatatctgacaaagaacacatgtatccagaatgtataaagatatctcaaaactcaaaaataagggggaaaagaaaattagaaaatagaccaaagacatgaagagacacttcaccaaagaggatttagggatggcaaatatgcttatgaaaagatcctggaaatcattagccattaggtaatgcaaattaaaacacagtgagacagcactgtccctattagaacggatgacatttaaagactgaccaaacgcagtgttgagaactcacatcacagctgctgggaatgcagaatggtgcggccactctggaagaactgtcggtttctcataaatgtccataaacctgccaacatgtccccgcattcctactcctggatatgtaccctggaagagggaaatcttaggatcacacaaaaacctgtgcgtgaatgtttacggtagctctgttcattaccccaagccggaagcaaccaaaatgtccctcccagggcaaatgaattcagactgtggtgcatccgtatgatggaattctgctcaacaggaaaaagggacaggctttctatatacaccgccatttgggcggttcccagaagtatcacactaagtgtcagaagcccatctccaagggtggcgcatggtccgattccctttctgtgaccttctgggaaagacagaacatggggccagagaacagatcagctgttgccagggattagaggggtggagagtgtggctgtgaggggctagcgggaggggcctgggggtgatgtcttgatgctggtgtggttccacagatccacccacacgttccaatccatagcatgtgtacctgcagaagtcattttgctatttgacaactgaagtaaaagtaatacataatgtaggggaggaaaaaaacaccacgagagtgagcaggccggagagtgcagagcagatgcagcacacggctggccaccgctgcggacaacaggccatgggcctggggagcgaggggtgcagggaaacagagacctggatttgggaaaggaagtggattctacagcagcatgctctgttgtttctgggaagataccttcactcttattattaaaatgggattgagtgaggattgaaaaagagaagcaaacacccttccccatccaccgtgggatgttagtcattttcatcagacgccctttccctaaatcacgatgttagcgtttgcagccactcgtgttcttcccagaaccagtgcatcccctccctccccagcaccaaaggcccttctcagccagtgcgatcagacagctggaggttagggcagtgttctcgtctttcttccatctccccttctcctgtgccaagtgatgctatgaaggtggctaaatgctaaaggtttattttttttttttaatttaaaagagacaattaactgttaatagtaggcagttttcaaaacacaccctgattagggattcggggtacgaggaggagagtgtggtgggaagaatatggacgttggagtccgagcagctccatctggccctcctgaccccttctgagccacactcactgggcacctccttgcctctgggtctgtctctgtcctgcagaatggacaccactcggctctcatcgggcagcagcagtgccgagggcatcacacatcctgacacgaccttggctctcagcccgtgtccgcctcccgccagacacttctgccttctcagcacttcccagagctgcagcttggatggtggctgctgtcactccacattcctgtagttctgtaagcgtctcccacgcctctccatctgccatcagctgaggcacctacgactcccaggcatcgttgccctggccccaccacagttagagagagatggcaaggcgccagagaggccgtgctctcgaggcccattgctgagacaaatggcttagcaggctgttttagtccattctcacactgctgtcaagacactgcctgagactgggtgtattagggttctctagagggacagaactcataggatagctataaatataaaggggagtttattgattaatattaactcacacggtcacaagatcccacaataggtcatctgcaagctgcggagcaaggaagccagtctgactcccaaagctgaagaacttggagacactcagtattaaccatcacactgggtaatttataaataaaggaggtttaactgagtcacagttctgcatggctagggaggcctcaggaaacttacagtcatggcagaaagggaagggtaagcaaggcatgtcttacatggcaggagagcgagagcacaccagggaaggggaagtgccacacttttaagccatcggatcttgtgagaactcactatcacgagaacagccactcccataatccagtcacctcccaccaggtccccgcctcaacacatgggtattagagttcaagatgagatttgggtagagacacagagccaaaccatatcacagtcgctgtagccacctcagtctttattgagaataacttcttaaagtgtgtggatttgggtctgagtcactgttctctgaatgcagttcagcaaaagcacctgttttagtgtctttcactaagaatccacgtcagcactcacagggtgaactcccgtggtgcctccgcctcacagtgtgacagaggttaaattgcgggtggctgaattatatttacattttttatgccaggacaaattccaaactttagaattatacagcaatggagaaatccagatctttgctccaaaaggtgcccagccacagctgccattagctctatttccaagtggacgtcagtttttaacttgcatagacacagtgacttctccgcttaaaaacgctatttttatgtttttttaatttttggattttgttccccaattatgtttaaagtctcataagaaaagttttttgtttgtttggttgtgtgttttttgttgttgttgtttttccagacagggattcgctctgctgcccaggctggaatgcagtggtgccgtctcagctcactgtagcctcaacctcctgagctcaagtgatcctcccacctcagccacccaagtagctgggactgcaggtgcatgccatcatgcctggctaatttttattttgggttgtttggttttttttgtagagacagggtttctctgtgttacccaggctggtcttaaactcctgacctcagatgatctgcctgcctcggtctcccaaagtgctgggattatgggcatgagccgctgtgcccggccatgtcttttgcatattgtattatctacaaaggacatgagttactttttaaataagtgatcttgttaatcaagtgatcttcctgccttggcttcccaaagtgcttggattataggcgtgagccaccacgcccagccaaagaaaagtttttaataagtagatttgattttgcagttacaaagtgaggcagaaaattcagcacatctatgtttaatagtgtcttccatgccgctgtggtttttacagtcagaggacactcctataaaaaatacctcgttatttttatactttatcattttctgaagatttattcttgaaatatgttgatcttggttactgtgacctctgtggctcagaccctcttggccagcctttctactacctcagggcccctttttcccacgggggtcccaccaacatatgttaactcccgtaacgctagcccacgtgtcaggggagacagatccactcggaaagcagccgtgcggtacagttgagagacaaacagatcatcatcaagctctactgatgaatgcggcccctgtgttccaggcagccaagactgagttcccccttatttcccttcactgaacatgtcagccatgtttgtgatgttcttgtgtgtcccttgccctgagttgacgctgggaccagggtgcttgaggatgagctcccagcaattccaggctgtgcctgtcaccaatgtgccccgggcaagggagtcacctctctgacatggaagcccagaggttaccttctggaagcaaaccctgtaaccaacttccctccttacagggctggaagcgtagcagtgtccaccatctgtggaatgtcctctggagccgccttgcccatgccacacagaaggacaccacggttagggcacccatgcgtcacagcatgtggccagcagggccacgccacctcccagggaggcatctgacatgcacaaaaccttttgagtttttgtatgtttttttcaacactttcctaaaatgcagtgatcaaaagttagttgcctgctcctgcttgggacaccagtccctcagggggtttgggaattgttcctcccagactccggggctgacatttggagggtcaccgcctgacccctgctccagagtcagcaggatggcgctcctccaacaccactcctcccatcgcatgtgggagcaggaggggtgtggtcttggaagcgacaccctatgatgcgcattcacctgagtggccttcctggccacagggctgagccaagggggggccaaggcactgcctccctccaggcagcacgtgtgtctaaaaaatttatttataagtacccagggaatatttaaaaatatataaatttttgaatagttgagagattttaataaaaacgtttgtgcattattggcagagctgtcagtgggtgctgggtgagagccacacggttgtctgggtgacacccccgtgtccctacacaccatgactgtcctcctgtccacctgagatggaactctgggttccctgagtcacacctacattaaaacgtacacagtcatccatcacgttcacatctgtgccggcatgacctccctggggaagcgtttgcattgctgccctttttgccaagaccctcccgagcgtgatatgacctttgaacctagagccagagaacctgcttgggcgtccctgccttcgttaaatgaactgatcttggatccaggttaatggtgagataacttgtttttaattatagttttaagaccaggcagaaacaggctctcgtgcttagtctgatttcatttacgttttagcagttcattattgtaaacagaatcctaaggactgtagaccgggggcgtggaaaccccaccacaacacagcacctagaacacacgtgtgtgacatctcgagtgacgcacattcggaacagatcgtgtggatgtgcagatgtcagggagtctgcagtacctgcgcatacactagctggggctggacttgatctgcttttagcttttgccagctttttagggagtctgaagacctagtttagctgtttcattcttttgtctcaactcaccacatggaaatttcttgcccttgagaatacctctcttgccactaagtgtgaggacgacgttggttcctgggtcccacctgactagtgtgacgagtcacgtgacgcaaggagaataacgggcctgtgttctcgggctttttgtttccgtcaagcttcatgacctgcaggaagtaaaaccaggtctgcctcacgctctgcacacccctcccctccctggcggccgccctgcacaccccttccctccccagcggccgccctgcacaccccttccctccccggcgaccctcgttgggagcgtgtgaaggatggtcctgagtgcaggctgcaggtgccaggtggtgatcggcacataacgtgacagatgggcaggtgtgtttgtcacgcacagacctgcatggtaggcacctgccccatgcccatgtgtccttgcccgctgccatctgagaggatgtaccctcatcctacaacagctggcccttggtgtgccaggtctgccaggccagagctctctaggggtccgtgttgggtaagtgcacggcaggtggccccctggccgagagcctcaggaccccgctgtctggggtttgggggctgagtgtggcacagcaccactttcatgccctctggaaggcttggcttttgcgacctggcctcctcaccagctcaatggcagtttcatggcatagcgtccctgctgcccccagacggtcagaaatccaacccgagtcatatcattatcctcgtctttgtcggcactggagacgtggggaggtttcgttcctcagaactgctgcacgatatgtcttccaaaataaatgcggtttatttcaaacagcagcactcaaaatcaaggctcctcaggaaatccagtattaaccccttccgagctttcgccgtccttgtcagatgggcaaaacacgttgtttagcatctcagcacaagactggagagaagatcgggcagtttgtgcataattatttagcagtctttaaaactaggagaggaatctgttttctaattaagctgctgtgtctggaagtaaattatagtgaaccttcctcgagcgacccccccagtttctaattatctatgctaacctagcagcctgatgaataagctgttgctgctgcagtacatatttatattctgaatcctttgagagagtggcaataagatccgtgcctggaaattaagggacatttttcagccctgaaacaaagtaatgcaacacttaaacagtgctagaaatattagggttttcagaaagctccggggaacctgagagatgtgaacctgttccacgaggctgctagttagtattctgatcactggaggctcaaagcgtacccagaacttactcgtgattaacattgattgtgtacacagcatattttaaaccgctaacaatccattgtcgtgaataagtgagtctctgtgtgctgctgcttccgaggctctggtagcacggctgccccgtgtggcccagggacagcaggtgcggggctgcagccccacagccctggagcttgggtttgactctggctctgaaaccttcagcattgtgttagctgatctctggttcccatctgtgggacttccgtctcatctgagcctggggatgcagtgcagaaaatgtaaggagacctgggagctgctgcttgagagcacgtggctatccgtgcttcctggggaatgatagtgaccgtaggaagcatttactgagcccccatggtgccaggcatcgtgctgaggcctttacaaacattacctgtaagtcctccctggagcccttcaagggtgggtgctgttgttatctaccttttaaaagatggggaaactgaggcacccagcaagcacagggcctgccaagcaccacaccattaggacaagctgggacagggatttgctggcagcctccctggagcctgcatctccttcccctcggcatgggctgtgtgaacagagcacgggctcctcaacaggagcccagacctctagaaggtctgcacagggtttgggggggcagcactcgtgtcagaggcacagcggctgtgattagaattcacttcatcgagggaagtcatacacatggattatgtttgaaaggaaaactatcaaaagatcccagtcttgattcaaaaaatacctttctttccaacataaatatacaatattggctggtaaaggtgaaaatcagtaattcattaacgtctgccagtcactgctgagatgagtaacgaggcactagacgctgatttagaaatgaagaggtggaagcaaaacccgagagatcgccgagcgagggggaggtgagtgattggcggaaacgggggaccgccgccacctagcagatcacccctgcctgcccgagcacagccacctcagcgttcccgtgcgcgccacgccagggcgcacggtgctgcacgggggtccttatgcccgggcgcctctcattaaggtccccccacgggcagagggaagacgggcaccgggtccccttcgtgttcgatgtgcaccccagcaaggcctccttagctcatccggattggtaggggtggaggaggcttggttctgagatgaaattgcagacgtgcagccaagggggaatgtgagaggttcagaggccaccccagggaacctgcacacagcacggagatcttccgtttccttcacagtggtacccaaaccctggtatttgtcatcaaaacaaaggcctgcgccacagagcacggagctgtaacatctgtggcattcgctccacctcctcacggctctgcacctcccagcatcctaaagaaaacgtgggctgggcgcagtggctcacacctgtaatcccaacactttgggagtctgaggcaggcggatcatgaggtcaagagatcgagactatcctggccaacatggtgaaaccgtctctactaaaaatacaaaaattagctgggcatggtggcgtgtacctgtagtcccagctacttgggaggctgaggcagaagaatcgcttgaacccaggaagcggaggttgcagtgagtgagctgaggtcatgctactgcactccagcctggcgacagagtgagactccatctcaaaaaaaaaaaaagaaaaggaaaagaaaatgcatgtgtctggatatctctaaaggaagccctcgctctgcggagatgcaggagcacagcttgattggagggcagcttccgttccttgaaggcaggctcccaggtgcagagcgaggaagaggccgcagtgaggctgagcgtgtgcctggtcagtgccccttggccgtcctttctgatgttggcctttgctcttgtgtaggagtcatctcagacggctcagtacctatggaggcacacgtcactgcggtcgcataaccgggatgaggctcagcccccattgatgcctcttctctagacgcatcgtagttcagcaggtgcacctccctccgtccagtctgccatttctccttaaccttccctgagagtctgttgctccagctccattgcccgcacggcccttcggttcctcacaacccctggttctggtggggtgcctggagtgcctcctctggcaggggtgcctccttggatctgtttatcctgcaggattcagtgccctgccgttgttcctatgtgcgtggctgcagacttgcaatcggtgataaagcagtgtggcgtgaggcgccagcataaccggggaccccgggtgtgtggtggcttttccggtgctcatcacagccacccggcgagcagcctctgaggccatctccatttaaacttctggaaaccgaggcaagggaggtggagagacttgctcagggtcacagagagtcacacgagggtcccctgtcggtggcggagcctgtgtccgcccccacccgtcctgctgtgtctgcccccagccgccgctgctggcttctcagtttgctgctccgtgctgcacagtcccctctgtcagagcctggtcgctgtgccctgtggcccttcagagaaaggcctccccgttctgatgtgcgtgtgttgtcttctgacctcgatgccagtatgttttgcgtgagtggccagctcgtcagcggggcctcgggttccaggctcgagcgcacttttcagaccccgcgtgtgtttctcagcacgtttgttcattcaccgttcattcagcagacatctgctgcggactggctgtgtgctagggcctgtccgaggctctggagccaagtccttgctcgttaacttacatcctgatcaggggaagaaacgcacataagaggagtgtgaatgtaccaggagagccatgtgatcgcacacaagagtgcctggatgcttctttgattgggcagcctgatgaggcccatgaagaggcaacactggaactgagaccacctggccagacgggagcagccatgccgggaccaggggcagcgttccagacggggagccccacagcctctgagccaggcacgagcttgggctgtgtggcaagggccttctttgaaagaggcatatgtagcttcagtatttataattaacaccgctaacctggcagcacttaatgggtctacaggggcctgtgtgagtctgactcagaccactgcatcagatggggaaactgaggcacttaggagcttgatggctacctacagaggacattttgctccatgaatcagtggcgtgacccgcagtggccgcagaaggggcagtggcacaagcctgactagtggctccgtttgcagagggggtgggggcgactgacggccagcaggagggccgtggtgttctcacctgagaaggcgggcgagcactccttttgctagaagaggctaagagatctctacgattatttccatggatgatgacccaaacagatttagtgtggctgcgtgtgtagctgctgtgtcttctagctgtttctggagaccagaatgtgcctccccgaaatatgaagaattgttgggctgaagacaattaagaagcaagtgcaagagagctcctttcctgccttctgtttccctaaagcaaaacatagatctacagagacaaaggcatcctgtcccgccccgtcccagggaggacagcagcaagccccgaagacagctccaggcccacgcgaaggtgtttccttcattttctagatgaagtgactgagtctcagagaggttaactcacctgcccaaagtcgcacagctaggagtggccgagcctggaggacagagccgggtctgtgtgatgccacccccaactctgcatcggctggcgtgtggaaggacgtccatcccttcacgtccctctgcgtgtttgtgagtgcgattctgaggaaagtggcatgagttttctgcatcaagatgcctggtctcaaagggcgggttccatgtggacctgacaaaatgaggggatgtgtacagcatgggaggagagaccggttattttgacccaagccccgggtgcccagtggtaggaggagtgctgaccttctgtgtgatgcatgcccaccaggaaaacctcagaggattatcccagaaatcaggcataaccacacaaggctgcctgtatttggaaactgtctttcctagggtgttttaacaaattcacaggaagacacaatttacaaccaggctaggaagtgactctgggatttcagcatcttttcagagacagaaagatccagatgagctcaggacagtcgggggaaggtggtggcaatctctgtcagaaccgtggagtgttcgttgaagatacttccacagcaggagagctccacgccccatcctggaagctcaccctcctcccctcccaccctctttaggccagatttttgcagagaagctccctgatgagatgcagcgtgcaggtgagagtggcgtctggagacagcctggaggcggccagtgcctccggagggaagtgctccccaaccccggctctgctggagcccgtcctgcttccccttattttaggagctgcttttctcgatgtggcaggcctttcagcagcttctcaggagactctgcttggaggtggcttctcccatgtgactcctgcagctgcctctcaggaaaggtctgtctgaaggtcggccctgacaccgggaagcccacagaaaatctgttttgcagaagtgcttcaaaaataaacatgggctcagatgtctttctgatgggctttggaatctgcctgtttaataaaaaagaatctgcttttcattatgtcatcaacatgttgaataagaaaatggggaattacccctcgcctcgctgtggccccatctctccctgtggtttttgtttgcagcctccagagtggccattcctgtccattgttgttgttgactgactccaggaaggggcaataatttgtcgttctatagtaagtcaggtaaaaggtgaattatctcctgtaatattaactctgcttactgttaagtcagggaaacttcctcccgagttcaaccctacatttacttcacaagtaaagatgagcagaagtctgtactaggggaaccattaaatacggaaggacaggatccaaagagatggcagcactgtgcatatgaaccatgtgatttagaaaccgagcagagatttttaaaaatcattaaaaaacaagccgcctctggtggtttttaaaaagccagtcagcttatgcaggggtggaattatggaactttctagtttctattgtctctcgggtgccatgttcactccaaaccatttcggtaaccctgagccagtatatcctcctggagaaattaacaactgcttcctttaagtcaatgtttttcaaagttcaagtcatggttgattagtggctatgaaaccagttaggtgggtcacagccagcattttaaaaaagaagaaaatgtcattgttttcatagtaagataagtgttccgtggtcctgttgcttgaacatgtatctcttttttggtttgcttttttgtttctgttgtttggaggcatggacagggtacgaacctgtgaatatgtatctttatatgtggttgtgtatgtgtgtttgtctggtcaccaaaaatattcctagggctcatgatcaaacaagttggaaagcttcttatttaaatgatctctactcttatgttaattggggacctagacacactgaccaccttaattgcctatactttagttaccatcagtgttgtgaatacttagtcgttttccaagaacaaccttgccccaaatccctgctctaccatcatcagccttgtgccatattatggtttcctataatctgtcccatttttaattaggaatattgcttatacgtatatcttttttctttgattttttcttttttttaaattctcttttgcttatacatatatcttaacagcctcttcttttcttgttgaagaaataattttgacaagtttttacattttactttaaattaaaaactcatttcccttttgaccacatgcattaaccctcagaactgaagaaggccagattaaccgtaccaactcacccttcttgggagaatgaagcaaaccttttatcatcaagatatgtcaccctttatctctggtaatgccttttgccttagagtccacatttttaaagtatcgtagctgaacaactgtctcttggttagtgtttgcagaatgcatcttttttatccatatgtatataaggtagatctctttttggcaatatagttagcttttatttagttttgttttaaaatagagacagaacatttttggttttaattaaagtatttagtttgtttacatttagtgtagtaattgatatatttgggtttaagtctgcctcctacttgcttcatcctttttttttcctgttgctttttattctagccaccccaccacccttttttttggagcggggggaacggagtctcactcttgtggcctaggctggagtgcaatagcacgatctcaagctcactgcaacctccacctcccaggttcaagtgattctcctgcgtcagacttccaagtagctgggattacaggcacacaccaccacacctggctaattttttgtatttttagtacagacagggtttcaccatgttggccaggctggtcttgaactcctgacctcaggtgatccgcccaccttggcttcccaaagggctggggttacaggcatgagccactgtgcccggccaagccccttttttttttaacttttcttttttctcctcccttaccatcttttgagttgatttagcaattttattacacctttcttctcttctgttggcttgttaattttatattctttactatactttgagcatcctgttttttccattaactgccagatagtatatgccttagactttgcaggccatgtaaggtctctgtctcatagtcttcccattgttacaactctttaaaaatgtaaaaaccattcttagcctgggggccttaagaaaacatgctcctggctggatgtggtccttgggccatagttttggtgacctgctttagaaactataacgtgcatcctgctaaaaactaatctaagcctggcacagtggctcatgcctgtaatcttaatgctttggaaagctgaggcaggaggatcacttgaggccaggagttcaagaccagcctgggcaacatgataagaccctatctctaccaaaaaaaaaaagttaggcatgatggtgtgcacctgtaatctcaacactttgggaggctgaggcatgagaattgcttgagaccaagagttcaagaccagcctgagcaacatagcaagaccccagctctacagaaaaaattaaaatcagctgggcctggtgacatgcccctgtagtcccagctgcttgggaggctgaggtgggaggatcacttgagtcccagtggttgtggctgcagtggctcgtgatgcaccactgcactccagcttgggtgacagagcaagaccccatctgctaaaagaaacaaaaacagagtaccctttagtacagatctgctgggaaaaagttctcatttttatttgtttgaaaatgccatcatttctcctttgttttcacgttttcaaatcagcgttcttgaggtgcattcaataaaatatacccacttgagctgtacaactgatgagtttgacagaccactgtgcccgtggagccacaccacagtcagcgtatatcccgtgtgtccccttgtacctgtcccagttaatccctctccttatccctcaagcccaggcaaccattgatctgggttttctcactatacattcgatttgatgtttccagaactttctgtaaacagaatgataaagtatgtgctcttttctgtctcttccttggctcagaatcatgcctttgagatgtctccttgttgggagtatcagtagtgtgttcctgttcattataagtaacagcccgtcaccctgtgtgtcacagtttgtttcacctgttgatgcgcgtttgaattgttcctgtcctgactgttatgaacaaagctgctgtaaacattcatgtgcaagtctttgtgtgggcatatatattcatttctcctggataaataccggagagtgaattgcttggtcatatggtaggtgtgtgtttaactttataagaaattgtccaactgttttccaaagtggtttgctgacctgagttcctgccagtaacaacagcgtgccagttgtggcgcatccatgtcgacacttggcattctgccttttcggggttttttttattttattttttgagatggcgtctcactttcttgtccaggctgcagtgcagtggcacagtctcagctcactgcaacctccgcctcccgggttcctgcaattctcgtgccttagcctgttgagtaagtgggattacaggcgggcgccaccacgcccagctgattttttgtatttttagtagagatggggtttcaccatgttgcccaggctgatctcgaactcctgacttaagtgatccacccacctcggccacccaagtgccgggattacaggcgtgagctaccgcgtccggccatcttaccgaagtataacacaatatcattattattttaatttacatttgcctaatgatgacagagcagcttttcctatgctgctattggccattaatttatattctttaataaaatggatgttcaagtctcttgccaattttcaaattgtggtgtttgtcttcaagagcccttcatgtgttttggacacaagtctttgtcctatctatacattgtgaacatttttgctaagtctgtggcttgtgtttttatttctaaaacagtctaggccaggtgtggtggctcacgtctgtaatcccaacactttgggaggtcgaggtgggcagatcacaaggtcaggagatcgagaccatcctagctaacacggtgaaagcccgtctctaataaaaatacaaaaattagctgggtgtggtgtcacacacctgtactcccagctactcgggaggctgaggcaggagaatcgcttgaacccgggaggcggacgttgagtccgtccagcagtgagctgagatcgtgacactgcacttcaacctagacaacagagcgagactccatctcaaaataaataaataaataaataaataaataaataaataaataaataaaacagtcttttgaagaacagaagtttttcattttgatgaagtccgatttcatcatttatttattttatgatttgtactttctgtgtcctacctaagaaatctttgccaaccctcgggttgtgaagattttctatttttttctaaaacttttagttttaactttcatgtttatgatgaacttagtgaactatgattaacttttaagtctgcgatccgtttcaagttgttttttaatatagtcaagagtcaaggatcattattttccatatagataccaaattgttccagcactgtttgtggaagaggctatctttttgtcattgaatttccttggtgcctttgacaaaaatcatttgactataactgtatagttctattctattctcttgatctgtgtgtctatctttattggcataaagataggaataccacattaccttgatcacggtagctttattgtaagtctctgtttttgttttgttttgttttgttttgttttgtcaaaatggttttggctactctagatccttgcatttcatatgaatttaaaaatcagtttatcagttctaacgagaagcctgctgagattttgactggaattacattaaatctagatgaatttgaggagaattaccatcctagtaatatggagtcttctgacccatgcacatagtggcttcatcttccataatcatcacatactgatttagttgtcttggtgccttggagctttatctgtacatatcttgcaaatattttgttaaattaatgtcagtttaaaaattatttaagacagcatatagaaatgtaattgatttttgcatagtgacctcatttcctctaactttgctacattcacttattggctctgggagctgtttgaaaggtttcttaagatcctctatgtgtgtaattatgtcatctgaaaatacatacagtttgacttctttatttccgatgtttatgtctttaatttctttttcttgctttgttgcactgcgtaatgtctccagtataatgttaaatggacgcaatacagctgggtgttgaagccctgatctgagtcaaggatcaatgacagggaacattttatctaaatctactaagtataatatgtgctgtgaatttttcatagatacccattatcaggttgaggaagtgcgcttctagacctagttttctgagagtttttctcgtgagttcttgttggaattcgtcagcggcttcctctgtgtctgtggaggggatcgtacagctgttcaccctgttcagatggtgcatcacatgaatgatgttcagatgttaaacagtcttgcatccctgtggtaaaccccagctggtcatggtatattacccttggatagattgcgggattttacttgcatttcattgaagatcatctcacatgtgttcttctctacctgtgggagacagccacgccctctccaacaaggcctaaacctcactctatccacagaacatagccacgccctctccaacaaggcctaaacctcactgtacccacgggacacagccacgccctctccaacaaggcctcaacctcactgtacccacgggacacagccacgccctctccaacaaggcctaaacctcactctacccaagggacaccgcctctctccaacaaggcctcaacctcactctacccaagggacacaaccacaccctctctaacaaggcctaaacctcactccaccggtgggacacagccacagcctctccaacaaggcctcaacctcactgtacccacgggacacagccacgccctctccaacaaggcctcaacctcactgtacccacaggacacagccacgccctctccaacaaggcttaaacctcactccacccgtgggacacagccacagcctctttaacaaggcctcgacctcactgtacccacgggacacagccacaccctctcgaacaaggcctcaacctcagccctacctggggcctcctccaggtgctgggattacaggcatgagccactgtgcccagcccttgatttcttaatatactaaatttttaatttccagggtttaaaaagaatagcttctagttttcttccaaaattgttcactttgtcctttaattccttatacatattaagtaagatgattgtcaagtctgtgcctggcggctccattatccaaatcctctatctctgtcttgtcagctgcttttcttggtttcaaacatatatacagttttccagtaattacctgtttttttttttaattgaatgctacaaattgaaaacggaaattgtacaggtatttggggtgatttgaggctgtgaagtctgaattgttttgagtttctttttcctcctacgcgccttttagagtctcagctcaacaactgaggagtttccccagatctgcttctccttggcagtgcatcacctcctgctgttgttccccagccccatgagcctgccgtgatctactcagcgtccctgctgctgggtcccttttttggagttgccagatgcttccaagagaggtggccccaaacgaaagctcaacccctggcttcccctcctcgagtcttggccccataatttctcatagcctggctgcctttccttgcttctaaaatattcccgaacatacacacagcctttctagctgttctccaggtgagaatggtctgaatcacctcatctgccgttacccgcaagggagcccgtgctgttctcaaaaccctaaacctgtgggaaccacacgcccccagatttgtgcacgtgatttggaatctggtgggctcagctttttagataatgcccagtggctgcacgtgagggtccgcaggcacagagttggacccacgtccccagccttccatgtccagctgggactctatgtggctctcttgttcccgttcctgtccctctgccctccagactatagcactgcagcccagctgacagagaggccgctcctctacctttaagttgcaaactattcagaccaatatcgtgtattataatttgtaaaccatgggttttatgcacgctaaaatggactttaattatgatcactcaaagtctgtaaatggctataatattgggcactgtgtagtgagaacatcaggtaatgttacagagcgctgaattgtacatcattttaaataaagagaggctggacgagaatatcacaggaatgcacgtttccttggttcagagcaatattagcttaagaaaaagtattttcactggtttcacgaaaagttatcacctggtgcattatttcctgatcttcacttcgaattgttttctttccccaaagagttgtatttttacaatgaccgacatgtgtgtgtgctttatgtgtaaggtttcaatgcagcgttcattgagaagctggatgaactcatcacgcttttgcacctgctcagattgctttcagtaactctcctgttactccagcccccactgtggagaaccactggtctgagatagacatatatagcttccctcttactagcaacctagccattatgcactgacctggattttcaaaagaattatttcaaaaaagaaattgctcagttcacctcccctgaccttggcatggaacctttgtaagtaattaattatttgcagtaagtaagtgaaccagcccaagcttctctacaccgtcattttcatagtagtcatttaaatttaagtgcgtgtccttctttaactgaatttaatctgagatgatataaatttttaaaatcatacagttttgactcggtacggtggcttatgcctgtaatcccagcagtttgggaggccgaggcaggtggatcacccgagctcaggagtgtgagaccagcctgggcaacatggtaaaaccccatctctaccaaaaatacaaaaaattagctacgtgtggtggcatgtgcctgtggtcccagctacttgggaggctgaggctgaggtgggaggatcgcttgaggctgggaggtggaagttgcagtgagctgagatcaagcctgtgcacttcaacctgtgtgacagggagacctcatctcaaaaaaatttttttttcataagacagttttgaaatatcttcccttttcaggaaacttgctgtagcctccttcttatttaaaaaaaggggggaaaagttttgttttcctttaatacgtaaattgtatgttttccgtgtagattattaagcacataagcaaaaagaattaaaatcatccattttctccagcatgccgggataaccattattaacactttgtgtatacccttccagacttttgtctaagtgtattcttgggtatttttttgattttgtgcccaaagagataatctaggggaatggccaccagagcgtttcacgagcttcttagatgatggaatttgggatgatttgtattatcttgttttcttttttatcatcatttgagtacttttagtgagtttgtcctatttcttggaaaccgtagtttttcatttaacattttgtttacatacagtttgacaatcattcagtggggattcacccattggctcatcgtatgtatgcggcacctgttctgtattcaacgtttcatgccatcaaatatgtacacggcatctgttctgtattcgactttcacgctaagcatcgtaacagcaagatgaagaaagaatgtagtcctcactttcagagcgctccaagcctcagcttagacacagcctaggcaacagtgtctcagagacattcacagctctctgggcaggcatcaaaggagcagccccaagcagggaacccctgggttggtgtgggagagaccccaggggagtgtcctgagaggaggccggacttgagccaaatgataaaggatccataggtgtcccctaagccaagaagacaggagggtggtctgagcagagcacacaggatgtttgagaatgacaagtctgacatggctggaaagcgatgtatttggtgaaatagaaagatggggaggaacagaaaatagcaccaggaaggtaaacatgcttgagttactcagcctccaccatggcagccgcgtgactgtgctggggagcagacactaggcagttaggggtgcacaaggtttgttggatgtaacacctggcagaggccaggacagaagctggacctgatgtacacctggcccaggctctgctggccccatagagagagagctgtcgctccaactcagaggtggcccagcctctgcaggccccgtggagagagagctgccactccaactcggaggtggccagactctgtagctcagctgtgctacagggccacccagaacagagaaaggcctcatctgaacactggcccagtccctgtgcgtaccagctgggactgtccctgtaccgcgctttttcctgccaagggcccagccccgtgtccacaggcagcagacagccatcggcatcagtgggagcagctgttttttaagtggggaagtgacatggcccaggcctgtggactgtggagatcacaccatgtgcttaacgagctgccgggagctgtgagattgatttatgtcaaggaaaacaagtcattatccatgggaatttatctagctacacagaaaattaacagtggaacaatggcgggtaataaaagaaaaagaaagtaagggattcgttgagcaccaaagaaatttagaggaagatctcagctgtcatcctgtgctggacagtccgtcacgtgcagagcatcctcccgactggcgaggtggcttccacgtgccccgtcaatcagggctggacagtccgtcacgtgcagagcatcctcccgactggcgaggtggcttccacgtgccccgtcaatcagggctggacagtccatcacgtgcagagcatcctcccgactggcgaggtggcttccacggagcgattctcgagacccgaggggcgtggacacagcttctacgcaggcagtcggagagccactgggctcttggccctcactcctccagccagaggagttttgctttcctttgtcctgcataagattttgtttgagtagctaaaaagtaatggaaaaccaccacaatgatcagtggagaaccttgtatgtttgggggcccagctgtgtgttaagagccatcagcctgtgtagcgtgagccagggcagaagggcctggcccgagaatgctgtctggacgcctggcaggcctggctgcagggtgccgcagaggaggtgggaagaggcatctttgggaggcctggctggccccagtgcaggaccagagagcagctgagggcctggggcctccggggtttcgagcctcagtgaaacgcgaatccacagggactcttggagtggggaccagcagtggagaagatggaggcattgcacttgattttacacacgttccgcttgagctgtgatgccaggcaagccgagggtgaagggaagcgccttgtcgtgagacctggaaggagcagggctgccgctggagcagatcctggggtgtgaaaagagctggcgacgcagtgctcccagaggtcactaagggaggagccgggtgccaggggagagacagtcaggatttgcagattcagcaaatgaagaaaggcaaggctggccagccactggagtgagggggcttgggaggaggtggcttggaagggcggtgaggacagaaaccagctttcgcatggcaggtaagaggagcctacgggggccaaggagagcttagctagtgccagcttcagggccacatgggttttccccagggtagacaggcataaggccccagcggccactgcatgttgagccccagcagccagtggtctccccggcccatccctggtcctcccattcctgcgaggcggctgcggggtctgggtctggtttctgccacttgtctctagtggaagacacaccctcatagagcctcagtttctccatctgaaaagcaagtgaacataagacctgcctggcgtgggcattgggaaggaagtcttggtggacttggcaggtgggtgacttgggggcctgggtccaccgagccgcacagcgggaggcacggcatgagtgcccagctggcagcggtggtggaggtagtgtaaatgttcatgctgaagaaaatccaagcctctgagaggctgggcagctagtccacagtcacagagccagtctctggccaaattcaagcccccgtctgtctggctcccaagtttaggcctggaagtgaaggaaaaggaaggctgggggttctgcaggggagacatcctgatgacctcacagccccttgtccttgtcctctgcatggatggggccagggacggcagtgaggcggccaccccatggggaggagatcatgtgttgcgtctcctgagtgcagacggagctgaaggcgcccccgagaatccaggtgagagcaggaacctggagagactgggaggcaagcacctgccacgtgggcacctgtgagtgaaccggggagggacagggccccaaggagtgggtggcacctcatgctggaagtggggagcaggcagagtgatggggcaaatgacagggagccgggcaggtccgggagaaggggtgggggagggagcacccttgggagagtgactgtgatgggctgtgatccctcaggcatctggtggagaatcaaaggcgagggctggagacacagcagctcttgttgagtgacaagttcccagcagagggtggtggtggggacagccaggggtgtcagggaagaagaaggggccttaggggaagggcacctgcttggcatttcggagctggcctggcactctacagtggttgcacaaatggggtgtggatgctgaagttctgccagagtctagcagggccggggtcatcatgatgacctggatgttgcagtaaggaagataaatcctggcaagaaaccgcatgccacaggtgagcccggaagtgtgggggaaggtggagataaaccctcctgccaatggcagtgaaggagagtttgaggaggcgcgggccctgttggggggccaccccggcatctgccacatctgttgttggagtgtcatctgttttattttagtcgccattttgcatcagggtcagctgtgttgactcagcagagaaacaggtaccacgagtcatccagccatagcacggctgggaccagcgcttgagttttcttgtctcccaattcaggagtcttttcctgaactgtagctttttacagttttcacatagaagtccttgattaacactctgaatttaaattttaaaagagccaccttgatcattaaccctttgagggttcagagaaacttctagaatgaaacatggtctgacatggacaacatacaccaataggcttcttctgtggtcccctcgtgatctcagtggcctcccgagttgggcaagactcagcattggttaggatcaggtacagaaaggaaatcagaaacaaatcgtttctgcaaggatttaattttatgtgacgtgaaaagtgagggatgctggactcggttccaccttgtcacccccagtaggaccaggcctgctggatcaagaagcctcatcagcttttgctcactggatggttggttcatcgacttgaatgatttctgggtctgtctgaagtcggctgggcagatgactctgtctggtttcacgatgagcttagggaagagaccagtgggattttcaggaccatgttgggagagtctagctttgcatttatttactggtgatcatcacaagataccaatttgtaaaaacacaactaagtacacactggtcctatctggcctccgtttatcttgatggcttggccatccagtgacagtgctggggtgtgggacctcgtgggaagctctttgctgctcagaatgcagctttctgttaaccagtggtcacagactcgggaacagcaggggctctatgagcttcagtcgattcaggatacgtgggctcacgttagggatgtgtttagtcctggtttgcaaacagcctgcgggcaaatggtctgtctgtgcttgtgatggtccctgcacttcttccggaatgcagccctggcccccgccagctgctcgagctgtgctgcacccctaggctccctccccagcatcaccagggccaaggatgaggagatgcaggagccagggttttggcagttccctgttactcaggtgggcacactcattgcagtaaatgttgatgtataaagacaaggaagggtatccccatgatcgcattttgaggtttttcctccaattgtttctccttgcacatgtttgatgtaatcgtgactatagagtatttgtcttgcttctttacttaatgttataaagcattgtcccatattattgaaatattcagaacagtttaactgcttgtagctgctgcgtcgtggttgttgcgtggtttgtttaatcatttccctctcattggtttcggagcgaattttgggctttctgcaatggcagatgacacagcaccacacaccctacatcccatttccccatcttgcttccggtttaggtatggttggttcctggaagttgatgtactgagctatgtagatttttccgacttttacatgtggtaaagaaggtagtgccagcgcacgctcgtacaggatagaagtgtttttgtttagggcagggacagacacatccagctgccttagaatgggggctctgcacaccagaaagaccagctgtgtaacgtagagtgtggactttgagtgatgcagtatcagtcactcaatcggtcttgtctgtgtgactctgaatacacagactccgggcacttcccaggctggcagtgctccaggcacgttgttacagtcgtgctgggagggtaacatgtctgaaccccatggagcgaggacctgagctctgcagttggtgttgggccccaccctgccctgggcgcctctcttcctgaggcttggggacggtcctctgccctcatagtttgactaactccagatatgttgagagaggagagaacccgtgacaggatgctgaagatcagcaactcccgtgtcctccttccttgcacagtcgggccacttatgtgtttactgatcctaggccacagagcttcggcgtgtggtctgggcgctgtctgtcctctgcatggctttggtaaggagggcaggcagcgctcggtgacagtcctgcagcttgaaagaggcggtgtttttgcggaacagttattgacgatcttgtcagtcatttcattaaaacggttttcagcatatgtgtttctcatctgcaggtgtgggacccaagacacaagtgtgttggggctccatgtccaccccacgatgccccccgtgccccttctccgtgctgtttcctagggctgtgtcccgggcagccacccctgttcgcgctggcgcttgagggctgagatgagcaacctggtaaaatgagttcctggattgtttgcttgcatttcataaggaaatgtcttctctttgggaggtgtgccccaccctcacattcctccgtggggccaagctctgtcgtaggttgttagagggtgggcacctttgcttttcctcactcccctgctcggaggtcggagggcaggcagcctggccattcctcctgcgcacagtggacatgcttgttctgaagcgagagcagactggggagaaggaggaggggctgagacgagtctctgctgtccttgtgccgtgtgttcgcctccaggcctgggtttcttttaaatggtgggaatccttcatgatgcctgccctccaccacccacacagctaatgaaaggggcttctccgtcatccccgtcctggccagcagcctgactagaaaaccctgatgttgggtaaactggtctccactgtggaggtcgaaatttttcttgaatttggaaatctttgtttgagacttccggcattgtttgagcagcagtgctgctttagaatattatactaacttctcaatttctcctttttcttgccctatcactgaacctattttgaggaaataagacgttattttctgttcgtaaaggaaagaaagagcatgtgttgaagaattacattaagaagcttgcttaggctgggcatgatggctcatgcctgtaatcccaacactttgggagggtgaggcgggaggatcccttgagcctaggagttcaagagcggcctgggcaacacagtgggactccactacaacagtttaagaaaagaagttcactgaacttagctaccctgtgttactgatgcatagcctctttgaatattattctgatgaagacggtgccatcagatggttcctgcagtgggaattgctgatcagctaaatctttttgacagcgggatcatgcttatggctctgaacacgtggcatttggttttccattccgagttacttcacttagaataatggcctccagctccatccaagttgctgcaaaagtcatggttctgtcctcacggctgaggagtggtccttggtgctgcctgccccatgcgaaatggcagcagcctcatccccccgcccactctctgtcgtatttgtctctgcgtcatctgccgtcacttgccacctctaatgtgtgcttgttcatttgcctgttacctgtccttccccctagacccttaggacagggcctgggcgcgcgctggcaatccccacatccctgtcgcaggtatcagctgcgtgttgaatacacgggagcaaagtagaccttgcgggcgagactcctcccagcatggacggtgtacttccacagcgttcggtggctgaggtataaccctgcagagcatgatgtggactgctttcagcacgtgccacagactgcccttggggtccagtcatcggtccatgggaaccatgtgtgtgaccagctgggcttggtctgtaagtctggggacaccagaggaagaagctgttttggagatgtgcgggaaggaggaaagctgcagatggaggttgagctctgagctgtgagctcatggagagtttgattctccctgccgtgcgccaagcttctgctcagagccttcctccctcgctcagagcctttcgccgcccgcgcccttttttcttgcaacctctcttccattccctgctctcagagctgtggcatcactcatgagaacgccccttgttttctaggatccctggccgcctgaacgacaggaggacgcccctgggtgaactgaactggatcttcacagccatcacagacaccatcgcgtggaacgtgctcccccggggtgaggcgcgggccgggccttggggagggaggctatggccttgagtgcgcggggagccgactctcggacatgagaggagtcagataggatccgtgagtgcctccctagtgaggaagacagtgggaggggctgaaaagtagaaggcgaccacctaaggaggtgtctgcgagggggtgagttactgcacgccaggttctcagaacggtggtgtggagagactgcgtgtcagcgctggccctgaccggtgcacagcccttactgcgcaccggcggcttatcttcagagtcgtcggcattattcacactggctggaaaccagaattgctgttgtaagacttgtttgtattttttattgattggttgatttggggtgtttgttcacatgtacgtatatgtgcactgtgtgtgtacatgtgtacatgtgtatgcatacacgtgtgtatatgcatatttgtgtgtgtgtatttgtgtatgtgtacacctgtatgtgtgtgcgtgtatttgtgtatgcgtgcccatgtgtaatgtatctgtataggtacacacctgtgcacacacatgtatgtatgcatgtgtgcatgtgtgtacatttgtgcacgtgtgtgtatgtttaagtgtgtgtacgtgtgtgtttaagcgtgtgtgtgtgttgctgatgggagatatgcatattagtcccaactttagtaatttttgatagaagtgaatttgtgtatttggctttaaatgctagacacaagtcactgtagactcctttttatcttttatctgccctcagatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggtgagtgtttcaggatcctccaggtgccgtgctcccccgccctccgtggcactgtgatgtcatggaattgcacggagctgggcagggaggccccacacctaacttggggaccccgtgtagcattaacaagtgaagctaaatgcagggctcccagagatctccacacagaggagtgggggtctccttcagagggcagaagccttggagggccttttaggactgcacgggagcagcggccggctgaagcctcacagctctgcaactcgggagggtagcactttgcaagagagtttctaaccttttagaaaccagtagtgagaaaataacttgctgacttgaatttatgaagcacatgcaagatcgctctggagaattaaactgttgggctcatgatcaattagtttttatgcttatttctcacacacacacacacacacacacacacacacacacacaacgctcataagtgtaatcctttatgactattgattatagttctctcccattgctgagttgctactatttatacaactcctattagtagtaacagtgacaataatgtgatttgtttttagtctagacattatatttgaagacgtttggtttctttctgttctgtggctgtcctaacaagcaggtttgggcaaattctaaaatggtattaaaacaaaggaaaaatatttctgttcatcaatgggagaaaccctaacaacacaaatatttttaaaagagcgattaacgtatgcctagccgcagaagccatcatgtggcgtattttcatggccaggtttattttagctagtgttttgtgttttctttttaaacgtgtacaggaccactttccctcaaccctggaaacccagagaagcaagaaggaatctaaactcactacccatcacccactccagaaaagttagaaataatctaatttttaatgtttataataaatatttatatgcgatagatcaaaatacattatacccagcatagcacttggactttaaacagcaaaagttaaagcatgcatgatctgtatccttcttaagactctgtaagataaaatagagaaccctgataaggagaaaaggaaattgaagtaaaccatttaaataatgtgtaaataaaaccaccgcacatttatttttcacgaatccatgaataacagagctgtaaaagagacaggtgtttgaaaagcctttgcaatacttagaataaatatttaaaatgaacattttttaaaaataaatacttagagcatttttgaaagagtatattctcaaaatggccttattcctttaagaaaagtaaggccttaaatcctgtctctatttcctctaagacaggttattgtaatacatttattttaaaagaggaaggaaaaagaaaaaaaaagctgaaggggtcagtgccacatcagatcctggatcaaaaactagttcagcactgggagccggttgagcactcggagcggggtgggcagggcctccagacttgcaggttcccttaccaggaatcagtccatggaaacctttttccttctagcgtatgttttctccagatgtaaaagcacctcctatctgatgtgctcagctgcgcagagttaaagacagtgacatcacattggagtccgtggtcaaagaccagagccagagcacagagaggagccaggagggatgagcaggcgaggacaggtgcagggaggggcatgtggcaaggccggcgtggggcagccacatcccacctctccatctagaggccgcgtggcgaggccagcgtggggcagccacatcccacctctccatctagaggccgcgtggcgaggccagtatggggcagccacatcccacctctccatctagaggccacgtggcgaggtcagcgtggggcagccacatcccacctctctctctagaggccacgtggcgaggccagtatggggcagccacatcccacctctccatctagaggccgcgtggcgaggccagcgtggggcagccacatcccacctctccatctagaggccgcgtggcgaggccagcgtggggcagccacatcccacctctccctccagaggccgcgtggcgagttcggcacagggcagccacatcccacctctccatctagaggccgcgtggcgaggttggcacagggcagccacatcccacatctctgtctagagactgctttctaggactggcccctcagaagttttctgagtgccagcatttatatcagtgctgctttatagaaggtccttgtctaggcctagctgcagcctctcccagcgttgctggggctgcccttccctgcccagaaaaaaggccagctattctgcagactctgctccctggagcctcacagagccagccctcacctgtgcttatcggttgcactagagaatcatgaggtgatgtcgcaatccacagaggcccagagagcctggggacagcatcacaagggtgcctcgcagcccctcttcctgacggtcactgtggacactccggcttttctcctctcctggttctgacctccctgagtgtgtcagaggctccgcttgggctaatgtgcgcctttagtgatccagcccgcatggtccatcatcccaccacaagcagcctgcggtgtcgtgtcctcccgcttccctttcgggcgcgttcttctcctggttgttgcagggtgggctgtctgggaagtagacggagacggaggctggtgtcatgacactgctcgtgagtggagcagccctgggtcagcggtggaggggtgggcggagagaagtcaggctcacctccgccggccctggggagctctgaggatgggatgggaggtgagtgggcctgcctgcattctgcgttggttgtcagacataggccacccagaagagggcctgacagccgtgagccacctgcctgtggtgcccccagcagctggggcaagaaaaccttgatcctgaaggggatcccggcccctccctcacagtgtcttgctgtaagagaaaatctcacctgccttacctggggctgctgttaccccagccccattttgatggggcccttgggagcggaggaagcgcagtgcagaggagctcttccacaagcgcacagcccatttgcaagaaacatgtttcctctcctcatccgggaaagtgacacttcccggccggctgtgcagagctcgtcaccaggccctgctgaggcctgtggcagtaaccgcaggtctggactagaagagagcagccagcggcacccggccactgtagcggtcactggtgcagccactgccagcagccagggcctccggcccagcccaggtacagcggagtgaactgtgttcatgtagaatcacagcggcgatgcccttaattgctaggctggggcagggaagcaccgccctggcctcctcctggtccctggcacccttctgccgggtgtcactgtgtccccatggttgggtttgacggacatcagggatgaagactgaagaagaaccaggccaggagtggtgaagggcagggctcctccagtggggtgcacagggtgggcccccgtgccgtcaccgctggccactgggcacacctgtgggctccaccagccacacagctagaactcgccctgctgttgccgatggcctgggtggctttggggtttcaccttcaaccggcagaagaaacattatgcgcttgaatttttttcctttttcttttttaaactcacacctgggcacgcatctgcgtactgccctggcgactgacgtgagcatgaagggagctttagtcagccgctcggcccgcgggaaggaagaggcgagcaggagtgactcacaccaggctcgggctccaggcttcctggcaaagcagtgaatgtgaacacccagggggcagctgtgccaaattgaagctgatttgtgctgaaagaagaaaacctcattcacagattacagaccagtcatggcccttctggtggacgcgtctccctctgcttagtaataggagttcctccagcgccacttgtgggaaatagaatttgaaggtggaaacagcactagggagggcactagccatctaatcctgtgtgacagcagtgtcgctgcagacttggcagctcagaacagcacgtggcctccagatccagttcctgttgtggggctcagccaggttctctgtgcagggtcccatcaggttaaggctgccttcgcagttgagaccacccgccgtccccaccagtggggtccttagcttggcctcccaccactcagagccagcgcaggagccgggtgctgcatcctcacctagtgccacacacagtcacagcagccatcaccgttgccatattctgctggttgaaagcagtctcaggtcccacctgcacccccagggaggggccacacctgggacaggggtcctggggccacgttcaagcctgtccacctcagctggtgaactgtgctggggtttggagagggtgagagtaaagtcgcagagcccagggagcaatctgaccacagctcccctgaggcacaccagtcgcggcgggtgaccacaggtggtcatgtaagaataggaattccagtgactgactgattaagcgcctgctgcgtgttgggctttacaattgttaggccatctccccctcacagcaggtactgccgcaaagctacgatttttactatcaatatgcccattttactgatgagaaactggggtgtgtgaggacctgcatggtagggccaggctgtggctctagccgtctagtgccagcctgccccatgctgacttagcggcgtacgtgctgagtcatgggatgtacgtgcatgagcttctgtttcaggcgcatccctgggacaggagtgcacccaggcagaagtggtgtttaaccagggaggaaagctcttgtcacctcttgttacacatggccactgtgctggcggatcacagcatcgttgtcagcgtgaggaagcttccccggtgtctgaacgagtctgatcaggcagagacgagcagggagtggcacttagcgacctgctgtagtcatgctcctgggagcatgctcctgagaccatgcgaggtctcaggaaggatgtgcgcctcatatgagaaacccgtggcaggtggcattccttgcattttgcagtcagctgcatcccacctacagaacagagccctggggttttccctccagctggacatgagaagctgctggggagtcagcagccctgtcctgggatccgagtcgtcttggtgactcccacgcttcgatgcctggccgagacccgcctggcttgggcctgcccttggttgggacctcactgacctgaggcccctaaccccgacccctgccttggctttacggcctttacagtgctggccccggtggccacccacctgcctgcccaccgtgctcaccctgcctttgaatgcccagcctctttgccccacaaccaatgtgacctggcttaggagcatagctgaagcaggtcgctaaggaaaaaccaagcaacgggactaatgggatgttctgaaagacaaggacaaatcaagccatttgtcagaacattggttataagagggaaaatttgggaataactctactacctaacagaataggaacgtaaattcagaacggatacttaaaagaaaatgtaagcagtcttaaaattttattcatgagtatgcaaaatatatgttaaatgagagaaacagaacaccaaattgcatcagcaatatagttaatatctatgttaaaatacatagtacacacagcaataaaacactaaacagatttataaataaacattaatgatgcttgtgccagggtggtacaattggagtgatggttctccattttaaaaattgatagatattactttggttaattaaaagtctgcctgtagattttctaagccttcgaagcactaaaagcaatttttaaaaatagagtctttatggctaaggcattattgttcataaattcagaactagagacacacagaagaaatcattacatacttctttacatgaggagaatcatgactggtagagtggcctaagaggcaggcgtgggggctttcagacagcagaaagacggggctggtgtccaggagggcgcgggcatgggtagggcagcgcccgggctgtgctcagtccaaccggggctctgcggggcggttttggcccacagttgccagtcatagagtagccaaaagttcatattttcatttttaattatctgattattagatgttgatatctaacgtggcattaaaaaacattctgcgagcccaaccagacacatccaacccgacacatccaaccagacagcggcctgtagcctgcctgttccaagctgggccatgaacccctagggacagaggcttcagtgaagccctcggtgcctcggctcccagcatggggggcggcccgtagacatggcagtgccgcgtgcatggagagggcggcgtccacggcgacttgtggccgagtctcaggatgcttcccccactcttcttcctcagcccctcctgtgcgtgtccaagggtcctctctagttagggatattttctgcaaggtctgacatcgtgtcttcttgtctttctatgctgggaagtgccaaataagtaatattaaagggttctttgtacagaaatcaatgatgatgtgaattcagggagaatcacttgcattttacacatgttctctggggtaggttttcagcaacaaggatgccagcgtgaatctagagctaaaaagtaaacacgagtcagttccatttaatgctgaaaattatatcatgagccaactttgatagggaattgaatgtaaaaattgggctttagatttggagaagatcctagatcctcgtaggagaagaaagactggaaatgtggtctggctggtcaggagccgggacagcaggtcccacgctataggtgtacacagattctccccgctggcttctctgttctgtggcatcttcctggtttcctggagtcagggcagctccactggcctcagtttccagagaacaaacctgactgaggtggacttgccaccttggccactgaccagttccgaccccgccccgccccaactccagctccacccagttctctcatttcctctcctctcactgccaccaaaacattatgtcaaaaaatgggggtttctcagtctgtatcagttcactatgtgtgcagaaaatttatcggaatgactttaacggtagtagaccaccccccaattctgagtgctgacagtttgtaaaaggccctttccaggtgctctgccaaagccactcacgcacggccttctcacggcgtcgggctgctgcgccccacggtgcccccgcgctgggccatcttgcacgggccgctgctgtccagtggcttcgaaaggagtttggtagttgaggtgagaccgcaggtgcgctgctccagtggcttcgaaaggagtttggtagttgaggtgagatcgcaggtgcactgctcctcaggaatggcagaggcttcccatgatggggagcatcattttcatcttttttttttttttcggaggcggggtctcgctctgtcacccaggctggagtgcagtggtgtgatcttggctcactgcagcctcaacctcccagggtcaagcaatcctctcacgtcagacccccaagtagctgggactacaggcacacgcccagctaattgttttgtattttttgtagagatgaggtttcaccaggttgctcaggctggtcttgaactcctgagctcagacaatcctcccaccttggcctcccaaagtgctggaattaacaggtgtgtgccaccgcgcccaatagggaacatcattttaaagcagctctttgcttcccagcggagattccatagcagccgtgtgttgttccgatgtgtgttttcccaaatgcgctacacaattaaggtgcttaggagggaggagaggcaagcacagaggtttggcttgcactagctccacgtccttcccgggtttcagaaaggcatgtacttgcccttgcactgcccagagaccaggccccagcactgcctcctctccattccccacggaggctgagacgattcctcagtccatgtcaccctgagaaaatccccctccaataaggcatttgattctgtggagtccgttattgcagaattttacctccactctgtcctaggcgtgttaacattcgaagtctaattctaactcttagacactctcaccacgtccttaacacgagtgagtttactagtctggacacaggagggaggcttctggaagactgggaaaccccaggccttcttagatatgagcagtccttgctgctcgtgatgaatttcatgcatgactttatcactgtccatcggaatcccgccgaggctctggaggcagagatgtcagatctctgatgacagtgaacttccacagagggcagcagcatctccctgtgtatccttgtgtatcactatgtatccctgtgtgtcactgtgtatccctgtgtgtcactgtgtcactgtgtatccctgtgtatcactatgtatccctgtgtgtcactgtgtatccctgtgtgtcaccgtgtatccctgtgtgtcaccatgtatccctgtgtgtcactgtgtatccctgtgtgtgcctgtatgtcaccgtgtatccctgtgtatcactgtgcacacagtaaaatttaacaagaagccagtccattccaccatgttaccatgttgcagatttagggaggcgtaaccacacagacttggtactggtcttgattgtggagggcctttatgctgagccagagatgaggaagatgttggtgcctggctataagggcttgagccaggtggatacggagggcatgcagccaacaccgctcttgagacaccggctgggttagtgtggaaaaactccattgaatggtttgcctttctccctggaggtagttaggtgtactagttgaaacacccattcattgggaacccgtgatccaggggctttacaaatgggcatgtgtgagcataggcagcataggctgccgtggccccaggtgtcagggtgcaggcggctcctgtcttggaggcttccatcccccgtggaagctcgtgctggccactggagcaacattcccgcaggtgggaaggccgcgaggagtggacgaggcagctcaggcctgggggacagacttggagctcacatgcccatcgcccccctgtcctgtggcagtgtctggtccagcctcatccagggagggagggaatgtggcctccaccttgagtggcatgtcccagctccaatgctgttccttaacaagggcagggagggaggcacaaaggagtgaggagtggtttcagacgctcagacggagaacattcggctcagaaacagaatcgtgctctcctctgttactagattttgccaactgcaactgaggactgagctgctgtggaggtgggctcctcaccatgggagcatcaccgggggctctgcagggctgtctgccacgaaaacaatgcccagagctctctcctcccctcatcaatagaccaaagtgtgtacatccccagggagcacacaggaaagatagcagaaaagagcatttggaataaataatgtacaatctagctattatactccttgggtggtgatggagaggttgaatttttagcaagaggaaagagggaacaaagcctaacaaacattgaggttaaaacatgaagtcatctgcatttacactttgcttcaggccgcggcagtaatgaatactcagagccggctttctgtttaatgtttgatgcaaagtcaccggggagtcattctccttcactttcaatttcaggggtcctgaaaccctgcgtttctctgcggtaataacccgtgctttccgttcccggggcgggcgcgctctgactgatcagcgcagatggaggctgtgcggacttggacttggacggttttcctccagcccacctcctgggcacccgccatctcagggctgtttcctgaaaacccagctcttgcctggatgacatgttttccaggcgagtgactcatcagaacagccaacagcttagaaagtccctctgcccccagctgctgggggggaggagcccacgatgcagatgagctggtcacagctaatcacagcctcctcccctcagatctgcactccagcactccagccctgcttctccaggcagcttgatcgcaggctgtgggaagtgctaatccagacaccttcccggtcccctcccaccttctgctgtcgtgtgctgccaaacctcacagggctggctgctgccgccgaagcccaccaccatggcctctcgtgtgtacgtaggacccactttcccacttgtctttagctgggaatcccaaattagagctgcaagtgtgtgttgattttaccgtagaaaatgcagccagttttaatcaacagataaatgttcattagagaataccgttgttctgctgtttaaaaggttgccgtgcaggccgggtgcaatggctcacgcctgtaatcccagcactttgggaggccacggcaggcagatcacctgaggtcaggagttcgagacccgcctgaccaacatggtgaaaccccgtctctactaaaaatacaaaaattagccaggcgtgtggcacattcctgtaatcccagctactcaggagaccgaggcaggagaatcacttgaacccgggaggcggaggttgcagtgagccaagatcgcaccactgcgctccagcataggtgacagagtgagactccgtctcaaaaaacaaaacaaaacaaaaggttgccatgcgattttagaatttaatgggtaatctggccctgtaatttggttaaataaataaataaataaaccacccacggccccgagagggcctctggcttgctcagcaggcggtgccagggtgcaagctcctcccagtacctccgtcttccctgccttgctctgagtggggctgtccttcgggcccaggccgagctgtggcttgaggttcagggccgcttcactgtgtgctgataatcgggttccagcgcttgtctttcagcggtttgtaggcgttcttttacatcctttcttctcattagtacttgaacaaagttattttcctcctctcatgtagacagctctgcctcgagtccacagccctgggtagccggacggccccgagcagcctccgtgcatcgtctgggcgccgagccacagcccttcctcctgggctttgtgtcatccccgcagcctcctgagcctctgtgcatcagtgaaaccagaaccatctggggctgcttttctggtctgaaatgtggagctgggtcagtccccgcctcccaccccggggctggatccaagtgggcccccagccttttaggagcacatgtcccactgcagcaacatgggtcacgtgtccgagagagattgtcacccgtggctctgacacagctttgctgggcggcatcctgtccggtgtgctgagcgatgtctccagtgcagttcaggccttcaacaccaagcgagggccttggagaacgtgcgaataggctttccgggaggcatggttccaaaggcgccttgcccagcactgaccgaggccacaccaggtgccacgctggtctgctcggcccacggcccggacaccctctctgccctcctctcgcctccacctcccctaacttgcacacactttcttctaactcctgaagcagaaactttttatttgattaaattcgaggaatctttatagagtttaattgcaataattgactttgcttctgtcttaacaaagagtaaaatctccctcaatgctgctgaataccatttgcctgcagctggggatttactgggcatatgggagctatttattgcacgtactttgaggccttttgattatctcctgattgcttcttaactctgttggcaggggaagggcatgtttgtgcaaagagggccagtcttgggaaaattgaaatatatttcatatatttgaaagtgaaaaattgctctttagtccctttgttcatcttaaacttttacttttttttctggattttaacatttttcattctcattttggtcctttactaagacattgagaaaatatgccctttgacacggcagcacggagtgtcattaacctaaaaaataacacagagtcctcgagtctcttagaaaattacccaggagaagagagcgcagtgctagaagcagaatccagtatactgatcatcactcggtttccacaaggaacatatttctagcagaaagggagagtagggctgaagggattgctgtccttcctccatccctacgacgaaggttgagtgtccctaattcaaaaatccaaaatgttccaaaatccgaaactctgtgagggccaccacgctgccacaggtggacagttcccctcccgaccttgcgggcgcaaactttgtttcatgcacaaaattgtgtaaaattcgcttcaggctgtgtgtgtaagaggtatatgaaacatacatggagtttactcttagacttgggtcccatcccctgatatctcattatgtatatgcaaatattccaaaacctgaaaatatcggaaacccaaaacacttccggtcccaggcattttagagaagagatactcaacctgtatccgcggagatcaagactgtgttctgtggctgtgctgagagcgaggtgatgattcacttccagttgagagttcatgttggatgttgtggcggggccacagcagctgcctccgactgacccctgctttgtgtcagccgctctacgaggacgctgtgagggaggcatgatcataagcccatttcacagatggtgaaacggatcctagagagagagccacgcgcccagagccccagagccacacgctgaatttcaccaagcagcctcccacacgggctccctggtcaggccctcatcctccgggcgaggcagcgaggcaggcaggtcagccgctccctgggccggagctagtgggtagcagagctgggagcagagcccaggctcatggctcccggtcagatcttttcttccctctctccttctcgaaagtcacacggggctgctcatgcacagagggtgctttcctgctcgccctcactctcatttagccaatgcatattgaaagcctgctatgtgcctggcactgggaaagaagttgggtacggctggatgccagggcacctgcaggatgtctgtaattcagcgtgtggctctgcggccttgggcgcgtggctgtctctctagggtgaaacagtctcatgatcatgtctccctcacagtgtccttgtagagcagctgacacaaagcaggggtcggtcagaggcagctgctgtccctctgccacagggctagagatgtcagaggtgctggggtgtgccaggcctggggtaccacgagaaggccagagccacagaaaggcttaggggggctgtgttagagcctccgagaaagctcacagggcagctggcctggagggaggtgccggcagaggggcccattgggagggggctgttaggacaacaccgaggctctgacaaggccatgtcaggaaagtggcgatggtggctgggggtgccccataaggctgttgcctacacctgggaatcccaggaactggcctggaggtgtgaggtccaattcagactgccggctgttcctacagtagaattggggtgtggagctctggggagaggtgtgaggctattttaaatagcgtctgggggtgtcggtgagcaggtggcattgggcgccctgagcaaggatgagagcaggcagggaaagggctgtggaagctgcagcagtgcggccctgaaggacggggtcgggagcccggggaggaggctgtctcacgttcaccgtgacgggaaggaggccggaggagaaagcctcataatgtccaagggggagaactcaagagggacagtgtggtcggttactgtgacaaggggtctcgacaggggaagcacatcaccggggtcatctgtggagccactgtggcttggggggagcagctctatgcatggtaggagaccccagactgcagggtgcctggtgagacccacagggaggcagcaggaactgactgagcaggtggctgtccacaccagggagcagcaggggggaggcaagggagggacagggaggggcctgacggcaccatcacagcgcagagctcagccctgaccgccaggactcctttccctgactgcatgccgacccctcctgatgaggcactttgggcctggccctggtgtctctcccgcgtccctccaggacgctgccccatcagagcctgcgcagggaccacagctgcttagaacacgtgggctgccagtacatgggttcaagtcacagtcagaagccacagcagaaaatgggaagcattcctttatttttccaggctttttttcttattttattttaaagagaaaaaatgtgacaaaatggtgaggatgctggcagcgccagcgttcccggcctgcactctctcctggcctcccctcggacgtcttctgcagcccaaatctgaacagcagtgaaaccgtaaacatgccccccaccagctgccgtggcctccgcccagacccttgctgcccaggctcagccggctcctcctgtgccctgtgaagtggcctcgtgtggaagcccgtccataatgctcagtggatttcctctgttctctccgcaggcaagcctgggacctggctgttgacatctgtctgtctcagctgccgacgatcatcgaggaaggcactgcgtttcgggtgagtccctccaagggcaccctgtgcatccgcggcggcagccacttctctgggcacctggactgcaaagcccccagactgggggtggtgcccaggactctcgggtgtcagattttgttcacctgcctggaaaaaatgtagttgccagagtttaaaacatcgagtcaaccagggtttaaagttaaactttgaaagaatcaacttttaaaacagtcctatctcaaaattttgctattacagatctacttttcttaatgcggactcactccctgtgagtggtgatcctgttacactttctagccttttcaccacagacgcgttgtggatctcccccaggcctctgactctcagccctgtgggacagtgacccacggggggtttggtgctgaaccctggagggcgttctgcccccggccgcactgcacgggcgctggagagctgagccaccctacggcggaacctgggtttagtcgccgcacctgcaagtgagggtggccccgggccttcgcggcagctccctaggaccccctcgtggtttcttaatgagcttttgccttacgtgaggcgccaagtctgaaaatagataaataagacggaggccctgccctccagaaacccgtgaggaaagaggagcctctcacatctgtgcagaatgcaagggagcaatcggcaagagggcgcggcagacacggggaggccagggatgggggaggcggcagcctgggcagaggcaggaggggaccagcatccccgcctcccgttggggccacacctgagacaccaccgtgtcaggctccagagccacagagcctagctttgccaccgagggcaagtttggtcgtctcctcatttaagggagggattatggtggtatccaaccccaggggtgctggaaggacaaagggagttaatgtaagaaaagtgctttggacagagcccagcacagggcccttgggaattcatgtgcaggcactgccccagagccagctgtcactgatgtgaggatgccaccctccagcccagggcaggggcaccgatggtcaggaaggttccgtccactgcacagacttttaactttcagtgcacaccacagccgtcagggaagcttttaacacatgcagtcgggagcctgggtgtgcctgcgtgcgtgcgtgtgtacgcgtgagtgggtgtgcatgaggtgtgtgtgatgtgcctgtgtggggtgttttaactcctcagatgattttgacatgtcccacgggtgggatgactgggaaaacggccttttaagagggctttcttttttataatcttctgttaccctcccattattgcttgatttttttggtaacatttgattgtgaaaattttcaaacctacagcaaagttggaagaaatttacagtgagcaccccatgcccaccacttacttctaccccatctttgtattcatggggtattttcaagggcattgcagaccgccccgcattttacaccgtgaggcggaagccagctccccgtcatgtgcttggcatcaacactgggcttctagacaaaggccttccctcccttcctgctggaccacaaaccttggggggcaatgacagggtctcctgcagagtggcaaaccttcacagacgccagctgtccaccctcagcctgccagagctgctttcagagtgcctgcgcttttccgaagagctctgggcctgttgccgcaaacagatatttggaaaccttcgggaaactggcctttctgtactctgagcgtggcttcactcggtacttttaagagatcagaataatctgctcttatataaaataatgcagtttctatttgcatgtgtgctctttctaaacgaatacttaggtttctgtgccaggtatctttgccaagtttcttttcaaggattttactctatctatgctaaacaactagaatcaatattctgcatttgggaatgatttcaccatgttggggtgtcaggacaagccggggataactgacgtggaccacacactaggttccttttgtttttaatcttattggaggtgtaacttacatatagaaaagtgtacacatcatacacatacagcttggtgaatgtttcaagctgcacatactcgtgtaatcacacccaaatcaagcagccccatgagccccctcggcgcccctcttagctcctcccttccccagcagtggccgctttcctgcccagttttgtgcttggatgcgtggagtcacgcagggtgtagtctttgtgcctgcccgctgtcactcagcattgtttgagtaagctcactctctctgcaccgcagctcacactcaccgcacggcagctcactctcaccgcacggcagctcacactcaccacacggcagctcactctcaccacacggcagctcactctcactgcatggcagctcacattcaccgcatggcagctcactctcaccacacggcagctcactctctttgcaccgcagctcacgctcaccgcacggcagctcactctcaccacacggcagctcacaccacggcagctcacactcaccgcacggcagctcactctcaccgcacggcagctcacaccgcacggcagctcacattcaccgcacggcagctcactctcaccacaccacagctcactctcaccgcacggcagctcactctcaccacaccacagctcactctcaccacacggcagctcactctcaccacacggcagctcacaccacacggcagctcactctcaccgcacggcagctcactctcaccacacggcagctctcaccacaccgcagctcacactcaccgcacggcagctcactctcaccacgccgcagctcacactcaccgcacggcagctcacactcaccacacggcagctcactctcaccacacggcagctcacactcaccacacggcagctcactctcaccacacggcagctcactctctctgcaccgcagctcacactcaccgcacggcagctcacattcaccacacggcaactcactctcaccacacggcagctcactctctctgcaccgcagctcacactcaccgcacggcagctcacattcaccacacggcaactcactctcaccacacggcagctcactctctctgcaccgcagctcacactcaccgcacggcagctcactctcaccgcacggcagctcactctcaccgcacggcagctcacactcaccgcacggcagctcactctcaccgcacggcagctcactctcaccgcacggcagctcactctcaccgcaccgcagctcactctcaccgcacggcagctcactctcacagcacggcagctcacactcaccgcacggcagctcattcaccgcacggcagctcgctctctctgcaccgcagctcacactcaccgcacggcagctcacaccgcacggcagctcacactcaccacacggcagctcacactcaccacacggcagctcactctcaccacacggcagctcacaccacacggcagctcactctcaccacacggcagctcacaccacacggcagctcactctcaccacacggcagctcactctcaccgcacggcagatcactctcaccgcacggcagctcactctcaccgcactgcagctcactctcaccgcagggcagctgacactcaccacacggcagctcactctcaccgcgccgcagctcacactcaccgcacggcatctcactctcaccgcacggcagctcactctcaccacaccgcagctcactctccccgcacggcagctcactctccccgcacggcagctcactctcaccgcacggcagctcacactcaccgcacggcagctcactctcaccgcacggcagctcacactcaccgcacggcagctgactcaccgcaccgcagctcactcttaccgcacggcagctcactctcaccgcacggcagctcacactcaccgcacggcagctcacactcaccgcacggcagctcactctcaccgcaccgcagctcactctcaccccaccgcagctcactctcaccacacggcagctcactctcaccacacggcagctcacactcacggcgctgcagctcacattcattgcaaggtggacaccattgagtgtcccaacattcatgtgtcccttctagggccactgggcattttcagttttcagtcctcactaacagtgctggctagagccagactctgtcacatcagagcctgagacaaaagggaattctgtgatattggtcctccctttgaaatgtcgatatcttcttcagtatggatttttgtattaatttttatttttgtaaatattgcactgaaatatcatttgtcttgattactgatttttttttttggtaccccacctgctagcaccaattctgtgcctgaggccaaggcctccccttcctggctggcctcccgttcaggggctgctccctccttcacatttctcggagtgatccttcggggtcccagggtttgcccatattcagctttaacagatggtgccagagcactctgcaaagtggctgagtcagtttacactcctgcctgcagcattcgagagttttagttgctatgtatttatttggctatgatggttcagtatgaaaaggtatttccttaagagctaatcgtgtatttacccgatggttaatagagcattgttctatacttgtactggccatttatggttccggcttttggtatcctgttttatgaaacctttatttcctctgagatgagcattctgagcagacgctacgctctttgtcagctagcagcttgtgtgtttccctttcacatctggacctgcatctgctcacatttcacgtcccccgtgaatgctcggcttactggtggtgtttgcactgaggaccgtgtccgcgtggctccctctgttccctcctttgcaccaagggccatgttcacatggctgcctctgttccctcgtttgtccctttgctcacttgttctttgcaccaggaccacacagttgtaatgacaaactctacgtgacactttctaagctggtagactaagtcccacaacttcgtttttttccccgagtttgcctcagttacttttggtcctttgcatttccatgtgaattttaccatcagtgtgttaatttctgcaaagaacctgctggatttttgttgagattacagttaatctacagattgatttgggagaagtcaccacctctataatattgagccttctcctccctcaacgtggttgtaaatggtattgtttaaaatttcactttctgatttttctctactaacagtgacatagaaccctataaaaattgaggttttcagaggctgaggcaggagaatttcttgaacccaggggcagaggttgcagtgagccaagatcatgccactgcactccagcctgggcaacagagtgagactctgtctcaaaaaaaaatttttttttttggtttattgagatagtaggagaagccagaatgattcccctgcagtagaaagctcgggctaattgactttcttaggggtgttaaagagaacccttctgcaaactgagcagccgtacagggggatagaatgtccctacagagccgtacaggggggtagaatgtccctacagagccgtacagaggggtagaatgtccccttggcagtgaactttaagtcccctctttaagcagcaagcttgtcgtaagtggcaaatgtattgtgccattgtcaggacggagagtagccatctcagaatgtccagatggtgagaaaggcggcaggtatgctcaggttgttggtagcagaagtccagccggacgggctccacttaggtgtgacttggaggctcccagcctctcagccggccttcccattttcagtctgctgcccctgtttttagaatatgtcaaactgcctagcacacaggctggcaacagagcaaaactcctggcatccaaatcgccctgggagagccaggtatgtggtcctggccgggcaacccagacgctcagcccagcaggacctgtgagctctctgtctcgctgaatggacttcgctcccctgcacgcaggggccagctcaggagctcttcatggggtggagaaaatctcagagatttggcccaaaacatcagccctgtgaatcatgggtggagacacgggccgctctcgagatgttttccggaatatcatataaagtgttggccactcttccgcaggcgcttgctctaattcgtcagcctccccgtggctttagggagcttcacgggcttcaccgcgcacctgccaggcaaaggtgtgcttttccttttttgtcagtttgaggtgaatagtcaggaatttttctctttctgcatggagtagtgactccagcagtgaggaacatgtgaaaatccatcaggcaaagctaatgtgatagaaagaagaggtgtaactatctgaattacctgacttctgttcacagactcaagccttctctaactcaggagaattacgttctcgcgggatgtggaggagggggtacttaacgagatttttttttaaccaatttatgaataattcacacttgaaaacaggaaaatcactctgggggctccaagccagctccacaggttgccctccaagtgtgattaactttctgtaagctggctgcacaggagcacggattcctacgtggtgaatgttctcggctgactttttaagtcgggccacggggctctgcccgccaggctcctctgtggaggctgccgagagcgctcctggacttgggcgcacggaggcaccctgtcctgctcctggcgttcgcctgtccacatgtgtccacattcactggaacccggggcacagccgaccccggccagatgagcggagggagggttcctcccgacctcctctcagagacacgcacctccactgcggccacccaccttccccccgagcaaaatcaaacaacgtagggaagagaggatagtggatgggagagagaggctggtagttgtttttttttttttctttaattctttgtatcgggggctcagggaaggcagagctgtgtgttaagtggaagtgactctccgtggagggaatcaggccggactgctcctgcctggccgctcagttccgagaccttccaacggcagcctcccctgcagccttcacgctctccagccgcaggcccagcagccctgctgcccacctgctccatggcacccaggcgaatccccctccactctgtgcctgcactcacgtggctgggctaactgggagctcgggcccacccggtgtggcccacggagaactcgtgtcaccccctcgaggggccctgatgccgcctgacattctgaccccaagcattttttttggtctccctcacccgcgcgccttctctgtccagctgcaacccctcctcccgccctcaccccagagagtaccctcgtttcccatttcactgaggaaacaagaagcagtcgcatgaccgcctctgccgggtcctccagccctccccctgcttctctgcatctgggcccccttgctttgccgcctgcctggttcccctggggagcagccctgctctgccagcccagcctgtgcttccagtcccatcccccagcctgcccgaggatgccctccagcagcctttccccaccctccgtgcccccagctgggtctttctcaccagcgtcctgtccccattactccacatctacaaaaagcacttcctgaccctacatccctctccagccaccacctgtctgtcttgttcccctttgcaaccaaaaccaaattcaccctgtctcgaaacccctctggctgcgcttttgcccaactccagagcgttcttgctgctgatccggggcccagtcagctctccatccttatctcgcctggcccggtgctggtttgtggctctgccctggacgttgctccctggcgtccagacctttgagctctgctttccctccactgccgggccctcaccggccccagcgcggccccagctcatctccttggtctccatagcagaggctctgtcctgggcccctttcctttctcacttaacttgaaaaagattcacacaccatgactcccaagcgtgtccccagccagacttgcctgctgatccacacactcacggggtcccctgcccccggcatcttcactcccttgtccagccactgtcgtgagcaccacatgtccacagctggttcccagcacgctcctcttgcggccccagctcggtgccctggccaaaagccttggagtcatcctcagctgctctcttctcctgcctgcctctggtcccttcgtgcaccccgcaggctctccctctttggcatgcccagagcgcccgcttctcagccgcctggcatcctcgcggccctgcagggcgggcccttcgtgaaggcttggatgcccggcaggtggcaggggtgggcaagaccaggccatctgggaacatggccctaacaagcacctgttctgcttgccccgcagcacagcccgttcttcgccgagcagctgaccgcattccaggtgtggctcaccatgggcgtggagaaccgaaacccacccgaacagctgcccatcgtcctgcaggtgagtttcttcagaccgggccagacagccgaggttcctcaggaaggaagccagatgcctgtacagccccgggagtgccttctctctccctgagccctgtgggtctgtgacatcccagcccctctgccccgaagatgatggtgcatgggcaggtcgcattcgggcaaacggatcacacagatccaatcaggagtcactgggctgatcgcacattcattcctaaagggtttcctctaaagccattgatttccctcctccaccctcagataagtgtaactttgggactggggagtcatcagccagtccatcatccccctctcccctggctaccatttccactttaggaattgctgagattcagctacagatgggctttgcttcagagcaggctctcgacaccactgcctccttctcttgggaaggacaggagatggcagtgaatccgggagaggagggaggaggctccctgagcggatactgaccggcgaagcgggcagagcggctttgtggcccagcgccgtaggttatgcactgaagcacacacagatccggaagccggcagcccttcccttgcacggggctgtcacagctgctgtaacaaataggcccttttggggcacgtccttcagatgccagtgcccacggggcccgtgtcatgtcagtgctgttcacgtgcagaccatgacctgttcatgggttgggaggtcagcatcgtgggtcctgctggctggtttttggtcactgagataggatgggaggccatggaaattgaggagttcgtcacaggtagtgaagttagaaagattccacagaacttttgtttcggtgaatgtgtgtttgtggggaagtgtgtgggctgagtcagagtcaaaggagtttaaaatccactggtcagtgtagatatcaaggtctaagaactcactttaaaagctggaaaagtgtttttgtgattggggtggtgcagttggactttggcgaggagctgtgcatggccgtggggaggggctgcccagcagcaggcagggaatgagcaggccccgccctttttggtttaaagctgggtgactccccccacacacaggaagagccccacctccgggtgtggtgctgagttctgagagtcggcagagttgggtcctcgccttcctagaaagcagatcgggtggtggtacctccatggagaggggcgtgagtggcgccgcccacctgcccttcttccttccagagctcgtgctttctggttagggccgctcaccacactgacagacagcacaccaatcttcactagaccaggtgttcatcccacctctgagagatcatttagaaaaccggggccagtttatctctgtcacggccatggcctcagcagccttcccttccgccgttcagtctgtgctgcagcagtggcagccagcgtcgcaggcgtgctgtaggactgaggcttcacctcgttcaggactttgccccaagaatctcagccagagaaagaggagttgggagaaggaacagtgcacatggacgtgctcaagacagtaccgccggcctgtcctcgccggcattgtctcaggcgggcaacaaagaaccagtgtgccagccggctgccctggtgttatgatcccagctcctcagtaggccaaggcggggaaggatcacttgagcccaggagttcaaggccagcctgagccacatagggagactccatctctacaaaataaaataacattgtaccacatttcacagtatatatttctgctgctgtcagtatattatgacagttgctttttggacattgcaaaaagaatgcagacgttattactgttcttcctgtatgtacctagattcgtttaagactatcctgagattacagggtgaggtgtaaacaaataaaccagctcatgttcaaaaccaagaacacgcagtgatagcagcaacgcaaccaaacaacatttgacagaagcccacgttttcccttcgtgcgactgtagaaaggcagctggctgtgtggccacgggtgaccgggggtggccacagcgcaggttgcccatgctgggccccacggctcctgttggtcatctgggttaccaggatgtccctcaggagacactggctctcttactggccttcctactatttgagcaatgtgatggagtaaaatcggccctctccaaagcaggacccgatgccaagcacgttaaatccagttcttttgggtccagcaaataatctttttgtaaatggccttctgttgatttctttcaatgttcccttggccacccacactccctcaaggaaggagaagacgtgctggaggcagctttctgatggtgacgtatgcgaagacagctctggtcggagcgtggggcatttcccacatgattttccagcaggtgtgagtggcaggttcctcctccctctggagggtctgtttcctggctgtgcccagccgggatcaatgggcggacctccacctaacacaaaagtagggaaagatgaagtgtaatggggtatcggcttcatttgacgtaccccccgggagtggcttctttctcgttaactcggctcacttccccgcgctttctcttaaaagcctttatttttgccaaagcctgggccctgttatccttaaattattctctagtgccttggcaagtcagaaaacatcacttaagggaaagggagttttctcactcgcttccggttttccgaatccctgccacttcatccctaagccagaggcagtggctggtggccctccagggtcacgcacggtgtctcatcaggtccggctgattcgcagcccctcctgtaaacgtgagcatggaacaggcccttcctgctttccagcctcaatatcctctctgccttttaaaaatataaatcaacagaggaacaagaaggaagatacaatgtttaaaaaaattgctgttttgcccagacccttgattgatggtgtctatttttttgagatggagtctcactctgttgcccaggctggagtgcagtggcgcggtctcagctcactgcaacctctgcctcctgggttcaagcaattctctgcctcagcctcccaagtagctgggattacaggcacccgccaccatgcccggctaattttttgtatttttagtagtgacaaggtttcaccatcttggccaggctggtcttgaactcctgaccttgtgatccacccgcctcggcctcccaaagtgctgggattacaggcgtgaacgaccgcacccagccctgaacaccgtcttctcacgaggagctctggactctcgtggcctgtggggtgcgtttgccctctggcttcggcagctcgcccggaactcagtgctgtgtgcccccaacaggtggctcaggaagcccaggcaggggaacgaagagcgcctaggttatggaagagaggggagaaagtgacttttcttcttctttctttttcaggaaaaaggtgacagtgatatttatgtgttcatttatttacttggccctttttcttttcaatagatccagggtatacgggtgcaggtttcttgcatgcatgcactgcgtagtggtgaagtctaggctttgggtgaacctgctacccacatagtgggcattataccccataggtaatttctcagccctcagcccctcgcaccttttggagtctccggtgcctgttattccacctgtgtgtccctgtggacccgttgtttagctcccactcacttatacatgagaacatgcaacagttggttttctgtttctgagttattccactgagcataatggcctcctgtttcacccatgttgatgcaacagacacgatttcattctttttctggctgagtagtattccatgatgcacagacgctgcagtttcctcatccagtcctctgttgaggggtgatctcggctcactgcagccggagctccgcctcctgggttaaagtgattcttgtgcctcaacctccagagtagctgggatatcaggtgtgcaccaccgcacctggccaagagtgattttataggatgaagttttagtcccttttcctagatgtcacagatcagtgtgagcatttcattaggaggtctatttgctctctctccgtgcatcattttttttacaaatagaatgtggggtctgaaagtacaggattgttatcaggtgacagcagaatgacaaactagagtgatgttatacataccatgtacatcggggactccaaaaccgccctgctcatcaggtgcccgaggcaccctggcctgcagcacctggcactccagggctggaactggagaatcttttcttatgaagcagctcttccagtatgcctgtctgagcactctcttcatatacaaggcaaatgaaatttgataaccttagcaattctgttttaatttggtcgcctcagctggagtgcagtagtatgatcatagctcgctgcaacttccaactcctggggtcaggccaccctcctgactcagcctcctgagtagctggaactgcatgcatgtgccatcatgcccggctcatttttgtattttttgtagagacggggtttcaccatgttgggcaggctggtctcgacctcctggcctcaagcgatcctccagcttcagccttccaaagtgtttgcattacagtattgagcctctatgccggccaccatgattaatctttagtttgggctaccacaggtggaaaataaatctcagtaactcattcagctcaccatcatttacttctataatttccatagatcgtgggatggtccggaacaggaggtttttgttttgttgtttttaagtacagaaacaacattggctttttttctaaaagccaatcccattttaaaaataactttgctttatgttggcttcagtttttaaaaatcgtaaatcaacaaaaggtggcaggaagatgatgtaatgtttgagaaaaaaaaaacagtacttaacctttccgccaatactctttattgacgatgtttctttgcaaatgaaataattgtagcaccaaatcccatgctgcccaaggacctccgacgccgactcccaggcaggtgggcccccgaggcccccgcgtgtgtttcatcagcacctgcagctcctacagtgggacactcgggaccacatcacggtggtgattgtgaaccagcgtcccgcttgcttttgttgtttgtaaggagcacattctaaggagacctttattgctgggctagtgtcctggtaaaacagtaacaggaactggccttgattagacctcttcgccccgtcctgccactttttccatttgttctgcaactatttaccttagaaacagccttgtccttatttacagtgttggaaaaaaacaaaaagaatcagaaaacaatctttgtaagctttagatctgatgatgtctttgatttctgacgattgcagccatggcgagacctgcctcctctcctctccctgggtcatctagaaacttgagcctcaggcagcctagtgttccctacacacagagagtcagtccttaaaaccttgggtggtggagacatctggtagccgaacactatgatgctgactttacatccgctggacaccttggtgcacacagctttgtgctagacgctttacggactctgcctcattgaactttgagaataagcccaagtcaagtactgttgtctccgtttttcttgataatgatattgaagtttccagaagttaggaatctaagccaattattgggcagagatggaggcagggttaacatcaggttagccggccccagagccagtgcttttcctccgactggcccctcaaacctgagttccaggcagcagtggcatgcgacagcccccgagttaagcataggagagggatccggttccagttcacatatcctgcgagcagtcccacgttcctttcccagcctcttaatcagagactctcagcatcaccagcacggggaacctgccactcctgggtccatggtgaacccagcgtgggagctggctccgggcacatagaagggaagtgaggccacattcccactgctctttctctgcccccaaggctggacatgctgggatcccctccataccccatctgcccctccagcctggctagccacctcctcttgctgccacctgtgaccttccctgtccccctcatcctcctgccagtgctcttctcccaccacagggaagctcctccctctccacggctccccagggcccatgctcctgactcggtggctcctccgtggaagtcgtgctggccgacccccaggagcttgacccaggtggccgccatctcctctcccctcccccgatcctccaccctcactggcctcctcgtccctttcccctgcctctcttgagggttttcaaactcatcccaaaccttcttttctagagtttgctttccttcaccccttcttctctcagcctctggccagtgctgcagtctcctcctccccatctccgtattggcaccctggtcaaacccacccccttccactcgcctccccgacttccagcctcttgccaggcctgtccccaaagcgagcacactggaccagtcactgctgcttaacgtcggctggtggcttctggatctcaaaacaaactgacctctctgcatgccgtcggcggggcctttccctatccggcccctcccccatcactgacctcagtcatactggtagcccgtgcatcctcagacacccgggcttttccagcctctccacctgcaacgcggtaaccccctcatgtcacctccaggacccgctgcccagctgtgtcctgtgcatcttctcctggggggagggaaaacctccgaggcctgcagcgaggccaggtcaggggctcccagggtctgtgtgtttaggcatggtgatggggcggtcatttgtttaatgtctgtctcccaggccacatgaaggatgggtgaggtggtccctactgtctgtggtcactctcctagcacccagcgcagcacctgccccataaacaccccttggatgactggggcatcgtggatagaaatgctgtaggttggagggagtcgatgcacatgccttccagcatagccaccattaaggaaaaaatcaaaagaagtaatgccattaaaagtgtaaagcttggccgggcacggtggctcacgcctgtaatcccagcactttgggaggccaaggcgggtggatcacaaggtcaggagatcaagaccatcctgcctaatgcagtgaaaccccgtctctactaaaaatacaaaaataaattagccggtcatggtggcaggcgcttgtagtcttaactactcaggaggctgaggcaggagaatggcatgaacccgggaggtggagcttgcagtgagccgagattgcgccactgcactccagcctgggcgaccgagtgagactctgtctcaaaaaaaaaaaaaagtgtagaactttaatataacagaaaaagtatgtgcaaaacctctggcagagcccactctaacttataaagaactctgacatgtcaataagaaaaagccacattttgaagtagaaaactaaacgcatgcagggcaagtttactggggaaatggcccatcaacctgcaaaatgtactccccttgaaatccaagaaatccagatgaaaaggatgtattttcacctgtccttttggctaataatagtgtaatatgggctagtattgtcccacaagctttaaatttattatttaatttaatgaaacccttgtgggcaggtgttgtgttatatgtgttttatgaattaataaatcaaggctcagcgacgttaacttgcccagagtcacaccgcagtgagcgctgctgggtgaccagctcaggcagcaggaagctggtgcccacgtgcgtgccgtcgagagtgtgagtgggttcagcctcagggtcatttggtaacttaagtatatatgctccgaccttacctttttaatactcacatttatcttagtggaaaagaatcatgtacatgtgccgatgtacccattaggatattgatcacaatcttctttatcagagcagcattttggccaggcatgatggcccacgcctgtaatccctacacttcgggaggctgaagcgggagggttgcttgagccagaagttcaagacctgcatgggcaatgtagtgagacccccatctctataaaaaatacaaaaattaaccaggcatggtggtacatacctgcggtcctagctactcagggtttgaggtgggaggatcacttgagtccaggaggttgaggctgcagtgagccatgatctggcatctatactctagcttgggcaacagagcaagaccctatctcaaaaataaataaataaaaatggtaaaagtaggaacattttgatgataatttaaatatctatcactggggaagttgtttaaaagaattgtgtacatttgcataacggaagtactgtgccgcctttgggaataatatggtcagtacatacctactgatatgaacaatgttcacagtgcattgtttagtttaaaaaggagctgagaaatagaatcacatattatctagttcaagatcagtaagagaagtgtggacataaagaacaatgtctgagttcatatacctaaatgtcaccagtgggttagctttttaaatgcaattaaagcatgtttgttctagtattttctacattgagcatcttttatctgtgtaataaaggcataaagcgtgttttcttcacctgtctaaaagcatgaacttgtaaggaaaggagcaccagctctaggtaactgaagcagcagacagatctgaactgtggtcagaccgctccaaagctggcagctcatgcagcagcgtttcggggttgcacaccagtatggtttgcagtgataccattttcttcttgttcttccaggtgctgttaagccaagtgcaccggctgagagcattggacttgcttggaagatttttggacctgggtccctgggcagtgagcctggtgcgtgccttccgcattaacctgggggctgagggaggtgggacagagattaggctccgtgtttcagtctgtgcacgtatttcatgatccagagccacccccagccgtgagacccagggcgagtgtgtccaccgtgttggtgtcctgtcactcctgaggccctcaaggagcccactctgtacccgtgcagcctgcagtgctgcctggcgtttgggggtctggggttgtcgcccctctttatgtctgatgttagacataggagtgagtgtgttgtcggccggtcaccttttcctgagccgcccccagcgctgcggaggagcagggcgcccctgagcctgacgcagcacccacctcgtggtgctgcttcccccaggaggagtctggatcctcagcactgtctgctcaccatcatggcaggcacaattcggaaacgctcttctggttcctcattctatagcagagtagtaatggccactaaaaacaccctggcagaggcaggatcaagaagcgacgtgcgtttaacaaataactcacagggaaagtaaaaggaggctgagagggaaccacagagtcaaggaaactcgagagacctatggccagctgccatgtacagtaaaccttacttggttctgttgaagttccaaaaatgaatactcataaaacaattagaaattttacaggtgctggatttatgttattcaagaatcattgttcgtttttcttgggtgtggtaactggatcatgtttttataaaagagacctaattttttagagatagacactgaatattcaccaatgaaatcacatgacatatgagccttaatttactgtgcttgggagcggtgcggtggggcggtgggtgcggaaccgctgtcactagctgggtggtgagtacctgggtttggtgtatttaagtattttcatcagataatgttgacaaagagtggtaattgatagtccagcactgaaggacgagagaaaacatccaaaacttggaagaatcattcagcactcaccactgggccattttcactccaggtgcctgaggccacaaatagcttgtaacagagtcagggcctgagtcatcggaggaaggctggcgtgactcggtcacttggtgtgtgcgtggtggtgtcgcttagtcatcctggaaaggcctgcgtggtattgcgtgcactctaagaagacaggaagcatgtattcataacagtttagaaagagtttcatttttaaggttaattttttaaaaccagtttcttccctttaaagaattaagcttctgctcattggaaatttgcctaatacatgaatcgaggctggataaacgaggtatttttacaggtacagattttgcctctcaggtgagggcccagccacccgaaccagagaaactgctcataccttgttaaatgtggcctttcacagggaagggacccaggcctaggtcccaccaccacctcctgtcttggttacaggggacctcacttattggaaggtgatacctttaggatatctttgaaattccagcagctttgagataaggacacagcagaaacccctggctgtggagtgcagcagtactttgccaggcatcctccacactgcagtgccctccacgccctccctcccctgcctctgagggcagagagtcccctgagaatgacatggccagaactgggcgccagtgagcccctgggcaacccccgctcctccctgcctttcccagggcaggcatctttctcccaaggtgtatctgaagtgcaaacatgagtgttgagcaagctggccgtgccgtcacggagaggtggccgtggtgtcacggagaggtggccatgccgtcacggagaggtggccgtgccgtcacaggtggccgtggctcgtacgtgagcaacacagtgaaggtgcctgatgctctgctgccaagagcagacgaggccactgagggcaggcaagggccccaggcgcaagcagcctgcgcctccacaaggaaaagctgccacccgattcattccagtctcttgacaccagtcaaggctggcagtatgtggcagcttctaggaataaatcagagatgaataaatctggaggaagcccctctttactttaagtgaggcccattcattcctgttgcgtttcccatatgtgctgaagatagcaccgcagctggtcccgcgtggcacccctgctgctgcccgttcccttgctgcggcacaggtgcgctgacgccctccctcgcccccaggccttgtctgtcggcatcttcccctacgtgctgaagctgctccagagctcggcccgagagctgcggccacttctcgttttcatctgggccaagatcctcgcagtggacagcgtgagtatccccgccctcctccccagagtgatgtgaacctgccggcccttctggggatgccgagccctgcgtttccagcctgccctttctccagcctcgctccctctccaggcaccgccgttcccttcctctcttctggggtaaagtgggacgcgcccgcctcggcagccacctctgggtcgtgggggctgtcacctacctgtcctgtccctggccttcccctggtaccctgcgctcagtccccccacaccgtcctgtccctggccttcccctggtgccctgcactcagtccccctgcctgtgtctgacccccgtaaggctgtccccgtgctcctgaccctgactggaagcaaccccgccatggcataaacttggcctctgcctcgcccagaccccgcattggctctcctgtgcccaccattgcatttctccccctcctcaaccctgcacaggtggtctgggccaggccccgaggtgttaggggccacccccttacacggggctgtccagctctgtcctctctgacgggcatcagccctggccctgcagccatgtgttcgcccctcaatcatctaggccagggacccatatttagctatgttaagagagacacaaggtcagctgtccctgtccccagcggcttatgcttgggtgctggcaggggttgcaggtgacaccagccctgttgtgaggcagggtcacctcctgcaggagctaccagcgagatgggtcagaggagtggggctgagaagtcgtgtgggcgagacccggcctatgctgaactggaaacgccaggaagggccttgagggggtggatgtcgggcgggggtccaaacatggaggtggcagggagggctgggaagacatttagaggagggcaggccactccctgtggctgtgtgcggggacacgcagggaggccccatccacgcagacggtgcacggttcccggtagacacagttgaacttcatttagcaggcatggggattattacagattttggaacaaagacatcaaagaatgaagctgtggtttataaacattgcctggcctcggtgtcaagtggattgtagggaaacacggggtggagagcattttcctccaggagggtgggcagaggaggtcgggctgcagggctgggagggcggcaccaagcctgggttgggagaggcgactcgggctgaagcctgtgtggccggctggggctcggggagccttccagagacaactggtcaggagccctgtgcggcctaggagcagggctggcccgatgccaagactggggacctcgtctacccagtggtgatggcaggcgagaccctcgaaggaaaatgtggaaggctcagctgcgggagaactctcgaaagctcctcgtgtgacacagtggagaggagagctgtacagagtggtgcaaagggtctgggaagggctcatttatagaacgtgaagattctagaacaaagggtgtgtgctgagaatggagttgggggatatgttgccctctgcagggttgttggggacaaagatttcccagagatgcctttgcctttagctgtccgtgtgcggaggggcacacgtgtgtgatacagagctgggctcggagccaggttggcagggagccccgggaagaagccaagtcagtcttgctctgggggtgccgccacgggtgaggagagcgggacggaggagccggcatcagggcaaggctggctttgctccctgcttggttttgaagcaaaccagccccagcaactcattagaaggcctgtaggagcaggtccacgttccccccggacttcggccagctgctgtgtgcacgtgtgtgcgggggtggtcatgtatgtgggcgcttgtgcgtgcatgtgtgtgtggcgccctgtcaggcggctttcatatgcaaagtctcttaattcctaagtcccctgtgaagttagcttgaatttgcagcctatttactggtgaggcgccgcccacaggagggagcaggggccacatagctgccatgcgaggggccggcaccccactgggcccctgcgccgggtctggagctccttgcccacacagggaaatggaaggtctagcaaagtcacagagcaagtacaggagagtgccaagaacaccttggagaggccatggcttggagccggggaagaccaccctttccttttctgtgtggcaggtgaggggagagtggacggagcttaagcccccggggctcctgcctgctgcccggcgctccccaggccacattctgtcagctcctccgtccagtcactggcactgagacccagcctcatccttagccctgtcagccatgtcgcactggccaccaggacctgctgtgctcgctgaagctgccctgttgggctttgttcagccaaattcactgaccctgttgtccaggcactggcaggcaccccgagccacaggctcgtaccccgcactgtgcgctctcacccgtcagccctgcacaccccacacaaagccactgctgtgtctcccacccacagccgctgctgattcaagtccagcccaggccatcaggtccccaactgtgctgcccacggacccctgggcccctgctcagcccttctgctccctgcacccagccctgaccatagcctccccacaccccaagtcctcacgtactactttggtgtcacagctgaagtcagggggcagtggggaggctgctgccgaagcggacggtgagggcttccaccttggaggcaggcgtcagtcgtacccagcaccagttgacctctcgctggttccgctgattcttgtagattccctgggattttctgctagttcactggttcttgtagattccctaggattttatgtatatgctctctccaagcagaagcagcttccagcccctcttccggttctgggatctctcactctttttctgggcctggggcactgaccatggctctgctggcacgggtcggctaccgtgcttgccatctctcccagctgctcctgatttcctgagctggatgcggggagctgctgctcttcctctcagcacagctgaggttgaccttgacctcagttcaaccttgaaccctcctgggcccagtgctctgcacctggctgtgaccagagaacgctccataatggtgacctgaataccatatatttcagcaaaatattttccctgctacccattaaactacagataaagaatgactgctttgaaagattggctaaagcactggatttaaggttaaaaccctgagtttgatcccatcaccgcatttgctcttacaagtcattttcacttcccttggccatgatttgcctctgtaaaatcatgagccttcggccgtctgccttcagccacagttccagagctcagaaccaggacgtggaaaactgctgtgtaaattatagaggaacaggaacaggaccaggaaggggcaccacgtaaatctcacatctctcctgcctgtccctgttacactaaaaccttttcttgctaaacagaaagcttggctttgtggatcaggacgcgagaggtgtgggtcatttctattttactcttcttcaaattcactgaagagccacattatgtaaacaaagggtgtttggcaggaagtcattttgaaacgtggtttctgtcctacacccatatcttcgtcatctacatggacacacttagaaatatcttggcacctggccacggatgaaggaccatgtgtaggggctctgggatgcacaaaacggtgaccctcacatgacacaaagcccagggtgaagggaggaagagatgccatctgcatgcagaggtctgggattacggccgcctgagcctgctccccagcaccgccagtgctgcaggaacgtgtctaagccaactttgattctcagacttcgtgtttttagtaccttttaggacctggaaattgatgatgtctttatttttagtctcaggggtggctcttggtgaaaggggacagccttcctcgtaccttcctcgtgacattctcactgcatccacagcccatcatggtattgcagtgcagggcgtcttgtttaaaactggctcttggtcccgtggatctcccagggcctgttgctctcgagtgccccaaatggcagaacgtggccatgagcacggaggctgcagcgtgccttcgttttacaccctgctccaggcagataccagggcctcgggtttattattcatgctgctgaaggggtcatctgctcagtactgcttggggagctgttcccacagccagctgggcatgcccttgcctgcagtgttcttgtaactgcctgcaggcatcacaggccttcctgtgaattaatttcttaaccagcttgttgcacctgcatgtttaaaagcaatcattccactgaggggcattttgaagtgtttccggtagaaactgagcctcgtctacctcacctgcctcgcccttccttccatcgttaccctggcgataacttcccagagatgaaagttccctgtgtttttgaggggtcattcctctactcccttcccctccccacgtctggccatggatgttgctggcggtcctccggatctccacccctacccccccatgatgtgtgcaccccctacaatgtgtgcatgcccctctgtgttggtgatggtcctccgaagctccgcccaccatgatgtctgctccgccccctcgtgttgctggtggtcctctggagctccgcccaccatgatgtctgctccgccccctcctcgtgttgctggtggtcctccggggctccgcccaccatgatgtctgctccgccccctcctcgtgttgctggtggtcctccggggctccgcccccacatgatgagtgcctcctgcagccctcagccgtccctgtgactcctggggcttgccattgtgcagatcggggtgcacatggtgtacagacgggtccacctgtgaagatcgcagagcctgctcagaggttcagaggtgcagacagaagccagccactcccccagtgttctcagcatccccctgctgccgccagccggccctcaggacacacttaagagtttgagaaggatcggagcccactcaggctgggcccagcggaagggcgagcctgggacctcccctcatttcccaagcacctttggggcacaccgtgtgtcccattgtgccagaagctctgagggattcatggggaggccttaaagaaggtgggctcgggcggaagaaaagacggaagaacaccatgtgccaccggggagaagtgtgtgccgtttacatgagacagagcagggcacagtggtgacactgatctgacacagatggtaccgcacaggacaaggagcaccaaggggggcacatgaagaaagccgtctgtccaggattctcccaggactctgatcccagagggcctcccccagcatcactccccatgccaggttacactccacttcacactaccagccagaaattaccaggcagatagaatcaggaaaatatgacccgtaatgaagaaaaggaaatcaacccattaaaacctgctcagaactgctgcaggtgttatcattagcaggccaggacattaaaaagttagaagtctactctacatattcaaaaagttaaattgagacacggagaatataaaaagaacccaacttgaatttctagagatgaaaactgcaatatgtgatgggaagaaatatacttgatgggattaacaaccagttaagcattgcaggagaaaacagtacacggttaggcacggggctcacgtctgtaatctcagcacttttggaggctgaggcagacagatcacttgagtaaccaggatttcaataccagcctgagcaacatggtgaaacctcgactccacatgaaaaaatacaaaactcagccatgcatgttggcgcgtgcctgtagtcccagccattcagaaggctgaggcgggagaatcgcttgagcccgggaggtcgaggctgcaaagagccgtgattgtgccatggcactccagcctagggaacagagtgaggccctgcctcaaagaaagaaagaaaatagcaatagaaactaacaaaaatgaagcatggtaagaaaagaaaaaaaaatttaattaaaagaatattattccattgcgggacaacggcaagtgacataacgtactatttgggggtccataaaggaggctagcagaaaaagtatttgaagaaacaatagctaacatttttttgaatttgatgacaattataaacccacagatccacaaagcttagcaaaccccaagcacaagaaaactacacgaaggcatatcgcaatcaaattacttgaaaaacagtgagaaattcaaaagtctaaaggcagccagtaaaaagccagtaaggagcaaaggtgagaatgacggcaggtttcttcttacagatttcctacagatggaaaaggtgagagtgacggcaggtttcttcttacagatttcctacagatggaaaaggtgagaatgatggcaagtttcttctcacagatttcctacagatggaaaaggtgagcgtgatggcaggtttctcacagatttcctacagatggaaaaggcagacagcggaacagcatctttaaagcagagagagagacagagaaagagaaaaaactgtcaacctagaattctatacccactgaaaatatatttccaaatggaggcaaaataaagacttttaaagacatacaaaagatgaaagcttatccccggcagatccacactacaagaaacgtgaagtcctttagccttgaggagaatactcttcagagggaaacacggttctacacaaaggaattcaaagcagcagaaatgagtactatgtggataaatatgggatttttttctttttatttaaatcttctttaaaagataattgttttaagaaaaataataacagtgtactatgaatttttttcaataagccttttgcactcttaattttttttccttacgagacaaggtctcattctgttgcccaggcctgatcaccgctcactgtaagctcacactccctggctcaagccatcctcctgcctcagcctcccgagtagccgggatcacgggcacaagccacggcaccccacagaatgtataacatttgtaagagcaaaatgcatgctaacagtaacaaaaagatggggaggagagagaatgaagaaatactattgtaagattcttggactttgtttgaagtggtctcatatcacctgcctgaagatgaactgcagtagtccataaaccctaaagctgccactcaaattttaaaaagaattacagttaattagctgacaacagagatgatatgaagtcataaatatagacaacacggaaggaaaaagataaccaagagtagatgtaacaaatagaaaaaggcaggatgatagatggacacctaatcctgcccgtcactgcagtgtggagactgaacgccacaatgagaaggcagaggccaccaggttgaagagcaagaaaaaaccataccatggctacaagcaatgtacttttggcataaagacacgagtagattgaaggcaaaaggacgggaagagctctgccatgcaggcactaagcagaggaaggctgcagggcctatgttaatatcagacagaggaggtttgggagcagagaacgttgctaacaataaagatagacatttcataatgctacggaagtccattcatcattcatcaagagaacgtcgcagtcctaaatgtctattcacctaataatagagtttcaaaatacatccaacaaaactgatggaactgcgaggagaagtagataaatccgtaattacatttggaggtttcagtgctcctttctcagtaactgacggaacaagcagaagagaaatcagtaggaatagtggggacttgagcagcactctccagcagctgggccctgacgtttatagaacacgccacacagcagccatgcagtgcacagaggctgtgccacgataggcccgacccttggccaaataaacctcaacaaatgtaaagaactgaagccttacaggcgtgttctacagccacagtggagtcaaactcaaatcaataatagatagtaggaatgtctctaagcacttagaaacagaaacttttagataaataaatgattttcatttcattccataaaattttaagtaaattaatatatatgtgcttaatgcaaaatagaatataaatatgtaatattaagatacatagatattataagtcgtgaataacaaagatttatataaaatatttattactataagtatgtatatataatatataatataatgtacatataattataaatacttgcattaaataaatacattatataaacatgtatattaagatataaaataaataggttgagtatacgtggacccagctctgaacagtgctgagaggggagtgtgtagcagctgctagacaatgcattggaaaagagggacggtctccaaccggagatcccggcttccacctgaagagggcagcgtgagtggagtaaacccaaagctgtcggccaaaggaaatgatacaaatcagactggagactaatacgaaagaagacagtgaaacatcaaaatctgttgaacaaaacatttttttaaaaaacacatgaataaaactgtgaaacaccaccctgactgataaggaaacaaagaagacacaaattccagcatcaggaatgatagaggtgacatcatgaaagattctagggatattaaaaggatgataggcaaatatcatgagcaacttgatgggagaacatttgataactttgattccttgaatgacacataccactcactgaggaagacatcattaatctgaatagcactatgcttcttttttttttagagactgggtctcaccacattgcccaggctagttttgaacttctgggctccagcgatgcttccaccttggcctcccaaagtgctgggattaaagcctgagtcactgtgcctgtcactacaagtggaatttgtagtgaaaacttttactacaaagaaaactgcaggtccagatgacttcgccagtgaattttactgaacattaaggaagacgtatttggatgacatctaagcaccttcccatattgttctatgaggccagcattacctgataccaaaggttagacacacgttacaagaaaagaaaactacagataagtattctcttgaacacaggtacaaaaatgctaaatagaatttttgcaaattaaattcaatgctatttaaaaacaaaacatgatctagtgggatttatttcagggatgcaaacctgtttaaggattgaaaaatcaatggatgcctcttcagattattaaagaattatttttaaagagagaaaagtccatgtaatttaccatattaaaaaaagatgaaaaccatattaccatctcaagagatgcaggcaaagtattttaacaaaatctgagatccacttctgatttaaaaaaaaaaaactccctgcagactcctaatagaagggaacttcgtctacctgacaaacagcatctccacaaacttacagccaacaccatacagtggtgaaagactgaatgcaagatgaagccatctgttcttgtcacatcccttgacattgtactggaagttctaggtagtacagtgagtcaaggaaaaaaaggcattcaagttcaaaaggaagaggtttaactgtattttcagacagcatgattgtctatgtggagaatccagtttaatctattttaaagtgctactagaaaaaatttagtaagtttgcaggttataagatcaatatacaaaaatcaatttatgtatatacactagcaatcaacaattcgaagttgaaattaaaatagagaacatttacaataccactaaaaaaaaagaaatacttagggatacattctgacaaaaggtgggcaagatctgtacaccaaaactacaaaccattgtgaaaagaaatgaaggaagacctaaataaatgaagagatcgtccgttatcttgatttctgcttctgagatccacatggaaatacaaaggacctacagcaggcaaaacaactttgaaaaagaaaaacacagttgaaggactaatactacctgattacaagagtgactgtaaatccacagtactcaagatcggaaatagcttcaaatggacaaacagataatggaacaggaagaaagtcagggaatagacccatacatataaacacctgccctatgatgacatggagaaaatgaaaaggcaagacacagactgggaaaatattgacaaatcgtttttctgttaaaaacttgtggcaagagtatagaaagaactctcaaaaatcaatatgaaaacaaacacaagcagacaaagaaaattgggcaaaaggtttgagcagacacttcaccaaagaagtacaaatggcaaatcagcacatgaaacaatgctgaatatcattagtcaccagagaaatgcaaactgcacccacagtcttataccactgcacaccaagtagatgccagaaatgcaaactgcacccacagtcatataccactgcacaccaagtagatgcctaagaagctgctgttatcaagtgtcggcaaggccgtggaggaactggaaccctcgtatgctgctgagggcagtgcaaagtgtgcactaccactttgcaaacttatttcacagtttcttataaagattagcacacactcagcatacaatccagccattcctttcctaggtattccccaagagaaatggaagcatgtccacacaaaggcttgtacatgaatgttcctagcagctttatttataatggccaaaaactgggaatagcctaaatatacattaacaagcggatgaataagcaaactgcaatctttccatgcgatgaaatcgtactcaacaatgaaaaggcatgaactgatctcaaaatagttagattgagtgaaagaagccagtttaaagaagggtacctgctgtatggtgccattcatttaaaactctagaaaatgcaaactacagtcacagaaagaagatgagctgctgctgggggcaggtgagggtgggggcacaggggcagaagaaaatgtctgaggggccagaccccacctagactgtggcggtagcttcacaggtgtagacgtacgtccaaaatcttcaaattccgtacttcaaatttatatgtcgcttatacatcaatgaagcggctaaaaaacttctcattgtgggacagtctacaaagaactgtactgttcccttctagattttattttgtttttttattttttctgagatagagcctcactctgtcgcccaggctggagcgcagtggggcgatcttggttcactgcaacctccgcctcccgggttcaagcgattctcctgcctccgcctcccgagtagctaggactacagacgcctgccaccatgcctggctaatttttatgttttcagtggacgaggtttcccatgttggccaggctggtctcaatctcccgacctcaagtgatctgcgtgcctcagcctctaaagtgctgggattacaggcgtgagccactacacctggccccccttctagatttttaattcaagaaacacccccaaaaatgtggggggatttattctcaagactaatgtgtatcagctaagtgcagttcctagttggatcctggatcaaaaatcagaggctcacagaggacagttgtgaacaattgggaggaatttgactctggactgcgtgtcaggcagcaggattgggaggagtttgactccagactgcgtgtcaggagggaggactgtgtcgctgtcacgtgtctggagtgtgatcatggctttgtgctcatggaagcaaatgtccttttccttaggaatatttctgggcaaagcgtcatgctatctgcaactttcacacagtgcagaaaaacacaggggatcagggggcagaaagcaaacatggcagagtattttttgaaattgtccttagggtcatgtgatgggaccagagctcaagagcagcagaacttcatgatgagaaagtccaggagatgtggccacagctgtcttccgctggtcacactttgcaaggatggtggtagtggttgttttaataagttcctcaagcctgctgttagcatttgtgtatctgctaattagcaagattaaggagggggagagttaattaaggactcccgtaggcaaggttccagttaattgagggtttttcatagataaaattaatactcagtccagactgaccttctgagttatagttaataaagttgtggttatggtaccaccagggaactccaagagcgtaatgtcagtggatctggaaagatgctctgtgatggtattcatgaagtaaatccagatttggaaattcaaagaggcttcccactgggaacaggctgctgtggtccccggaaggaacccgcactatgaagaaaaggcagatgagagagtcatagaattttgtttctgcagcccccacgtctgtgctggttctcctacccgtgctcaaattctctactgttttctctgcaaagtcgtttcaccacagttcgtgtatgctggcgttgatagcctctcctcttcctgcttctccacttttccccactcccccttcctcacacacgtacacgcaaaactcaattcaaaaaatgtgcaaggttagctttctctgtcatccagcgatgactcagtctcaccaagggggcaagagagtgccatctagagcgtgtgaccctgctggtcccacagcagaaggcagtgccctggtgggggctagtctagttaggacctgagcaaacattttacttgtgtcccgaactcttgttcctatagtttctatcttaacaaattttatttttttagaacagttttagatttacagaaaactggaaaaggtagtaaatagagttctcatgtaccctacacccaattttccctgttgacatcttctattagtacaacatgtttgacacaacagtcaatgaacttatgttgatcagttattaactgcagttgatactctcatcagattttcttgctaatgtcctttttctgtcccaggatcccacatgacattgagtcctcgtgtcttcttgggcttctcttggccgtgacagtttcccagactctccttgtttttgatgaccttgacagctttcaggggtactggtcagggattttgtagactggccctctgttttgatttgcccaatttttttttcgtttgagacggagtctcactctgtcacccagtctggagtgcagtggcgcgatctcggctcactgcaacctctgcctcctgtgttcacgccattctcctgcctcagcctcccgagtagctgggattataggcgcccgccaccacgcccggctaatttttttgtattttgtttagtagagacgcagtttcaccatgttagtcaggatggtctcgatctcctgactgcgtgagccaccgctcccggccatgcccaatgtttttgtcctgattagattgggatttggagaggaagaccacagaggggagtgcccttctggtcccgtcataatgagggtgcatgctgttggaatggcagatccctggtggcgctggcctgggtccctggctgaggtggagcagacccggctgaggtcaggcgtcccccgggtgaagccgctgctgccgccccttccggaatgggctgctctttggaaggaagtcgcttggatgtgctaggcttttgttgcctaaactgctttatgtctgtggttaacttattccttcctgcagtttcattatctttttagggtctaaatatagttcttttaatttcctcttgttatttatataggcttactgtataaggcttagtcttggagttgttttattttattacattttgttttgcatttctgggattttttagtattccttctttcagtttgccccttcttgagctaaccttcctgcagtaccatcttccagctgactgtcagtggatgaggtggaaacagttttaccctttctgcagggagctttgccagttagggacccttcaggagtagtcaggaacgcgcctgtgcccacagttgggtgagtcccaggaacggcaaaaatgtcacctagcgttccccctgctcatctaacatagtttaattgccttgatggtccatggaatttccaaactagaggttgtgatatgcagaaaatcaacaagattgcattgctagggagcacgtttgtgaagctggcgtcttccacagaagctgtcatcagcgaggaggggctgttgaggggacacatttgtgaagccagcatctttcacagaagctgtcatcagcgaggaggtgccgttgaggggactccgggtgatgctttcgtcgtttggaaagtagcactgctgtgcagaatggcctctttttagccatcctcctagttccatgtggagccctcagaatgggttttactccgggcagattccaacacaccctcatgctatcccgggagaactgcggaccaggaaggcagaggccccttcctcccacccccatggaagccagaccacacgagctgggccacccagctgtcccagcactgggtcggtcctgggagaccacccaccccagaagagaccaggctaggtgacatgcacattggtgacaggccaggctgcagggaactgggtctgtcggtgccccctgggaaggtgggaggtgtttggctggagggagacagttgtatcagctgcctccgggttgccaagaatgaaatgaacaaaagagagaggaacccggagggggctgtctgcccagccatcccagttccaggctcttttcgcctgcacccaggcagactagaccgagccctggcaggggtgacggctcgccctttgcaagatggatgggcacaacggggccctggcaggtggaggtagcacggcaggctgtgccgagggcgaccacagaggctgtctctgtgtggcaacttcagggccccatgattgatggttaggctgcttggaacctgatcaaatctcagctcagcctgctgggtgtgagcaagggagaggggatggggagcctggtcagcctagagcgggccccccaccactgaggaggccccgggggggacccccagcctgacttctccctgctcatggctggctcctgtcccacactctttcgctactgtatttcctcttcttagtattagaatttggatgagaaaggcaccacagttttgacctgaggtcaaggctgggttcgttgcaggtccagaaggctgcagctcagacacctactctagccagaaatgcccggggctctgtgcggttccaagggctcctttgccagccctgccactgggcacagggagcccctccactactcaccgcagacagagcagctctccagtgggaagcaggtcctgggagtgattggcatacgtgatctggaattgtgatgtttctccacagcccaaacatgggttcttttattcattcatccaacatttactgagcgcctaataggaaccaggacgtgctgcctcctgggactaataaagactaataatgcatgtttttgtcctcacagagctgaaatctagcccggaaggtggagggtggaaatggctaactcaaatgcagcagcttgggaagtgcagtccaagtccctgcaaagggtggggagagaagcctttgcagaggctgttgcccggggacagggccccaggcggagaggacaaaggcccagcaggcagagggagctcaccacattcccaaagccgcaaaacaatgagctcggtgtgccccaaagtctgaggagctgaggagaaaggggaagatgagtttctttgtgcagagatgtttctcagtcaccactgtcacactgctgggttattgacaccagaatgtgaagaatctcactgtcagtgccacatgtgggagggcattgcttaccatgactcagcgtggcctcagggacagtgcgtcaggcccggcaggacagcactcggtctgtgctggggaagtcgtgcagacgtgcagagatacagacatgtggacccaagtcagccccggactgagcagcgggtaccccagaagggatgggcagtggaataaggattacatgtaggggcagaggacgtctcagtctgtacctgtctatagcattttaatgtttgagccttgatacctacaaattttaggacaggtttgaaaaagattgaaaaagatggaaagcatgccagtgattttgctatggacatcagatgcagcattcagggccactgtagacgtgggtatgtctggcctgagaataactaaagggctttttttttttttagacagtcttgctctgtcaccaggctggagtgcagtgacatgatctcagctcactgcaacctccacctcccgggttcaagcgattttcctgcctcagcctcccaagtaactgggaccacaggcgcgtgccaccacgcccagctaatttttgtgtttctagtagagatggggtttcaccgtgttagccaggatggtctccgtctcttaacctcatgatccacccgcctcggcctcccaaagtgctgggattagaattaaccatttacagaaaatcaatgtgtctatattaatatatatatttatgttgaaatatcttgcctcacttggcgagtggggaatacactgtgcctgggggtgaaggtctgaggcggaaagcttgtcttgcactgctcggtggatgttctgctgaagtcgtgaagagcagtgagctcttgtgaccggtaaacagaaatccctgcttcggtatcatttccccaggcattagcagttttattggcacccaccattgtgaaaacgctgcacatatcaacatctcagcacagccctccatctgcctgcagatgacttccccggtagcatcctcacgttacggtaacacaccaccgaaggctcactcaggagctgtgttcttgttggaaacttttttccttcccagcaccccgctcataacaagggctaaactcttctacccagtggacatgaaacacggcccgtatctctgtgattgtctctgtgttcacgtcagaacgcacgtggtagggtatttgcgtgaaatcgcgcgtggtagggtgttcgcgtgaaatggctcagggcttggctcatcatcctgcctccttatgccttccccgtcaggcacggtggtctgttagcctgggcgtaattcttgtgttcctgcttctccataaaataatccttaaaatctttgttaaggagaataaagggagggtctcttcccatggcatcttttgccagaatattcagaggaagaaagcccgccccggccttacgggtgcaccttgtagaaggcagggccttggccaggggctcctcctggtctctgccccattgtcgtgtctgcttgcaaaccacatctttagttgctgcaacaacaaatacatgcttgcatcttcccactttgtgtttgctcttcttctcttcttcacctcccttttccccatttaaaaaaatataagttcctgaaacctgagacacagaagaatcaaaattggcttcagtgtgtggtgagggaagggggcttgctcaggaaaaaaaatgtcatgttcatgctcttcccacctgctttctactctggccttcacatgtcaccaccatagcttgatctgggagaaaacaagcacagcaagatggagcctgttgagagggcggctttggcagattcacgctgccggcaccgtgctgttcatctgagccccgagtctctgccgggtcttccaccaagcccctccgcccaggatgtgtgtgtcgcctgccgggtcttccaccgagcccgtgccacgcagggtgtgtgtgtcgcctgccgggtcttcacaccgagcctgtgccacgcagggtgtgtgtgtcgcctgccgggtcttcccaccgagcccgtgccgcccaggatgtgtgtgtcacctgctgggtcttcacaccgagcccgtgccacgcagggtgtgtgtgtcacctgccaggtcttccaccgagcccgtgccgcccaggatgtgtgtgtcacctgctgggtcttcacaccgagcccatgccacgcagggtgtgtgtgtcacctgccaggtcttccaccgagcccgtgccgcccaggatgtgtgtgtcacctgctgggtcttcacaccgagcccgtgccacgcagggtgtgtgtgtcacctgccgggtcttccaccgagcccgtgctgcccaggatgtgtgtgtcacctgccgggtcttccaccgagcccgtgccacgcagggtgtgtgtgtcgcctgccgtgtcttcccaccgaacccgtgccacgcagggtgtgtgtgtcgcctgccgggtcttccaccgagcccgtgccacgcagggtgtgtgtgtcgcctgccgggtcttcacaccgagcccgtgccacgcagggtgtgtgtgtcgcctgccgggtcttccaccgagcccgtgccacgcagggtgtgtgtgtcgcctgccgtgtcttcccaccgagcccgtgccacgcagggtgtgtgtgtcgcctgccgtgtcttcccaccgagcccgtgccacgcagggtgtgtgtgtcgcctgccgtgtcttcccaccgagcccgtgccacgcagggtgtgtgtgtcgcctgccgtgtcttcccaccgagcctgtgccacgcagggtgtgtgtgtcgcctgccgggtcttccaccaagcccctccgcccaggatgtgtgtgtcgcctgctgggtcttcacaccgagcccgtgccacgcagggtgtgtgtgtcgcctgccgggtcttccaccaagcccctccacccaggatgtgtgtgtcgcctgccgggtcttccaccgagcccgtgccacgcagggtgtgtgtgtcgcctgccgggtcttccaccgagcccgtgccacacagggtgtgtgtgtcgcctgccgggtcttccaccgagcccgtgccacacagggtgtgtgtgtcgcctgctgggttttccaccgagcctgtgccatgcagggtgtgtgtgtcgcctgccgggtcttcccaccgagcccgtgccactcagggtgtgtgtgtcgcctgccgggtcttccaccgagcccgtgccatgcagggtgtgtgtgtcgcctgctgggtcttcccaccgagcccgtgccgcccaggatgtgtgtgtgtcgcctgctgggtcttcccactgagcccgtgccacgcagggagtgtgtgttgcctgctggctgccgttctgcgcgtgtgtggtttcaagtcttgtttcctcttctgtttaacgaggcccttggtctaagtgtgcttgtaatttgggcgagtgagcagcagccgagagagtccaccccagtccccctagccagcgaagtgggagctcccaggttcctgcctgcggggagggtgggggcggtttgagttagtgaaaatgtgtgtattaaacagatatgtaaatgacccctgccgagcgctgaaaatgaaggtatgaaaaggcatcatcatccgtggttcccacctggcataatgaccgtatcagaacagacatctggtagtatacaccacatagttgccagactccgataccaagggcacatctaagttctcccaccctgatttgcatgcctcaaattcagaattagtgagatttgagtcagtgatgcttcattacactctcgtgagacatgtttgaggagcttcaccgtgaatgtgtgggcttcgatttgacttgtggaacctgtggttaaaacaaaggaaggtgccttcattctcagaacccagtgctttttctgttgccctggccctctgggctgagtctttacgtggacggcggtcgatgcatctcagtttatttgtcaaaaccttcagctaaagccagttgttgcttgaaaactgcctgcttaattggcctcctcagctcgggggagcagcttgcaatctgaggccggcgcctggctccctgaccacccgctccccatcgtgctcagctctcattccagcagcccagcccataacccgcctcatcagtgtattgatgtgaggcagaaacacctcattgtaagagcacccctgagaaatggcggggttaggggcttctgggctgcataaccagcagattccctctgcaaaactgctcctgcctcagtgggaaagggccagctgtgcagggctgcactggagagccgttctcttcttgatcctcaggcatccagttcttaaaattccggccctctgtccttgcatggccttcgtcctctggaaaggagcatgctgggagctggcagaacgcacgcctcactctgtcgatgcagtgtctgtcactgctcagtttctaggtattgatcctagaaacccatgctctgtgggtccctctccaagaaacacagcatccatgatttgtacatcgcactgcagtttcagactgctttcacatgcgtggtttcatctctgactccacgacctgagcacagattttttttttttgagacgtagtcttgctctgtcgcccaggctggaatgcagtggtgcgatctcagctcactacagcctccgcctcccaggttccagcgattctcctgcctcagcctcccgagtagctgggactacaggcacgcaccaccacaccctgctaatttttgtattttttagtagagacaggatttcaccatattggccaggctggtctcgaactcctgaccttgtgacccgcctgtctcagcctcccaaagtgctgggattataggcatgagccaccacgcccagctgagcacagatttttaaaactttacctgggtccctgactagtaagagggagaacctggacttgaaacttagttttgtttcaaatcttgccccttttcctcgggttttgggcaaatacttcccgaagtattatcgttacccctgaatatccaaggcaggatcattttattcccttccagagccagcacttgcagaagtgtccccaagttaggcagcctggtgtggcttccggtaacactgccagcctcagagccggcctgtttcctccaggacgcccacaggaccctcggaagccccttcctctaggggcccgtccctcctccttccccaggccccgtcccccgccttgccctctgaaagtggtcttcagcaccacccgataagcggtgacttctcatcttagaagcctggcttgggtcaggttctgcgtttcggctgtgcgcgccccggagcagccctgcttgtgtctcatcatcgatgcctcagctgcagtgtgccccactgtaacccctccgggatgaaaacgcaacccacctcttcagtgggcagccctccacttggatcctcgcatccctggcatcatctccgtcctctgtccttgctgacccagctccaacccagcctgtctgacccgtagcccacctgccatgtccttcccggctgcagctcctgctgggctctgcagcccctcctgcccaacgccacctgcccccgcctgccctgctcctgcttgcccttcccctgcccctgcccccgcctgccctgcccccacctgccctgcccctttctcctcccactcccacatcccgggcctggacctgccatttcctagcagcaggagtcttttccctcgatcccacccttccccttcttccctcactgccctggacagttctgtctgctcatcagcgtaaagaggtctccaaaaagtacaagaccctccctctccccgctttccaagcaccctatggtgcctctcgctgctccttcaggaactgtgagcagggcacaaatacctagtgctcagcacccagtaggccctcacgactgtgccgagccatggccgtgtggctgtgattgtgctgacagcacacagtaggtcctcacgactgaggcgagtcatggccacgtgactgtgaatgtgtagacaggcacagaatggcctgaagcgtgggaaggtcgcctgcctggcagcagctttagcaccaggaaacctcccaccttggggctgcccctgagggtgaacaagtggggccagtgggaagcacctgctcaagtgggactgtgcacacaaatcactgggaattactgcctcacacacgattggttttcagcattttgtaagtccaagcaaacccccaagaaaagcttgagcgggaccgggtctgcaccaacaggctggttctgagtgagtgctggatggatgtgctccagtgtggagggcagagggagggagcgggacccctggagaggagcggggtgcaggcaggggctgcagggcactccccagcaggtgcccggacgttgtgaaagaaaacgtctgggagctgctttcctctgggcgttcgtgggatccctccccttcttagccaaggaaagcatgtctgcaggcaccggctgcagctgtttttcaaatgaaaactgggcttgaaaggaggaaataattgaggtataagaagtccctgcccttattcgttcacgcaccatgagaagcttgtggcatctgcgggacactgcactcactgcctctcctctgtctctttctgtccagtcgtgccaagcggacctcgtgaaggacaacggccacaagtacttcctgtcggtcctggcggacccctacatgccagtaaggacggggcagcacgctctccacgggcttgggactcagcactcgcctctgcccacacgctgcactgcggtggggccttttgacgggggctacaggagaaaggtcaagggtcacagcaggggccacgtccacggggtcagcaactgcttcacgttagacatggccctttgcttactaccatgagcgcagctgttatttcgtgtctgtctctaaacaagagctcagttaacccggacacatgggtggttttagtttattttagtctcttttcactgggacttctttgcaaaatagtcaaatccactctccctgctgtccgccgcgttagactagtgagcgccgcacgtctgtaatatgagagttcaggcgcctgggaaggtcttggagcacaagaagatatcgaagcaccccatttcaggaaggaagggagagaggaaaggaaggaaagaaggttgtttgaaagtttaaattttcagtatactttattgtattaaattgtttgaaaattagtaatccatgaatagggtgtatagttattctataaatgtttcataatgttttaatttctaactcccagcttagtaatgagaacaaaatagatatatcctaaataattctttaacataacttaatattgccagaatatttaaacatattagctagtttacacagtgttcggtggctttgctgtataaaggaacttttgtatgtaatttcaccccctagttggttttctaagctaaaggattttttaaaacacaaaacaaacaggactattttccaaaaggtaaacagtatgtgcactttgtgttgtattgaaacatcacaggcagttaaagttgatactttgtatcagttttggaaaccatcacttcccattcttaagaataaggaagaaagcaaatcccacatgaagaagtgaggaagaatgctcactggcgacttgggcgcgagggtgagctaagctcacatgaacggccccacctcagccacgagcctgcggaagttttgaggacacagccaggtttgaaagaatgaaaaggaggctgggtatggtggctcacacctgtaatcccagcgctttgggaggccaaggctgacagactgcttgagctcgggagttcgagaccagcctgggcgacatggtgaaaccccgtttctaccaaaaatacaaaaaaatttgtctggcgttgtggcacacgcctgtggtctcagctactcaggaggctgcagtgggaggatcgcctgagcccggggaagtcaaggctgcaatgagctgtgactgtacaactgcactccagcctgagcaacagagtgagaccccgtctccactcaataaataaataatataaatattcttaaatgactgactagaaagaatttgctatgattctgtcaaaccatcaaccattgttttgtttcttcagtgctttgtgcctgttatgagaaaacattcagtgcttcctactcatcctcagaaacgattgatttttctaaactcataagcagatctgaaaaaacaaattgaagctgtgaaaaagaaaagacatgcactgttattgaaaactctggagatgaattaaatcacagaacagacagccaagaagagaattcatgaaggagccacctggagcgccgtccatgaagctaagcgagaagatatgaaagccgggctaagagccgggctgggaacgttcaccatgtagccagcatggttcagaatgagaggagaataagtagagaagcagtttttgattagatagtggctgagaattttccagatttgaagaaaggagagttccgattttaaaagcaggatgaatcctgagaaggttaaagagaaacaaattcgtacatagacgcatcataatgaaaacagcaaatatcgaaggcataaagacaaaccttaaaagtccccagaacaaacgttattagcaaaggaggagacagcaccggccccaacagcagacctctcatcagcagcggctctcggccggggacaggggagccctcggcgtgcgaggaaagcgaccacggtcgggtcacctgcacccagctcagtcaccactcaggaatgggggtgtagtaagcagcgttcagacaccaacagtttactccttccgaaccccacagaccatggctagaaagaccacatgtcagcgaggaggaaacggaaccaggaggggaaagcaagatgcaggacacggcaaaaagccaagaagttggcacacgtgttggcacatctatagatttgtaaaaatgaagaatactcatggcgaattggagggttaaacaagaggaggactcaggtaccctgggagccctgcaataatccaaggagccctgcaataatccaagaggcgcgtaggacactagaccgcgcgacgtgtgtgtaaaaaactaaggcaccgctaaaaagttacaaatagactctggtttccaggtcagcggaggcacagaggaaaggacagaatgaaaatgagtcacagtagagcagaaaggagaaaccagtgaaacctagagcgctgcctccatgccttttgctgccaaagcccctgattgcaggaccgtgtgctcacagagtgctgggcaggctggggaggtgaggtccgggtgcttcataccgacagccacggctggcctgtgacagaggaggcatccaccaggtctgtgcccgtcttgcagtgttagggcttccaaggagcagtctgttcactccgggaggcgagcctggagctctaaggcctttgaaaacagctgttcttttttgtagagtccacgtaaaatccaggagtaaagctggctctcgttactttaattatgcgccacgcgtgtcatgaagattccgaaaggatcacgctgttgtactttgggaatgagagtttccactgaggggagacgaccaggactggtttttgttttccaggctgaacaccggaccatgacggctttcattctcgccgtgatcgtcaacagctatcacacggggcaggtgagccccccagccacccccagccccagagctcacccttggcattgcagaggagctgggcccactgtgaaacgtggtgccacatgggggacagggggtgtccagcagaggctctgacccttcatctagccagccatttgcaggctgaatatgaatcagaggaatctaaaatggggaaaattgagcaaatcaaggcttcccaagaatgggtggccaccgttgtcccgtgcaggtacccaccacgtgcctgccattggcaggcagaggccaacctgtctgtggtcccgcctctgcaggaagcctgccttcagggaaacctcattgccatctgcctggagcagctcaacgacccgcaccccttgctgcgccagtgggtggccatctgcctcggcaggatctggcagaacttcgactcggcgaggtggtgcggcgtgagggacagcgctcatgagaagctctacagcctcctctccgaccccattcccgaggtgagtcaggcgggggctcagagtccagtcctcctggctgccgactgcgggggtaaggcagaggtctgctcgcgtgcgggtgtggccggccacgtgtccaggaacttcaggggctgcacgctaataagagtaggacagtgggaccttggtgagaagagaaccacaccactggggattttgcacccaggcccagagtgcgctcccggggacagtggcacagctgcaagcgggggtcccagagggaacctcagaggcaggggtcacgtgctcgctgtccgggtgccgctctgcgtcctcactgtggcctgcaaggcagggaccactagatctccactttacgggcaaggagtcaggccagtggctcgtgcctggtgcagctgggaaaggtgcggggcactgcccacagagtggccgcgggctggaactctgggagtttcatgcaccattgccttcactcttcccaccggcctgtgcagtgcacagggtgttgctcatttttagagctgaggaagcagactcagggacagtgacttctccccaggaccacatggtgtcagaggcaagggctaagccagggtccccggaccccagggccagcacagtgtcgctcccctggctgagccctgtgtgctcagtgcacttcagggcccccatgcccctctgcgtccaggagtgcctgcgccctcccctctttccaccctcccacgctctgtggcccatcccagccccctcgtctaactcctgcctcgttcatcagcacattccctggtgcctggtttggtgtttcagttcccggggcaatgcagctcccgcctctgcagtctgagctgcccctggagctgggcggctgcccctgctgctccccacctccttccccgttgccactctgatagtgcgaggagagccttgggcctggagagctgttgagcaagcgcctgtggggttggattcacctgcacacacagccctggcagaaaggcaggctgcagcatggcccggtgtgggacatgcctgtgaccccccgccgccttgcaggtccgctgcgcagcggtcttcgcccttggcacgttcgtgggcaactctgcagagaggacggaccactccaccaccatcgaccacaacgtggccatgatgctggcccagctggtcagcgacgggagccccatggtccggaaggtgcgtgaacccccagcccggcagcagcagggcacccaggctggaccccgtgacacctggggccaagcccgcatggccctgaccacagcagggagcactcagtttccactgcgtgtcattgcgagagcagatctttacatgtttcattctcttcaagttgcgtttctttaccagacacccatgggtttgcttcatttaaaggcatctagcaggctgcgcctcccggcagcttgtgtagtagtctccttcctgcctgggagcaacacacacaggcaccactgcgattccaaagagacgcagccacccacagatggcgggaaggtttgtgtgctgggtcccccccaacaccccatgtacgtcagcgactgaacaaaacagttttatgttttgttttgttttgtttttgtttttttgagatggagtctctctctgttgcccaggctggagtgcagtggcgtgatcttggctcactgcaagctccgcctcccgggttcatgccatctcctcctcagcctcccgagtaactgggactacaggtgcccgccaccacactcggctaattttttgtatttttagtagagatggggtttcactgtgttagccaggatggtctcgatctcctgacatcgtgatccacccacctcagtctcccaaagtgctgagattacaggcgtgagccaccgcgcccggccaaaacagttttataaacttgaaaacttacttacctgtttagatgtagaaatatcacagatgatcgtccaaggtttcacaccctcagattccccacccaccccagcgcaaaaggggcgtttaggaagacactggtttcctgatctcctttgctggtgagatggaaggctgctcttgcagagaactcatctgacagctggagcacagagctgctctatgggcagggagtgtgtctccccgtcaggtggcgttggccaccctcgtgcgttcccgtgctggctgtgtgtggctccctcttggagatgggctttatcatgagacgggccgtggtccaggggcctgggggttgtttgtctggagagcagctgccgctgctttacttgggagggacgtgacccggacaggtttccctcagccagacgaagtgtggaaagtcacgttctatcgtgtgtacccttctagaattagcccaagtcatgagtatgctacattttctaacgaaatcttgaaaataggaagtgaggttccgggctgccttttctgttggttctgactttgttgccatcacgttctcctcgtggccgggtttctgaacctggcttcttttggcccctgctgaattctttttcccacatcaactcacgtttggtggacatcactgatcaaagcagcaaatcagcggtttgtctgctaaaattctttttaaagtaaggaaagctttgtttcttctttacaaaaacgatatgaaaatagagaggacgttagctgtgaggcgttccccaagagccatcccgtggccgggctgtggccctgtggtgtggccctggctgctgaggcactgagacgaagctccccctccaccgggagcggtccggcgtcactcgcctgcacggctgcctgctgaacctgcatcctggagatgtggcccgcgaggacaccgtggggttcggaggaggtgctgccaaccgggacgcagctgtctcggggatgctgggcagggcgtgtagagggggatgacagcccctgccctccgggagcacgtggtctaatcaaagaggcagatacagataaggtcattacaccagagccttgtggagaaatactgcctggagtgctgtggagctcctgagggctgtgcctgtgcctgcatcggagcgggaagggtgtcagcagaggcttttgtggaggggcagctcttacctggttatggagggtgagcaggagaagcagccaacagagctgataacgccagctggcagggtgatgtctggagggaggaaggctagcgaggagtcagagaaagacaccgtcactcacctgtgaccaagcgggctgcactggcgcgcagactccggaggtgcgctggctctgaggggctgtgctgactctggggggtgccagctcggggggtgcgctggctctgagggggtgtgctgactctgaggggtgccacctcggggggtgcgctggctctgagggggtgtgctgactctggggggtgccagctcggggggtgtaccgactccgggggtgtgctgactcttggggggggtgctgactccaggggtgcgcctccatcctcgtcatagagtcctgccgcatcacagctggttttctcttctgtttactaaccaccatgggcaggcacggtgctctgcaggggacttgggcacaggtgcaagcaccaaggagcctggcggcgtggagccggccccattctcgcagcctcttctcaaggaccatcctgagcccgtcctgagcctgctgtggggctggggttggggagtagaactggctgagaggctcctggcaccctctggggtgggagagaggagggtgttactgctgcttttccataaaagcaacgtgtactggttaccaaaaaggttacatccatcctactttttaataataaaagtgtcctctcctgtgtggggtgataacgatggccgagtaggttttgtttgttgacttgtttaatgagcttacttgacaaaatttaaaagtcagcaaattcagcttagcccccaaattattttgaacttcaacctgtctttgaagtacaaaacctgcagtcagcagccacccgtcccttgtcaagaagggccaggccaggggtgcggggctagaacccccagtgtcaccccagcctctgcctgggccgggctgggcaggagccgcacacagggacgggctcagcggggcttggatgggggcttactccctccctgtcatggcctcgggaggaaataaggactgttcagatactattttattttatttgttttattttattttgaaacagagtctctgtcacccagattggaatacagtggcacaatctcggctcactgcaacctctgcctcccgggctcaagcgatcctcccacctcagcctcctgagtagctgggaccacaggcgcgtgccaccatgctgggctaatttttgtattttttgtagagatggggtctcgctgtgttgccccaggctggcctcaaattcctgggctcaagtgatccactctgtaatcccaggccttggtctcccaagatgcttcccaggacgctgctcgggcctgctgtggtcacaggagctgagttttatgatgcctgagcacaggtcacaagacaaatattagccagtgctgtgttgttggagcggagtgggtggccctcagggcaggtgggcaaggggtagaggcgaggtgggccagtagcccatggtcagtgcagccgtgtcaacactgggaagtgtgtgggcccccagcggggcaggacatgtgtccaagaaagatgtccttgagtcctggcaccagttcacggttagaaactaaccatgtgctacagacgacacccctgcagggagggctgcacccacccagaacacacttgtcaggcacgtgccacgtgccgggccggctggggcctcagtgaccccgcagggcactaaccctgcctcttctctcaagaaagttacccctggagctgggggaggggctgggtgtgagagtggtgggccggggtggcagctgagcagagccagtatggatggggctgggggcacagggaggccttgccacagggagaggcccagtgcaggggctgtgcccatcagagggcgtgggcacaagaggccaggagggcagtggggcaggtggcccagccaggcacaagccttgtcgttcgtgatcagaggcctggaggggtttgggggcaggacctcaccttcggctgcccaggtgagaggggccgctcgcccagctgcagggacggcgcaggagggaagaggcaccagcactttgaatgcggagctcacagcacttgctcacaggtggagagggtacgagaaaagaagaggacagggaatcctgggggtttgggtctgagcaacagaagagcagagttgcccctcgttgaaggggccagccatgaaggagcaggttccaggatcacgcatggactctgaaggtggggagccgacaggaagggctgagctgacaggtgaaagtatgagtccaggcaaagctgcctccctttcgaggaaggctgctcagccccagccagggagcaggaggacagacaatggctttgacaagcgaccggtcagaggacctgggaagcctggccagtgtggagcccgtggccactaatgtggcctccccgtctgtgtgctgctggggagccctcagggggaaggggtcacatgacaacaccagccaagctcatcttgcaaaagctgagagagaggggagctcccacacccctggctgagcacctctgccagaccctctgatgggttctgcatgaatatcctaaagaaggccagtgcgtgtgtgtgttgctgtcagagcccagctccattcaggaagggcaggaagggtccaacgcaaaggagagctctttgctgtgtgccaggcagcagcctccagagcgaggcccgccatctccagcaggatgtgcggcctccaagggaggcccccgtacgcagcaggatgtgcggcctccgagggaggcccccgtatgcagcaggatgtgcggcctccgagggaggcccccgtacgcagcaggatgtgcggcctccgagggaggcccccgtacgcagcaggatgtgcggcctccgagggaggcccccgtacacagcaggatgtgcggcctccgagggaggcccccgtacgcagcaggatgtgtgttcgggagtgagggaggcccctgtatgcagcaggatgtgtgttcaggagtgagggatgtgcggcccccgagggaggccccgtgcgcagcaggatgtgtgttcgggagtgagtgctctctggacattccccttgaataacagacgtggcccctgttggcctcccctgaatcgaagggcccaccacctcggtgcacgttaatccatgccagctcccagctctggcttttctcacctgatgtcagaaggaaagggaaaaaaatcggtgctttctgaagacaggtgcagccttgatcttccctggaaggggcccagtgggtgttcgctttgtcggaggccccgtctcggcagtgcctcactcctcttgcacagggaaggcagcgggggttctgtggtttgccaggggagcctgggacagtgacttaggcagttggagacgagcgccagaaccggggcgtgggccatggccgtgaagacgcacactgggccatggcccttggtgcccagcagggtgggaggggcgggtggagggtgatgccagggctccattctgagcagtgagagacttgcagttccatcggcgcaaatcaagagggcgctgcaggctgaagggaaagtagacggtgcccgcagttcatagggcagggagagtttggggtgcaggtgaagagccggcagctggacagccagcctggacctaggagagtgaggggccggcatcagggaaaccacaaagcatgataggaggaagcccggggcatgtaaggctggggtgggaaagtgcgtgtacagagagtgcgtagacggagagtggggtggccacgagaagaccctggtccctggtgggcgcccatccagagcctgctcatccagccgctgtggagacaggggcgtcacgcgactagcaaggggtcctctcacagcgcttggctttctgctaagaatccgtattttttcttttcagaaaaaaaaaaggcagaaaaagttgtcgtagggaaaaaaacgttctttccgctttttaaacctacatcccccttctgttccccagtgacttctaggatctccagctgttcctgtcacagcactgaactgtcctaaaagagaggcaaattgtgtctgttcccttggaccaaggcatttggtcctaaagatgatgttttagttctacaacttttcccgttccctcttagggactagaaacatctaccaatgaaagtttcacatgtgttgaaaagagcaggcttcggcttgtccgctgcactcggccctggggcgctcagattcagaaaggccgccagccatcgggtgtgatctagagcggcgttttcagccagggtcccagtggtcaccgtaagcgagaggctgtgaggcctcctacctttccctctctggagtcctgtgactcaccgtgtccttacgagacccccgatgcgtcgtgcgcctctagcagtggggaggattctggcaggcattctgggcttcccccgtgagccagtggcctgccgtctcccagcactctgctattccaaggcctctgctctgacggttcgaaaagggatggtccctgtttctgatgccaattgcacggttttgtcttaacctttcttttttctgttggtgactcaagtctcactgctgctccacaatcattttccagccccagtgactgttattgtcccttctccctctcggcaggagctggtggtggctctgagtcatcttgtggttcagtatgaaagcaatttctgcaccgtggccctgcagttcatagaagaggaaaagaactacgccttgccttctccagcaaccacaggtatggcgtcttctcctgtgaacccgcagagcacctcgcctggcggttctagtgcaggccgcggcccagtcttgctcaccctcgcagagtctaagcgcaggtttctcagatacctgccgcaaggggtccctgtttttctcatctttttaggcacctgccagatttaaaagggcaggaaagagggccacactgaccctcttacatttttcctttctttttaccctttttggaaattaaactcacagagaccttgaagtatgacaaaacttctgcagtaggagcttgcggaaaagcgcaggggccgtcttcctgcgatgagtaatttcatcacactgctcttggctccgtggctcggtgagtcatgtcaggcgtgctttctcacacgtgtcgttttgactggagagtacagttcctatctcatcgctgccggcagcccctcccgcttccacacagccgtctctgccgtgcaggggcttgtcatcagcagtgaggcctcactgcttctaggaagcccaggaggggagaagggtgagccagactgagtgtggacggtcattgctctgctgcggcttcccggggagcacggctcacggcccacgtcaccatgcacctcgtgtgcactcggacaggccgcagccaccagcctctcccctgttgtcttttgtaatttaatatgcacagagccacaagcggttgttgtttgtccagtgctatcccgcagagcctccgctcacgtctgagtctccctgagctgtgcagcccctgctctgacatttgttgcagcacaggtagcagctgccgtcaccgagtgtcccagctgctgagtgtcagaagacacgctggcctccacctggaagcccattgtaatttgtctttctccttctttcccagagggagggagtttgaccccagtgcgagacagcccgtgcacccccagacttcgttctgtgagctcctatggaaacatccgtgctgtcgccacagccaggagcctcaacaaatctttgcagaacctgagtttgacagaggaatgtaagatcctggaaatcgggttattggattgggagagattggggttgttttttctgaaacactgtatctgagtaagcaccactctgcccctgccccttcgtctaagtgcgtgccctgaagtcccatctgccaacatggtgatgagtcacccttccagacgtgagcatggcaaggaggcgtaggccagcccccagaatagccagcgggcccgttaccaatgcggcagggagctcaagcgcagccgcagttgaggcggtggctccttggagggctgtgccctgcccccgtctcccagtaacctgtggtctgcgggtggggagcttggctcccagggagatcagtgagtgcctgtgcctgtgtgtgcgccggggcgtgtgtgccagggtgtgtgcgccagggtgcgtgtgtaccagggtgtgtgtgcgccgggtgtgtgtgtgcgccaggtgtgtgcgcgcgccaggtgtgtgtgcgccagggtgtgtgtgtgctgggtgtgtgtgcacaagggtgtgtgcatgccagggtgtgtgtgtgtgtgtacaagggtgtgtgtgtgccagggtgtgtgtactgggtgtgtatacgcgccaggttgtgtctgtacgcgccagggtgtgtgcgccagggtgtgtgtgtatgagggtgtgtgtatgtcgggtgtgtgtacatgccagggtgtgtgcgcaccagggtgtgtgtgtaccagggtgtgtttgtgcctgggtgtgctgagctttatttagaagaaaatatgtatctcagtcatgccattaactgtaagaccaaaaggagggtcccgggagcaccccactgaccccgttgcgtctcgggcagctggtggcgcggtggcgttctcccccggaaacctcagcaccagcagcagcgccagcagcaccctgggcagccccgagaatgaggagcatatcctgtccttcgagaccatcgacaagatgcgccgcgccagctcctactcctccctcaactccctcatcggtgagtccgcctgcccctttctgcttccgaggggccccgagggtctcctccccacacagagcagcacagacctgtgtctgcatcaggtcagtgggtgtcaaaactgtctgttcaaaagaaagaataaaggtcaacaggactgcgaggcagggagaacgttttgctggggcaagcgggaaagttgacatcactgttgtgttggggtagtattttacaggctgctccggagccatcggagctggccagtttggctgggtgggaaggctgccagaaccttccatctttgttccatagacgggtgagagttcttcatggtgctggacaccctggtgatgcagaacggtggttctcagccgggggtggttttgccccccacgagcaactggggtacagtaggggtgctccttgtcccagtgggtgaggccaggaagctgctcacatcccctggtgcccaggacagcccccacacagtgtccgcagtgagaggcggagggccctgcggtcgggctgggggctgtcatccccgccctgctcacctgcggaatctccacacaactttccctccatcccagcagcttgacgcagcactgcctggaaatggaaatctgacggaagggtcagattcttctcttgttctgccatgaatggtgtgtgcctgggtcctaccaccaggattgctgttgtaaaacaggagaagcaggaattcaccgtgttttcttattgtgtagctatgttcatcttcacactgctggtaacagatttagggcttaaccaaatgagcctcatctcctcttgttctgactatccagagtggcttaccggcttcatttgaatttttttcatgttaaggagcattttagccatgtaaaaatttacagagacttatataagagcgctgcgtgtgtgtgtgtgtgtgttgtgttcccagcttaaggaattacagaggtcgagccccagaccctaccccggtcccattccctctggtgacattacactttccctccctggccatgagccctggcacacacgtggtgcccacttagaggcctttacctcctattggcgccgtcgcacgatgcgtggcccgcaaagcccgtttctttggctctgacttcaatatgtatctttgatggtcatctaggttttgttccttcacctccgcgatctgccgtgactccattatccattctcctgtctggggacagtgaggccggttctagtttcttcttgccttttgttccttttcttaataagcaaactcagaattcagcccctgccaccatggagccccacatccaacacaccctcactcgctgcacccagctctgctgggccccagcctacccggcccccagcctgggcatcggtggggaagctcttctccggcatatggtggccgctcccctctcattcagagcccccatctggcagcaccttcccagaagcctccccagccccacgccccacctggaatcaggcttccccagctgccctctgaccctgctcccttttcctgctttatttttctcctgaggactgtggactgcagacgtgctgtacgtgtaacttgttcattggcccggcccatctctctcccctggagcttgagagccgcacgtgcaggaacccagccttgttaaccactgtctcctcccaccctgtccacacccagtgcctggtacgcagtaggtgctcaatacacataaacgggcacgtgtgtggtgcgtgttcttcagcgtggatacacgtgagtgcctctcgccaccttgcctcagagtgaagctgctgcgtgaacggtgcctgcaccttcagcttttgtagatgtcgccccaggccttccacgggatcctctgttctaaagcgcaggcgcccccatctcgccactctctaccacgccggtcttggccagcctttgtctgtctgatagacacacctggtgtctccttgtggcatgaatttgcatctgccttgattgcagtgaggttacagccttgcagccttacagactcgccttgtgtcgtttatctttctctgagtagtttgtaatcagcattcatcacagttctgggtgctgattcctggctgaatatatccatcgaaaatgcatctaatctatgactttttatgatgcctttggtgccacacaagcttaatcttttagtttctctttttctttataacttgggccttttgtgtcttgtttttcctattctcaatgtcctaaacatattctcctacattttcttccaagatttaaaattttccttttttgtgttcatgtcttaagtatatcctgaaccacattttgtctctgtggtgaggtggggatccaggttgtattttttctttatgccaccccagacccttcatcagacagcccgtcctcccgccagtgcttctcagcgtctccctggccatcagtccttagggtctgagtgggggctccattcttagcagcacccatcccatccacggccgcgccgacaccccacacagccgccccgacaccccacgcggcctcgctgacaccccacggccgcagcaacaccccacacggcctcgccaacaccccacggccatgccgacaccccacacggccgcaccgacacatcccacggccgcaccgacacaccccacggccgcaccgacaccccgcatagccaccccggcaccccacggccgcgccgacaccccacacagccgcgccgacaccccacacggccgcgccgtcacaccacagctgcgggggcagcacctttgagcccgctcctcagttcgtttctcagaactgtcttggccgctcttagccctttgctctgctgtatacatttcacagtcaggctttctgtgtcgacagcagcctcactggggtgttgtttgaatggcgctgaattggtggatttccctgggatgactgacttccttgcatcatgagtcttcctgctcctgaacagggtgtatctttccatttacttaagtcttctttatgtcttcaagacagtctaactttctgcataaaggtcacaggcatgacgttacctttcagtttttgtaattttaagtaatatcttttttaaaacctgttgctggcaaaaaaagaaagaatgccagtgggctgggcacggtccctcacgcctgtaatcccagcactttgggaggcggaggccgagacgggcggatcacgaggtcaggagatcaagaccatcccggccaacatggtgaaaccctgtctctactataaaaaaattagccaggtgtggtggtgcgcacctgtagtcccagctactggaggagaatcacttgaaccggggaggcggaggttgcagtgagcggagatcacaccactgcactccagcctggcaacagagcaagactccatctcaaaaaaaaaaaaaagaatggcagtggacatctgtgtttctctcttgagagtaaacgaaacctttctaaccttttacctttgatacgacatttgctgtagattttttgagtgggtgctctatatcagtttatagaaattcccttccctttggttcactctttttatgagtgcaaattcccattctattctagttagttaagaattttcctgataaatggaattaatttctttgaatgtattttctgcatctcagaatgaccctgtgcatggctgtttgttagggtagggaattacatgattgaatttcttgtgaaatatccttgcatttctgggggcacccagcgtggtaatgtcccctgacatcgctgccttacgctcaccagctatttctttgggcgctccccattggcattcacgagtgggttgggctgtgacttttcttgtcctgacctggctggtttagacattgagtctgtacctgcctagtaaaactggctcctccgggcatggtgacaggtgcctgtaatcccagctacttgggaggctgaggcaggagagttgcttgaattcgggcagcagaggttgcagtgagccaagatcacgccactgcactccagcctgggtaatagagtgagactccatctcaaaacaaaaacaaaacaaaacaaaacaaaactggctcaggagtgtaccctcattccctgtccaaaaaaactggctcaggagtgcgccgtcattccctgtcctcgggggcaatttttataagacaaagatgatgtgttctttcggtgtctgagtagaatttgcccctgaactgtctgggctagtgtagtgttgtgagggtgggtttgaattctgtattccatttctttaatgctgataggattatttacattctctatttcttcataagctagcttcaaaaagttttattcttctaggattttattcatttcagctaagtattctcattctttcccttgaggctgtctgcagtattctcatgagtctctaatctctgctgtctctttattgttttagctgcttttactgatattcccaatctgctgcctctttagatatgtccccgtttattcctattgttgtttatttgccttttcccctttttcctgattaatcctctaagatgtttgttcatttctttagtgtcttcaagttctaacttttaggctttgtggatttactgcattattttatctttatttttctattccagtactttattttgtttcctttctactgttttctctaggttcactctcttgtcctgttacagttctcaaacagaaaataaaaacagctcattaactttgagtttttcttccttcctaatgtgtgtgttcaggtctgcgggacccctgccccggctcccccaacccctgcccccgctccccccccgctccccccaccccccgccgccccgactccccccgccccggctccccccgcacctgctcacccaacccctgctcaccccgcccctgctcaccccgccgtctccgtctagtgagttttgatgatgggcttttcacttgtgttcagcttcaagctttctttctacttccattgtggttcctggggatggcggtccagccacaatgacagcagcgcatgacaggagcccaaagacccgaaacagacgcagggcatccgccaaggcagttcccaccgggcaaccctgtgggtgtgctcccagccttggccagctgctgccttgagcacctctggatagaacgagtccagagcttgcaccatgccctccagggtatggagaactgaaaggttcactacacaacaacccagacacgccagcttagcccagacacgccaacttgttaattttcattgagaaataacgttgcagctttgtgcatttggctgtccactaaaatatgccaagtgcccagaaagcgcagagttgactccgtatattcgagtataaatcaaggtattgccaagtcaccaatgaaatatattctaacgtcacttgtaagatgtttgttttgaactggaatacactttttaaatagaattaatgttacatatagtggttaggtttccaggctagcctgcaagagtcttttaaaacctgtctgcagaaattctacttataaatctacaatgaaaaaaggtatttaaaaatttttttttaagtactagaaaatgtaaattcatagtattctgttttgattacacatttcccctggccccggccacagctcctgtgaatagctctctagcgcctccagcaggttagtgccacctctgccccagttcacgctcatcaaggtcaaggtgatagctcccttccgtcacgtgtaggttagagcaggagtctgcaaactcttcctgtgaaagagctttgcaggtgggactgccccttggcacttccccaacactgccagtgtggtgcaaaagtagccagagaccgcgtgtaggtgaatgaacttggccatgttgctatgtaaccgtgtggactgaagtttgaattttgcgtaacttcacatcacaaaatattgttcctttgatttttttttcaaccacttaaaaagtataagaaccatacacaggccatagaaaaacaaggctgagttcagctcagagagcctgacagtagggcacaccctgcccgcaccctggcctccaaggatactcctgtgagtcagagggcttgggattctcccacggattggacagatattttgacagtgcccccactgtgcatgctggggcacaaaagtacagaacaggcaaacccaatgccacctgtgtcgaagccagtaccatcggctctgggcatctcccacccctccctgcagaagtgggcgtcctccctctgcagccaaggggaccggcgtttactcaggttgactcctggccaggagtcggggactcctctttgtgccccaacacatccttctctcagccgggcatctgtggccgtctcctccccgcctcgcagccacctgagccagcagctctggcctggtggtcgcagctctctcccgggtctccctgcttccactgtggccctcctggggccgtgtgctcactgtggccttccttttttttctgagatggagttttcctcttgtcactccagctagggtttaatggcgcgatctctgctcactgcctcccgggttcaagcaattctcctgcctcagcctcccaagtagctgggattacaggcgcatgccaccacacctggctaattttgtacttttagtagagacaaagtttctccaagttggtcaggctggtctcgaacttccaacctcgggtgatctgcgcgcctcagcctcccaaagtgctgggattacaggcatgagccactgtgctcgactggccttcttctttcacaggaagcgacagcagcatcacccctcggtgctcacctggtgaccgtctgccaagggcctggtggccccgccaccctacctggcccatgctccatggggttctcggttcactctcgtccctccactcacacgtatctggccatcaagtaagaatcaaaataaaaagttgcacctggcctgcaagtgtgcagaaccgcaccttttgttgatccaggaagctcaagccaggcagtgtggcgctgggtcaccatggcaccattgagagcttccgtctgcaggtccccacgcccacagcacctccctttccccctgggcatttggataccacatgggcatctccccttctgctggcgaaggctacagaaagttcacagctgtggagtttccaggtggctgaacttgctgaggctgctgtttgctgtgcgcgtgccatgcctgaggccctgggtgctgtccacaggcaagagggactgcggaggccccgcccaactcctgtgtgaaacttagctcttgtctgtgatgagtgaatgccgttgttatcctcggtactggtctcggtggagtacagggcgaagaatcgcagtttcatttgagggccacccagacgggaagcacacagcagcctggggcccggacacaggggcttggcctccatgagttttctcctctgccggttctttcttttctgtcttctcgaaggagctggactccccattccaccatccttcttatacaatgtgattcctgacttttttttttttactggagaaaactgagttttattcgtatatcattcaaatcttaggaaatttgacaggaaagagtttcacaatgagctggagtttaggaaggaaagaaaacaaagtcgcccctgcaaagccagcctcattcatattcagtgaggtgtcactcacaccacctggaaaccaccgtgcttacctaagtgtttagaagtcataacttacacagaatcccattgtgcacagcacttccctgtttccagccaatttcttctttcatttcagccaaagaacagcaatctctttagtcctttcagtgaagattgcagaggctttcagaaccatggcaacctggagagtccatgtctccccatctttcctggtgccccagaagccctgccccagcgcctccccatctttcctggccccccagaagccccgcccccagcgccctccctgctctgccttccccagagcacttgcattcttacaccctcagtcacgtgtttcctttcttccccgtggcaatgaagccccttggctggtacttggcttcctttgatcgctgatggagcccaggttcccccagcagtgcctggccctggtggggcaggataaatgtttgtgaaactaaatgggaacccaggtctcagcactgtgtcaggttctagaatcttctttgatgtctccatcctgcttgtttctcactcagcccttcgtctggcctgacatccacaagaatcccctacctcaatccctcctatttccagtgcccccatcccaccaggcctcgttgccctgggtcttgctctctgcagaccacaactgggcaggccctctttcacaccagctcctcaccaccctccaggtgaagccttcgttaaaaccgcattttctgtagaggccaaaccattgtctgacattcaaggccttccttcagcctcctgccccccgtctcagcagcagccgctccactgcacctgcccgcagcacccctggctggcccctggcccggcccctctgccatccgtgcagctcagagccaggtggtcttgccgggaggttgcctggcccaccgccaggatccccatgtaggtgcctgacccagtacatcaaagcatgatgtcgccatttttaccaccacagtcctataaagttgtttcttgctaacgcatggatgtgtggacacaggcctcacctgtcccggcccccagcccatgcgtctgccctctgcacttatctgtgttcctgacggccacaagtggccgtggagctgctcaggatggaaggatggctggagacggtctgtggcctgtgtccacatgtcccgggacccagcctgaggtgccctcctcacccccagacacccatgcatgtggccccacaccatgtcactcccacgctcatccgtccagccccagctcccagctagagtgcagtcccatgggggaccacgctgctgtgtgctccacccgccttccctcccgaaaccctgcgtctcggccagagtccaagcacacccgtgctgagaggcgaggcgggagttaattctgctcgggactctggtggcctgagaaggctcttcccgcagaaacagcctcatcccgagagcgctggcaggaacgcagatcagaggcctgggctagatgggaccagttttcacgactctgctagatacggtgacattttttacggttttgaaaatgagttaccatagaaatggatccaggatggactaatgcaagggaggggagggcgagaaaggaacacagccctgcggagcctggagccggccctggtgcagctgtggcaagcgccctgctcacccagaggaggagctgggggccctggccagcggcagagccagaagccccgcaggccgcctgtgctctccacacctgaacacgggattctgcgggagagctggtgtcaagtcctgacccctctacttcgttccgaatctgggagccagaactactgcctttggaggaaagaggagcccggagacccgagcccagaaactggggcactgcccggctcctgggaggccacagaacagtggcggcccctgcaccccaggcctgcccaggcctctcagccgcacacattgcggccggctgcactgcggcatcattggtgttcacaggacgggccatagcaactgcttctcccttggtttattttttaatgtttcttaaagacggggtttcgctgtgttgcccaggctggcctcgaactcttgggctcaagcaatcctcccacctcaccttcttgggtacctagaactacagtttccttccttttttccaaggcatcgagaagctgaaagagtccttacaagccccgcgtgcagctccagagacccccagtagtgagttccggccaggcctcgaggtctgggtttcagggcagagaaggtattggtttctgcctttgcagaaaaaaagcctggtgctcgctcaaccaaaagaaaagctaggcagggtttttgccaaaggaactgtgtaggtttggaaggaaaaggcttcacaacccagaaactggagttactcttgtcagaagacggtggtgagaaaatgaacaacagttttccaatgctacaggattatgtttttaggacaaaagtccttaactaaaggccattatgatgtttgtctcgtaggggtactgaatatgctgagaaaacgatgcagacgcaccgcccacccggcccgggaggtgctgcgtcttccctgtgggcagctgcagggcccacggctccggccggcccaggaggagggagggcggagcggctggtcagcgtgattctcgtaacagccacaccgagttgtgggtgcagcccctgaggggtcaggaggggtcacaggaaaggggccgctgcggaagccctcggcctggggcactggttccccaggatggcagagggtcttggccatcacagactgggtgagcacatcagagggcgtaacccgctctgccaacccctcagccttggggtggcggctggcagctgtcacctgcaggaagactctgtcttctctgaactgctccgacagccggggagcttctgggattcagagtcagccagagctctgagtaaatttccccgccgtgtatgctatttggaaagctgtggccattgggctctgaacaataacttctaaaaccattcattatgatcttttattacttttagtctagacatgaaaataggttctccgtgcttacagggagttctgtgagtgccagcaggggccctttctaagctcaacatccccggtccctgactccctgccgggcaggacccaggcagccccacctccttcctggtggactcgaatccgatgggaagttctctgcggtctgttttggggactggcagattttacaacaggacagttcatacaacggagcctgagagaagattgtggccaaaccagggaaagacgtgaaataaagacagcagttccgtgatcacagcgtcatactttttactagtacatagttataaaatccactgtcactaaaaagactggcaaaaattagatttttttttcccctgttgagtcgcaaacagtatttcgactttgatataagtggaagtctgcacgaaggtcgacaacaatagcgttggccctcggtacgcgtgggggactcaagggcccagggcccacgacgctcagtcctgctaggaaaggcgtgacagctgtgcatcccccacacacatcccccatcgtgcttgcatcttctctagtttccttataatgccaaacccagcacagtgtgtcaacagtggttatgctctcttgtttttttttttatgtgtattactttttgttttgttttcaaatattttcgatctgcggttggttgaatccatggatgtagagggccaactgtaataaaaatctgtttttaaaaattagatgaaagtggccaggcgcagtggcgcatgccggtaatcccagcactttgggaggccaaggcaggtggatcacgaggtcaggagatcaagaccatcctgcctaacacggtgaaacccgtctctactaaaaatacaaaaaaaaaaaaaaaaattagctgggcgtggtggtgggcacctgtagtcccagctcctcaggaggctaaggcaggagaatggcatgaacccaggaggcagagcttgcagtgagccgggatcgcgctgctgcactccagcctgggcgacagagcgagactctgtctcaaaaaaaaaaaaaaaaagttagatgaaagtagcagctaatacatctcacacacacccccaccccgccctgcacattgccagggtccttacctggagtgtcctgtggagccctgacctagaccccgggtgtccgcgtctgtggcccccacattgtgggtgaggcttgagcagccaccagcctgcaccctcctcgcagtctgccagggccgccgggagtggggggcctcctgccgtgcctgccctgggttccgggcttgcccagtgccctattcttcacagtggcctggtcctcacccccgggtcttgtgaggagggttctcatataaggccagctgcccctcacagccccttcacggggcagtcgagcctcgtggggagctgcttcaatgcctcactcagctgtggggagcccaggaccccagaataatcaaggggagtgggtctcaggtgggcagtcatcaacgggcatcttacggggccatcctgtcacccatgttagagagtgtcgtggagctaggcggtagcgaacttcgccagtgaggccgcatctcctcctcaccagggcctgtcgcgggagggaattcaaagccaaatctcctagcccacccacccactctaaaaaaaaaaaatgaggacgcagccatcgccgatgtccttgtgttgcacggagcagttcctaggagccggctccgctggggtagaggagactctagggatgttcctacagtctggaccgattttacatttccgagacttgcttgtggatctacacggctatcgcagagctgtgcaatctgagagctggaaggcttcggttctgtcccagtacacgcggtgcaggaccacggttgagcagaaggtgcatctgcgtggcaccgtggcgctgaagtccaggtgtgcttgggccctaggctcccaagacgttcccactgcctcctcctgggcacaaggctcaagcacagggaccgccggccaggcacacatgtgtatgggcaagacccgcaggggacgtgtccctgggaagaatgcttcctttggttgaaggctgtaaactcgccctgtgaggtgagacatgtcagctcccagaaaaggtcccagcctctcatgattcacgccagcacaggcagcacagcagcagagcgtgacctcctagatggcagcgtgacctcctagatggcagcgtgacctcctagatggcagctgagctcaattccacacggctcagtcctggagacaatcactcactgcaacacgcattcctcatgggggcctcttcaggagccacgggcatggggcttccctgacctctgcactcacggtgggggcgcgcacagcaggggtagacactggcccgccatatctggagctgaagtagagcccgtcttgggctcgcttagcggagaccataggtggaggtgagccagtggcctcaggcatctgcagaacccacgcacacattgactttcgcacccgcctccatctccgtggacttgactgtgtcgtgcaaaacccactccacgtgcgcagctgtgttcctgcagtgacacgaggccctccactggctttcgatgcttcagctctttcaccaacaatcaggtggactggaatcacacctcactcgaaaccctttgaatctctatttagtgaacaagcacttgcttctcagcaaattgtctagcttccccaaaaataaagaagatggagttctgtgtggctggatcccttttcagctcccagcactgagggcagggccctgtctgcctccgcctctgggttgaagcctggcagtaaactggcactcctggtgcccgcaggcaggggaggcagcgcctggccccgctctgccctccacgctcagcgcctctggtcctcggcccagcccttgctggacatgcagcctctaccaggattgctgcttcccttctcggcctctctgggtccagcgtggcgtggacaacagttcggcaatgcctgctccatcagcctcctccctggcctcagccaatgctgactgtgccaggagcccacatagcccgtgcctgcccccccttctggtttccaagtgctcacagcctccaccccacaatctctgattggctcctgcaggcttccgtcaggtatcccccaaggctccgcgtccccatcacctccgtgttttattgttcaatgtcttagatcttgtttgtgctaccccctctcgctccacccctcctttgcccagagaatgatcctccttcccttcaaagcccagctccttcgtgcctcttccaccaggccttcctggccttcacttcctagcccactgctgacagaaggagtcactctcgctccttcctgcatctccctgaggccgcacgctgtcgtggacgtagcatggctcaaaggtttgatgggtgtgcgttcacatccttcatcctctgggcctcaccttccttggcgacgctgggggtaacacctgcctgtaggattgctggggaattaaataggaccgagcagccgcaccgacgaatcctcaccgacgaagcctcagcgcttccctccatgcccacgactcaccagtgttatttataaatgagtctgagtccctgctgggtcctgccttgtctgtctttgtatccgagtatgcagcacagaaccttgcattgagtgttgggtgagtcgggagaggcttagggacaaaagtcacagcacatcaacctttcgtgaagtcctagcatctcagagcagggccagtgcctggaggtggacaggaagcacgtggaggtgggcaggaagcactccctgggtcacagtgcacagcagcacgtgctgaacttggtgcagtgcagacgtccatgccacatgcaccactacccatgggctgcggcagctcctagaaatctaggatgtgacatcagacgctcctccgggagtgtggtcatgccctccgatccgctgaggcatttcaaggaaagttacaccctttccaacgcagttttccttttagaaagatttggcctcagtagatgaatccatgtgatcaagcctagtgatcagctaggattcttgaatctcgggacccgttgccagaataacaaaatgggggcttcctgtaacctcggctctttaaagcaacacttctgataccagggttagggtttcagaaaatgcagccgccttaggagcctcattggcagctactttccactaaaacatcttccatttctctctctcaggagtttcctttaacagtgtttacactcagatttggagagtcctgctgcacctggctgctgacccctatccagaggtctcggacgtggccatgaaagtactcaacagcatcgcctacaaggtacgtgccgggcgctccccaccgcgctccagctgctggttctcggttacgagtatgcatgccaggaactccaggtgtgcccgggtccacaccacagtttagaaagtaacaaaacgagcttcagcaaatatcttaaatctggagatgtacacagtacaccccaaactgtgtctgtgcagctcccacgtgggcagagggtgctggatttactgatgcctgtcaaggcaattaggggaggactgacattatctttcaggatcctctggtgtctgggtgagctacagtgctggcccttcttccattttttttttctttctttacttaattatttataagagatggggtctccctgtgttgcccaggctggtcttgaactcctgggctcaagggatcctcctgcctcagcctcccaaagtgctgggattacaagcgtgagccactgcacctgttttttgtttttgtaagacagtctcactctgtccagactagaatgcagtgacctgatcacggctcactgtagcctccaactcctgggctcaagcaatcctcccacctcagccttggaagtagctgggactacaggtgcacaccaccacacccggctaatttttaaattttttgtagagacagagtctcagtgtgtcgcccaagctggtctctaactcctcagttcaagtgatcctcctgccttggcctcctgaagtgctgggattacaggcatgagccaccacacccagacttttcttccctttctgatagcagtaatttttgactcattcaaaacccttctagttaatggtttcttattcatggccattctagctcaagggaacttttcaaagaatcagtttttggtttcattggtttttctctgttgtttgtccattttccatttgattgattgagctttcatcaataaagcttgctttcttctgcttactttgagtttaatttgctcttctcatcctagtttcttaaggtagaagcagaggtcattgattttagtcctttctctttggggactgtaaactcttctcagtcccttttgtgagctctgggcatttggcctaccgccttcccgctgttttttctctgcctcatgggttgtcactctacccttgagcagatgaatacttagtcaaagaccccaggggcctctcctgcagaccttggaagctttcccctctccagtgctctgtcctgcaaattgtcaccacctcagcctccctggagccccagtctctgtctcctgttccctgaaagtgctgggctccccgtctctgcactgtggcctgggactgcctgaaactacctgcaagccggacacagggcagctgtttatttccgttctctcagggatcacaagcccgtgacacccagcacccagtgtccaaaaacaattgtttacggtatttgtcctggttttctagttgcttatggaagttggatgatttatgtggaattagaagtcactcattatagcacttaaaaattttttggtaactttttgataaaacttcaaaagcttacagaaatgttgcaggaagaatgcagggaaaggccacactcttgcagcctctgtggtgttctacgtcttcatctgacctcgtcacggctatggcgttgcctcgggtatcactcagtgccagggtctgcagggtcgaggagccacggcttcccatcctagtccatcgctttttccaaatgagctatcgagtctccccctctcatttgctgtggccttctgggtcctggccggccatcgagccagggttcctgcagctcctcagctccttttgctgatattatacttctgtggctttcggttccttcaactaagttattttctgttggtctagttatatcttagatggaaatcaccttaccgtctgcagttggttcttcttcagttctttttttttttttttctcttgctctgttgccaggctggagtgcagtggcacaatctcagctcactgcagcctccgcctcccaggttcaagcagttctgctgcctcagcctcccaagtagctgggactacaggcgtgagccaccacacccggctaatttttgtatttttaggagagacgaggggtttcaccgtgttggccaggatggtctcggtctcttgacctcgtgatccgcctgcctcggcctcccaaagtgctgggattacaggcgtgagccactgcgcctggcctgttctttatggtatcaccggtatagtcacaagtagcctattggccaacttggaaaggtccagattgtttaattctgcaccggcctcccctcctgcagcggactctgccacttccttcgtcaccgcatccctgcagcggattctgccacctccttcgtcaccgtgtggtgtggccagctgcacgggcacctggagacgttcatccccaggcagcaggccatctcctcaggtttcttttatgtgctactggcctgttgaaaatagccagtcaattaagttaatgttttcattatgcggtaagaaaactaagaaataatataattatttgcttttaaactaggaataagataaatacaaaaataaacctcaggctgggtgtggtggctcacacctgtaatcccagcactttgggaggccaaggcgagagacgatcacttgagcccaggtgttttgagaccagcctgggaaacatagtgaaaccccgtctctacaaaatagtagcaagttagccgggcacggtggcaagcacttgtggtcgcagctacccaggaggatgaggctggaagatcccttgagcccaggagctcaaggctgcagtgagctatgattgtgccactgcacttcatcctgggcggcagagtgagaccgtgtcttttaaaataatgtttaaaaatatatgtttgttacacattatggtctgagaccaagaaggggaggcagtaaagcagacaggaaggaaataaggaagaaaagaaagtcataagactgcacaaacacccctgaggaaaccacccacggaggccccagaccagagcaaccggtcccgaggcctctcagatgagctgacgctctggaggattgggactgaaaccgtcacatctgcctgctacggattagggaaaatcagttcttaccacttaccactgcccttttagactctaaatagcctctaccacttttagtttaagatttcaaggttgggttttaaatagccgttttcactaaaatagttgtaaaagctttttacgaacattaataaatggtttaagtttttagaattgatggccagttcgcgtctctgctggcagttctctgacacacaggagtgtctggtggcctcttcttttctcttggaggcacaggatggctgtggccatggaccacccttgctctgtcctgactgcacagttggaggccagcgctatttaggaggtttgatcgttttcccccaattaatttagcttcttgggtattttgatcatgatgaaatcagtattcagcctatttaagtttatttttcagtggcttttgtgtatttaaccttactgaaaaattagcctgaattattttaaactgtaatccgagtgcctaatcttgaaatataaggactattaagtgcgttcctgtggacctggcctccagttgttaaatagctcctcttgggaagctctcgagcctgtgtagcacagaagccactgctctctgctcttcagcaaacgtcccagcacagcctccacagcccagcgcccttttggattgtgtgtgacatgtagtgtagctggacggcccgcccccctctcccaccacggtaaggcagttaagcacctgcgtctgcctttcatgttagcaggttatagcaactcgaacacacggctttgtcgtgctatccgattgagacccagaaaccgccataaaagtggcatttgccttctgtgcctgctttgccgttctagaatgacacagagaccttaaggcacatggccatcactccagcagacatgccacagccagaggggtggagaaggtcaagagaaggcctctgctagagaccttgctatgcatagcacaatgcagcatgagcttgtgtgtgtgtgtctgtgtgcgtgtgtgtgcacgcgtgtgtgtgtgtctgagtgtatatgtgtgtgggtttaagagtaaacattgctactaaagcatttggaagcataaatctttcttgtcttcattttaatttcaagaaatgccttattttcctgctctaggaactgaagggattacatttcattttacagagaaacgagcctattttagatatttaactctgaagccaaatttttgttcatcagagtctaaaacagccttattactatggaatgccctgtagaattctatattcaaatacagaaattgccaccagctctgtatgagagaacccacacagctccagagctgtggtctgatttcatgtatttataatatatttcgattcccattccatgggcttggggttttcattttgcttttagctcccttttctcttggtttagttttgggggtgttgtttgtttgttttgttttgagacagggtctcactctatcacccaggctggagttcagtgatccagtcacggctcactgcagcctcgacctcctgggctcaagcgatcctcccacctcagcctcccaagtagctgggactacaggggcgcaccaccatgcctagctaattttcgtattttttgtagagatggggtttcaccatgttgcccaggctggtctcaaactcctaggctcaagtgattcacccacatttccctcccaaaatgccaggattacaggcatgagccactgcacctggcctgcttttaggtttttttaaggaaaatttcagactatgtagaagtagaaagaagagactgatgcccctcaggagcctgcctgtggccccagcagttctcacctcagtggttttaggacaatgccaagaaagaaccttcaagccacaggtggtcacctgtcagggcacatgttctcatgatcactgcttatattataatttatgagaaaacgtgtgagcataaatgcacaaactcacctagaagcaccgctgcagcctcttgatactgtgaagagtgtgtgtgcatgtgcgctggccgctgcctctgttgcaggactcatgcatgcagacggagatgagaaaggggtgtacttaacgaaaggtcaaattgatggcagtggcagccagtctgggagcggccactgccatgatgccagctacagctggggaggtgtggccagggccgtgtgctccacaaagctggcaggaggcagggaccggtggaatcccacccccttccaaactggcagggtgggagcctcatgctccccaggtgcagctacagccacccagccacaactctggatccaggcatctctgtgctcttgggggccgggagcaggcaggaaccccaccctcccaggcacagctgcagccacccagccgtggctccagacccagccatctctgctcttggggaccaggagcgggcaggagctccaccctcccaggtgcagctgcagccacccggcatggctcctctgtgctctcaggggcccaggaagtgcccctacccctgcaggcttggaagcgtctgctcccgctccctggcctctccctgctcctggcacccacttcaatctcggagcaaagttgaggctgtacccaggtgctgttgcaaccagccggctgtgcacacgctcggggcagtgctcacatgccaaccacctgctatgtcagccccctctggactttgggcaccaacgagcatgggagggaggctgagggtggggactgagggcagtttggcactggcctgcaggtgcccctcggcacaatcagcctgggtgttatggatgatggcaggaggcagacagggtcctgggcagaaaggggcaggtccccagtgaagtgccaccttcaagccagggacagcctgaagcctgggggctgggctgatggaccagaatgggaacttttagtgctttttccaagcctgcccatggctgcccatgaatcagtcagcacatacttcctcccctttgaagcccataaaaaccctggactcagccagactcaaggaaacgatggcataacctgccttcagaaaggagctacccatgccggggtctcctctctgctgagagctgagcagacgttgggaaaaccagctgcagagaggagctgcacactccagggtctcctctctgctgagaactgagcagacgtcgggaaaaccagctgcagagaggagctgcacactccagggtctcctctgctgagagctgagcagacgtcgggaaaaccagctgcggagaggagttacccactccagggtctcctctctgctgagagctgagcagacgtcaggaaaaccagctgcagagaggagttaaccactccagggtctcctctctgctgagagctgagcagacgtcgggaaaaccagctgcagagaggagttaaccactccagggtctcctctctgctgagagctgagcagacgtcgggaaaaccagctgcagagaggagttaaccactccagggtctcctctctgctgagagctgagcagacgtcgggaaaaccagctgcggagaggagctacccactccagggtctcctctctgctgagagctgagcagacgtcgggaaaaccagctgcggagaggagctacccactcctgggtctcctctctgctgagagctgagcagacatcgggaaaaccagctgcagagaggagctacccactccagggtctcctctctgctgagagctgagcagacgtcgggaaaaccagctgcggagaggagctacccactccagggtctcctctctgctgagagctgagcagacgtcgggaaaaccagctgcggagaggagttacccactccagggtctcctctctgctgagagctgagcagacgtcgggaaaaccagctgcagagaggagttaaccactccagggtctcttttctgctgagagcagaacacttatcaggacagtctgcctccggagaggagctaccaactgtgggtctcctctgagctattctgttgctcagtaaagctcctcttcagcttgcttaacctccacttgtccgtgtacctcattcttcctggatgcaggacaagaacttgggacccaccaaatgtcagggctacaagagctctaacacaaacagggctgaaacatgccccttgcttgccactttgcagatgacaagaaggagagaagagaaaaggagagaagagctgcagcccttcagggaacccagacctaggagctccctgagatagggctgtgatgccatctctggggctctgcagttcctggcgtctccaagcttccaggtgccaccacgttccccagtgccagatgttgaagctgcttgtagtacacctggcccagccacagccttgcagggagcaggcacccatgccagtgcctagagctgcccacccccctgcagccagcatgcatggctgcgcacagtggctggaccccacattcactctcacacccctcaccactctgcgcctggcttgcctttggcaggtgtgagatgcgggccagcagtgtgagccaagcgcagcctgccaggctgaatgggcataacaagcccagtgggtccaagtaaaaactcgggcaaaggcgtcaccagccacagaggtttctggctggcaaagcaataccccaaggatcccatgacattttgatttacttataaaatgaagacctaagttactgataaagtaaataaacattggccgagtgcgatggctcacacctgtaatcccagcactttgggaggccaaggcgggcggatcacttgaggccaggagttccagaccagcctggctaagagtctctactaaaaatacaaaaattagctaggtgtggtgatgcactcttgtagtcccagctactcaggaagctgaggcacaagaattgctcgaacccaggagacggagattgcggtgagccaagatcacaccactgcactccagcctggcaacagagcgagactcttatctgaaaaaagtaaaagagaatgaaaataaagattgagatatccaggaaagcatattccaaagcaccaaacatcctaagcctgatgcctggcttcatgctttcgtagcatgagttacttatggataggtttcattttttttttttttgagactgagtctcactatgtcgcccaggctggagtgcagtggcgcgatctcagctcactgcaacctccatctcccaggttcaagcaattctgctgcctcggcttcccatgtagctgggattacaggcacgcgctaccatgcccagctaatttttgtatttttagtagagacggggtttcaccattgttggccaggctggtcttgaactcccgacctccagtgatccacctgtctcggcctcccaaagtgctgggattacaggcgtgagccactgcacccggccatggatacatttcttttaaaatcacattgtcatgccagaattttctctcctcctacttgacagcctctcttagaacccagagagcccggtctgtgtctccctaccctctgttctctcaagctgcctgaatcgtaaggatttcttaattcagcatgtttgcaattaacctctagaccaaagtagttctgcactgctaaaactgtctttacctctgaaattctctgaaatttctcttccagtgatctcagccgatctgcatatagatattctgatttctttttaacctcgtcaaatggcatttccttaactgagacagacagttctctgttgccaccgtgatccctccctctagaactgcacctctctgaagccattggactctctcccagctcagggcccctccgggaatcgtgagctctacgtccagcccctgaaggccgtgctgcccatcccacccctgcctggtttcagcggtggcctgctgtgtggaagtgtctgactgcctctcccaccaagccacgggcgtgcacaccctctgcatcctcagcaagcgttcacctcacctgtcttagttcctgcacctccaccacaaggatggatgctcagaacagtgggatgagccgccccaggaatgtggcatgccagcagcactaatgaacatgaacagcctggacacatgtcacacctatggcttgaaagcttgtcatgcacatgctcattcccctcactgcagacctggggaacgagggcagcatcagcctggactagcatagctacagaatcagatgtggccctgccttagagccacgctgcccaatgctggcccgtgggcccctgcccagctagagcagaggcacccctggatcgcccatccagacagagatgccctgttcccctgcggagatgcagactccaggctctggggtggcggccgggaatctgttctcagtgagacagtactgtgcagctgcaggcagcggctgccccacgagcaccctcgcgggggtcatagccacgagcaccctcgccggagtcatagccacgagcaccctcgccggagtcatagccacgagcaccctcgcgggggtcatagccatgagcaccctcgcgggggtcatagccatgagcaccctcacgggggtcatagccatgaggcactaggttggctcttggagcctggggctccttcaggcaaggacaagcaccagctttgccctgagccccattctagttctgctagctttcagccagtgacttcatgcctctcagcttgcatttctcctctataaaacttaaaactgggatcattgtatgactcccaccccctagggctgtggtaagaaaggcagagccccgtccctgtgctgcctgggtgcagcgggggctccatacagcaagctgcatcgtcagcactcgtgtctgtgtcctgtgccgcccaggtgcagagagggctccacacagccagctgcatcatcagcactcatgtctatgtcgccatcagctccttggccatctcaccatcctctgtggaaaaggggccacagcaactccagaacctcccgagccttcccacacacccgggtctgaggagggaaggagctggtgggctgagacacctcggcctccactgacgcggcgttctcttcccgcagcgcctaggactgagggcaccgtggccccaagtgaaattccttaaggcttcctttgtaactaatgggcatcttgttaagagtcaccacgttgctttaatggaataatacctaggacttacttttccaaaagaagagttcgtaggatttatctaggaaacgcagtttgcaggaaaatgacttgaagaaatagcagcacacgcttttgcaggggtttcttctcccccaccaagcagccagcggcctctgcgctattcttagcccaaaagtgcctctggataatcctctgggaatccctttttaagagtttctcacacatgaatccagatcctcgatataaaattaacaggaacatttctgaaatactccacttcctcccaagatagagcagccagaagctgacgctggcatccgcagccctgactgtgtcaagatccagtgggaaaattcactgtccaagtctctgaaatgtacggtattttcatctgcattggatcagacgcccccgtgtccttgtgaggtggcgctcccggaacaggagacagggtgggtctcattccagtccccgcttcagcagctgcaacagtcgggggtggataaaagacacctgcacctccatcttccaggcgtgttcatgtgcgcactggcccaagagagtgtctgtgctgagcattcgactgttagcaaagtcgtatctgccaccaccgaaggttggcttggggagtggaagaaaggccctgtcttgtagccgggaccttgaccctcttacagctgccgtcctctctggacgcagacctccctagagggcatgtttgcacacccttgacctctgcaggctgcgagtgagccggggctctgggggtgtacatgctgagaagggcgccgtgtcctccaggcaggcctgggcccacagaggctgtgcgggccgcactcagccctccagtttgcatctccaaacccagcctctgccattgccgtgccctctctgttcacccttcctggtgctgcgctctctaagatggtggcagggaccagcagaaaggactctccctggtcctctgcctttgcccctgccccagccagctctgcagctcctgctcgctgcgtaccctgtcctcacaccgacaccgcaggcaggcaggtctgccaggtcacctctgagggacacgctactcatgttcacaatcttggccccacacccagcgcaatcaacgctgagtaaatgttgaacaaataagaagtgcacagctaaagaaagctccctccaggccaaccccctgtggtcactacactaatgggggtggggggggctcctgatccaggtgtgtgtctgtctcacgagatttccagaagtggtggaaaattagttttgtgacagcagccccaggtacaagccatgtgaaagcaggatggtctcatcttataaccccaggggctgcgagaattcatgccgaggcccggatcagttccctgcctggaagagtgggcagagcagagggttcgtcaccacggctccatgcggtactcccacgggcgcttccgtgcagggtggcaaggcgggagctgcacagaccccaggcggctcagcgtgacgtcccagggctcctgagtcaccggccccagcccagcagcgcctgagcctttgtgctccgtgagcgtctgagcatgtgtgggttttgctaaaggcttcatttcaactccagaagttttctgtcttccccgtcacctcccactgtttttccagacattttgagaaggcacatataaagttcacagtcgaaaacttgcttttctctttttagacttttgaagggatcatatgtctggcaggttctgtgggatggttgtatgtgtctagggctggccgaatagtttaataccaaaacaaaacaagctcagaaagaacatgtattactcttgtcatttaaaaaataggaacgttgcttaaagacaagttatggttccattttcttgctatttgcgttttgaaggaaaggacaatctgggaagcgtgggtgttacatgagtgaagacttcaggatcgttttgttttccttggtgttctgttggctgaattgcaggttcaaggttcctaaattctaagtgaataattaaaagcatgagacattgcaggctccacgcggatgcggacctgaaggacagggttctgtctggctggagcgcagcctgggatgggccggcgctcagggaatggcttgtgcctgcgggatcagtgggcaccttcatggagcagctggccccatcctcctgacacagatgaggttgccccagcaccatcaggccccttctgaacgcgcacagcctctggagtccagaacccagcgggacccgcattccccccactgagcagtgtactcagaacaaaaccaccccgaagcacctgggccctcgcgaggtcatgtcggtggccgggcagcgcacgccctgccttgcgtggtttctcacggctgctcactaacgccgacagctggtctccagatccacagaaaaccctgctttaaaaaataaaagcaaaacctcttgcctcctgaatgccagggctcaagctggtacaaatctttttctgtggtagaatttcaagccctgcaggtgtctgtggcaggaggctctcagagcccagggtcttggcttcatccacagacggctgggttgaaggggtggtttggagcctcatgctgcccactaggctgtgccagctgtgcaccaccctgctccccaccctccgggagcagccatccccttcccctgccagtgcgcccctccccagggcaggtttcagccatgtctgccctggagatgaaggttccccgtccatgcagtgcacccagcaccacctgcgtgcgcccgtgggaaaggatgaccacagcccctcggccaggaggatgttaagggcggtcttgagttccaggccccgtcacagtccaggcagcagagcccattttgccactggagagagcccaagccccctgcagtcattctctgacagtttctgtggcctcctgaagcacacgggggtgtaaacagtggcctgcgtggaggcctcaggctgctggtggctttccaccccgtgcccaccggccaggtcccgggtggatgaagcactccctgaccctccgtgaatgccacatcgcccggctccggaaagagcatggctggtggattcttcccgggcctcaactcgcagcctctgacccgagagctgaggtgttggggagaattggactcaaggctgggacagtgtggaggcccagcctcaggcaagggggaggacactgaggccgccaggagccgcccctctggcagggaaggtgaggagggtgggccgtcatccatctcagaggcttcaggccctgacccctcaggagcctcaggcagagcttcctccccagacatcccggctcacacggccacgccagggctagcccagtggatgcatgtccaagagtaaagaataccacttgagcttcaggattgcctttgcgggggatccagctggggccttccattggtgttggtgcttcctcggccaaaggccttttctgtgattctgaagcggctccacgccagcctctgcttcgtgtggcggcctccgcggagcacgtcccgtctgaccttcacacccccattcctttgcccctaggccaccgtgaacgcccggccgcagcgcgtcctggacacctcctccctcacgcagtcggcccccgccagccccaccaacaagggcgtgcacatccaccaggcggggtaagtgccgcccgctcagcctgcaggtccgtggtggtgaccggggccccacgggctgagctgtccctgagccggcctccccatcctcctccttccccgccctgtcttggcttcgtctcctcccccctctccagcgggcgttctttccctctccctcccggacaccccggtacccgcctgatctgagccctgccttgagctctccccatcttgaggaacccttcatgtgcacatcatctcagcaaaagttgaatgaagcctggtctctgtggcctttcagagtttgtaagaggggatctagatctccaaatgggtaaccaacaggtgtttgcacctcaggacgtggcactgctgtgtgctgagctcgcacatcccggcccactcgactctgagctgggttcgtcctgtccgcgccacctcccagggtgctggagttcaatgagggacaaccctgccccctgccaggcgggcaaccgagcagcatggactcggcaccagcagctggggttcgggagccatgatggcatgctgggtgactgaggacaccccgggccctggtggcacctgggagggtgcaggtggcccaggaagttgttccatgttccctctcgaagccccagactctgcagaggatgcagtgtttgtttttcttccaatggcaggggctcccctccggcgtccagcaccagcagctccagcctgaccaacgatgtggccaagcagccggtcagccgagacttgccttctggccggccgggcaccacaggccccgctggggcgcagtacacccctcactcccaccagttcccccggacacggaagatgttcgacaagggcccagagcaggtacgggagcccggctgcctggtgatctggacactgagagcgttgcttctcagatgggggctcatggcctcagcctcaggctgctcacatcaccatgggatggggcaggacccaccctgccgtcctgggtctgtgggccactctctgcctttgcagacccgggtgctggtcctcactcgtgcacccctctgcctgcactccttaggagcactgctgggtgtgtcccggtccctctgcctgcactctttaggagcactgctgggtgtgtcccggttctccgcccctggttctggtttcaccattctgggcagcttccatgtaacgaaacaggagcacggagttacctggctctgcccttcctgggcacacagcactctgcgtccgcttgggggcagctgcactgcagagcatttgttctgaatgtgttgtcttttctgtgaacatccaagtacgctgcataaataggtacactctctttgcctttaactaagttgaaaaagatatttctggagagaggaatgcctgctttgttttgccagggttatgagagtggtgtgaggtggcagctggtccggagacctcggctgtctcgtccaggtgctgccactttgtcagttgagggcacctgggctcaagaaggtggttcagggcgcacccagcacacccagctgctctgggtgctgacagcatgatcatctcagcaatgagtggggtccggggctcgcttggtaatccagtgattttaaaagaagttagcggccgccttgcaggatgccctggagcaggaacggccatgttggggtagaagagctgtcacggcaagagcggacaggtccccacaggtgctgctcagccccagcccacctggactttccgtgtctcggcagaggaggagcgagaatcaccaccgagccccaagtgcagggtcagcctcctggccaggccctggggagcaatgctaccggcacgtgcagctcacccacccgaccccccggggtgggggggatgcacctctcactgcacctgccctgagatcatggggagctccctgtgccaagacacagcgtgagagacgccagcaggccacatggcgtggcacaggagacccctggtgcccagcctcactccacaagcacacacagactctgacagccctggccgccacaggttccacaacaggaaacacccaaagctcagtcctcctcagctccacatcctctttctccagtagctgggagctccagccggcctgcaaagctgtgcgctccgtccaggccacttcacatgggagtccccgctctcagtctggtgtcacggggccatcacaggagctgtcctggaaccaagcggcagaggctttttgggggttgataaaccagcacacatggacgcacgtggcattgtctgaacagtcagttagaattgacttgggagctgtgctgggtcggccctggggatggtgggaccgacgtggctcacacttcacagcccgggcccctcaatccctggccagacgttcaggggttcttggtcaccaggatacggaagtgagcagagcacagaagtgccgtccttaggggcagcccggtgctcccggcagcgcctttgtccccagctgcagctcttttgagctcaggagtggcatgactgactggtgtttctttttccttccaaccctcctgcttaaaccctgaagactgcggacgacgcggacgatgctgctggacacaaaagtttcatctccgccacggtgcagacggggttctgcgactggagcgcccgctattttgcccagcccgtcatgaaggtgcgcccggggtgtggggttcagagtagagtcctagcgaacatgtgtctgtcccacttctttgagcataaacgctcaaggcttgtggctgtgggagcgtcccattgtggtcgtggtagtgatggtcacggttgaggtagaaccgcagaagaaacaaacttcacttaccttcctgtcgccaaacgaaaagagaaaacctgcctcgctggagcttcccagtgtgacaggtgtcactttgccttaactgacagggtcaccacaggccttcccactccctaatggtgaggatcactcgaggcccatcccaaggccacgcttgcgtggctccgaggtctggggactgttagacgcagcctgctgcagccaatcctagcgcatttggggttacaccacaagaccatctctgaggctcaaccctgacacagccctaacaagcgccgtgtgctgtggacgcagtggctgtgttcctgcaggctggggcagggcggcggctctcggcctcttcgaggaatggggcgggagctgctttgtcagcacagtcccagtgctcatctctctgccagggcccagcagggactcgtggagattttctataaatctaaagtgcattctgagcaaacctgcctcttccctcatatataattgaaagctgaaactctcagcttattctcgattgtatatcaagcttgcgtcttagtcatctctgtgaatggtatttggaccccatgacagctcagtccctgtggtcctgtcttcatagtgaatgctgatttctgttcataaaaacagaaccatcaggcagcccctgaggcaggcaagccatgaagcttgaactacggagcccctttactgcaaagagagaggagttcgcctccctcttctcacatgaacctgggtggacagtggcctggctgttctagaaagcgtcttgccgggaagcatcaaacgccttaaatagccgttccctttgacccagtcatgaatctgctaaaatactgtcttgagaaaataatcagagatgtagatgacttccgtgttgtttctaagaacgaaaattgagattcacttaaatgtccacagagggtgaatagttaaaaagttatgaaatatttgatgagatattattggagctactgaaaagttaaacattaaaaatagtgtcctaaggaagcgctcatgacaacattccttaaaaagaaaaaatgcaaaatgcagaccaagaagccagatttacagaacaatcacagccgtgcttctcatacagacacagatgtgcatacgacggagaccagcagagcccgctcctaactagagattcgcaaatggcgccacccacgactgcactgaattgggcttcttttgtgcctcttctgcagtttctacactaagcacgaagcacctttagagtcgggggaaaagaatcaaagaaacaaaccccaggagatcattgaggctggtggattcagtcctagtcagaagcccctcaccaggcccacctgctgggctcaccgctgcttacctgcgggtggcatgagggtggcggcccctgcagacagagggaagtgccccttcccatcactaggaggcttctggttaggaaaggaaagcatacacaaatcctggaattggatgcaggaagcaggagccacccaaactctgagtgagccagagctgggaggtggctggacactgtgccaggggtgccaggccgtcctctagaactgcggcccagtctgttgaaaagtcaatggaatttagtctaatgttaacaagcttggtgtccttgatgcggtctcgtgcttaaggcagacaaggtcaggcgactaagaaacccacatggtctggtcttcgctcttgctgggatggcagtggctgtacatgttggtaatttcttggtgtgataacgagaggcttttcttgaagtccttgaaaaatgcctattctcagtcatctatcctatgatgaaagaggaatggcatagataatccaaaactcattgctcttaaacttaaaaatgaatttgacttttccccaaaggatttgctttcctttcctaagcatttttaagtacacagcagctgattgcaggaggaagttccccagaggcatgtggaaggccgtgtgtgtgtctgtctgtctgtctgtctgtctgtctctatgtgtgtgtgtgtatccctgtgtctgtctgtgtgatgtgtgtgtgtatctctgtatgtgtgtatgtgtatctcgtgtgtgtgtctgtgtgtttctgtgtgtctgtgtgtgtgtgtctatttgttccggtgtgtgcaagccccaagccagcgtctcctctccctttcttcagattagcagcccctcctccgcctgccctcatctcctccatttgcacatctgagaattcccgcccgcacggaggagctggagggtgtcagccttgtggtctggccctgccagcaggtcctgctgtgtggacactgcagaggagattagtccaaggggatccatgtaggagctgccatcacacaggaggttgatcaggaaacggttgctgaatgagtaaatgattgtcttcctctgcccctgccaagtatttgaaaacaaatgctcacttggttgtcgttgaaacaacaggctctgggtgtcatgatggaaaagagcgccgtgttgtggtcggcgtcgtctgtaactcctgatagcaactgcagtcttaggagtgtctttaacattagagaccttttccaaacttcagaagaggaagcaggacgtgttttctcttgtttaaaaaaaaaattgttttcctactttttctaggtggtattcataaaggtattcttttactgatttaattcatcatctaatgacatttgtgtaacgagctgcattaggaacttcttgttattagcctgcttcacatgtaaactaaaaatagctctaaggctaggattgaacctaaaaaagaacagaagaactgcaaacccgaaactgcttcaaggtatataagaaactaaaacagttaccaggtcacaaaataatgaccagtttacactgacatgcaactagcgattagcaggatgagcatccaaggacaccgtggtaaggacagcgtctgctaacgtttttattagttcaccgtcagatttcgtacaggtccgtatgactagaaagagccgtgttctgtctgcggctcacctttgattggtgaagcaacctcctttcttcccatgttggtttacggagctcgtgtctacattagaaaccacaaaagaatattaaaaatggtctgccgtgtgcttaagaaagaaaaagatgtattgaattgtgttctgattacaaaagtcatacaacttttttcttctctcagttggaaggtttcaaaaattgattctatccagagaatcaatccctacaaggctgtaggggcatgtgaactctcagacactgttggtgggtgggtccagtactccctttgcttagggcaattaagcagtaactgtcaggattagaaaagggtatacctgcaaagccagcaatcctgctaggaggcatatattcttaaaaaccactaatatacatgtccatgaaagggttctgcccggagatgttcatgataacatgatttgtaatgggaaaaagttgaaaagaatcacttagtaggagagttaatttaaaatgatggatccatgggttagaatactatacaaccattaaaattctttaagttgtatctttctatgaggacttggttggatgtccttgatccaaaaggtaaaataatcaaattgtacaaaatgcttgcacgagctctgtgcttctgtagactggaacaagcacgggaggaggcttggccagttacacagcaggctggccacacagtgacttctagaaggtggagttggagccaggcaaggggactgttctttttttcatcatttacttctggatgatttgaattttttagaaagaacagttattagttttgcaatttaaaacagactaaaataccatttttaattataaaaagctttaagagtcgatacgctgttgggaggcatcacacgcagaacccagtttatttcacacagcccttaaagctacagtggggatttccgtttggcggctccgcagagcatggggatcttgttttgccctgagagcatctgctcctctagggtggatgcggaagctgcactgcccgtcatcagatctgcggctgtgcagctggggtttcagtgcaccattagaaactcaggcagtgaaggagcgacttgagatggccatagtccccacgcagggttccctcccagcactggggttgccctgcctgcatggcttccggtcccgcttttctcactatgcagtgaacattgagcatcctgtcatagattctcccacaaaaatgactttttctgttttgttttgtttttctcctctgagaatgacactctgtgtgacattctttatataaacctgcagcaggcagagcctgagaagtcccctcgtgccaccctcagctcagttcatccttggctcatcctcggctcatcctcagctcatccctggctcatccccagctcatcctcagttcagttcagctcatcctcatccccagctcatccccagcgcatcctcaactcatccccagctcatcctcaactcatccccagctgctcctcagctcatccccagctcagctcatccccagctcatgcccagctcatccccagctcatgcccagctcatccccagctcatcctcagctcatccccagctcatcctcagctcagctcatccccagctcatcctcagctcatcccctgctcatccttagctcatcttcagctcatccccagctcagctcagctcatcctcagctcatcctcagctcatccccagctcatcctcagctcatccccagctcagctcagctcattctcagctcatccccagctcatcctcagctcatcctcatccccagctcatcctcagctcatccccagctcatccccagctcatccccagctcatccccagctcatcctcagctcatcttcagcttatccacttcagtctgctgtgggcttcacccgcctcaggaggacagctggctccaccccagctgcagcttctaaaatgggtgcttcctgttctttcctggaaagttcagaaggaaagcaaatggataggtcgattcccctccaggaagaccagaatagaataagtcgttggttttggatggaagctgcgtgaagaacacacttggtgggtggaagtgggagacgtagcttctctgactttgtttccactcagccaccaccagctggactctggtgctcgcagtctccgaggcagcaggacagcttcctcccacagctggggcagggaccgtgcagtgccattctgctcacctttctccacacttggctgtagtgccagcgcctgtctggtaaattactgctgagtgttaaacagtcaggggtcaggtttatcagccaagtcagacaggcttgttttagagaacactgtgattattcagtgttgtttaaattaaatacgtggttattctaaccgtgcattcttagagagtttcatcctggttttgcttggctgcacgtgcagagggtcctgtgggcagttccttcggcctcaagcgtatgggaaatattgctctggtaaaagccgcagcctggttccacctccgcctgcagacagctggaaagagcaccactcccaccttggaaataagaaaagggcagaaaagctataaaattctgacttttcctgaactcatcagagagctgaggtggcaggggaagtgagttgcccagcagggaagggaagaggtgcctccaaggagagccggaccatgagcaccagttccctgcagcagagcagaaggggccagcagggagaaatgctcacctgaaattggcagtggtttgcgcaaggctaaacctggaccaatggagaatctcaaacctttgggagccacaggctgcacaggccatggacgtccactgggccctcacccagaagattgaggtgggacacgagaagagcccctcagaggtgtgggcccgcagcaggctctcctgtgctgctccccacagaacataacctgcagctcctgatgaaagacagcaaaccctgtcgcccccagagcacaggcgaagacccactgccacagaagaactgcaaaagaaaaccttccatctccagcagggcgaggacctgccacgtgtggcacactgcagggagcaggacagagtcactgagaaggttccaccctgagacccagagacacaggccctgcctcagtcagagtctgggctagagcaacagagagcccttcggacccttccaacaggctagcaggctccaggcagcaggcacagcagtcgagctgtagcaggggcacaggagcatagagagagaagccccccaaggtgcagacacacgaggaaagccaaaaaccaagggagggtggggtgggaaccctggcaaaaaccctcccgaaacccaggccctgcttgaagcatgaggtagtgtgagaggaatccgaagctggccacatgctgagtgtcaccatggcaacagtaaaacccaagcccatttcagtgcctcgctagattgactgaactctttaacagtctagtaatagaggcacacccatttccaggcatgcatatatatatatatatatacaccttagtctctgctgttctacacatgaagtctggaattcattcagaaattaggagaggctgggcatggtggctcacacctgttatcccagcactttggaaggccaagacaagaggatcacttgagcccaggagttcaagactagccttggcaacgcagcaagacctcatgtctactaaaaagaacaaaggaaaagtatgagatgcccccaaaaatataagacaaacacgcctgccatcaagagacaaagcagagaaagacccaagggcaacccagatgttggaactatcagagatggagtggaaataaccaagattaatatgacctaaaggcattgacagcaaaggtagacaacaaacatgaacagatgagggatttcagcagagagttggacactaagaaagagtcaagtgaatgccccccagaggcctatctgtgacctcaaatagccaaggaaaaaaatcagtgaatttaaagacaggtctatagaaagtacccaaaatgaagcacaaagactacaaagagtgggaaaaaaacaaacaggattgcagatcatctgagagcttcaggacagtacaaagcagtccaacatctaaccacagatccagcaaagatcccaaatcatggtatatacagacacacacatgcacgtgcacacacacatatacacacacagctggacacatatctaagccaccacaaaccaaagataaagagaaaaccttgaagacctctggagcaaaaggacacattacttacaggggaacaaggacaagaatcaccacagacttctcattagaaactgtgtaagacagagatagtccagtaatatctttaaagtgctgaaagaaactgtcaacctagaattctgtacacacaaaaatatctttcccaaaagaaggtaacaagacaaacatatcctctcttgccacttgtcttcaacactgaactggaaattatagccagggaagttaggcgagcaaaagaaataaaacatatcatattggaaagaagaataaagccatctctgttcacagatgacatgatcctgaatattgaaaatcattcaaaatccattttaatagagtatcagaacttaaaaaccaatgcagcagtattgtacccacaagctcaatatccagtaaccatttgtatcagaatcccctacactagtaatgaaaaccctaaaaatgcaatcaagaaaacactttcatttataatcatagcaaaaataataaaatgcttaagaataaacctagtaaaagaaatgtaagacttgtactgaaacattattgaatgatactaaagaagacttaaataaagggaaagaaatcacacattcataggtcagaagactaacattaagttggcagaactccccaaatagctctacagattcagcaccatccctggcagccttttttgcaaaaattgacaagctgatactaaaatttgtatggcaatataagggacccagaataacaaaagaaaaatgtaagagacaaacatactgaacaactcacgcttcctgatttcaaaacttactacatagctgcactaattaagataccatggcattggcttaagagcagacatataggtcaatggatttgaattgagagcccagaaatataccttccgtcactgctttatgcctataaactctacaatttaggcgagatagacaaattccttggaagagattactacccagcgtcatttgatagcaaagagataacctgaatagttcctgtctattaaagaaaatgaagttttcttgctttgttttgtttgagatggggtctcattctgttgcccaggctggggttcagcggtgcaataccttccatcactactttatgtccataaaactctaaaatttagatgaaatagacaaattccttggaagagattactaccaaacgtcattcagtagcaaagagataacctgaatagttcctgtctattaaaggaaatgaagttttcttgctttgttttgtttcagatggggtctcattctgttgcccaggctggggttcagcggtgcaataccttccatcactactttatgtgcataaactctaaaatttagatgaaatagacaaattccttggaagagattactaccaaacgtcattcaatagcaaagagataacctgaatagttcctgtctattaaagaaaatgaagttttcttgttttgttttgtttgagatggggtctcattctgttgcccaggctggggttcagcggtgtgatcattgatctttgcaacctcaatctcctggactcgagagaccctcccacctcttcctccccaggagctgggactacaggcatgcaccaccagacacagcgaattttgaaattgtttacagagatggggactcgctatgttgctcagactggtctcaaacttctgggctcaagcagccacctcagcctctcaaagtgctgggattatggatgtgagccactgcatctagccaagaaaatgagtttttaactaaaaactcaacacagaaaacttctgacccagaaagtttcgctggcaactgtaccaaacctttaaggaggaaataataccacttctgcacaacctgtcacagaaaattaaaaggagtgaacacttcccaactcagtatatgaaggcagcatttttctgatatcaaaaccaaagatatcacaagaataaaaaacacagattcccaagtcctcagcatcgtattaacaagctccagccaggcacagtggctcatgcctgtaatccagcactttaggaggccaaggcaaggaggatcgcttgagtccaagagttcaagaccagcctgggcagcactgcaagaccctgtctcaaaaaaaaaaaaaaaggcattatacaaaaatcagttgtatttccatatgagcaattggacattgaaatttaacatcagtaccattcaaaatagcaccaaaatacatgaaatacttaagtataaatcttttttcaaaatatgtgaaagatatgtattctgaaaaatataaaacactgatgaaagaaatgaaaaggtctaagtaaatggagaccatgctcctggtttagaagactcaataatattaagattccagttctccctaaattgatacatagatcaatgcaaccccaatcaaaaccccaataggattttttttggtaaaaatagagaagtttattctaaaatttatggggaaaaggaaactaaaataaccagaacaattttgaactagaagaacaaagttagaagcctcacactatcttatttcaagacttgctataaaaaaagtaatcaagatggtgtgggattggtgaaaggttagatgcgtagatcaatggaacagaatagagagcccagaaattggtctacacaaatatgttcaattgattttcaacaaaggtgcaaaaacaattcaattcaatggagaaaggatactcttttcaaccattggtactggagcaattaacaaccagttgtcaaaaaaaataaaaagaagaacctcgatcagtacttcacaccttatacaacaattaactcagagtgaatcatagccctaagtgtgaaacctaaaactataaaacttctagaaggaaacagaaaaaaaaatatttctgaccttgtaggttaggcaatgtcttctttaataagatgcaaaaagtacaagtcaaaaaagaaaaaaacgataagttgggcttcatcaaaattaaaaactgctttttaaagacagttaagaaaatgaaaagacaagtcacagacagagcgaaaattataaaacacgtaagattaagatcttgtggctgttatacataaccctcaaaattccatgataaaggaaataagcagcccaattaaaaaacagtggcgaaagattttacagacaccccaccaaagaagatatacaggtggcaaataaggacatggaatgatgctcattgttaaggatcttaatcacgggaaagtacggacccctgcagtgagatcccactacacacctgttagaatgtctcgaatcttaaaatctaccaagtgttggcaagggacacggagcatctgaaaccctcattcttggctactgcaactacaagatgctacagacaccttggaaaaggttgtcagtttcttacaaagttaaacgtatgcctaccatgcaacctaaccattctactcctggatattcaccaagagaagtgaaaacatgttcattcagaaacctgtatgtgaatgtttatagtgactgtattcatagtcaccaaaaactggaaacaacccaagtttccttcacctcgtaaagagagaagctgatacaaccatacaatgaaagactcatcagaacaatatttaaataaactattgataaacgcagtggcacagatgcatctcaagtgtatcatgctaaatggaagaagctgctcaaaagactgtatcctgtatgatccatgtatacaacattccagggaaggcaaaactgtgtggaactgttctatatcttccacatttatcaaaactccgcctgtacctacagagggcgaaattcactgtacgtaagttacatcttcatcaacctcatgttgcggggagaagaaactcttttccctcttgtgctgaagtcacatgaaagatgatgtaaatgccttgttgaggagtgaacgtgcatagcaagctccgagcttcattcagagcttctcccccctccacagcttggcgatttgtggtaacacaaaggctgtgtccttggacgtaatgtacacgagacactggcagaatcaaatcacctctgttgcctgtggactcacgacgcacaccactacctcttccgcctcttcctctgctgcctctgtccacggaggggactttattgttcagtggggaggggatagtttgttgctaaaccgtggggaaaataataaaaagcgtcaaggggaaaagcacatcacagaggcaaatttgccctcacttcaggtcatcaggagctaagcgggtggagagggagggagctggcagtgtgagcgtttaatgtgttagcgatcttttcccatgggtgcctctccccttttgccttcacccaagtctttctcaatcttgatagtcatgtacctgttttgaattttatcccctgcaccttgaacctttctaaattcagagggattgaagataagactcagctctaaggctcccagattccccggataagaatttatcccaaaactgccccaaactgctgctttcccgtaagtcttctggggaacctctaatctccctttattcctgagccccaggtttttctttgcaacaggaaaggagttgtgtttcattggctttcagctgaagcctctgtgggaggcttcagaatcgtaattggtttctgtctgagtggaagccaagaggtacaggagtgtcaagatcctcatcatgtaacaggatcagcggcacccacagcctccaggagctctgtttacagggaggctcagcctgcactgggcctgggcccttttttactgaaaagcctttattcagcctgaagagaaacaggtggagaggaggcgacagagccgatgatgaagagctgcggtgtcatttgctgcctccgtgctgagcggcggtcacatcctagtttcccagggtgggtgcccgcatcttccacggcatctctgccttcccctggcctctccatccaccgctctccctcctgcctcacgccgcacctccacttctgcccatgcttgtcctgtgaccctcgtggtcatagctggttgtcctgacacagacacttggggtggttccggaaccgcgtcccgttcagaaagtctcttcccagcccagcaagggctgtaaaggaaggctgtgggctctctcctagagctcagattagggaagtggcggcccctacccctacaggcagaagcccctgggccgggagagggcccttgcagtgccgtggcaacaggacaagtgtggggccccctgaaacccctcagctcctgtctccgggcgtcctgtgcccctccctgttctggcatgggccccctctcaaccttgcagtcgtctttgttgtctttggagctgaggctctgaagccgccccatttctaccccccacgtctggattctttgcctgagctcaggcccaggaccatagagtgccgggccaaggagctggaattcccatcagttcctctcccttcccactcgaaagttccttctagactcttcctctaatttattcccagagaagcccgagtctcattaaagtgcaatgtctctgttcctgcacagctttgagtctttccaccgcgggttttttcttattactgttctatgttatttaccatttgtcatttcttttctaataagctcaggattgtcgtcaagtgaaactggttgctaagaatccacagtctatcccatttgccgttgcgggattatttctaaatcagaaaatgtgcggagggagccatttgacaccttttgtggttactgtttccgggtttggatgtcttttttgctgtgttgttgctgttttatcgagtgtggttttgtgacttttaagaagaaaaagaaggaagcagagcaatcaaatgctaggaactgagccacagccacccatgagcacggggtcagacatgaggtttggggcttgcctgtttctgttttgtaatcagagctgacacaaagcattcgaggaagagacacaaagaatgctctgtaagcatttgcacatgataaccacctacaacgaccgcctaaaactccacacggagaaaccgttttctttctccgccacatttacgtgcaaggacgcaaacacggccatgcgccatagtctttattcccatttcttctatcagagaaagcgactttttaataactaatgcaggctctctttttcctttgtcgagacagagttgcttttagccaaaaggaattagggttcttaccttgtttatttcatttattttatattttgggtcttcacaagtcttagtttcttagcaaggaacagaattagccagattgactggacggcatgtatgcttaaggaaatgcatctgcgtaacccagacaagtggccatcctcccgcggaaagtcaattaaatcctagttagtatttgccaagtgtggacctctcctagacgctgaacgtgcacaccccaacccacatgtgcgtgcacacacacagacacatgcacgcactcgcacacacgcacacacacgcatgcacgcaaaggccctgaagtgaatgaagacctttgctcagggaagagagggcagcagcatgtctagcgtctgcatatttcaagtgaaaataaacttggtctttctgaagctgtctcattagggaaggcactgaagttctcacgagttagtttaaccccagccaggcttgcagctcagcaccctcctagctcttccaccatcaggagcccagtggcaccccctctgctgcccaggaaggtcccacactctctcggggcccggcctggcctctcatgaggctgtcttccttctgtctcgtaagctccctcatcttccagccagctgcctggttccctttggcattagagagagaataaaggcagtgtctcctcaagcgcacctgcctcctgattgtgttttcagtgtttgaagcggcattcggtgcccccctgccctgctgctcagtgctgacctcagtgccccccattccctggggaggcgtttcccaaggccctggtccccatcatacacctgtcagcctcacaggccactcactcaagggtctcagagcccccacactagtgaacacaggcgtggagagcgcctctcccagctccggggagggaccagcgatgtgttttgtagcagacacaggacccacaacagcccgtgcctctggtgcactggccagacgagaagcccaaagccttcagcctttgagaaagaggtgccttcatctgaaaataactacagccaaccctccatgtccacaggtgctgcatccgcagattcaaccaattttggataaaaaaacaaatgtaaataacaaaaataaatttaaaataacaatacaacaagaaacaatccaaattttaaaaatacggcatagcagctatttacacagcgttgacactgtgtcgggtatggcgggcaagctagcgagggtttgaggtgtgccggaggatgtgttctgcttgtacgcagatgccacaccctttcgtattggggactgagccgcgcaggttttgctatccgaggggtcctagaacccataccccattgataccaagagacaaccctgtttcatcgctgggcttaactgggtgttttctgttgttgaagatcccagaagagcacgacctggagagtcagatccgcaaggagcgggagtggcggttcctgcgaaacagccgtgtcaggaggcaggcccagcaagtcattcagaagggtaagggcacccgcacagccagccaggggctcattccgggggtggggcctggggcgagggtcccctgtgagcaggccccccgcggcccacgcacaaccttctccagccatccactgtcccacgacagacccgccccgcaccccacctcccttgcagataagcacatcaaggctggtggagatgaagctgctgctcctcaaggttctgcagcccagagtggggaggggaggggccgggtgggaacccagccaccgcctgggaagagggctctcccgggaccctgcctcttcctctgcaagggcagccctcagccctcgggattatcagcgcaggtggaactcatggaggcggaactttgcatgttgacatttccggaagggaaggcctctgagagcccacatctccccacccggacaggtgtcgttgcgccaggccctacacatggcgcatccttccctggaaacaggaagtgaaaatgccaggccctgctttcctcagctggcctccacttgtccctgaaatggtggccagctctgtcaccccacatctcagtcatgattttcctaaaccttctcccagatttgccactagatgccaaatcgctcccttcacctaccttgttgtttgctctcccagctgcacccggggtggaggggcagggagcagccctggagggggcggtgtctgttgccgcagacagcggagggagctccttgcggaagggatccaggctgcaggcggccccggtcacagagactgtgtggggagcagggaggccctgagagtcaacacagcaatgagggtgtcaggcagccccatcccagggaccctggcctctccccaggatccaggagagtacaggggcccaggcccagccctacagccccactgagggcacggagcagcagtggtgtctccgcactcctccccctgccctcgcggccacaggctcccaccactgagccagctctggctgggggacctcaagctgcccccaaccaaatcagcaccatcaaaagtcaaggactctgaccccagtctgcaggtttattgttttgaccttgcatctttgtcctgtaaaattctggagattattatgggttactttctgaagttgaggttgatgacccgtaggacagatgtcctccctcctgccaaagccgagggccctgcccgcaggcagcacaggcgccatgagcgcgtcctcagcgagcgtgcctaggcccggctcacacctctgctctgctgatcaccgaaaacactgctgacttctggtaccagcaacgtttctgaagcgcattcccacgcagctctctctgtgaaagactgcggttcatctcgcattaacgcagacggtggctgttgtgctgaaagctaattgtggttgtttgtagccctctgtgcatctgaagagctggcggcagaccaggtttaaagcatcgcatgttgcaatccggtgcgtgctgccccggcggccgccgctgaaccttgcagccagggtggctttctccagcagagagaacagaccctgctggatgagcgtctccaggtggcggcgacaggaggctgttttcctggaggttagcgattctctaggaccccagcctgctagctgggatggccagcacacgggggctgcctgctgcctgagacaggcttgggagctgagtctgcctcacacagttcaacatctgaagatgagctggcccctgatggccaaggtgatgctctggcctggagcctgtggtcagaattgagcagggtgcgaaacagagccggcattcgagacccaaaaccgagatttctagaccaaaaaaaagaatatatttgtaaaccagagtttgtccagacacacaaaggaggagctgctgagccgctggagacaccaccaaatgaggcctcaagacacaggggatggtgccagcaggcgtggtgccagcaggcgtagtgccgggagtcactgaggagtgaggccgcgccctcctcccagtcctctgtcctcggaattcggattcggtgcaggcgtttattttcatttaaggagccaactgtgtgctgggaaagatgtgagcattgagaaaaaggaggaattgatgcctgtagatggaagagaaccagagaagtcggcgtcgcccaggagacggggttgggaaagccctgtgtcacgcaggcccctgcccggctcttcagccttctcctgggcaacattcacgaccttggctgtcacgcactgattttcaaacgtaccaaatgcgtgggctgggtggggtttccctttgtccttcagtgcttagaattatgcccaaactccgtccagaactccctgcagctgggaatggaggcaccactagggtaacacggtgctgccgccgcaccaaagccttcgggcctgcctgcctctgtgagtgcagcctctccttgtataacgtggcattcatttcctttccgtggttctgggtgtttgctggggactgacattgttggaaacagtagctcacccgaggtgccgagcacacaccaggcatcagtgaggcttcagcccgcagactccgtggccctggtgccacctggacagtgccaggcacaagcggaggggctgtcagctgctggaggtgggcggctttggctgtgcttaagcccagttcagagcagcctgcagcagagtgcccaagtcgcgcggctttgaccttgcaccccgacggtaggctccttctgttgtaggactttttaattcagctaaaaacagggtctttgtcacatgaccatgaaaaattaggctcccagacactttgaagggtgggaagggcagggtttattgggtgagaaggaaaaaacgggaaacagggcctccccgcaaagccggagtcctgctggtgcacttcccgcctcgcagattggatcccaggttctaccccagatcgggaggctgggctcctcctgctgcaaagggcgccaacttctgtggctccccccgttgtcccagtgtgcaggctggtgggagtttctctggggacccctttatacttggctatctcacttcctgccagagcacaagcccaccactccccacagggaagactggaggcgggcaacggtcctctgagccagaccagaagttcaggtgaggacacggttagtaagagccagtcaggtgaggacacggttagtaagagccagtcaggtgaggacacggttagtaagagccagtcaggtgaggacacggttagtaagagccaggcggtgtctctctgcaccacctggagctatgtctctggctgaggaaggcttgggggtccccaagacaccctcctggttgcccagaggccacacaggtgaccgcagccaaggccaggaggcagcccagcttgtgtccttggtgccacaacagacaatgaggcttatgcacccacagatccccagctgccctttcagtcaccaggatgtgttggaatccatcttgcgccctctgcatttttagcttccttttatggttccttctagaaaaaagccttttagagtcacaagggacttacttcctagtgctcgtgtttgggggcctggtggttaagtccacgttcccctcttctgttaaatctgtgattctgtaatagatccctcagtcaaggaagttcatagttaccattctagactgaaagacccccggactttggctgcaatgtggatcctggcgaccacacccatgtctcctccttaagtctgttacgaatcagagccctaccgagcttattctgaaactttagcactttcttcatataatctgacccagataaatttgtacaaacctgaccactgctgacaagtattggctgaatgcttccacatgtccagctcggcatcaggagctttgggggttttgagcaaaggcattaaccctgcggccagggcccctgggccctcattctgggtactcagtggctgccgtcaccccaagagcccagatgtgcctgctcctcagcaggtggtcaggcccctcccttcagtccctgcttttcttctgcttcctttgtgcctctccaagtccccaaggtattgacgtcggccatgataagatacgtcgtgaatatttattgtaaattaagactggcttgccgggcatggtggctcacttctgtaatcccagcactttgagaagccaaggtggatggatcacttgaggtcaggagtttgagaccagcctggccaacatggtgaaaccccgtctctactaaaaatacaaaaattagctgggcgtggtggcggatgcctgtaatcccagcgactcaggaggctgaggcaggagaatcgcttgaacccaggaggcagaggtggcagtgagccaagatcacaccactgcacttcagcctgggtgacagagcaagactccatctcaaaaaaaaaaaaaaaaaagactggctactggctgggcgtatgcccataatcccaacacttgaggaggccgaggcgggaggatcgctcgagcccaggaatttgagactaccccgggcaacacagtaagaccctgtctcaacaaaaaacaaaaaaaagtagccaggtgtggcggtgcgcgcctatgtccccagctacatgcagagttgaggcgggaggatcacttgagcaggaggtggaagctgcagtgagccatgatcacaccactctgcaccccagccagggcgacagaacaggacactgtctttaaaaaataaaaaaggggcccggcgcggtggctcacgcctgtaatcccagcactttgggaggccgaggcgggcagatcacaaggtcaggagatcaagaccatcctgtctaacacggtgaaaccccatctctactaaaaatacaaaaaattagctgggcatggtggcgggcacctgtagtcccagctactcaggaggctgaggcaggagaatggtgtgaacctgggaggcggagcttgcagtgagccaagattgcaccactgcactccagcctgggcgacagagcgagactccgtctcaaaaaaaataaataaataaataagggggaaaagatgctggctcctggatccactcttgtgtgtttcttttgacaggcattacgagattggacgaccaaatatttctgaacaggaaccccggcgtcccctctgtggtgaaattccaccccttcacgccgtgcatcgccgtagccgacaaggacagcatctggtatgcaccgcgctggtcaggcctcccttccggctgaccgacagccccagcgatgccctgttctcccccgatcaccactcctcttccttgaaaagcagatacaaggcactcaccccgaggcccttagcactgtttcctgagaaacggccctactcaccttctcctctttgaccgagccccacccacacctgccccgggcctggccctgtccttgtcactgaaggacagtccagagtcctgcctgcaggtcagaggggagtggcagggactccccagtgacacttgtaatagaggcgtacacaggggggccagcttgctgccctgcccgcagaagcaagcatgtgatagacaagcagtaagaagatgctaggtgccccaggagagaagtgagtttaactcacagcaaatatcgcccttagagatggagagagtacccacttcatgggggagggcagtgggagggggttccttttagagtttagagtttataaaatctctgtggttcacacctccatttctttttcctctttttaaaaattgtggtaaaacatacatagcctaaaatttgccattttaaccgttctgagtgcgcagccagtggcattcagcgtattcacattgttatgcaaccatcacccccattggtctccagaaccttctcatcacacaaaaccaaaacttggtccccatcagacaccagctccccattcctgcatccgcctgagccagtgtttcactttctgtctctctgaagtggcgcacgctaggagcctcataccagtggagtcacccgggatttggccctttgtgcctggcttattcggctcagcgcagtgtctttaaggttcctccaagctacagcacgtcagaatttccttttcatggctgagtaatattccactgtgtggatggaccacactttgtcttatcattcatctgttcatggacacctgggttgcctccaccttttgtctattgtgaataacactgctgtgaacattggtgtacaagtatctgttcaagttcctgctttctgttttttggggatacgcccagagtggaattgctggaccatatggtgatgctctgtttaattttcggaggaaccaccaggctgttttctgcaggaaatcctcttcccttcccacccgcacagcctgtggctccaatttcccacatccttgccagcactattattctctctttgtttgtttgtttggagacaaggtctcactttgttgtccaggctggtcttgaactcccaggctccaacagtcctcctgcttcagcctcccaagtagctaggatgacaggtgtgagccgccgtgcccggctgtggtgtgtggttttttgatagcagcccggtgggtttcaggaggtatctcactgtcatttgggtttgcagtttcctaatgacttttttattcctctcttcttcccttaagcttttgggactgggagaaaggggagaagctggattatttccacaatgggaaccctcggtacacgagggtcactgccatggagtatctgaacggccaggactgctcgcttctgctgacggccacaggtgagcggggtttgcacagccaggattggaagccagggtctggaggagtggcggggagggtgtgtgatcctgagatgtgtttgtacatctgtcttacagaaagccctgctcacacgcgagggccactgtcattcagaagtggggaggtttatgagggaaagggcttcagcagcagagacaggaaagcaaagatgaccccatccttgagggttccagggacttgtcttctcatctcagtcctctagcccttccagcaccaggaaaagcctctgacagcctctgtccttaaacccctgtgagagacccggtgggtcccacgtgacacccgagaatcagggaaggatgccccaagccacaacacgtgccaggtcctccccggccagggtctcctggcatcgctggctcatttgccagttgctgtccccactgggagctggcactcaccctcctccagtcccgtcctgcacctgaaaggacatcgttgaccatcatggtcgctgaccagtggttcattgccgtagtgggtctcactcaggttttggttttcttgggttttcggggggttttttggaggggtccgaaatgtcttagtttcatcttcactttggaacaatcgtttgtttccatgtcagttaccccacgttgacagtcattttcctttagcgctttgaaaacacgtgtccattgcctgttgctgatgagaagtcgctgtcagtcccactgcacttcctgtggagactagagagcgctgggcgggaggcaggcgggggaggccagcacggctgagagaagtgaaggccgacacccggatcccacccagcctgtccctgtcggccgcagcccctggacacctgagcctctgagagtgtcgagtcggttgtgctgacaagtgcgcagccctctcaacgcggttgcgggctcctggtgaggggcgtggccatggggacgtgtcctcgtgcagcccctcctccgagcgctgccccctcaggaccaagtagcatcaaccgatgtcgaaagcccgtctttgtccctgtagctgtcagacgtgaccgggaggagatgcatagtcggggcaggggccggtgggggcaagggaccagccaggctcagccagcggtttcggagagaccagatgtgagcatctcccaacaccagagggagagggcagttccttggctgagagagcgagcactggagcagggccagggtcctttgcagaacgggctccagacagcagtagaagggctccagctccaaaaccaggaacgtttggtgtatgcgatggaaagcagagagcgggacaggcaggtgggtggaggtgaggccgtcgtccaccagggcaatcagctggggcttgaagagcgcctgagggtcacgcaggaggggctggtgaggccagggggtgcggatgtggttcccggaaggctcagagtgcccgcatgctttccccacacccaggccgacctccctgcctgtctgctggaggatgcagagggccgtttcctccattctaagccctgaagagcagggcagtgcgtccctgcccacgtcttaggcggagagcccagacgtctgcattgtcccttcaagtcaaggctactctctctgtggagcacagagaggaatggggcggagggtgctggtgtcctctgtgaagctggcctttcgttctgctccctggcacaggctggctcaccagagggtaaaacgcagccccacccacccaaccgagcttcacccgcctgcctccctccagggaacccgatgccctggagctggagggaggaagggcagccccggctcccagggcagccaaacctcagagttgagctctgtggccagggtgggacaggattgtggtctcccatcccctgggctgcgactcctcctgctggctcgcccagatatggatctgaggacagagtccagtcggtgggcacccagagatctggaaccacgggtagtgagtcaggctggccgcccagggtcactgcagcacgtctgccaggaagggctcttaccaccacgcacagagcacaggccaggccatcgaggggcctggttcacatcctttcctctctccctccccagacgatggtgccatcagggtctggaagaattttgctgatttggaaaagaacccagagatggtgaccgcgtggcaggggctctcggacatgctgccaacgacgcgaggtgggtccgcccggctcctccccagagcagaatgtgttcccggggctgcggacgcactcggaattccaaggcccttctggggctgtctctaaacaggctgctccacctcagagtccccagaatcctaaagcaacagctccccgccaatgtccccgaaagcgtgagagccccaggtccctgagtgcactgcctggctggagtcccagccctgggcatggtctcagccactcgtgggtgcccctgtccccaaccttcatccttggcttgcagacatgtgctgcttgggacagcatcactgctggcagggcctaaagggcccgcatcacggggtccttctttggacctaaaattaggtctgctctttggacctaaatttaactcctccttgggggtcggggtgcacatggccatctggggcctcacgcgctcgctggcatgcctgggctggtgggacggagtggctgcagtgccggctctgggtacagttctgcgtgttgcctgcaccgctgcacggcctgggtgcggggcgaggcgcaggcccacaggtccttctggaaggactcaggcaggagttaggaggctcccggggtcaggcttctgggtctagatttccagaggcccctctgcagcaccaggcattcgcctctaggagtcatcgctcttcagcggatcctgcagcccttggcgatgctcagagtgaacgcgttaccccgccagcccccctctgccggctcctgccggtttgtgatttctgtgtcttcgtctgtggcctgtggatgtggccttacacctcgtggtcagccttccgtgtggggcctgccctggttctgccctaggttgcatggctctgtctccgcccttctgtctgagcacctgtcccgggagatgccaaccctcacgtgcctcgggacgtcatgggggcagctccagggtggacattgcctcgaacgttggatttttttttttaatgtagccatgttcttaagtttcatccagcaaaaaaaatcatccacaccccgcactccgtgggggccctttcctgttgcttctgtcctgatctctgggctctgcttcccctgcgaggcaaccctcttctggggtatgacagcttccctgggacagggcaggaaaagtgagccccagcccggggccctggtccaggaggggtcccgggagacagctggatggccagcctgggggtcaggccactcaccggccattgtgtgtctctccaaaagaccaattttggtgacactgtgtcatttgctagagaggaaagatcactgtttgataggctttccaggctgtttttctggggtcgctcagaggcagtggtgccatggaaggagctgggcttcagcacgggagcgcctggctgagccctggctctgccttgccctttctcttgtttgcttttgtgaaaacttccctccctgtccaaggctcggacctgccggaaatgcagtgctggaaggacacacccgtggctagccccggggtccatgagacccccctagaagcatccacatgtccatgcccagctggccccggggtccctgagaccccccggaagcatccacacgtccacacccggctggccccagggtccctgagaccccccagaagcatccacacgtccacacccggctgggcctggggtccctgacacccccagaagcatccacacatccacaccgggccacgctgcaggaaacaagacttggtggcctgtgctgccccacgggctctcagtctctccgggtcaggatggcagtgcccagcttacatatcaggaagcagcactgacgagaaaagcggccttctcggcccagaccctccagtgcttccttcagagtgggagcctgtgctgcacttcaggggtctcggggtcagagaacgaggctctcactgcgggggaaggcagcagaggcgtctcgccagacgtaagagctccaggccccagtccccgaaggctgtgccagctgtgggctggggcaccaggcacagctctgggctccctcaggttgcacaggacatgggaaacctgggtgtgggcagcaggcgggtgtgtcactgctgctgcggctttgctatgtgtccaggactggttcaaaccagttcactcggcatcacagaatctgaactgaaaaaggacttagggttcacctgactatacccctccatggcaggacgctcgggccgagggacagctgcccagagcctctggttcagatggacacctgaggcccagggtcgggctgtgccatgtcccccatgccggcatgtcactgtcctacccgggtacgtcggcctatgtgctggagacagggcctttacagaggtgattaaggtcaaaccaagtcaccagggtggccctaacccaatgtgcctcgtgtccttacaagaagaggccaccaggacacagacacacgtgcagggacaggtgggcgttcctgggacgccggctcggcactcacccaatgaggtcacggtgtcaagggagggcccgagttccagcaggttgctgggggatgtctcacgggcctgagggtaattatttgtcatcgattggagtcacactgcctaaatccagagccgtgaatgctgaccacagcacagccaccactcttcttgaaagtcacagtcaccaggacccagtgttggcatttgatagattaatggtattagcaggttggtttccctccgcggtattacatttaagggaataaacaactcacatgaacggccaagggctgaagacagaagtggtgctctccatcttcgtcaggtgctcacggagggcccacagcacatctgatctggtcaccacggggatccgtggagccgcagaggtttcatcctcccctggaactgaggagctcaggccctccgccagcttctgctgcagggagcctgcaggaggcccaaggcgtgacctccgcttgccccagcccccactcgcctctcccggacccgcttgcccagttgggcacacccagctcaggcacacgcaagccaggctccccacgtcacccctgagactggtgctttggaggctgtttcttgttttctggcatcttgaatgttctccatgtgctcgttctcaccttttccctctgtttgttctgctcgtgtcactgctgttcccagggcacctctctgttcttcccgacccaaggtgtcgcttcctggcagagtcaccaggaggatcgtgcctgggacgtggctgctgccccccaagtgaccatgcagtctagaagtgcagagcccagacccatgcatctctcccttctctttttcttttcttctttttttttttttttttttttttttttgaggtggagtctcgctctgttgcccaggctggagtgcagtggcgtgatcttggctcactgcaacctccgcctcccaggttcaagcgattctcctgcctcagcctcccaagtagctgggactagagggtcgcaccaccacgcctggctaatttttgtatttttagtagagatggggtttcaccatgttggccaggatggtctcgatctcctgacctcaggtgatcctcccaccttggcctcccacagtgctgggattacaggtgtgagccactgcacccagcctgtgcattttccaagttgtgcagccaccacctttatctagttccagaagattctcaccactccagaaggcggcctgctgcccattaaagcagtttcttcccatagattcttatttatctatttttgagacaggttcttgctgtcacccaggctggaatgcagtggcaccatcacggctcactgcagcctcgacctctcagggctcaggcagtcctcctacctcagcctcctgagtagctgggaccacaggcccatgccccacacccagctcccataagttcctcacttaaacagagagaaacttagaaaatgtctgtgccaagccaagccctctgtgcttgtggatctgccccaggtctcagagtggggcctcagggcctcctggcgcagcctccggatggccgtgcctccaggcaggacagcactgagccactaaaagggatgcaccaggaaccctgggcggtgtcctcctcggtcacccagacgccacttcccaagagcatgtccgggtgggcagcaagcattctttgtgattaatgtaggtaacagcatatcctgagggagggggctccagttctgtgtcctcaggctctgttggctgcacagctgcagcaggagctgggctcttctgggcagaaacggggaagtatgtgccctcccgcccggttgcacaccggccctcactgtgctcacaaggcctcccagcggaggagcagggctgcaagttgaaagcctgtgatccaccacggcgctcgtgcttctgacctgctgggacatttcttcctgcctgggttcaggtgtatcacagtagagggactacacttctttttttgtttgtttgtgtttgtttttgagatggggtcttgctctcactgcagcctcaaccacctgggctcaagcggtcatcccacctcagcctcccaactagctggaccacaggcgcacaccactgcaacggctaatcttttttcttttgagacggagtttcactcttgttgcccaggctggcgtacaatggcggatcttggctcactgcaacctccacctctcaggttcaagcaattctcctgcctcagcctcccaagtagttgggattacaggcacccactgccacacccagctattttgtgtatttttagtagagacggtgtttcactatgttggccaggctggtctcgaactcctgacctcaggtgatccacccgcctcagcctcccaaagtgctgggattacaggcgtgagccactgtgcccgggctacattggctaatcttttattatttgtaaagacaaggtcttgctatgttgcccaggctggtcttgaactcctgggcttaagcaatcctctgtctcggcctcccaaagtgctgggatcacaggtgtaaacacatctggcctgggactgcatttcaaaagtaaaataaagaatgtatgtatgccagcaattaacaactagaaaatgtaattataaaacatcatgggccaggcgtggtggctcacgcctgtaatcccagaagccgaggcagatggatcacctgaggtcaatagttcaagaccagcctgaccaacatggtgaaaccccatctctactaaaaatacaaaaattagctggacatggtggcaggtgcctgtaatcccagttactcaggaggctgaggcaggagaatcacttgaacctgggaggcggaggttgcagtgagccaagatcacaccactgcactccagcctgggcaaaagtgtgagactacatctcaaaaaaaaagaaagaaagaaagaaagaaatcatagacaacgggaataaaaactgcaagatacctaggaatgaatccaacaaatgcactttcttcacagatcaaagcataaactctaattgaagactataaaaggcacatgcagtgttcatggcaccatagccatggatgaaaagactcatcattgtggagattggcagttctcaaattaatctgtggatttattaatacacttttgattatattcccaggagagatttttataaaatgcagaccagccaaggcaatattgaagaggcgcagacggcattaagaagctgcaattgcagggcagccaggccaagaggcaccagggccctcagcgcagcagtgagcccagaagggccgcaagtggcagggtacctctgcgcactagggaaggagccatgttgctaaatggtgttgggacagctgatgccatatagaaaaggatgcagtgatacccctacctcacaccatgcacaaaacacatcacagtgagagacctaacctgtaaaagcctttcagagaaaaatcaagaggaaatcttcctaacagtgaggaacaaaaagacagattgaacaagagattgagggtaaagacatcaataggtttgactctacagacttcttcatgaccacaagaaaaatgtcacggttgtaatgtaagtggcagaataagaaaagatatttgcagtatctacgagttacagaatatatataaaaatatgtgcaactgtctgtcgtgaaaaaaaacggcaaacaccacacatcgataaggatttggggacattggcttgtgtgtgtcctgccgagagtgtagatggtcacccatttggggaatgaaatggccttccctggggagatcagagtcatgcaggatacatgactggcagttccgttctaggcgcttccttctccacccgcaaggacacgtgaagttgttgactgtgacatggttcacaaagccaggggcagctcaaatgacggggttagttgtacagtggaaggtaacgcaagattaaatgagttaaccagagctgtgtgtcttgggccagataaatcctcaaagcctaacattaaagaagcaagttgctagaaaataggccccattttgacactgaagaggttttttgaaatgtggaaggcatgttacgttgttgatgagcgtgcgtaagcaggaaaacctcagcagcccctgggaggcgccctcagcccaagggacagccctcccaggcaggcgcaggggcagacgatgcttttactgtgtctaaaattatgcttctctatgaaaaaaaaaaaaaagagcaaacaatggtaaaatgttagcaaagttagagctgagtggtgggtacaaggattactatggtgttcctttctgtatcttaaaatggttatcattacagttttagaactgaatctggttttaaatacaggccgtcacgtgaggtgggggttgctctgctctgtctaatccccacacaaagggcagcccttgccccattctctccgtccatcccttgctgacgccagccgtcgggagtcagccccttgctgtctgaaggctgccggcccgtggcccatgccgagctcctgtttgtctcagaagaaccggcttcctcaagctttgatagggccaaaaggaggaccctcatcttcaagccttaacagccttcctaaagtcacccagacctgccagttctgcccaggcgtccagacggcaggcatcttagacgtcgctgcaagggtctgctccagatggtgagcaccttagacagacgttgctggaaggcactgctctgaacggtgggcacctaacagacgttccgggaaggcactgctccggatgttgggcatcttagatgttcctggaaggcactgctctggacagtggacaccttagacagatgttcctggaaggctctgctccgatgttcctggaaggctctgctccgaacagtgggcaccttagacagacgttcctggaaggctctgctccgaacagtggacaccttagacagatgttcctggaaggctctgctccctctagcgatgcctggggcatagtcgagtcaggggaagactcagagttccagctcagaattgtcgccccagcctggacttgggagttccagctcagaattgtcaccccggcctggacttgggagttccagcttagaactgtcaccccggcctggacttgggagttccagcttagaattgtcaccccggcctggacttgggagttccagcttagaactgtcaccccggcctggacttgggagttccagcttagaattgtcaccccggcctggacttgggagttccagcttagaactgtcaccccggcctggacttgggagttccagcttagaattgtcaccccggcctggacttgggagttccagcttagaactgtcaccccagcctggacttgggagttccagctcagaattgtcatcccggcccggacttgggagttccagctcagaattgtcaccccagcctggacgtggggcacaccagggtccctagcgggagctcatatgaggcatatggacccaccagatgggctcgatggtggcaggggtaccttgtagctgctggccaaattgctgcccagagcaggccccaaagcctgcccaaggcaagggcccatggggtgatgccatgtcccactgtatctctccaggagctgggatggtggtggactgggagcaggagaccggcctcctcatgagctcaggagacgtgcggatcgtccggatctgggacacagaccgtgagatgaaggtgcaggtaaccatgcaggtgtcccccaagccctgggcctgtggggcagtgtgtgcagggctggtcctcgtcacagaacccagcaaagtgtgcggtgaggcctggccatcccaggggtggagtcagggcctgggaggacagtgccgggacaatgctgggaggagacgtgggctccctgaggcctctggatgaaggtgaactgcaacacccagccctgcgctgcagtatggctcaggctgcgccagctctgagtgtttgcaagtagtgtcttctctctgcaaattaaggaatgtcagaaatcagtagggtgaccaattgtaaattagaatgattaattatttggaggcgtttttttttttcttttgagatggggtctcactctgtcaccctgcgtcacccaggctggagtgcagtcgtgcaatcacagctcactgcagcctcaacctcctggtccaagtgatcctcccacctcaccccccccccccaccaccaagtagctgggactacaggcatgcacccacacgcctggctaatttttttaactttttgtagaaacaggggtctcagtatttgcccaagctggtctcgaattcctggctccggcaatcttcctgccttggcctcccaaagcactgggattataggtgtgagccgctacagaagacagaagatttttgtttctttttttttttttttttttttttgagacagagtcttgccttgtcgcccaggctggagtgcagtggcgcgatctcggctcactgcaagctccgcctcctgggttcatgccattcttctgcctcagcctcccgagtagctgggactacaagcgcccaccaccacgcccagctaattttttttttgtatttttagtggagacggcgtttcacgtgttagccagaatggtctctatctcctgacctcgtgatccgcccacctcagcctcccaaagtgctgggattacaggcgtgagccactgcgcccggccagaagcctctttgcttcttaaagcatctgctattttcagttttgacaaaaagcggagtacattggttttgcccaagacagcctggaaaagtggtagagacctaagcaggccgcgctcagcagaaatctaactgcattgacttcatttggagcagaggcgagaccacagatactgtgaggggcagcgcctgaggtggctttagagccagtattcccttcctctgggtccccagggagaggtgtggcacagaggccatacccagcctctctcccgggcaggccatctggtgtcaggagggatggctcagccctgctgccgtagagggcggtgtggagcaggcccagcagaggggaggcctgggcaccctcagctgctcgaagctgctgtggttgctctgggcagcagcagcccgagaacctggcccaggccttcccgtgtgggcagcctcccctctgacgtgaccgtggatccctcgaggcaccagcagctttcatggcaccttctttggggtgggggggtcttgcacctgtctggagctgtggctccacacgagacgtagccctcagggcacagcgtggacaccctgatcctcagggtctggtcaccagtgggggcttagaggcccaggtggcctgcggggcaggtgctgttcctgcagaggtgggtggaggcacagagcgcagcaggtgctcccagagccggctctgcccctcgcaggggtctggccccatcatccccacgcctgtgtttcctcctggagtgcacaacccagcaccgcccatcgtgcgtggaaagcgctctccctctcgtggcccttttcctcctgcgtccctggcaggtgccatcgcccccgcccccgcttctccagcacttagagcccccgagggagccagatgacccctcctggactcatcccatagctcattagaagttctgagacgcagccagtgaggagtccttgccaaaatgtgctttgctttcctttttaggaaacagagagaggttggaagtttaattggcactgacagccagtccttcccagaggcgtttgcaggcctccgctcggggtggggctggcctctgcctcactggctgggtcccaggcgcctcagggcctcagggctgtccctccagggccaagggataagggcgtgactcattgtcctgccagcccctgcctctccctgggactcctgggctccccaggcctttgatgcttccctggatagagagaaaggcccctgcagccagggagggtgatccccacagccaggcaggcagcaagaggggtcctggcgctgcaggacagcagggagggtggctcggtgccccggtcttcaccgggctgcctgtgtttggctctaggacatccctacgggcgcagacagctgtgtgacgagtctgtcctgtgattcccaccgctcactcatcgtggctggcctcggtgacggctccatccgcgtctacgacagaaggatggcactcagcgaatggtaccttgaccctgtcctctccctccccgagtgctggcagggtaccttccaggtggtagggccgtgtcactgccatttggttgggtccaggtttctcagtgagatgcaaagcttccccaggagcctgcagtggcgtatttaggccagtcctgggctccccaaagccgccaggcccgtcccactgaggcccatcccacaaaggtctgccccacagaggtccaccccacagcctatggaggagcacaggggacaggccatgtgggatgagccagtggactggaggcagaggctgtcggggtgaggcagggccgcagccaggcacctgccacctctgagctcacctgaacagaatactgccactgcctgccacctcctgggtcatgcagcaagtgtctggggagggatgtctgagggcacacacgtgggcacagcagccctgggcactgcctccactgagcacccctgtgggcaggtgctgtccgcgtctggcagaggacagggtacacgcatgggcacagcagccctgggcactgcctccactgagcacccctgtgggcaggtgctgtccatgtctggcaggggacagggcacacgcgtgggcacagcagccccgggcactgcctctgctgagcacccccgtgggcaggtgctgtccgggcctagcaggggacagtccgtcttggcccacacggctcatgcagcagaagtaaatttcacccagcacagagcgaggattcccagaaggtccttgtgcctccagcttcatcagctttaggtctgggattctcattcctgaccctccagtctgcacagatcggggagacacaatgaggagttttgagggaagcaaagcaaagggtgggcagggcctgggagcgctgcgatggccgcctggcccccgtctctgggcagcttccatgtggctcagacagtcctccagcggcctgacggtgacctagggcccagccctgagccagcctggggaggacacagggggtctctgctggagcaggtcacctggagggggctctgaccctgcgtgagcactagcccctcgtggggagcggacgggcgagggcctgcggacccgctggcacaggcagacctgggcagctcccggtgagagccccgaagggtggggacgtccttcagggaagccccacgctgagcgtgccccctcccctacagccgcgtcatgacgtaccgggagcacacagcctgggtggtgaaggcctccctgcagaagcgtcccgacggccacatcgtgagtgtgaggtgaggagcgccgatatttagcagccgttctgctgtaaaaacattattttcccctccatttaaaatacgtccttggtatttaaacagctggaaggggatggcatttcgggcagtaattaactcctgccctggaactggccagaaagatcaggcgcagcccgtaggggcccaggggccacagctgctcccctgctgggggacacctgacctgcaggcgctttgggaactttcctgggctgccaactgcggagggttccggggggagttgggcagctgctctccctccacgggcaggggtggcagggtggcaggggcggcgcgtctgccaggcacgtggcagttgtctgcacataaattcagttctgcctcttggtaaatacagcaccaagagcagggaatatttatttgcctattaaaggaagagcaagatgtaatttatgaatgcaaagccagcatttcttcaaagagatgctcttttcccccttgtttgtgatataaaaaccaaacataactcttgggatggacgcctgctgggggtggaaggcaggagccacggggcctcaaaagggccaggccatccctctctcgggccacagcctgccatccaggctctgtctcccgggactgcaggccccggttgcatgaaatctaatctctagctggaaatgaaaccaggagctcacagcctcctcccgcatctgtgctcatggtcatttctctaggccagaaagctccgcgccttttctggctctgagagagcttgtgggggacagccttggccctgagaccagtatgggtgcatgtctgggccccacctgggcagccctcactggggacgctgagcatccaggcagctttttccttgagcagtgtgtgtgcaaacaggtgtgcgaccccacacacctggttccaccgtccccctggccaggcccctcatggggcctccgggaggaggtgtcactgtgaccctctcttggcagcgtcaatggagatgtgcgcatctttgatccccggatgcctgagtcggtaaatgtgcttcagatcgtgaaggggctgacggccctggacatccacccccaggcggacctgatcgcatggtaggcgccacccacctccctggcctgcaccgctcacccgcctcgggcctctgtgcaaacgggaggctcttgtgttcctgcccccaggagctgaaggagggcaggggaggatttcactgctgtggggacataaaaacaaaagatgtctgcccaccacatcctcccaggataaactctcagggccctgccaggcccgagtcctcagtgagagtgaccagagggtcacacctgccccgagccagcctgtccccgtggtctagccggcctgtccccgcggtctcggcatctgcgcccatcttccatcctcaaagaagagggcagtgatgccgggaccctttctctccccacagtggctccgtcaatcagttcaccgccatctacaacagcagcggagagctcatcaacaacatcaagtactacgacggcttcatgggccagcgggtcggcgccatcagctgcctggccttccacccgcactgggtcagtgtggcggtgggtgggggtcgggggtcgggggctggggtagagggatgggaggcaaggggacaaggcagcaggggtcctgcctggctaccccacaccacagtggggcccattggctgcctgagggagggacttgcctgggtcccaggatctctagggcccctgccccaccctgcactcgccccggaagcagagccccagtcccgtcactccgggaggaattgacacacagtggctggggcaaagctcctgccctcagaccctgcactaaagccatccctggggacctccaggagagtcgctcggggtgtccatccctgtgcggccctcaccccgtcccctgtgcggccctcaccccgtcccctctgcggccctcaccccgtcccctctgcggccctcaccccgtcccctgtgcggccctcaccccgtcccctgtgcggccctcaccccgtcccctctgcggccctcaccccgtcccctctgcggccctcaccccgtcccctgtgcggccctcaccccgtcccctgtgcggccctcaccccgtcccctctgcggccctcaccccgtcccctctgcgtccctcaccccgtcccctctgcgtccctcaccccgtcccctgtgcggccctcaccccgtcccctgtgcggccctcaccccgtcccctctgcggccctcaccccgtcccctctgcggccctcaccccgtcccctctgcggccctcaccccgtcccctctgcggccctcaccccgtccgctgtgcggccgagtcctcaccctgtcccctgtgcggccgggccccacctgcacggctctctggccttggttgcagcctccccacgtggcttcaggccgttgtttttagattaggattctgcccacctgccgccttgtgttgtgaggctccaggcatgtagctctgctgacacgtgtgacattggatcccagagctgccccgtggggcagtcctgaaaaaaccacgcagggcccggggcagcgccacgcccctcacggagtgcaccatgcatgggccctgcagaggactggtgggaccggcccggcatttccgggcctgaggtgggcgtgggggttcctgagaccccggcaggagctgcctaaggatgcgggttggcctgcgcccccccgccccccgcagtgtctgcccgcacctgaacccctgctcaccccttctctctccttgcagcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaaccccccgacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccacgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagacccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcagactccg

SEQ ID NO: 386 - DNA, 421549 bp, Homo sapiens; identical to SEQ ID NO: 385

SEQ ID NO: 387 - DNA, 98858 bp, Homo sapiens
gactatttaacaaaaatatttaatgctgccaaaaagtataaaaatacagtaggaatggcagtacaatacaaagtaatctcccctaatttatttcttgtacatctttctacatttcatacactcattaaaaacacttaacacatccaattaaaggttctgcaaagtcttctgctggtgggtgctcttcatcccctggatgtaaagtttactttgtaaacaaacaactgtgaggcaatctagagggttagcgagcctcactttagtttccggagtgggcttcaggtcttgctttgcacatcaatggttcaaaatttatagctgcagaatattctcaagtcatgaatattaggtgtctgtcaatcttggcctaaaacataaaataagaagtcatctattcaattcatatttaccaaacacacagacgaacatagatgcacacaaacataaaaggactaacaatgaactgaaaaggtgaccaaaaatcattcccacatgacacattcaaccacactaagtgctgcactgttatcttagggtaaaacggctggggtgctggatttccaaacgatggtggtgtgacgcggcctcatgtggaagcatcgtgacttatattcttcttcaagaattatgtgaattcttaaggtcatcttattttactcaagaagtgacctctgtgtgataccgacagacagacaggttttaaaaataatgtacccacaagaatttagcaagactttatactatgtgctagacttaccaatactttggaattcaatgcaaaagtctaatccaatttggacctccactgtgtaatactgctaaaaatattatcaacataatgtttgaacataaagttggcctatatttttaaaccacaggttgttagcagatgctttttgtcctgaaggataatactaacaattatatctaccgaaatgaagtgacccaatcttaagctactactaatataaaatacataattgacagatttattgtattttaatgccataaagtaaaaataaatgagaattcaaataagcaacagatggatggaatgactattgtaagggcagttgagtttttgatgtcacctcccaaactttgcaagtaacaactttttaggaggtcaatggtatttccattcttcccccaactcccctcagtaccgcaaaacctccaaatctaagtacttgtcagtattgtatcttcacatatatattaagaaataggaaatacaaatcatatccacacatttagtcaaaaactcccaaatgctgagaattaggctactccctttaaagacagggcacttggcataattgtaccaagcaccttggtgttctgaacgtcctttttttctctgattatccaacagtgacggagaaatgtcaagtcatcaagaaaacattctcattagataatgtgagcccacaactactatgggtgtttattacatgaatcttcagaatgtgaaccaaagtggctgaaggtactttgtattgattctgagtgctgcaaaatatatatgttttccatgcatccagaagtctttttaaaataagcaactcaattcaatcaaagtgaatgaagtaatgatctggtttagagaatactctgatgttctagtatttctctgttgcagtggtagttcaaactggtgcacaaagttttttaaatgtgctccatttaaaaactagagaattactttggattttaacaggtaagagtggttgtctattactttcccacttaaatatctcatttaaatattccattaaaaacagagtccgtgtaacataaaagaaaaagtatgaggtttggagttactggaagtctacagactgcagagtgaatctcagttctgtcatgtactagctgtgcaatcttgggcaagttacttattctttgactcagttttctcatctgaatatagggagaatgctgtttacctagaagaggtgttacgtgggttaaatttagattatgtatttaagctggctggcagaattttaagtgttcaccatacctcatgtccttccccagtattttgttacagatatacttaccaagaatgaactatcatttataacaactgaaggacggggtttttaaaaattcacgttattatttctttgtaaatattattcagggtgggggggtaagaaaatacggttaaatcattgggaggcttaattgttttaaagactttacttgcaagactgaaaagacaaatgggctccattttagaaaattctaatagattcacttgaatcaatttttgctatttttatttaaaaaggcaaaggcaggagaaacgggttcaaataagtcaaatgaaacaaacgtggtgctttctgtggagacagtggctctgacacaccactttatgctagaaaggcgcaagggccgggtgggtgtggacagagggtccactaccaagtcagctctatgcctgaggccacgaaaagccaaattgcaccaagaataggttttgccaccagatatccacactaatattctactaaactgaattgaggctaatcagaaacttctcttaaggtgcaaagatgctctacagatgacttacctaggttcccgctcctgaattaactaaactcaaaataactgaagtttttaacagcagaaatttgatgtatcaagagcaacctgtgtctgaaaaatatgccaaattagagccacaataaagaataacttgatgcgtctttaaaaaatggtctgtataaagaaaaaaattcctgtgcaattcttggagctcctcaaaacatactgtataacgtaaaaccagaaagtcgtgaagcagtttctgtaacatcttcaccaaattgcataattcccaccttccattctaaatttaaaaaaataaagtaggaagagttcaaaagtttgaacttttcaaattctcccaatggatcgcccagagagggggatcagggcttttttttttttttttttttaaatagagtggggtttcaccgtgttgcccaggctggtctcgaacccctgggctcaaatgattctccagcctcggcctcccaaagtactgggattacaggagtgagttaccaagccaggcctggtcagggctctttgaaatgttttccttgtcagactgttaccctttagagacaaggcctcacaaaccaagtaaacacttctatccatcactccttacagtcggcgatggcttcatgctgggctaaatagtatacaacaggagaaaaggctcagcaatggcagtgaggaaaaatgctcccttccctgaaggacaatgagtctttccagaacccagtagacaggggagacagccttaggagaaagcacatgtacagcattgctcaatgctgttcttggagcaatctgaatgtgctaaatattcagaaaattcctgctgccgagggaaaaataaccaaactcatactattttcctagaagttcttacttaaataatactacccaaagaggagtgaaaagcttaaattctcaaatctggatgaacaacataatggctgtattgggagcaggcacacagaacatagccactgagtgtacagttttggaactggagagctcttggtagagcagggattgaggagtccacacaatctgagctgctttccaccaaggcatgtcaccccttatacatattcactggaacaaagacagctgtattttctagtatatctgcacttctaggggcaggtgggattacaggagtgagttaccaagccaggcccagtcagggctcttggcaatgctgtcccatagacactgctttgaagatagctataagggaaagtggaattgaaacgaaacaaatgaactggggagaaggatgagtggaacaggtcaactccagagtaaaccatacaggtggtttttaaatcgtgaaaaaatacatttctattcttcaaaattttatttataaaattctaggcctctaccatgtaaatatgccaaagccaaataagggtttcttaaaagtaaaagagacttcattagctgttggtgtatcaatgggaacgcagaacaggcatttctgctgtgcagttagttctgctatgcactgtgcgtccagcacagccaggcgagggaggacctcagacatctcccctgcagggtgcaacagactgagagcaatctatgccccggctacacatcactgagaacccatgtgtgcacctgctagaaaaacagataaaccaatgtttatagaactggaactcctgcctgaacacagaaagaaatggactacatgcctaatgacatttggcttataatagactacatttttaaaaaacatatatttataaataatctttaaaatatctttatttttatatctattttatatatctctctgtatgtgtgtgtgtgtgtgtgtatatatatatgtatgtatatatgtattatgagagacagagagagagagggagagagagacaaatatacagagagagacaagtctcctctactgcccaggctggagtgcaatggctccatcatagttcactgcagcctcaaacttctgtgcttatgtgatcctcctgcctcagcctcttgagtagctgggactacaggcacgtgccaacatacccagctaaatttttcttttttttttaagtagagacccaggctgatcttgaacaaactcctgggctcaagcaatcctcccaccttggcctcccaaagttctgggaatacaggtgtgagctactgtgaccagcaaagatctctttaaacatgtgtatctgaaaagtaaaaatcaaggcaggctagatttttaagtctgtacaacaaccaggcaggcaatttgggaatgtaggtactcattatggtatacaatagtcaaccaaaacacttttaataccaccaggttctggtctggaactagatatgtaatctagtcagggatattttttctcagagggaagtgagttgcagttgcagtcttcctttgataattatctacttctaggacatgttacacatctgagacttttcaaagacagcaccataaaaggatggagaaatgccagtttcaggctaacaataactacttcataaaattgtgttgaggattaagtagggtaatacgtaaagaaaaaatacagtgtctggcatacagtaaaccatcaataaatggtgctttgaactgactgttgaaagcaaaggagttgatataaaaactggaagactgtttcatatcataaactgctttttaaaccaatacacatttttcgattcataccaccaactttagtttaagacaaagaggacaggcacaagtgcacattagcttacagtcagaaccccttctgctgacataccattaaaagaaaatgattaacacattttttttcttcctttctcttttcttggtcattccttggtagaaatattaaaacaataatgaaatggactaagaacataaaaggaccaaaagacagaaaacctcacaaatgtataaagtctcctctaacacaagaaatggtctaaagtcctccatgtgcttattacatgttacttttcttaaccctttaagaatgcagaaaatgggtattttcatttttatatggatacattaaacatggagaattatatttttacattctatatatgtgcaagcatagataaaactcagtcataggctaacataaaataaatacttggttaatattggaaaggaatatataacttgttggtgtagctagagaacacagcattaaaccaaaggttgctgtcaatctattagcagaaatagatatgagtggaaatgaactagatatgaattaaaaactcctgaaaataaaagaaacattttttttataattttttcttccttaagcaacactacatcattcaagtcaaagtatatatctgactcttaaaatctgttaaaattagaaaatatttaatattatgaggacctaaggatacaacaagttttttaaagctgtagaacccatctagaattgctaactttttcctctggctgttaccagagaaggcagccacgtctgtctctttgaccagcacacctcattcaataaaaagtcaggactttttatcatgggcacaacacgatgtcatgtgttttcatgacatccaccaaaaaatattattactggtaaaaactgaacactatttaaagcatccactgtcaatgcccttctcaaggatctgctcagagaaggaaagatgactaaccttagaagtgtaccaacaagtgttcatcacactgaatgtggttttaaaaatatatgcgacaccacccagaaggacagaaagcatacagaaagcaaagcgtaagccaatgaagcgcattcagccagctgaggggtgaggcacgtcctctctggcactggcttcctcaagtcttcacctgtgtaccgaaagcaagcctagtttcaactggaaatgtcataaggtctacctgtatgtgacttgcagagtaacataaacatactgcatttagcaaagacaaaccaatgcaaactggaaagaggttttaaaccaataacaacctgaaatgtaagggtcttggatgcctcaacacaggtttaatgcagacagacataaaaaaatgtccctcttacctcctctccatttcaaggttacaggacacagtaatactgaatcaggacacaggcacatgttatataaatcttatttaatatgtagtaccacctacatcctgctttcatactttcaacataatttaacacattcaaggagactatgcaaatcaattcaaaatatctatctataccaatggttttcaaactttttttttttttttttttgagacgaagtcttgctctgttgccaggctggagtgcagtggtgcaatctcggctcactgcaacctctgcctcccgggttcaagtgattctcctgccttagcctcccaaggagctgggactacaggcatgcaccaccacgcccagataatttttgtatttttagtaaagaagggatttcaccatgttggccaggacagtctccatctcttgacctcgtgatccgcccgccttggccttccgaagtgctgggattacaagcgtgagccaccacacccggcccaaactgttttttttgtttgtttcttttgagatggagtctcgctctgtcgccctggctggagtgcagtgacgtgatctcagctcactgcaacctccatctcctgggttcaagcaattctcctacctcagcctcctgagtagctgagattacaggtgccctccaccatgcccagctaatttttgcatttttagtagagatggtgtttcaccacgttggccaggctggtcttgaactcctgacctcaggtgatctgcccacttcagcctcccaaagtgctgggattacaggcatgagccaccgcgcccgaccaaactgtttttaaatgataactgccccctttaaaatacttaagccttatgcagaaatcttatgtggcatataaagagacaaggcagagatgctgtggttgaaagtaacctcttgacccacctggacatccaatgagcatagtttgaaaaccactgaaataaggtatgctatccataataatgtatgctatccatgcctcctagcaattaaatttgtaacaacaatttcaagtttaagtaagacaaattaaacactgaatggaatgttgaaatctgaggaaagctagcattcaaatgagcagttaaattcattaaacagtttgctttaaaaaatattcattaagttaaaatgacaatgtaaggtttgcatataatcatactatttattgaagtagaaagaaactgaaaagtgtttacttcaaaacttcagtctagtaaactgaaattatgaatcataaaatgctgcttcttacttttgcttcctaaatcataatctaccccaactacattgaaattttcatgaaaaataaacatatcaataatgggatttacagaaaccaatttctttacaaagtcttgaccaactgtttacctgactatcccagtaaggagaattttccttcaaagatatttttaggaaaaacttttgtttctttgtttgcttttctttttaaaatggggaaaactgtaaaacataaaagaaatgcaatatatagtagaaattgcttattccaacttctaactgctcatatcaaacttctctttagaaaaatggaaaatgtatccagtacaattcaatcgacatacaatttatttttttagtaacagatttttcaaattgagctcttaaaaagtacagttaactacaaaagattaaatagatacttataaaatatatttaccctgaaatgcttaagaataaaagtgttgatgcccatgtcaatagtacattatacattacacacattatttaaatgtcattttctttccaataacgtagataaaaccacaatatttattgcttatatcaagtgcaggttaaaatccagatagcctccaaaaacaaatcctgtgataaaggatatctcaatgttggtcaggtgaaatactgtgtttgacatgtatgaatacagttgcaaaatttaccagtttttaacaaacatgaatgtctttattttagacagccatttacagtttggggttcagaggaacctgcagtcaagagtcctgagatgttgggcttgtgactgtaaatatcacttatctggttgatgtctattctactgcaccgtttttgggatatgaggcgtttgctgcagacaaacccctatgattaatgtagcactgtcagttactagtgcagaagcttgctgggcaaaattaattgtttatagggcattttgctgaaaaaacagtgtccagccaacaaaagcgccaaccaaaatgactgacataaaccccatcttagtgagaataggttgccaatataaccacctttttctttttcgttcattctcatttagcctctgtttcatctgctgcaccttctgagctgtggtggcctttctgtcctctcgaatacgtttccgtagagcactatgaggaaataaaaacaagtgaaaggaagtgcacacagagcaggacttgagtactctaacacagaggacctaggcgcaaataaaaccatccacatagttttcaccctatttgaacactggaataatgaggggaaaagcctcaatattcttttgagacagcgtcttgctctgtcacccagcctggagtgcagtggtacaatcttggttcactgcaacctctgcctcccacgctcaagtgattctcgtgcctcagcctcccaagtaactgagactgcaggcgtgcaccactatgcccagctaattttttgtatttttagtagagacagggttttgccatgttggccaggctggtcttgaactcctgacctcaagcaattcacccgccttggcctcccaaagtcctgagattacaggtgtgagccacggcgcccggccaagaaaagcctcaatattctttaatgattcagagatgtaccttgacaaccattcctggtacagttttatattgataactgcttttagtgggacctgaaaataagcaaggtactttcttgacacgtgaattgatgactgttagttttctttccttccttgttaactagtcagcaggagcaggagtgggaagacaagggggtaccacttgcatctgatcccatttcctggtcacgtttgatggttaaggctcttataaaagctagctatttaatatttccatgaatattctgttgtgggagcacttattcttttatttgaccatacacatttctacctcccattttcatagtcaatacagaaatttttttggggtggtgggggaggcggggtggatggagtcttgttctgttgcccaggcgggagtgcagtggcacgatcttggctcactgcaacccccgccttccgggttcaagcaattcttctgcctcagcctcccaagtagctgggattacagacgtgcaccaccacgcctggctaatttttttgtatttttagtgagatgatgtttcaccatgttagccaggctggtcttgaactcctgatctcaagtgatccgcccacctcagcctcccaaagtgctgggattacaggcatgagccactgtgtccggtctcagaaattttgtttcagtggaaggtctctgactctcaagatacttagttctggttctatataaataataatgccatccagctactcaggaggacggcttaagcccaggaattcaagtccagcttgtgcaatatagcaagtcttgcctctctataaaagcacacccacaaaaacaaaaaaacggccaatggcaacatataggttactatttcttccattccctcttttcacttttctgtattacagcaaaggcctaaccagcttccctgccctcaaattaaatattattgccatggtaatttttctagagcatacccctggacacgtagcttgatttaaaatctttttttttttttttcgttaccgggcctagtgcacgatggtgcttaaaaatctcaaatgcctcttcaatgtctcctacattgagactacctttttcctggccaagacgtttaacctgaatttaactatgataaataatgattaaagaaatgcattgtatggggcattctaaaagatatctggcctagaagcttcaaaaatacaaatgtcaagcaaggaagaaaaaggcagggaacagttccagattaaaggagaccaaagaatcacatcaactaaatatagtatcaatctttgattaatcttgaaatattttttaaacagctacagaagttgggatcaggaaaatgttctaaaattagatcgtggtgccagctacacaatttggtaaatatattaaaagtcactgaattgtatactttaaatgagtaaactttatgctatataaattatatttccataaaactttattaaaaaagctatatggtgaatctttcagacaagagaaatctgaattgaactatgtattagaatattttaatcaatgttacacttctttggtgtactggaaccttctctccccaagagattgttagtgggaatgtaaaatggttcagctgccacagaaaacagtttgacagctcctcaaaaagttaaacatagagttaccatatgacctagcaattccactcctagatatgtacccaagagaactgagaacacatgtccatgcaaacgcttgccaatattctcctgctatgcagaactttgttcttgccgtttttttgctgttctccaaatttgttccccactaaaatagaaaccttcccttctctcctgtcctctcatttcagttctactcttcaattatcttgctccaccccctctagcccttctattcttacggcatttaatttgaagtaatttataatttactaataatgtgctaacttgggtacttgttttatcttcatcacatattctgcaacttgaggacagactgggttttgctatctttgttcatcttatggtgctttctcatgtctttttcactttttgttatcatatatacaggtatccctggctgtctgaactccatctgaatatctgctataatgacttgcaaaaattcttactcagaattcactctctgaattgaaaattcactatcacaaatatgcatgtacctgttagtgaaaacatttgtgttcaagtgtaggcaaaatatgtataaaaacagagagggggttagcctcccatgggccctttattagcttttgccaggagcctgggggtatcgttaacaaggttccaatttagatataatctttaacgtattatttcattttttattttcattgcggtatagaaggcaattataatttgtatctagtattttgtcatttaccatacaagcccaataatgagtcccttaagtgttatatgattacataattagtgctttaaatgctacataggagtttaaaaggttttgtactatatttgggggaactggttatgctttctggttgggctgacaacacactatttttctcatttaaaagaatggaacagaggtttttgctttccaaaagtgcactatataattcaggaatggactagagacaaataccaaggcatgcctgtatctaatttaagaacacaattccagagaatgacaagactactctcgatttgtgataaaatcttttcttccttagtggggcctaaagaaattatgtctgtgtaatgacttgccaaatgggacctgcccaggttttcccgtatatttatgcaatttaggatattaaccaatgggaatgcctcctgtggacccttgcccagggaagatcatgtggcgtgatcatagctccctgtagcctcaacctcttgggctcaagcaatcctcccacctcagcctcccttaagactacaggcaggtcccaccacatttggcggatttttgtattttttgtagagacagggtttgccatgttgcgcaggctggtcttgaactgctaggctcaagtgatccacccgcctcagcctccccgagtgttgggattacaggcatgagccactctgcctgctccagacttttcgtatgtccaagttgtttctcactctcagtgatctgggtttctgggttgaactgtaattgagaatactgcctttcaaattcagactgcaacctacagtaagaaatagcatcacaacagagtaacctcacacacacacttacataggtacacaatgtatatgtaaatatatggaatttatacatcacacatacatatataaaaacaggttaaaattcaagttcaggggtacgtccatgtgcaggcttgttacataagcttgaaacttgtgtcatctccgtgacatgtacaacaagttttgttgtacagattatttcatcacccaggtattaagcctagtacccattagttatttttcctgattgtccccctcctcccaccctccatcctccgacaggcccccagtgttgttcccctctatgtgtccatgtgttctcatcatttagctctcaattgttagtaagaacatggggtatttggttttctgttcctccattagttttgctaaggataatggcctccagctccatccaagcccctacaaaggacatgatctcattctttattatggatgcatagtattccatgctgtatatgtacattttctttatgcagtctatcattgataggcatttagattgattccatgtcttttctatggtgaatagtgctgcaatcaacatacgcgtgtgtttacatctttacagtacaatgatttatattcttttgggtgtatacccagtaatgggattgctgggttgaatggtatttctgtttttaggtctttgaggaatcaccacactgtcttccacaatagttgaactaatttatactcccaccaacagtgtttaagcattcctttttctccacaacctcgccagcatctgttaaattcatgttattatttgtgatatgctgataatttctattttattctattttcttctttaaaaaatgtttataatccaataaacttcacgactatgtgatttgaccttcaatttgaaaaacactgctttggaggatgaatatcctccaaatgaatacaatgaaaatgaatacaagaaagtactgtgttctatttcttttgaaagttgaaattctggccaggtgtggtggctcatgtctgtaatcccagcactttgggaggctgaggcgggaggatcacaaggtcaggagttcgagaccagcctggccaacatggtgaaaccctgcctctactaaaaatacaaaaattagctgggtgtagtggcgggggcctgtaatcccagctacttgggaggctaaggcaggagaattgcttgaacccgggaggtggaggttgcagtgagccaagactgcgccactgcacttcagcctgggtgacagagcaagactccgtctcaggaaaaaaaaaaagaaaaaaaagaaacttgaaattcttttgataagacttttatgaggatctttaatgcaaagctatctataggtattaaaaattactgggactgattaaaaaataaaactgttcagagtaacctttacttcacaccctgatcctatgctcttcttttacatttttttttttttgagataagagtcttgctctgttgcccagtctggagtgcagtgttatgatctcggctcactgcaacctcctgggttcaagcaattctcccacctcagcctcccaagaagctgggacaacaggcgttaatgcctctttaatttttgtattttaaaattcgtatgtccaagttgtttctcactctcagtgcctggttaatttttgtattttcagcagagacggggtttcaccatgttggccaggctggtctcaaactcctgacctcaagtgatccacctgccttgacctcccacagcactgagattacaagcgtgagccaccacgcccggcctcctctttttcatttctgtaaccttgtttttgtaatcagacttctccgcttagaattctgacttttctgttgggactctctgctttcaaacatgcaccagtctcatttatcagacagggaaggaaaaaagggaaagaagaaaacaccgccaccacatgcgaaaacatgtacaggcacataaacacacacacagaccccataaaacagtcttctgcaatcactctataactccttagagttatagactctagagtggttttagtagtctcctctgtatttgcaagcttgtatgagtgatttaactcactaggattaacatggttgttctgaatctttgtagattaaaactcaacacttctgaaatactaagaatgccatttcagtcatcaagcctgtttttcatttaattctgcagatagtactagataaaaggggggaaaaagcagtaacactaggaatctgaaagccttattattgaaaaagctaaggtaacttaaaactattatttcctgatttaaagatattctatttaagatgaaaaaaggaaccaaaaaaattatgctttctcttgcagtctaaaactactgaagtcaaaaattgggaataacattactaaatcataataaactcttccactataatatataataatacatgtattatatattggaatatgttagcatttataaaatttcaggtatttaatttttatattaggaaaatacagcagtaaagctataatgtatggcagacttcgactattttcattccaatctaacaaatataaccacaagataaaattccccatgataagaagtatatttggcaaaaagagaagaagaaaagttattcagagatgcaggagagaggaaagaaaaacctcattcactttgctatgtgacttataccaggttatcagcttcctaatctgtgagagacagtcttagaaatgtaattgtaatttaaaattctgaatagatgccacattcatatggatttttaaaaaacgcctttttctttctccagtaatgcaattaagcttacatgtttaaatgttttattaaaggcatattatcagttacattataattatagtacaaatggcaggtattcatactacttattttctgtaccataccatatattttagcacccaattatattaacttttacactcaatcattattgttttaaaggatttttgaactggtttctaagtattggctgaaagctccttaagaacacctttgtcatcatatactaaataccctcaggtaagaaataaaggttatattaatttggctgggcacggtggctcacgcctgtaatcccagcactttgggaggctgaggcgggtggatgacctgaggtcaggagttcaagaccagccttgttaacatggtgaaaccctctctctactaaaaatacaaaaattagctggacatggtggtgggcgcctgtaatcccagctacatgggagggctgaggcaggagaattgcttgaacccaggaggtggagcagctaaggttgtgccaccgcactctagcctgggtgacagagaaaaaaaaaggttatattaattcaataaaaaaaagggcctatattatttcatatatcatatccacataattatttatttattattattatttatgagacagggtcttgctttgtcacccaggtgggagtgcagtggtggtatgtcagctcactgcaacctcgacctccccagctcaagtgatcctcccacttcagtctcccgagtggctgggaccacaggctcgcatcaccacacctggctaattttgtttattttctgtagagataaggtctcactatgttgcccaggctggtttcaaactcctagactcaagtgatcttccctccttggcctcccaaagtgttgagattacaggcgtgattgtattttcctaatataaaaattacatacctgaaatcctatggcacctggtcccataaaatttatttttaaaataaaaaagcctcatctttcagcctgtagttatagaaagcttacctctcactgttctcctccattgtatcttgcattttagaggaaagtcctgtacatcggtcacctgtcagtttttcttcttctagacctattctgttcccattgtatttttcagtcattattttgtttggtgaatgatcaaaggcaggagataagtcttccttagaaagttctttccatcgtttctaggtagggaagagaaatgaaaaacaaatgcaaacattaaaaatttattttccttaaataaaaaaatttatgaattaaaatcctatattcaagttaagaaaacccaatgatgctaaaagatgagtgaaaaagaaaaaggcattttgccatactgtagcttgtaacaactatgcttattttaatttcaaaattttataataaagcatttagtatttatgtacatgagtatatagttgaatataataatcttaataaaatcttgtggacttttacctatttgagacaaactatactgggaccacactcaactattagtcacagtaatataattttaatattggtagccagatccatgaaactcgacagcacactgaacacattcaatgcaaagaggtcctctctccaaggtacattataataaagccatcaaaagtcagacatagagaattctaaaagcagcaagagaaaaggatcaagtcacatgtaagggaacctggcaggttgctattaacagatttctcagaaaacctgtacacgccaagaaagaacagactgtagagaatgggataatatattcaaagtgctgaaagataacaactactagcaaagctatctttcagaaatgaaagaaaaatggagtctttcccagacaagcaaaagctgcaagaatttattaccactagactagccttacaagaaatgcttaagggagctgctttgactggaagcaaaagtataattactatcatgaaaatatatgaaaatataatctcactgacagaggtaaattaattaccaaattcagaaaactccattgctgtaactgtggaatataatctttcaaatctccattatgaaggttaaaagtaaaaaatggttaatggtaactacagctacaagttgttaaggaccacacaatataaaaagatgtaaattaagcaacaaaattataagttgtggggggagggtaaaagccaaaaatattttatgagaccaaggttaagttattatcagcttaaaacactctaagatgtttaatgtaagccccagagtaaccacaaagaaaaaaagtaactacagcagacacacaaatgagaaagagaaataaatcaaagcttatcactatagaaaatcaccaaaccacaaaggtaaacaataagagagaaagaaaggaataaagaatatgaaaagcaaacagaaaacaattaacaaaatggcaggtgtaagtccttatctatcaataatacccttgaatgtaaatagattaaatacttcaatgaaaagatacagtggctgaatggatgaaaaaacaaaaaacaaaatccaactctatgttgcctacaagacactcacttcacctgtaaggacacactaagactgaaagtgaagggatgagaaatgatactccatgcaaattaaaaccaaaaagagaagaggagtagctatattttgataaaatagactttaggtcaaaaattgtaaaaagaaacaaaggtcaaaggggtcagttcagcaggaggatgtaatgattttaaatatctatgcacacaacactggtgcacacaaatatataaagcaagtattattacatctaaagggagacatagactgcaatacaataatagcaggagaacgctacatcccactttcagcaatggacagatcatccagacataaaatcaacaaaaaaacattggatttaaactgcactctaggccaaatggacctaacacacatttacagaacattccctccaacagccacagaatacacatttttctcatcagcacatggaacattctccatgatggaccatatgttaggccacaaaaacaagtctcaacaaattaaaaaaagaaaaaaatcacaatcaggccaggtgggtggctcacacccaagaactttgggaggtagaggctggaggatcacctgaggtgaggagtttgagaccagcctggccaacatggtgaaatgccatctctaccataaattagccaggagtggtggtgggcacctgtaattccaagtatttgggaagctgaggcataagaatcacttgaacccgggaggcggaggttgcactgagccaaaatcatgccactgcactccagtctaggggtcagagtgaaactgtctcaaaaaaaaaaaaaaaaaaaagaaaaagaaagttctcaaataaacaacctgatgtacctcaaggaactagaaaataataaactaaacccaaaattagcagaacaaagaaaataataaagaccagaagaatggaaataaagtgaccaaaaaaaagaaacgaaagatcaacaaaaccaaggatcatttttttgaaaaggcaaacaaaatcaacaaacctatagcagactaagaaaaaaaaaagactcaaatcagagatgaaaaaggagatattacaactaataccataaacaaagtattgtaagagactattataaacaactgtatgccaacaaattgaaaagcctagaggaaatggctaaattcttagacacacacgaactatcaaaacggaaccatgaagacatagaaaacctgaactgaccaataaagagtgagattaaatcagtaataaaaagtctcccatcaaagaaaagcccggacttgatggcttcatggctgaattctaacaaacatttaaataatactaattcctttcacactattcaaaaaactgaagagggaaatcttccaaaatcattctgtaaggccagcattaccctgataccaaaaccagacaaggacacaacaaaaaagaaaactacaggccaatatccttgatgaatatggatgcaaaaatcctgaatgaaataatagcaaattgaattcaacagtatattaaaaacatcatttaccatgaccaagtgggattcatccaagggatgaaaggatggttcaacatatgtaaatcaataaacatgatctctcaaaaatcaacagaatcaaggacaagaaccatatgatcatttcaacagatgcagaaaaaccatttgataaaattcaacatagcggctgggcgtggtggttcatgcctgtaatcccagcactttgggaggctgaggtgggtgaatcacttgaggtcaggcgtttgggactggtctggccaacatggtgaaaccccatctctactataaatacaaaaaatagctgggtgtggtggtgcatgcctgtaatcccagccactcaggtggctgaggcatgagaatcgcttgaacccagaaggcggaggtagcagtgagccgagattgcaccactgcactccagcctgggcaacagagcaagactctgtctcaaaaaaaaaaaaaaattcaacataccttcatgataaaaactctcaacaaattaagtatggaggaaattgtgcctcaacacaaagccacgttatgacaaacccatagttaatatcatactgaacatgaaaaagttgaaagcttttcctcttaagatctggaacaagacaaagatgcctcctttcttttttttttttttttttgagatggagtcttgctctgtcaccaggctggagtgcagtggcatgatctgcaacctctgcctcccaggttcaagcgattctcctgcctcagcctcccgagtagctgggactacaggcgcgtgccagcatacccagctaatttttgtatttttagtagaggcagagtttcaccatgttggccagggtggtctcaatctcttgacctcatgatctgcccatctcagccccccaaagtgctgggattacaggcatgagccaccgcaccgggctaggatgcccactttcaacacttttattcagcataatactgtaagtcctagccagagcaattagctaagagaaagggtattcaaattggaaaggaggaagtcaaattgtctctgtttgcagaagacataatcttatgtatagaaaaccctatagactctaccaaaaaactgttataactaataaaaaaaatcagtaaagttgcaggatacaaaatcaacaaataaaaatcagtagaattttatacatcactaacaaactatctgaaaaaagaaatcaagaaagcaattccattttcaaaaaaattacctaggaataaatttaaccaaggaggtgaaagatctctataatgaaaattataaaacattaatggaaaaagttgaagaggacacaaatggaaagatagcctatgttcatggattaaaattaatactgttaaaatgtccatactacataaagtgatctacagattcaatgcaattcaatgaaaataccaatgatattcttcacagaaacagaataaataatcctaaaatttgtatgaaatcataaaagaccccaaaagccaaagcaattttgagcaaaaagctgggggcatcacactacctgacctcaaaatatactacaaagctatagtaaccaaaatagcatgctactatcataagaacaggtataaagaccaataaaacagaagacagagcatggaaataaatctacgtatttacagccaatttatttttgacaaagatgccaagaatatacactggtgaaggacagtctctttgataaatggtgttgggaacactggatatctagatgcccaagaatgaaactagacccctatctctcaccatattaaaaaatcaactcaaaatggactaaagacttaaatatgagaccccaaacaaatatacatactagaagaaaagatagggaaacacttcaggacattggtctgggcaagggaagggtcttttgtataagacctcaaaagcaaaaacagacaaatgggattacatcaaactaaaaagcttctgtatagcaaaggaagcaatcgatagactgaagagacaatctacagaatggaagaaaatatctgcaaactatacatttgacagggattaatatccagaatatataagaaactcaaacaaaattcaatagcagaaaacacaagtaatccaattaaaaataggtaaaagacctgaatagccatttcttaaaagacatacaaagagccaacagatacatgagaaaatggtcaatatcactaatcatcagaataatgcaaatcaataccacactgagatatcaccacaccccaattagaatgactattatcaaaaagacaaaaaataaatgctggcatgaatgtggagaaaggggaactcttgtacacggctggtggaatgtaaattagtacagccatcttggaaaacagcataaaggttccttaaaagattaaaaatagaactatcatatgatccagcaatcccactactgggtatttatccaaaggaaatgaaattaggatttcaaaggcatatcggcactcctgtgcttattgcagcactattcacagtagtcaagatacggaatcaacctaaatgtccatcaatgaatggagggagaaagaaaatgtggaaaaaaaaaaaaaaaaaaatatatatatatatatataatataatactatttggccattaaaaaaaaaagaaatcctgtcttttgtggcaaaatggatgaaactggaggacattaagccaagtacacaaagacaaatactgtatgttctcactcatatgtggaatctaaaaatgttaatctcatagaagcagagagtagaatagtacctactggaggcttcgcagagtagggaagagggggcatagtgagaaactgaacaacagttcaacagggggatgagttctggtgttttactgcacagaatgactatggttaataatatttaatatttcagacagggtgtggtggctcatgcctgcaattctagcagtttgggaggctagggcgggcagatcgcttgagcccaggagtttgagatcagcctgggcaacatggtgagacccagtctctacaaaaatttaaaaattagccatatgtggtggcacgcgcctgcagtcccaattacttaagagactagggcaggaggatcacttgagcccaggaggcggaggctacagtgagcgagccatgatcgtgccactgtacaccagcatgaacaagagaatgagaccctatctcgaaaaaaatttatatacatacacattttatatacacataaaatcctctcttctggctatttcgaaatacttatatatacttatatatatttcaagtactatgaaatatattagcacataataatatataattaaatagagatttcaaaatagctggaagagaggattttgaacgttttcaccacaaagaaaagataaatgtatgaggtgatagacgtgctagtctaatttggtcattacataaatgtatcaaaatatcacactgaaccccataaatatgtacaattactaagtgtcaattaaaaacaaaggccggggcatgcggtggctcacgcctgtaatcccaacactttgggaggctgaggcaggtggatcaagaggtcaggagatcgagaccatcctagctaacatggtgaaaccccatctctactaaaaatacaaaataattagctgggtgtggtggcacacgcctatagtcccagctactcgggaggctgaggtaggagaatcacttgaccccaggaggcggaggttgcagtgagctgagatcacaccactgcactcctgggcgacagagcgagactccgtctcaaaagaaccaaccaaccaacagacaaaaaaacaaaataaaaaataaagtagcactgcacaaaaaacacaaaaatttttaaaaagatttcagccaaggtagattttgcttgaatcttaatccacttctaatccagaggtatgtaacactggagtagtcaccacagtggtgcttgaatgtgatctggaaccttcttgctccttgccactgttcagtctaggggagaactaacggtgagatctccaagctggtccttgtgatgctaaaggactttaatttggttgtgtctatcaggtacgctagcagctccaggcagctggctagcccaccactgggctagagaaacaccctccagcatgcctctagcatggccttcaggagtagatggcaacacaaaccaggattcggaccaagatgaagacaaatttcagtttcttctatgaaagaggatgtcatcatctaccctgggagacagttgtgattaatgagatggcatgtgaagcgcccagcatcatgtctagaaaatatgtttcctgtgctctcacttgtcaccattcctagggacaaaggtagaggaagaagagtgtatctgggcccctgcagatgaaagcagtgacaattgtacatgccagagaagaaaaacgcatatataacctatgcactgggactatagtctctcaagtccttgaaaggatgaaacatgatccccatctatgtatctgccagtggcaagtggtagaggcagaagcagtgggagccaatggttttgattacctatgactgacactggcccaaatgacttggtatggacagggatggccttctttgaagatcctatcaaggacgcaaggagtcttggatctaataaataaggaatactctacttattgcccgaggagtctaatgattttggacagagatgtaacattgcaacttaaagttttttagaacttatggaatattcattccctggagttactcttgtgcaatatggtactgttaaaagcaatgcttgtattcagatctttaaaaaatctctgggaaatccattcatacaatggataaactagtttctaatttgtctcattgtcatcatgtaccagaggtattaaaaagaaaaaggcacgcctggcacagtggctcatgcctgtaatctcagcactttgggaggctgaggtgggcagatcacttgaggtcaggagtttgagaccagcctgggcaacatggtgaaaccccatctctaccaaaaatacaaaaattagctgggtgtggtggcacatgcctgtaatcccagttacttgggaggctgaggtagaagaattgcttgaacccgggaggccgaggttgtagtgagctgagattgtgccactgtactctagcctgggtgaaagatgagactcggtgtcatggagaaaccctgtctctactaaaaatacaaaattagccaggcatggtggtgcaagcctgtaatcccagctacttgggaggctgaggcaggagaattgcatgaatctgggaggcggaggttgcagtgagccgagatcacgccactgcaatccagcctgggcaacaacagtgaaactctgtttcaaaaaaaaaagcattttccacacttcaccgttcccagatatggctattttacttagctgcataatcaatgtacctctttttatgtttttaatttttttagagatggggtcttactctgttgcccaggccagaatgcaatggtgtgatcacagctcactgtagcctcaaactcctgggctcaagcagtcctcctgtctcagattcctgagtagctgggactataggagagaactaccacggctggcttttttgttttataatagttgatttacagaagatttagaaaatgtgaaattctacagtttgttgtgtttggagaacagttagtagtacagtttggtacaatttgtctagaggatggaaaacacgcaaagcttgagtaggagagatgaggctggaaaggaaatagacctccgggaaagaggtctctggacttcatgagtagtggggtagaactgaaaatcctgagccctaagagggcgcaaaccatgtccccgaaagaatactgtgccaacaatcaagaaactacaatataatggaacacaggagtaattaaggatgtcttcacttagatgactgtctattttctttgttcccttgtttgttttgttactcaatccaaatcttttatagtgaagacatggagtacttgctactctccatgccatattctaacacttcaaatgtgctagctcttaatcctcacaataaccttaggagataagcactaatactaatattaccattattacaccctttttacggaagatgtggggagaataattaggtaactcgcccaaggatatgcacctaacaaatagtagagacagaattttaacctaggcaagtctgggttgactatgctgtgaccccttataaagatgtgtgttcaacaaagtaccccacaaaaatgttaaattgtctccagaatttacactggtcaatttttgaagtttccactcttgactgagacctagttatgtaacttggccttatagctggacaacactcaacaatgtcaacaaataagatgacaccaaaaatcaagtctcactggaccacttcccagaatatgcaacaaattcagaatacgtcaacaaggaaagcactcggcagagagagaaataaaagagatatttaatgctagtgaattaaaaaaaccccacaaacccaacaatgtcattttgccatggctatgttcagcaaactcactcatggctatgttcgacagactcattcatggctatgatcagcagactcactcgtgcctatgttcagcaaactcactcatgcctatataggttcagcaaactcactcgtctctgtcctccctgtgacacacaagggagccagcactcctgagtcacctgcctcaggtcattaatgctgactggtgaagccaaggaattacatttcactaaactataacctcaaaggagctctcattttgaggcctggtactgtttcatctttctttctaattctgtgctcacgttgcaccaacccatgagtcactgccactaggagccatgccccccacacaatgcctagaaccctagctctacccatttctctcactgaagaaagctttaagcaatgcaattaaacttcaaatcctctgtaatttgttaaaagtttatcatttacatttaatactttattagtaatatcaaattaccagctagagatcttacaacattagttctgaattgccaaactagatatttactctggggggttaactgtcatcatcaatactgggaatatgctaataaatatgtggtaataccagcaaccagcttaagtatttatgcctgaccttgtgctgaaaggcaattgcaaatagcctatatgtctataggaatgtcaaagtcattggaagttttctgtaaatgaatacatgctttaagattataattacacatatttacagacttaagatacaatcactttgggctgggtgcggtggctcacgcctgtaatctcagcactttgggacgccgaggtgggcgatcacttgaggtcaggagttcgagaccagcctggtcaacactgtgaaaccccatctctactaaaaatgcaaaattagccaggagtggtggcaggcacctgtaatcccaactactcggaaggctgagtggggagaaccacttgaacctgggaggcagaggctgcagtgaaccgagattgtgccattgcactccagtctgggcaacaagagcaaaactgcgtctcaaaaaaagaaaaaaaaaccagtagcatgtgtggtatgtatttattaatccaactttatcagtaatcacttcatatgccgatggtctaaatgcaccaattaaaaaagattctcagaatgccaagaccatttctgcagaaattaaccccttggaatgggcagcatgcttttctgatcctgagtacctgaaggataaagatgtttccaatatcctatctggaataggggcagaaaatgccttagaattgagagcctgaggacaatatcacaccagataaattaacagaaaaaaaatccttcctagccacaaactgcactgtcaaagactccacaaaaaagtgtgtccagaaaaactcatctctgtgataaaaaaagatccaccctcagataaagtatgtattctaaaactaaagacacaaaacttaaaaaaaaaaaaagcagtggtaggaaagacacaatccaaaggacaatacatttccctcccagttacccgtctcatcacagccaggaagcaggcagggaaggcggcatgcaggctgtgaaggcatggggaaatctgattgaactacttttctttttgaactccagatttaagttggtgaaagctcactgtgattagaaagggaaattttcctaatcttaaacatctgaaataacttttacttcacctaaatcactgatcactgccaaagtgaccctggcaaatccagtgttcccaaagtctggcgtctgaagcaggacatgttctaatgggctgagtttcccaaacattgcgtattttggctctgagtgccctaatgtttctgtgcattaagaatattttaatgctatttaaagatttggaaaaaatctttttaaataaacctttattctgacaccaatggtccgatctaatttacattcttatattggctagtaatcagagaaatgaaagtgctagtaaatatgttcacacatgagaaacataatgaaaagacagtcgatcttcttatattatgcatcaacttacagtatctgcttatgtccaatactatgtgattaaaccagacaaaaaatggagtctgtggttgtttctattttacattttaacttagtacataacacaagtttctgatcagtctttgaacttaggttctacaaatatgcagtaaaaatagcttaatgagaataaagccaccaaccagaagaatataacattttgctggaatttcattatatctgccataaatattcaagttgcttgttgttataaagtcaaatatcacataaaccaagtatcagtgtttaatgaaggcaaaagtatctcaagtttccagttactttaataattaaaagattaaccacccccaaaatgaaaaattcagtttctttaatgaaatcttgtttctacaagggcttttaagtaacacacaggatttaacctgaggctgagtatatatgaggaagctagctaaaattttacaattttaagacagccagctggatttaccacaaaaattcaaatacactctttgaaacaaagacaagggctcaagtggagtgcagttatttgatgctatgtgtatttaacaaatagatatgatttaaaacctgtatgaagtttacctgtatactagaatctccctttatacattttgctccttctattatagccatgtatgagaatctcagttgatctggggtctgaataagacccattcggtattttctcatgttcagtaacacttgttttatgttaatatcatctcctttttccatctgcaagaaaggcaaaaaatgagacaagtcttgttattggaacccaggaaacagaatcaatgcaagatcattgctaagatttttgctatgcattttctcctctgaaagaacaacgataatttaaccctccagctataactgttatgtacacaacaactatcccagcctactcatccctccccacatctcaacccctcaagtagttggaggactttgattctttagctgattcacaactgattccaaaccaatcatagtaatctcattccttctggccagtcattggttaaaggaaggatttataaccagttctggctagtataaggactatttttttttttaaaagtcatggcaggagtcaacctttctgctcattccccttccgcctccttcatgtctgcactacagacacgatgtctggatatacagcacccatctaacaatggtggaaaagaggccaggcatgatggctcatgcctgtaatcccaacactttgggaggccaaatcacttgaggccaggagctagagaccagcctggccaacatcgcgaaatgccatctctactaaaaatacaaaaattagctgggtgtggcggcgcatgtctgtaatcccagctacattggaggctgaggctggagaatcgcctgaacccaggaggcggcggttgcagtgaggtcagatagtgccactatactccagcctgggcgacagagcgagactccatctcaaaaataaataaataaataaataaataaataaataaataaataaataaataaaaatgtggtgggtcacacctgtaatcccagcactttgggaggccaaggtgggcagattatgaggtcaagagattgagaccttcctggacaacatggtaaaaccccgtctctactaaaaatacaaaaattagctgggcatggtggtacgcacttgtagtcccagctactcgggaggctgaggcaggagaatctcttgaacccgggaggcggaggttgcagtgagctgagattgcaccactgcactccaccctggcaacagagcgaaacttcgtctcaaataaataaataaataaataaatagaataataaaataaaatgaagaaagacggtggaaaagacagcaaaagcccagatccacgataacactgctgagctacagcactgctctggactactgacctagtgttagaatccccacacccaggctcaccaaaaataaaagaaaaaaaattgttgaagttatagttggcagggaacaggtgtcattaacaaaataatcaccagagttttaaaactttgatgtaacaatctaattttgattgaagtatactatatatacgcagagtggtaaagtaatacagatgtttagttaagactcaaccgttcccaattcctagctttcattagagatgcaacgtctgaaatgttcttccaagagtatcactccttccaagagtatcactccattgatcaagctccttgtgtgtgtgtttacaatgaaaagcatcatcatattaattcacctgggaatctactttgtgctggcagtcatggtggaaagcataagaatgctgacataactgcaatgaagcatagctacgttttacagaaacatcgaagagactaatacagggccttaaagtcaaggttaagaacaccagtcttgtgtcaagcgtggtggctcaaacctgtaatcccagcattttggcaggctgaggcaagaagatcacttgagcccaggaatttgagactagcctggccaagatagtgaggccttgtctctactaaaaataaaaaagcaaaaactagttgggtgtggtggtgcaggcagctacttgggaggctgaggtgggaggatcacttgagtccaggaggttgaggctgcagtgagcagtgattgcaccattgtactccagcctgggtgacagggcaagactctgtctaaacaaagacaaaaacaaaatccccaccagactgaataccaggacaagctaaactgcttaggttattgataatcttagaacacgctcagaaagcagaaactaagctgcagggactactgaaggagtagatggcatggaaatcaaagcagacagtattattgttgggtttgatcctataataagaggaagaagtaaagacagaagttaggagaagtataagggcaaacagaagtttcatgtatcccaagtaacgaaaaaataaaggtcctaaaaagagaagaaaagatctaggctgtatacaggctgggactgggaatgactggtggagaaagaattagccgttgggggcacagacaggaacctcaggggagtaacagtaatactgacatttatggaatgctcagaaaacatcagggactcttctaagtctccttaatgtattaattcattgaattctcacaggaaccctgtgaagtatgtctatcattatccctagtttttaaatttaaaaaatgagataaagtatctgtctgaggaggaaggaattcaatattacatatgaatttatatttgaaaaaatgtgggggagagacctattatttctgtaatataaagctaccaggaagaaaaacaccttcttagggatctctaaaatcatcatggatacattcctaccagtcatgaataagaggcagttgcaacggtggaaatgagatttttaggtttttccaaaagtagaagtttaagttgaaaaacctcagttctgggatacagcatcagagtttattcactgccagtggaagcaatttaaaaaaaaaaatcaatgagattaaaatgagatcgtaagaagcacttaccaaaacaagacaagtgtctaccagagagaaggtgccagagcgcccaatgcctgcactacagtggatcaccgcaggcccatggtcagggttcaaggagccagattctctcactttaaacaagaaattgagaaatgaagctggtgattcagggactccaaaatctggccaggtagtataatgaaagtgagatattgttctggtttcaccactctaaaaagtgaaaatcaagggagaagttagttctaacttttttcttttaaaaaactacttcagaaagatcatgtgttttatataattctttaaagccatataggctgtttatactatgatttttccatttgttttctgacaatcccatatacaaactagggaagattttctttagtggaaatttgtgatgtattaataatagctaacgcatacaacacttactattttggaggcctgttctaagcactttacttattaactcaatccacacaataatcctattaaagcccattttcctgatgaggaaactgaaacaaagggtaagatagtttgcccaaggtcacacagctggaacatggcagaaccaggatttgaagcaacctggggcagcctttgggttctcagctactaatctgttaccatacatgttaccaatattttctttaattcatgtatcatgaatgggctatttttttctattttaaaaaatttctgccgggtgcaatggctcatgcctgtaatcccagcactttgggaggccgaggtgggcagatcacttgaggtcaggagttcgagaccagcctggccaacatggtgaaaccccgtttctactaaaaatacaaaaaattagccaggcgtggtggcgcgtgcctgtaatctcagctacttgggaggctgaggcaggagaattgcttgaacctgggaggtggaggttgcagtgagcagagatcgtgccattgcacgccagcttgggcaacaagagtgaaactccatcttcaaaaaaaaaaattttttttctaccagtataattttacattctttaacattttcctttttatgaatttcaaagtttattttttaaatataatctcccgttcacatgattatcttttagattctgctacacaggcataggggagcaactcaagaattaatctaaagaaacgatctttatatttttaattggaattgctcctctaaattgttgcctttccccatggcaataatttccaatcctaaagctgtttatatgcttttgctgatgtgctaaagtggtttaccaacatgctaaatgtttcctgtctcttaagcctgcctggtattcactatcgcttcctggatattcctgatgatctgtatttctaactcattatgaaaatgttccttagctttttgccaattgccttttgccccaaggagcacttctctgctttatactcttcatttgtgtaaacgaagcagtggtcttccactaatatgtctttgtgcaatttttcagttttattgtaggaggttttttttttttgagggaggaggcatagaaacaatgtaaaaaaccttgatgtttaatggtttaacaactaaagattattattataatatcctgctcccaataaaaattttcaaaattagaagttagctttcgctttaaaaatataaattttcggccgggcgcagtggctcacacctataatcccagcactttgggaggctgaggcgggtggatcacctgaggtcaggagttcgagaccaacctgaccaacatagagaaaccccgtctctactaaaaatacaaaccttatctgggcatagaggtgcatgcctgtaatcccagctacttgggaggctgaggtgggagaatcgcttgaacccgggaggcggaggttgtggtgagccgagatcgtgccattgtactccagcctggacaacgagagcgaaactccatctcaaaaaaaaaaaaaaaaatccattttgcagtagaaattaagacttctatgtcccagactcagtatataaggtataatactaataaaatacagtgaaataaattttctaaaaagtacatacttttagtgaccttttaacatccagcattaataatttcaaatacagtgtgatccacaagttctcaatatactaaaagcaataaaaaatttctccattacaaattaaaatgatcatggtttctacgctttaagacatttatttttaaattaattatggtaagtgaacaaagccagactaaaggctatatactatactattccatttttatgacattctggaaaaggcagaaaaacagaaacagaaaccagattactggtttctggctgggggtagaggacaggactgactgtacacaagcaacacaagaacatctggggcaggggagaggtgacagaaccgatctatgtttctgttatgggcagtggttacatgactgaatgcactgtcaaaagtcacaacacgactgtacaccaaaaggaatcaatcttattgtaggttaaaaaaaaaaggtaaattaaatttattgcattaaaaaagagaattcaaaacattctaaaataagaagggtaaactctagtctccttttacaaagcagcaggtgggcagttaatacggcaacactgacacaggaatgagctagagaggtgggttcttgacagcggggggtgggggggatacagttaactcaaagtcaagttttcctttaaatgaggttaagattccagtggatgttaataacccactttgtttcttacttgctgcggccaccagcaggaccagactcagtctgtgtgggccttcatgtggtctgctttgagcaggggcctgcagtgctctgtgggctacggcccagtacccctacggggtcctgcgcacaattacttcatcaagtcctggctcaaacatatggttaccccacaatcttgggcaacagcttgctttctctttgcttgtatgattttggctcaaaactagtggtctcaacttttttcacattcaggtcacgctgtctgggatattggaagccagttcccagaaatgctcatgactatttgtataatatagtcttccccactaatagatttttgaaaatcagttgttgttttttttcccccctacagaaccaggacttttttgagaggttaactttgattaatttatccttacagaaacaagattaaaaaaacacagctttccaaaatcataattcacagttacaaaggaccacacgaaggcataagatgcatatatttactactctggtatagaaacattcatatgcatgactggatggacccctttccctctttttcacgcaggaaaaaaaatgagaggggaaaaaaagggttgccaaaggatacagagctaaaacgaaattcatctttattccaaacaaggtctgcatttagactttacaatttttggcaaactccttattttcaaaactgtggaagcacccttttcttctccttggtcaccgagtcacactacttctcctctggtccccagctgctgccctccacccttctcgctgcttcacccccctccctacacacacgcgggttgcacccacaattataggctgtccctgtctgcagccgttccacacatgcctgccaagttttctgtgtaaaactctgcattatgtatactacattctgcacaaaatgtcagtggcttgctgttctaaggcaaaatcccatttacatttttaaaagagaattctaaatttaaagtctttgaacagcaatgtcaaacttgcatatatgaagccaggaaaataacctgtgagttgagcaagtgtaacaacaggaattgttaggccacagcaatttaagcatatgccctgttcacagccttcaaatgcaagttaataatcatcataaatatataataagattatacattttccaattatcataaaaaatctatacagctctatgaccccaggcccaattactttcacactttaggtatatatggaaggtaccaagattttgtttctaaaagactttcactaagccccagttctgtcatctgtaaatagggttaataatactacttaccttacaaaactgttgttaaggaataaataaaacaattaatgtgaagtgcctgccatatccctgcacatggtaaatgcttaacagatactggatatttttaaaacaactatactcaccaattgcctttattgtggcccctagaaagctccagtcaattgtaaaactcaacacattttcaacctcttcattgggtatttcctctacacctaaagagtgacaaagtttgtcaaccctatgtcctaaccagatgtcaaatctgtaccttcactatcactgccttagttgagtctctcatcaatttttgccagggtcagcatgtcagtgataaatatttactgactgggattcattgtgaaaggcagatcaaactcaccagatcaggaggagtggcagaaacggctagggacaggcttgcattctcagcagagagaaagcaatatgcaaaggcatgccacccacccccaccaaggaattcacctattagagaagtctgtctgttagcacgaacaaatcctggatacccgaaggagagggagttagacaaggaggcaaggaccaggctgagctgggtcatggtcttgtgcactggacacagactttttttggtaaccaatggaagccacagaagaattcttagaggatggtggaaagattgcatctgtgttttacaacaatcactcaggtgtaatgtgcttaaaatgtactcttgtgtaatggcgggggggtaccaaggcagcagataacttccaaccccttcgaagttaaaaacctcattatggagtcaagatttacatagagagatgtattgaacaagcagtagaatgataaaatttaaattactgaaaaagtataagaagaatcatagctgttagggatcaatgtgtcatagatacatgttaggagagacctaagtaagaagtgggccacaggggttactaaggacgtgcagagaagagagaggacattctaggtagaataaactgtttaaactattttgaaccaaatcccagctaagcatcataataattagagactctcatcttgctaaatctttagggacagggaaatagaagacagtcagcattataacagtattcctggaactcactaaacgtaaagcgggccaacattacagaaatagtgaagggcaactaaaaagaaaaaactgaaagacaagtactctagatgaccttatatttttaaaatccctcaaaattatctccatagcttaagccacaggccacactgaaagccgagatgcaatctcttcttcaggggcaagagttcaaacttttagctttaagtaagtcactaaagggctcctggtatgtcattttgctgttccattagactggaggaggcgcagggcttgcttagacaacagctttacctttggacttgttaatagatacgtgtcagactcccttagatgcaaactggatctctgcaccccagcgactccaataaagacagagatctgcgtgttgagattggctatcagccccctactccatcatcactttttctcactcccattggttctttctttcttgctagtatccttttcaactactcccggttcctgttgtcccttccaattcattactgttacaaaaaggaaactgatcaactaaaaaggtaattgtggctcccgcaccatcatgatattaactcacttgatccttagagcaatcctatgaagtaggtacgttatcaccctcattttatagatgataaaacaggtactgtttatcatctatagtaaagtaatgtgacccaagtcactcagcaagaatggcagagtcaggatttaaacttgggctatctgattctagaggttatctacttaggcaaatgtaattctgcctctcatactgaaatgctactttatccttctaaagaataaagaatccctagttctaattaaaaattataaagtagaacacaaacaaattcttgctattatattgtggtatgttctaaacccaggccaataaaaaatccagtgatcatgtcattataccacacagttgctagcaactaaaacagagtggctggccaactcacatgatggcctcaactccagaaagatgcttcagaatcaataatctctctttacaacaattagcatcttttcaaaaggacttatccccatgtcaaaagttaggagatggccgggcgtgttggctcacacctgtaatcccagcactttgggaggctgaggcgggcagatcacctgaagtcaggagttcaagatcagtctggccaacacagcgaaaccccatctctactaaaaatacaaaaaattagccaggcgtggtggtgcacacctgtattcccagctactcgggaggctaggacaggagaatcacttgaatccaggaggtggaggctgcaatgagccaagatcatgccactgcactccagcctgggcaacagaatgagactttgtcttaaaaaataggggaccaggagaactaatgagatcagtctgtcacttattagctaagtaatcgatggaaaaattcctataacctaatggattttaactattattttttataatataaaatacggggataataagaatatttacactatctacactaactgaagactactggtcagatgatatatatgtgaaagcattttggaatctgataaacaaaacacaaaaatcattctattttattgttacttaaggtataatcaattctcaataaggactgtttcagaaacagggaaacacatctatgcccttcatctaaatcaattttaatgccataagcaaatgagtaattacctgggataaataccaagagaagatgattcagagaactttcagaaccttgtggaaatacagttctgtttctgggaatgaacaatgtacagctcagtccagtatcaaagagttattgatgtatctcaatgcagtttaagacacatgtaaatggaaagagttgggacaaaataaatatagtaatgggaatgtataaataaatctaagcattatcattcgtaattttgagcctttttaggtgactcaagagactgtataataagcttagtacggatgtcacgggaagctggacagaaggaaaaccagaacctaggcctcacgcacagagcatgcacctgtgcttactcaatgcagcaaaaaacacaagtgtttcaagggatccaccataaaagggactgccacacatctaaaaagcatgtatatatctcccttctctttaaggtttttttgtattgttagtgatcacttaatttacttaatggttaactaaaacagtatttcacttatagactacatacattcctaaagtcatatgaggctaaacattctcctattttcaagctatcacagtttctattagcatctcagaattactctcatttcattattttctagtttattctattacaacacaaagagggcaaaagaggtaaatggcgaaagggggagaaatgcctcaatcatcaccctggcaacagcaggttcataacccactatgtgtatgtacctcaaccaaggcccaaggaacagttcatatgtttctggggaagaaaaatgcaagtaaggcctggcatggtggctcatgactgtaacctcaacactttgggaggccaaggtgggaggatcgcttgagctcaggagtttgagaccagcctggataacaaggcaagaccccatctctattaaaaaaaaataagaaaattaggtatggtggctcatgcctgtaatcccagatactcaggaggctgaagtgggaggatttcttgaggccaggagttggaggcctcattgagagctgtgattatgccactgtactccagcctgggtggcaaagcaagactgtctcaaaaaaccaatcaaccaaccaaccaaccaaccaaacaaacacccaagtaaatgttcttgagaccacatgccacatttatacatgtgtgtgtatgtatgtatgtatgtgtgcgtgttacatatatatataaaacaccattttttttccaactcaatagggacaaatttttgtgttgtgaatcacttaacaatagctttgtaagttattttcttgactattttgctattcttggcagtcacaggtcctgggagctattgcttgctgggcatttactaaggtcaggtgctctgcatacacatcctcatttgaccttcaggacagccccggagggaaggcgtggtaacctccattttacagatgaggaagggatcagtgagggtggggaacaagtctaaagtacagctctactaagcagcagagctggatctgaatccaggtttgcctgattctaaagccctctctattaatcctcatgtatttctattaattaatttttaatccccaaatatcaaactgaactttgaaattcttagtttctactgtttcttcagagtcctcagaaagctactagatgcagacacacaatctaaaaacacgtgattatggctagatactataggaattatccaaatgcatgtgcttatcaaacttcaaatctaataataaagaataattctttaaaccatcatataaagtccacaatttcgggcaagaaaggtcttacattgatattttctaattgtagtagatgtactgtataatacgacttcacatcttctgacaagagcttcacactgaatcctgtttctttaaacagcatctcttggtcatctgttggccagtactgtgcacatttaacctaaatttagaaatatgtatatgatttttttttagtttatagacatcatgaaaccataaagttaaaaaatgaaaacaaaccagatatatacatgctatattttttcaagtacccaaaactaagaagtcactactatattctacgcttaatgtattttagtaagattgaaattttatagccgggcgcggtgactcacgcctgtaatcccaacaatttgggaggctgaggcgggaggatcacctgagatcaggagttcgagaccaacctggctaatatggtgaaaccctgtctctactaaaaatacaaaaactagctaggcgcgatggcgggcgcctgtaatcccagctacttgtgagagtgaggcaggagaatcgcttgaacccaggaggtggaggttgcagtgagccaagatcattccactgcactccagtctgggtgacagagcaagactccatctcggggagcagggcgggtagagattgaaattttataaagcattttttatgtgtgtgcagtcatcactgtaagccagttttagaacatttctctcagactcagaaatccccttgtgtcctattcccactccaagccacaggcaagcactgatccattttctgtctccataggcttttcttttcttttgagctggagtcttgctctgtcgcccaggctggaatgcagtggcgtgatgttggctcactgcaacctctgcctcctgggttcaagcaattctcctgcctcagccttctgagcagctgggattacaggcgtctgccaccacacccagctaatttttgtatttttagtagagacagggttttgccatgttggccaggctggtcttgaactcctgacctcaagtgaaccaccaacctcagcctcccaaagtgctgggattacaggcgtgagccaccatgtccggtcttataaggtattttttaagtgttcctgtaacttataaactaaaaaagccataggtatcatattcataaaataaaaataaatttatcattcttaaagcatgattacctatattttaacgtcatgggacattcactttatgtttctaaaattatcaaactcttgcaataattttatcttcaaaataaatgttgctggccaagcgcggtggctcacgcctgtaatcccagcactttgggaggctgaggcaggcggatcatgaggtcaggagatcgagaccatcctggctaacacagtgaaaccccgtctctactaaaaatacaacaaattagccgggtgtggtggtggacgcctgtagcctcagctatttgggaggctgaggcagaagaatggcgtgaacctgggaggcggagcttgcagtgagtcgagatagcagcactgcactccagcctgggcgacagagcgagactccgtctcaaaaaaaaaaaaaaataataataataataatgccttaagaggaaaataaataattttttttttttttaagagacagtgtcttgctctgtagtagcccaggctggagtgcactggggtgaacttggctcacttcagcctcaatcttctgggctcaagcaatcccccaaccccagctgggactccaggtgcgtgccaccacacctggctactttttgtattttttgtagaggcagggtctcactttgttgtcgaggctggttttgaattcctgggctcaagtgaccctcctgcctcagcctcccaaagtgctgggattataggtgtaagccctccaacctggccagaaaaaaaaaaattttttttaagtaaaatagaaataaagagataaacaggattaaagagaacgtgacaaataaaaaaggtaggcaaagaaaatccaacatacgtataataggaagacccaaagaagaacattaaagcaagcaagggagcagaacaaatactaaggactgtaattcaacaaatatttctttaacaaaaagtatttaaaaaattttaaaaagtacttgaagtcaaactctcaagaacacatcatgtacctgtaaaaactgacccagaatggccaattactaagacatatttttggtaaaactaataatatctgaagaaaaagaaaaaaagaattctttgggtagtgcagataaaaagaacaagagacttataaaggaaataagatgtccattagactttggtggaataccagaaggaaatggaaaaaaaaagttgttcaaagaatagcacatgagccaaggattttatatcccgccaaactgactttcagatattaagacagcagatgaaccatcactgacatgtaaaaaaatcagactataatgctcacaagtccctccttaggagccactagagaatgagctttagtcagaatgactggagagacatcagcaaagactgttgatgaatattaaataatgcttgcttgtagaactaagagtctacaagagatgtaagggagagactacagtttgtaaagtacaactcagaaacaccaggaagagaatgaaaaaaatattaaaaattgtaaaccattttcagtaattattttggtagcagatgatatcatgattatggttatatattgtatatgatatgggaagaaggaaatgagtcattacaagatagtttacatctctcatatctttgagaaccaggattcttggtatgaaaaaggaaatagcagatgtaagatggaaggggctaagcaacacttatagttccaaatttgaactgggaatatcattatgaactcttgaagtatgttatcttaacatatgcatattgttccttagcttttgtccactgaaaagccctaaaaacaatgaccagtccagttgcaatatatatccttatttttgctgtgatcttgaaatactgctgcccattaaaagaaaccaaaactccttagagaaatggctggttccaggtctgggcagcaagagtttgagatgagcctgagatgcagtcattacagacagcaaaaaaaattttttttttttgagacagggtctcgctctgtccccaggctggagtgcagtggcacgaccatagctaactgtagccttgacttcctggcctcaagtgatcctcctgcctcagtaccccaggtagctgggactacaggcatgcgccaccacacccagctaatttttgtattttttgtagagacagagtttcaccatgttgcccaggctggtctcaaactcctgggctcaagcgatccacccaactcagctccccaaagtgctgagattacaggtgtgagccactgcacccagccaaggaaactattaaaggtttgttaaaaaggactcagagctgggtgaggtggctcacgcctgtaatcccagcactttgggaggccgaggtgggcgtatcacttgaggtcaggaacttgagaccagcctggccaacatggtaaaaccatctctacaaaaactagctgggcatggtggtgggtgcttgtaatcccagttgctcgggaggctgagacgggagaatctcttgaacccgggaagtggaggctgcagtgagctgaaatcatgccactgcactccagcctgggcaacaggcgagactctgtctccaaaaaaaaaaaaaaaaaaagaggactcaggacccaacctaaagacattgctgctagccaatgacagggtaatttgatcaaaaataaggaaaataactgcaaaggagtaaaattaatccagtatgtccaaacccataataattcaacctctcctgccactctccaccagaaaaactcctaattggtcatctgttgagaacagatgacctcaatagggaatcaacttttttttggaaaactgcttttaagagaagtaatgacagaattggattatcatcatttgtaacccataatgaattaagaagctgaacactgaccaataatggctattaatgaaataaaaagaacaataatcagacattatgggtctcttgatgaataacacattacccaccacctctgaagtaatcttccccaaaataattaaacctgactcttgttaaccatctaggttcaaccaccataaacatgatttctaaattctggtggcagtgttatcttattaatacagtaattatactccaaaatgagagaaataaaatttgcaaatcatgtagtctacaatggtgctcaaactgacaatgtcataatccttgatttttttttttttcttttttgagatggagtctcactctaccgcccaggctgcagtgcagtgggttttgagatggagtctcattctatcatccaggttgaggtgcagtggcacaatctcggctcactgcaacctccacctcctaggttcaagcggttctcctgcctcagcctcccaagtagctagcattacacctggctaattttgtatttttagtagagacggggtttcaccatgttggccaggctggtctcaaactcctgacctcaagtgatctgcctgcctcggcctcccaaagtgctgggattacaggtttgaggcaccgtgcctggcctaatccttaatttttaaatgatattgaagatcaggaaaaacccctgtaaatgactatgctgatactgctggaaattctggcatgtcattgccacatctaattagaagtggattaggaaattttcatcatcattaaaaaccagcaattatgaaatgtagaataaagtaagaaatctgaagtagaacagtacaagatcttaaagctggaagaggacttattgacaataggtcaataaggattcctagggattccaaagatctatatgtcactgctagtccatatttattccattgtatttctatcttggagatgaaaggtctgcaattgttataaaaatacttaagaaaggaaaaggatacatgagtttttccggacagaaacactttgaccgctagcctttagcaattaaaggccaaaactaaggaatgaatattggccccaaaatgaaaatctttatatgctaatgatcacatacagtatactaagttgtaaatattaaatattactcaccgattctttctccacaatgcggttcagcatgacaactgctttggtcttctgctgccaaaccataagccagaaatggcagcatgtgttaggaagtggaccctgtgaagagagaggagagagagcagatgagggaagcagacagaaagagcaaggctccaggaaggccttgttaagtctgctcctgggatgttacaagacagacagcggacgggcttataagaagtaaaccaagacttccaatctacctgatttcaaaaacaggtctgtgttagttaggatttttggttgtaaatgatcaaaactgacttttattttctcaggcaaaaaaggaattgtgtaagatatcaagtggctttcagagttgaggactagagagacaaacttgggtaggaaccaagggttaagacacaagcaaggtcctgccccaaagaaagtcaacctgggatgctgctcttgataccgtcactactatctccttgcttttgctggcactgccatatgaaggtggctatagtattcatgtacaatctataggcaaatcagagacaaaatcacgagtaggagtatctgactgatcatgttctagctgcaaagaaggtagaccaaggaaatttctgtcctcttcatcttctacagccaagaggatgtgcctcccacacatcatagaaaatccatgagaaaaaagtctgtaccatcactggccagccaaccaactcaagtcaactacaaaaagatttctagaaaaagtaggaatcattaaagtacctgaaccacaatgaaactgttaatctacaaatgcacagtatgtacggcctcaatggaagagtattgggcagagttaaaaaggggcaacagtccatgttacaacaatgccatggggataaaagcaaaatatttcatgtatttccaattgctttcacattttaatgatagcatagggcaaaaggaagatctaataagagatgaaaagcctatgtacaaattttaacgagttttaaatgagaaggttaaaatgagatgtagttttgctacacctaaaataactatgaacatgcattcaactcacatggaatgtagcagagtggtatgagttaggggcagagtcaggagtgggggctagggctgcccagagcttcagacccacatacaacaagggggttaaagtggttctagactaaaagcattttttattttttgagatggtgtctctgtcacccgggctagagtgcagtgtcacgatctcagctcactgcaacctccacttcccaggttcaagagattctcctgcctaagcctcccacggagctggaattataggcacccgccaccacacctggctaaattttggatttttagtagagacagggtttcaccatgttggccaggttggtctcgaactcctgacctcaagtgatccacctgcctcagcctcccaaagtgctgggattacaggtatcagccatggtgcccagctgactaaaagcatctttaggcctggtgtactccttggtatgtagcagatactcaataaatattacttaaatgaataaaccaaggttaagttgtaaaaatgctagaagtctactgaggatcctgacaaactacaacctaatatttgagagtggcgttttcctcactcaacttatttttctattacttgatctacttctaaaacaaaacacagtctaaaggtaaaaacagcaatgaggaaatccccagtaaaatgaatacctttttctttaattaggaaaaaaaaaatggatgtagcaatttgccagtgaggttactccttagtgtatacacacaatcacaacccatgccattccactggtgattctaaagactaaataataaacaggaacacagctggagtcttgctctgttgcccaggctggagtgcaatggcacgacctcggctcactgcaacctctgcctcctggattcaagcaattctccctccctcagcctcctgagtagttgggattacaggcgtgcaccaccatgccaggctgatttttgtatttttagtagagacggggttttaccatgttggccaggctggtctcaaactcctgacctcaggtgatctgcctgcctcagcctccccaagtgctgggattacaggcgttgagccactacgcccagccataggtttttaaatcagaggaacagagattcacatctcagctcttccatttaccagcaatgctaccaatgttcttcatctgcaaaacagacataatacaccaaggaggtgacttttaaaaaaatactaattcataaaactcagaagaaaaagatgactgaagtaacaatctacaaaggacaatcagaagagctgggttactgcatctctagttttctgtatcctccattccaaacaacctgctagatgcaaggccaagagctagactgagatgcagtcttggctctttaagagcttgcaaaggtagaaggagaagtacttgtatgactaatggacacagttaagtagtacaagagtatgggcaaattaaaccatcaggtcttagggagcaggaaaggctgggaaggaaactacagaagagcctcgaaaaaggtcctaatacagagagggaatgcagaagaatgggagggagttagggtccactccaggccctccaagcataaggcaaagtgcatgaaagtttagggcatatttgggaaaagacaaatagatcagtgaggtagaagtggagggatgtagttggtgactacaccactagagtgacagggatggtgccaaggggagaccttaaaaagctgctgcaacaggacaggtgtaattgaagagagctctgaaaaaagcgaggggcaatagaagatcagaaagaacttggcagacaatgaggacagtctcaatcccaatgagaaaaataggaaggcagctaccttggtaaaaaagacagagaacatgcagactttgaaatccagtaaaaatatccaatagagacctgaaaaacatagagaggaattcaggagagaagaaaaagccagacacaggcttctgagttctcgcattaaatgggcagggctccttcaggacacacacagcgacaagaagttcaaaaacaattactaggaggctgggcacggtggctcacccctgtaatcccagcactttgggaggccaagacaggtggatcatctgaggccaggagtttgagaccagcctgagcaacatggtgaaaccttgtctctactaaaaatacagaaattagctgggagtggtggtgagcacctgtaatcccagctacttgggaggctgaagcacgagaatcacttgaacccgggaggaggaggttgtagtgagctgagattgcatcactgcactccaggctgggcaacagagtgagactccatctcaaaaaaaaaaaaaaagaaagttatttaatgtctctggatctccttagattcctcgtgtataaaataaaggtaatactatttaccacagagggttgtcctaaggtttaaattatacaaagcatgtaaaaacaccattacaaaatttttaactgttattatttcctattataatgtaaaattcataaaattcataatagggtttttatgaaagtctgttttatttaaacaatgcctgccacagagtaggtctcagtaagtctttgctgggtgagtgaatacccagtgaaatgctggcaccaagattccagcacaggtaccatgacagtagtctaccctatcttaggttacaaaggttgaaaaccatggtcttaaagggctgtagtgcagactggaggagaaaaaaaaaagctaatttagaatcttaagacctatgtttttaagaactaagaagagaacaaaaaaccagtaagtgataatggagaagaacagtacagagggagaaagggttgtgataagggatctagggtggtaattcttctctattttttaatgtaattagttgtccctcaatatacacaagggactggctccaggacccaacctgccccccacccactgcagtataccaaaatccacacatgtccaagccccactggtggccctgtagaacctgcagatacaaagagtcagccctctgtatgcatggatttcacatcccatgaataccgtatttccgacccgtttttggttgaaaaaaatttgcctgtaagtggactagtacagttcaaccctggatggttcaagggtcaactataggtatttcaaacagaaaataaaatttttaactctaaatagtagtttaaaatacaaatgcacataaaaaaaacttccaatattacagaaaggaataaaatggaaaattaaagtctctattcccaagctccacaaattattactaatggtatatgtatgattaacttatttaaccagtcccttacagattgcttgagtctgatgcgttaaaataagactgcaatgaacatgatcacatatgtcttttttttttttttggacagttttgctctttcgctcaggctggagtgcagtggcactatcttgcctcactgccacctccacctcccgggttcaagcgattctcctgcctcagactcctgggtagctgggattataggtacccgccaccatgcccagctaatttttgtatttttagtagagatggggtttcaccgtgttggccaggctggtctcaaactcctgatctcaggtgatccatctgcctcagcctcccaaagtgctgggattacaggtgtgagcctccgcgcctggccgatcacatatatctttatgtctgactgtatttctctaagtagactttcttggtcggtcagagtatttgaacactgagtattatacactttgaaatctctccttttctgacaggtgaaaggcccattccctggttactgaatggagcatttcttcatgtgcaaagtgtccacctttgattctttgaactaggagtttatgtcctttgccagttttttccatgggctgttttttttctttttgacttgcaggagctgtactacctcaagtaaaaaatgcattttagtttcctgtgaattgacgtagtataatagctcatagttacattaatctgcatatctttttacttatcaaatatttttctctttcaaataagtcattctgatttaagttatgttttcaaaaatctcaaatattatggtatatcttttgaatatttaaaaatctttagggggaaagacagccctgttgataatcaagtctttattacttgatgaataaagagtagctgtggatacacaaaaatctctcctactatctcagaatggaaggaagaatcatgcttgcacacaggtgtggctgatgcgctcagaggcaactgggcagaaggccacagggagcacaaggccttgtggctgggcctctggagcacctggtctcagcacccgctcaggtccttgaagacgaccagacaccatccagggcttggtgtactctctgaagatatatgcgaggcagggggagctacagaagagctgtccagggcctctggttttgccacagggtatgggaagagaaaagaagacactaagaagcataagcagcactctgtgtcagatataatgtaaggaacacaatctgccaaagaactggcctaagccatttcctaagaattttccttcacagaacgtgtaatatcaaaaataacttgccttttatcttaaatactcaaagcttcaaaaccttataatgtccataattcattacatcgtcagaaaaaaactgaaataccatttcatttccaaaagaagtcaagatatacttttacctatgatttaaagcagaacaagcacaaacacatcattttcagacatttgcgtggtatcgtattacttgcctgtgttaagatgtaactcctttgtgcctcttctatgtcaactaaactggcattaatataatcattctcagcattttgcagtttaacacgactgtgatcatctgaaaatagagaatgataaaccacaactgtcatttcaaaattactgtttttatcttcatattaatattctaggtatttataaaaagacagaagaaataagaaaaatgaattagcatcataatagagttgagacaaatcctaaactattctctactttttttgtaaggagtataaaatgcaatcttgtttattactatagtgctggaaaggaagcacttctgtttgtagcacattagccattgtgacttgaaaaatcgaccaggagtaaacatagttaaatgaataaagtacttaccttcctaaaagtaaaaggatcattcagattcttggtacctaagaattgattggtctacctacaaaacgataactggtctcaaatagatgagactagatttccgaggttactatatttcaacctcttcatttctcaacagataagaattccactatatttaaataaattttagcactgaactgtgtttaggttaaatgctgaaaatatttaaagacagttggaatattccaactgtattctttaaaagaccactgaagatacttcactacttagactctgttaacagtttagagatatttctagtttttaaaagtaaaaatctcatagattgagaatttatgctaatttaaatatgtgaaatacaaaatgtgaccttatacatttagatgggaaagcaagagaagcatgacaccaggagaaaaagcccatgaattaactcagaatcctcaacacacaactgccggatgcatatcactgaattataaaactaaaaacatggtgtttgatgtttaactctagagaatgcatactattacaagttgtccctctcaaagaaatccatactaaatagccagtctctccttacttttaaatgaaaaaactgtttatattatctccatatgaaagaaaatgtaaaatggctttagtttcacacatcaatttatctgagatgtttctgctggactgaacccaagacctctgtaaatattacatgtcatttgccaacaggaaaaactaagatcttgttatagtaaatcacatatactagtgttctcagaaagatgatgtcaacaagcacttttttttaaaaatcacttttttaaaaaacagtttaatcaccctttaactgttatattatgtaaaatagtaaaaaggtcagcaacttaattaaaataaagaccacatatctcctagacaacataccaaaaaaagaaagcctggttttagaaaactacatgattttaaaattaaagttccactaaaatatcacaccaaaggaatgtatttcctcatgttgtaatcacagaaagaacactaaccaaaggctactcatatctattgcacaactgaaaacagccatttagctaacatgcggtaggaatccataaaacccgggaaggtccacctcacagggtgctgggaatctggttaccccacatggcaccaccccacacccttgcccagctatgcaggaagtaaacctagagaaagaccttcagccagagtatttgatacctcaccctcaggactctgaactaaaattcactgctattttccttctatctgtaaaatatgcacgaggtgttacctcaatgctctataagcacagtaaccacacaccagaaaagcccagatccagtcctgggaggcagtagggaggagggcactacctgcagggcactgggtctgcagggctcagcccctggcagtggcctcgcttcctgtttaacattaatatacagagtcaacaaaagcaaaggaacggtgaattttctcaggaaaatttttttttattttgttatcagataatactaaaaaagaaaggtaatccttgggaaaactctatagctatttagaactgactacaaatgttatttgagcctgtattttcttctcaaggctgattaaaaacaaaactgaaatacctacatcactagatattattttaattcttctgttcttttaagaaaaacacatacaaaggaaaaatgaaaaacaatttaaaaaggaagaaatattaaagcaaaaaggagaaataaaactttaaaataaatttaaaatacattaaaattataaaaacaaaaattgaaaaagattaatataaaataaaaagtatatataactttttgatttcgaagaggcagtagagaaaaaaataaaacacatcaccttaaaataactattgcaaaagattgtgaatatacacatttcaggaagtgaaactatcaaagcctctttatgagaaactgtgactttataatttatactctttagtgatgataacaaagaagggcactacctcttctccaattaaggatcacaacacacggtttcgagtttgtgagagcatatacacaggttcccttaacaacctgagtcacaggtctcttttccctgcccagatactatcagtcagccccaaatctgtaaactaatcattaaaaaacaaacttttgacttctgaatgagaacacacagaaaggtacatcctttctcctcttccataggaacctctgacatgagattatcataacagcagcatcccataacctttgggctgtataagtaagccccaaagcccactatactttaccatccttgtaagtctggttatctcaccctttcctcttttaaaggatccagtaaagggagaaaaatgaagatagttcaaactcttttgcatgggataccacaaaagcaaccaaaccacacttcacaggaaatcttatttctcaacctctactagcactagtagcagaactatcaagaacatacacttttttttctacaggcatcatctgccttaattcttgtcactgagtaaatgaagaaatgcaatacccaaacagaactgtggtttataacttggattaaaattaagccaatttctgacaaggagtcccttcacctcctaccctcaaacagcatgttttctgagaaacagctccacctctcaagaaatgactagtgctagctgtggctgtgctgacaatacagattagtttcctctttcaatactgtcatcataagctttaaaaaaaaaaaaacaacccacagctttcaccaaatatatcattattgtaaagacatctccttttggaaagttttccaggtcaaacagaaaggagaatttgtattcattgtaactggttacaattcatcctgaacaggttaaatcacagcaaagatcaagcatccttaacttacaagtcaggcaagaagatgaccaattctaatagtacagcgtgaaccagtgacttttcccctttagattttcccattctcaactaagggtaatcagtacgttttcaaacagtgatgtccaagaactcaaagcattttctagatttgtcaactctcttcaatcctgcaagtaaaatagtcgaacaacaaatattatgcattctctctcataaatcgagcaatgaaccaaaaacaaagctggcactaaacaccaggtcaccatatactcccccatattaatggagaatacaaactttagtacacatagaatattaacatttcaattgtttgctctgcaaagaaaattctacttgatgaaaggtttccaattgaccacaaaaccaaccagaaccactgtctagaaccatttggtgcctacgacatgtcaggtttgtgtgacactcgtcactgggtcacctctctcagtcctcacagccctatgaagtgcatatgaatatggatcacacccatcgcactgtcactcagggaagtcaagtcatcacaagtgtaacacactagagcacaaaaatgaaacctagatttgtgcaatttaagagattacctatttcctgcattctgcattccatgtctccctgatccatccagttggtgcctttaccatcctttccatacatcctaaattcttgctgacatcaccttttcacgttgctctccactcaggtgtgacttccaactcctctctcacataaaccccacttctgtgccgatgcagtccatgacatatcttctctaactagacgctctgatggaatgcctccatgatgaactggtctgttccctgcattgaatactttcagcaatcatacacaatttttagtcaacaaacatattttaacctatagggatctaaaggtaagacattatttgtttgaagcttttaaaaaggaaaaaagaaattatattaagccgtgactctgagtactgatactttattgcataaaatattgtgggaaggagcttgagtagttgctacctgaataggcctagtgagatcagcaggaaggggaaattccagcagagggcacatcataaagaggaatgaaagggaatggtgtagcggcaggactggcagattcagaaaggctggcgagctggctagagagggctccccagacacattaagggcggaccctgaagggcacgtgggccgtgctacaggcacaggctctggacagggccccagtgaagttctttaaaggactggtataaacacatttgattttcatgaaaataactctcagcagcatagaagatggactgaaccaagaagaaggcaacttcatacaccaatacactgaaagcgtaatcaaaaggtgatgaggcctgaatcaagtagtggcggtgggaatgtaaagagtatttccaaggtagcaccatcacagctttgctaataaagtatacattgtttaggaaacatttggtaagttcaaccttttccaaacaatagtttactgtccttgaaatcatcagcgtctttcaacccatcatgatttcaagatcctaaacttgacaggacaatgtcactaattaaattctgattccacaaatctcctaattgaaaaagtcctctttaatctgtccccaagagtctgcaatgaaaagaatacctgagaaatgtctttacaaaataggtaaaattcattagtttggaaaacagacatttttcctctttggtagcttgtataaaataagacatactaatcttcactttaaaataatcagtaagtatctcaccatttttttttttttttgagatggagtttcgctcttgttgcccaggctggagtgcaatggtgcgatctcagttcaccacaacctccacctcctgggttcaagcaattctcctgcctcagcctcctgagtagctgggattacaggcatgtgccaccacgcccagctaattttgtatttttagcagagacggggtttctccatgttggtcaggctggtcttgaactctcgacctcaggtgatccacctgcctcggcctcccaaagtgttgggattacaggagtgagccacggcgctcagcagtattgcaccattttctttgaaactcagactctccgcttctaggagagttagagcctaaacaaattgaaggtggagggacttaggggaaaagatttaactttcatcacatccaaaggcccatgagacaccatgcaaacaatgcggaccaaatatctatattggtgatatagcaataagcataactaagtaaagtatatgagtaataaatgctaagaaaaaagagtaacgggactcacagcgctggggagaggggcaggttgcaattctaaacagggtggtcaggatgggccttgtggctgaccacccaggtgggtcacatgtaagcacagatgtggaaggggtcagtctcacggatattttagttaacagtgttccaagcacagagaacggcgaatgacttaaggtggtacatacctaacatgtctgagggacatgaagaatgtggctggagccacggggacaaagcggagaggagcagtctgcagtttaggttcggagagtcaagaaatcctgtactgattcatttctcctaaatttgactgtcagggaaaaaggactgctacttccattttctcagcgggcctacctagtagagtgtcataacaatttaagtcagcaagtattcaaacattgtttatatgatgaattccagaagattttcacatattcaaattcctacacctgctagaattttgttagaatgacaaatcactatcaacccattctgaaccataagcaggaaatgaaatgacgttaactgactttcttaagcgtaaactaattcggcagaaaggaaaagcgcagaaaccttcaggacttcttagtacaggtacctggaattttgcgacgcagatgaaaaacatgggtgaggggagtttgagggatctaaagatgtggattctgatctctcttttggctctaccaacctacatgattccagacgtagtcatgatttcccagaaaagggtgactactacttgagaaacactatcagcatcccagtcgccgacagtcctatgataaggggcactcaggggtctgttttcttgtctgtcaaaatcagtggctcgaatggaccagtccttcttgattattttcactgacaaaccctccttaataccctaagagggtattaaagtacaaaattccttggtaattcctattttaccttaaacatttaaaggaatttcagaattctacttgatcatgtatctgtattttaatctagaaacaaccacaccctcaccccaatcccgagtacagctgactgtcctggactccagcactcccccactgcacgcttccacagctccctccacccagcgtaagtgctctagggcagaccagcccacccaaggtgctgtggcttttaagaggggcctcttagggcaagattctgatcagctccgctggtggagggcagcaggagcacccaggcacccagtagcagccttcttgccacagttaagctctttgcagccagggacgctgtcagactcaccacagagccccactcctagcaatgcgctgtccagggcctagttccagaaggccatcaaactcagaagcatgaaaagacactgctacaatccacagaccttattttgatttctccagttctacaggcactcatttgtgtgtgctcagttctatgccattttaccacaaacaaattcacatgaccaaaacaacacatacctattccatcagcacaaaggttctgtgtgccccttggcaggcacactcttccccattccacccctaaccaccgatctgctctccctctcgagaattctcatcatttcaagaatgttatataaatggaatcatgtactatgtcatcattggaaactggattgttttcacccagcgtaagtcctctgagagctacccatgttgttacgtcaagtttcttcctttttattgctgagtagtattctgtgttatgaatataccatagttaaccacttacccactgaaggacatgtgggttgtttcgaatctggggctactacagataaagctgctgtgaatattcatgcacacacttttgtgtggacattatgactgcatttctctgggataaatgcccaggagtgcaagtgctgggtcatataagctaagtatacgttcagctttttaagaaactgccaaactattttccagagtggctataccagtttacattcccaccacccatatatgagatccagcttctctgcatttttagggtattgtgatctctttactttagctgttttagtaggcgtctagtgacatcccaccaccatgattttaatttgcattttcctaatggctaatgaagttttttatatgttcataggcttatctgccatctgtgtcatatcttttgcccatttcctaactggggtttttgtttctttttactgttacattttgagagttctatatatagtccagatctaagttctttgtcagatatgtggtttacattttctccaagtctgtactcatctttttgtcctcttaacagggtgttttgaggagcagaagttttttatttcgatttagtataaattattgatattttaaatgaattgtgctctaggtgtcatagctaagaactcttcatctagccttacatcctgaattttctcccattttcttatgaaagcttttacattatgatccatctatgatctatcttcagttaacttttgtgtaaggtgtgagatttcattttaaattgctttgcacctttgtcaaaaaatcagttcaccatatttttacaagtctatttctagattatgttccactgacttatgtatttatccctctgccactaccacactgttttgattactgtggttatgcattaagttttaaaactaggtagagtgattcttctagtttttattttccaagatcattttagccattttattttagttcctttgcctttccacataaaagaataagcttgtttttatctacaaaaaaacttcctgaaattctgacagaaattgtgttagatctttaggaacaatttgacactatgagtcactatagatctatagaacaatttggggaggactgattcactatgctaagtcttccaatccatgaacatggtaggcctttttcatttatttaggtcatcttttgatttcttttatccatgtgtttggtgctttcaacatacagatcctatatgtattttgttagatttattccaacatattccattttcttagagcaactgtaaacaacaatgtgtttttaatcttggtttccacgtgtttgttgttaatatacaggaatacaattggcttctgtatgctgaccttgtatcccacaacctcgtttaactcacttattagttctaggacattgttgggtagattctttgcaatcttctacatgtcatctgctaataaggtcatttttatttcttcccttccaacctgtatgccttttatttccttttcttgacttcatgtactggctaggattcagtacctcaagtttatatgtatttttaatttgtatgtttaaataattttaaaacttacagaaaaattccaagcacaaagaattttcttcccaagtcatgacagcaagttgcaaacatacctgattattccatttttttatcttctacaatgacataatcctacttactcatagtatagccatcgaaattataaaattaacagtgatactttactaacccagacaccattcaagttctaccaactgtcccaataatgtcctttaaacaaaaggatacaatctgttctttcacggtattttttaaccttttgaaactgtaagtcagttgttttatagtgttcctccatttgagttgtcagatatctatttccctatagatgagttcagtttgtatatttttggcatgttcatctcagaaagatgctaagtattcactgcatcttatcgggtggttcaggattctgacatggtatatctcatgactggtcatgaccacatatttaaggctggtgttggccagacttctccagtgtagaggtactattcctcttcttatatttaataagtattttgtaaagggatacttcaagattatgtaaataccttgttcttcaccaaattttcacccaccaactttagtatccatttcaatatttattagttggcaacctatacaaaggtagaactttccctatccctcatttatgtattcatttgtttctttacatcagtatagacacattaattcctattttattcaataggttgtaaccattatttattttcatgctcagattatcccaggtttggccagtggactcagcttggcttctacatccttctgatatgtcttcatcattttttgggcatgtctttatgttctgtcactacaagacattccaggctattcttacactttccctgtcgcagacgtggaaccagccatttctccaaagctctattctcctcctagtggagaataaaatttggtatcaaaagctaagcatgcccaatggctcatcagctatcgctgctctcaagatttcccagtggacagggataagaaatataggtatatacacatacctatgttcatatttatctgtgtatctatactcactgaaaaccatgcattcatacctggatacagcaatgctaacccaatattacaggcttctttttcaaggacattaccacctttactcacatgccttccacatgtgggcccaaccccaagtgctttatagatttaattattcagggacagagaaagagaaacttaatgatatctttaatactctctttactaccctatgacaaaactatgtacaagatttttgtcagtccaaaaaaaaaaaaagtttcatctgttaaggaattcacaatgtaataggacagaaaggtgaatgcgggaaattggtgagaaagagatgaacaggggcaagaaatgaagcatacaagaaatagaccaaagtaatctaatgcaaccctctataattcattcacaaatattctctagaagatctgacagtgagaagatccaccctctgcgtgaatacctccaataacaagtgtactagttcagagggttcgtttgtaggtttaaaacagctcttaagagctaatgctaacctgatattcaccagtgctattattcgctcatgaaccctagttctatattttgggcttaacacaggataaagaactcttttttccatgtaaaagttcaggtatctaaagtcagctatcatgctgctctgtttaggttttctctttccctgtctaatcaatgctagcttcttctctaagagttctagttcttcttccttggaaccactccagtgcatcaatagcccgcaggaataaattattaacatcataaatagctttgatttggctttgattaaaattaaagatttttttttttttttttgagagggagttttttttcgctcttgttgcccaggctggaatgcaatggcgcaatctcggctcactgtcacctccacctcccaggttcaaacaattctcctgcctcagcctcccaagtagctgggattacagatgccagccaccacgcccaactaattttgtatttttagtagagacggggtttcaccatgttgacctcaggtgatccacccacctctgcctcctaaagtgctgggattacaggcataagccactgcactaggccaaaactgaatatttaaaaaaaaaaaaaaaaaattgaagatagaactaaagaccctaacagtgagtgagaaaatcttttagtaaaaaagctgtcaacaacggattttgagaaggtaaagcactacactgacatctggtctttattttcaaactttaatgggataagaaaaaatgttagcaaatatttacataatagttaccataaaatttaacttaaatctatacttattcggattattattatagaactaagtttttatctaaatctgctattactaagaaagatgacaagcactttctggtaagtttaaaggtttctttttaatgatttgaaggtctatcatcttataattctaagactatcaaaatgtttcttaataattctttgacttgtctgcacatttctagaggggttatctacgaagcaattcgtatcatctatagtggtgatggttttaaaatatgtccacaattcactgatacttcctccatcaaactaataagagtattaagtaccctctccttgaacatgcatggccttagtgagttacttctcaaacggaatgttgtggaagttgtatgtgacttctaaggctaggtcacaaaaggcaatgaagcttctgccttgctctctaagaatgctcactcttgaaactcagttgccttgtgataaagtccaggtctcatagagatgccttgtgtaggtgttcctggtgacagcccagttgaggtcacagtcaacaagagtaaagaagttgcttcttcaaggtgactccagccccagcccccatttgaaatgcaattacacaaaagaccttgagcaagaatcacctatgtggggttagtcaacccctagatttgtgaacataataaatgtctcctattgttttaagccactgttttggggtggtttgttatatagcaacagataaaacttttatacttttattcctcttactgaaccttcctgctttggctatgaaagttctatagtggcctcataaacagattaaaagacagttaatttatttctttccaatccttatggcttttatttctcattcttgcttactgtactaactaggacctagagtataaggtcagggagacagaagtataatgttaagtataagtggtaagaatgaacacacttaccttgttcccaatatttttttaaaacaatgctttcatcatgtcatcattatgagtgatgttgttgcagttatctcttagaaatcttagaagttcccttctatttctagcttgctatgtgtcatttttaatcctcagcaaggactttaaataatctttccacacttattgagataatcatatggctctttctcctttgttactgtggtgaattataaaataatctaggccgggtgcagaagctcacgcctgtaatcccagcactttgggaggccgaggcagatggatcacctgaggtcaggagctcgagaccagcctgacaaacatggtgaaaccccatctctactgaaaatacaaaaattagccagacatggcggctaacgcctgtaatacaaactacttgggaggctgaggcaggagaattgcttgaacccgggaggtggaggttgcagtgagccaagatcgtgccaccgcactccagcctaagcaacaagagcgaaaccctgtctcaaaaaataaataaataaaaaataaaaaaggtattctaatgttagctacccttacattcctgaaataaacttaatgtgaacataatgtattatctttttaatacattgctatattcagtttgctaatcctttgttaggatttctacatctatattcacttgcattattatgaaacataccggtaaaaccagctggcccagtgttttctttgtggattttgtttattaatgtctttaagtggactcttcagactctacttctgcttgagtcagttttggtaaattatgtttttctaggaatctgttccattttttctaaaaaatcatatttactgccataaaattgttggcagtattcaattcacgctttctttgtatacctgtatttatgtgcccactctttctcctgatattgtttatatgcaccttctttctttcttgtttgattgatcgtgctcgatcttgacagagttgatcagtcttaccgaggctaacatttagtttagttggtcccttgtgctgtaactgtgatttctatttctgctcctttgttgttgttacttctttctgctttttttttctcattctcttatttttactctaaattaggttagacagcacattaattttaactttcatcttaaaatactgggctaggcacagtggctcatgcctgtaatcctagcactttggaaggccgaggcaggcagatcacttaaggtcaggagtttgagaccagcctggccaacacagtgaaactgtctctactaaaaaacacaaaattagccaggcctggtggcacgtgcctgtactcccagctactcgaggggctgaggcaggagaattgcttgaactcgagaggcagaggctgcagtgagctgagatcacacccctgcactccagcctaggcaacagagcaagactccatctaaaaaataataaataaaatataatataaatatttaagacaatatattttcattgcagtactgttttagctcctttacacaagttttgataagcagtattttatatattgtttatttttaagtttccattataattttgtcttgacccacgatttagaaatgttaaaacttccaaatttatggaaatgtttatctttttattaataacctatattttaattgcattaagataaaaaattatgagctataagataggaattttttttttttgagacagagtttcgctctcgttgcccaggctggagtgcagtggcacaatcttggctcaccgcaacctctgcctcccggattcaagcaattctcctgcctcagcctcctgagtagctgagattacaggcatgcaccactatgcctggctaatctttgtatttttagtagagacgaggtttctccatgttggtcaggctggtctcaaactcccgacctcaggtgatccacccacctaggcctcccaaagtgctgggattacaggcgtgagccacagcgcccagccaggcattcttaaattttaagatttacttgacagcctagtcaatggtccattttttacaaatagaccatgtcagtcctagaaaaatgtgcattttctaattgctggatatagggttctatgtatttttcttcttatattaaggttaataatattatataggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaagaaaaaagaataatattatataaatctatttctttacaaatatcttgtcttattaagaagcccatgaacatggatttgtcaatttctccccaaaattctattcatttttgcttaatacatcttggggctactttattagctgcatacaaatctcagagctgatactgacatctgcattcaaagtagttatgccatttgctaagatcatgcagggagcgtgccgaaagcatagaagttttcccttccttcttccccctctagtaactcatttaaaaagtatgtttatttgagaatctttttgttttgtagagcaacaaaccatggactatgtaacctgacactaccagaatcatgagtctctgtgttaatttcctttaaaatctgactgtttcacatggatgaaccttgaagacagtatgtcaaatgaaataaaccagtcgcagaaagacaaatactgcatgattacacatatatttagtgtctaaagtaatcaaactcatagaaacagaaagcagaatgctggctgccaggggctgggggaagaggaagatagggagtttttcaatggatttagagtttcagttatacaagatggaaaagttccagaaatctattgtacaacaatgtgcatacagttaacaatactgttaatatacacctacaagaaatttatggtatgggtttttaacacacacacacacacacacacacacacacacacacacagattgtttcatggccagtgaaaagacatgacagttgactcaattgctggcactcccttttagaccaaatagtaaactgggatttctacctgtactgcaaataggaagatctcaaaatttggtggtagtctctaatagtataaagacgtttcccaaagtaaccattacaagctactctcttttcaaacaacgaagttcttgtccatctcttctacaatgtctcacagttaactgagacaactgaggcatctctaggttgtagcagattatggacctcttcaaatcctttcaattttcttccttttttgagacaaggtctcacattgctcaggctggagtgcagtggcacaatcacagctcactgtagtctcaaattcctgggctcaagcgatcctccctcctcggcctcccaaagcgttgggactacaatcatgagctgctgcacccagcccaaattcttcctaatttaaaatatcctttttcctttatgtttctcgtattcagaactccaaatgtagtttccatatgtcagtctgaggagtggtgccatagtgagtgtaaaagaatcatgttaagattgtttaaaaataaacatttccagaccggctgaatccaaatctagaaaagaaagatctgggactctgaatttttaaaaaattctttttccattcccctttatttacctagttcaggctaccattctttttcttaaaagccatccctgcctccttgggcagagcctcttctcagctccatcaatgcactgtcatatcttacaatatctgtaacatgcttatgtgttaatctcctcaagtataccataaattattcgatacatagcatagtatcaaacatgtagctggttttcaacaaatgttttctgaaccaaatcagcaactgtcaagtactatgtatagaaatgcatttaaaaaattttttagagacagtcttgctctgtcacccaagctggagtgcactggtgccattgcaactcactgcagctttgaattagtggtctcaagtgatcctcctgccccagcctcccaaatagctgggactacaggcatgcatcaccacgtcccagctaattaaaaaaaagttctgtgtagagatgttgcccaggctggtctcaaactcctggccttaagcaatcctcctacctcagctttccaaagtgttgggattataagcatgagccacagcacccagccagaaacacatttttaaattacataatgactatcagttggaaaaggtacagcaacaccatcccagcttttaaaaaatacacattcctgagcccctctggacttagtgaacgagaaccaccacctccactggatgagaataccactcacgggaaagaggttgttgagctggtatttgcagaaggagaactttgattgagatgggtcagagagaggaggggaagaatatttcaaaaagggaatgacatatttgaagccactgaggtattaaaaaccagtcacgctagaagaactccaagtgattcagttttactgaaatgaataatttctaggaaaatgggtagaaaagatttagagaggtgtgtaaaggggtcaatctccaaaaagcccagtatgataatgctaaagaagtttaactttttcataaaaattgtgcagcactattagagaggagagtggaaaacacacttgcattatacaaagattactccagataccatgaaaatggactgaagtgggaacagaagggaaacaaggagatgggtttggaggctactgtaatgacgaggaaaagcgtagtagggcctgaaccaagccaatgtgaacagagaagaaaacagatttgaaatacattacggaggctgagcacggtgcctcacacctgtaatcccaacacatcaggaggtcgaggcaggtggactacatgagtccaggagtttgagaccagcctgggcaacatgacgaaaccccatctctacaaaaaatctaaaaaactagctcagcatggtggcatgcacctgtagtcccagctactcaggaggctgaggtgggaggatcacctgagcctgggaggcggaggttgcagtgagccgagacggtgccactgcactccagcctgagtgacagagccagaccctgtcttgaaaaaaaaaaaaaaagaaaaaagaaaaagaaataggaatacatcatggaaatggaaattagtattagtgacgtgggaaatgaatgagggaagaatctgtttctggcttcagaaaatgtgtaaataacggcaccacttataaacatggggaaaaggagaaaaggcaggtgtggggctaaggccagtgaagtgtgtcagggaggaacactcactcagtgtatactgagtctgaggtggctacaggacacccagacagagatgatgacttggatacacagacctgtagacagaaaagtccacgactgcagatgagatttggggttataagcagagatggaaactaggcccacagcagatgagatcattcatccaagtgttacagtgagaaggagagagaaacagactcctgaagaaataaaggcaaagtgaggaggagacaccctgaaaataggggaggggccaaagaggaaaatcagaaaaattacggggttaggaaaaaaggcacggtcggctgggcacagtggctcacacttgtaatcctagtactttgagaggccgaggtgggccaatcacttgagatcaggagttcgagaccagcccagccaacatggtgaaaccctgtttctactaaaattacaaaaattagccaggcgtcatggctcgtgcctgtaatcccagctactcgggaggctgaagcaggagaataatgtcaaaagtcacagagaaggaaaccagtggaaagtctctcattgcatttgacaactacagctacagtgcttttagaataagtttcagtggggaggctggagaagaagcatgggctgaagtgtgcatggtggggagggtggagagacaaatggcacattgattcttttaagcctgtgtacaggtaagaaatgtccatccatgtaggtaagaaaggaagtgggggctggggtaggatataagggttgagacaaaagagagcgaaccatatttatacaaaagagaagaagttatgagatagaaagaggctgaaaacacacaaaaagcagtgatgatgaagagcagggcccatgaggaggatggggacgaaggattcggctaggacagagggaggggaggcttctctcctgggactttagggaaggataggggcaaaagaaagtgagtttccaggtgatagaacatgaagctaaggtggtgtttcctgatttttacaatttttatctgtagaattgaaagcaggacgatatcctgagcatggtgaggagctctgagagataatttactcggtgcagagctggaacacggtggcagtggggcagacgagggcatgaggacagcaaggcaaccccaagcccacctaacactggagtccacccaaggcacacgctcatttgcccaaagtgcagagaggatgaatgactgatttttcctaagttggagcttcacaaaatggtggaattaaaaaatccagagttattttttaaatataaaaacaacaagaaagttattaatagttaggttagaggacaaagtaatatgcttcactacattttttaatcgaaatttcaattcaatacatttccaacttcacaatacatgaaaaagtcaactaaagatcctgctgaagtcaaagagcaggtacagtgggagtaagcaagtgaaagctggaatgacagaaagtagccctcaaggcagcagagtttcagatttcagaggtgaagatgactaaaggtcaatgtcagcggagctgaacaggtctaggaactctagcgcaatgagccgtagttctttcccagagacatgaagtcacccaggatgaggaaggtgggaaggagagggtaaggagaaagacagtgaatgactgaagtcaggagaggagaggtgccaaggcggtgtggggatgtgctggccagcacaagccttggaagagatcatttccatttgcaggctgaagcatattggctcagactagaaaatcctgtggctacgtgagaagcaagaatgagcagtctctttctgagagatcaggagaacatggcttactagggaggcatgtgtggggagggagggggcaaagaagaagaagagtaaggagaacatgcactgggggctgctcccagcagagcacagctccagaggacaaccactgcatggtccgcaggagggaagcttggttctctcaaggctaagtgcttttcaatgagaaggcatacaggaagagcctggtcccaatgatgatggagggaggcctgataacgcatattttaaagagtctccctgcagccttcaactgcaggtatacaacataagtctaaaagctgaggagaaaaatcataagttttattgatgtatatacttgaggataacttaagttgcaaatgtttttactttaaaataaaacatctcaattccagttaaaataaaattatcagctgggcatggtggctcatgactgtaatcccagcactttgggagactgaagcaggcggatcacttgaggtaaggagttcaagaccagcctggccaacatggtgcaactccatctctactaaaaatacaaaaataagccgggcatggtggtgcacacctgtaatcccagctacttgggaggctgaggcaggagaatcgcttgaatccaggaggcaggggtttgcagtaagccaagatcacgccactgcactccagcctgggtaacagagtgagacaccatctcaaaaaaaaaaaaaaaaaaatcccatttagatcaattcgataaaactaattaggggactcaaatgtagtgtagtgcatccaataattgcaattacaacaaatatataaaaattaaaggcaacaccaggttagggaaggaggatccaagcaaggagactgtggccccagaaaggcagtgcaagtgaccctgtgatgggaatgctccactggtttgcatctagactgtggtggtgattccaggaatctacacgtgataaaactgcacagaacttacacgcacacacaaatgagtgcatgtaaaactggtgaaacctggatggactgtattgtttcaggttcccaggtgtgatattggactgtagttatgcaagatgttaccactgggggaaactaggtgaggggtatactcgatctttctgtattatttctcaactgcatccaaatctacaattttcaaaatcaaaagtttttaaaaaattaaaggcatcaaagcaaggtgtacaactggaaaatactgtcttcaaaactcatggtaacattagagaattattctctgtagctcagtgattctcaatcagagatttggaggcaggggaagggcacctaagtatcagaattactgcccacacccgctattccctgaacgcacacccacactggaactgccaccgtgatgagccacctgtttcagaggaagtgggtcaaatcttcaagtgtgctgcaactgaagaaaatggaaaaccactcttctagctacttgtctttaagaacacttctaactggtagtaaagaaaaaagcattaagagaaacatagtatttaatagtaatttataacaaacatgaaagattttcagagactgcttctcatttgatttgcccaaaatcagccaatacacccttcttggaaatgtatttggtcaacataagaaaaacattctattcatgtaagaataaaaataaggatttttttccagtaactgatggatttttcagtggtacatccagaccctaaatatcttatctataaccaatgactacaatgtatataaaggtatacagtctgtgtccttgaacagtgaaatggttcaacctacacaggagatcttagcaggcagcaccataccctagtcaacaggcgaacaatcagtaacaagcaaaaaccagaatgtgatcaatctgatactgtttttcaagtccctaccaacagggagccctaaagagaaaacctatgtttagcccactaaagtcaaacatagggaaatatgctgaagcacgaaggaggcccaatttaatatctgaataagctgcatgaatcagaacaaaaaataaaatcaccgcatgatgatgaatacaccaaagaactctagtattataattgttcacacaattgtgtgcgtctgtgtgtgtatacatcataatctaaatgtccaacaacagggaacttatgcaaaagagtggtatatccaaagccactgtcaaagcaattaaaaattgtttataataaaaaaaagtttacaatgtactgctaagaaaagagctacaaatgagtatgtggcaagattctaattttccgtttaaagtacatgtttatttttaaaaactccaaagaatataaacccaagttattatttatttttaaataagtttgttccttatactcttctctgttttctaagttttctacagcgagtacatactactcttataacttggggaaggaaaaaaaccaaactacaccaataactattttaagcaaaacttacaaaggggatggaatgatatgaaaaggaaatacatatggatattatatagacatctataattacaattattttaaagaaaggaaaactgtgcataagaaaaacaggttgtgggaaatacaccaaaataatggtgcctatgtttgaaggatgaaataattatgggtaattatttttccttccactattctacacctttaaattcttaaagaacgtgtcttacgtaaataggaaaaaaattactgtatttatcaacactgaccccaagccctccttttcactacatcctgcctcctaaaacaaaccaaaaaatacacatgcacacaaacccacaagtacttacatgggcttacatctctgtatctgtttcgatttctgttttctggaaacttggccactctatgaggatagtcatgggactcatttcgaatttccttaaaataacaaaaatatattttaatatccctcttaaattctccacagcaaaacttatcttcccagccagcgtaaaataacatgaagcacttatgatatgccaagtactatggaaagcacattgtttacatcaattaatcatttaatcctcacaatactaatggaaacgattttcttccccattatatctgtgagggatgaaaggctttcaaaggttaaaaatccaccaaagatcccatagctagtaagtggcagtcccagcattgaaccaaggtccttcagatgccaaagtctgtgctctagatctgtttacttactgctaattaggctctattcaacacctacaagcaagcatcaaacactttatgaagcagaattaatgcaatggaggtatctatggtcagccacatcatattcaaattctgactaaaactcacagcatctacctaaattttggagtttctacctgaaaatatttatttcttcatgttcacgctatttaactgttactttattttgaacccagaaatatcctcaaattttatttctatcatgtttgtcattacttctccttaaaaaaaaaattatttctagagccataaatgttcagcaacaagcctggcgcagtggctaacgcctgtaatcccaacactttgggaggccgaggcaggcggattccctgaggtcaggagtttgagacgagcctggccaacattgtgaaaacccagctctattaaaaatacaaaaatttggccaggtgtggtggctcacacctgtaataccagcgctttgggaggccgaggcggggaatcacctgaggtcaggagtttgagaccaacctggccaacaaagcgaaaccccgtctctactaaatatacaaaaaatcagctaggcgtggtgatgggtgcctgtaatcccagctactcgggaggctgaggcagaagaattgcttgaacccgggaggtggaggttacagtgagccaagatcgtgccattgcactccagtctgggcgacagagtgagactctataaaaaaaaaccccaaaaaaatacaaaaattaggctgtgcgcggtggctcatgcctgtaatcccagcactttgggaggccgaggtgggtggatcacgaggtcaggagttcaagaccagcctggccaggatggtgaaacctcgtctctactgaaactacaaaaattagccaggcgcgatggcaggcacctgtaatcccagctactcgggaggctgaggcaggagaatcgcttgaaaccgggtggctgaggttgcagtgagccgaggtcgtaccactgtactctagcctgggtgacagagtgaggcggaaaaagcaaaacaaaacaaaaattagccaagcctggtgacgagcgcctgtaatcccagctactcaggaggctgaggcatgagaatcgcttaaacccaggaggcggaggctgcagtgagctgagattgcgccactgcaacaaccagcaggcctgaggctcatcctaggcgccttcgggttctctgcatttcaacatagaagacattctgtaaggctatgtccgcactaagctctcactactgatgtatccagaatggccaggtttgatctcccaggaaacagtgttctaagaattcaagtaaatacagaaatgtaacagaaaccaaaaaaaaagcattttaataggaaaaattaaattatgcttttgctcacattattacatgtaagaaaaagcattttaaaagttaggtgccattttgtttatttgtttttatagacatagggtctcactttttgcccaggctgttctcgaacacctgggctcaagtcatctacctgcctcagcctcccaaagtgctaggattacaggtttgagccaacaccatcagccgagtatctgaagtttttatttatgaaacatgatgcacaaatttctaatatgaaacttctccatttttctggaagtgaatggactggtaagtacttttgcaagatataagacactgttattagcctgcacgtggaagagaaatttaattttatcccttccaaatggaaagttaattgacttaataccatttattggtttctgcatttatcagtaacacctgctctatcataaaccaagtttcagcacacgcaggagtctgtttctagatcctcattctacttcacagaagcatttgcttgcccttgagacagtatcaaattttagttactacagctttgtaatcaatgcatctggaaggcaagttgtcccctatttattctccccatttgcattgccgttcatgatattttaattaattttgtagttttcttcataaaggtatgctaaaggttagcataaatgtataataaaggtttattcttagatacctgataagttttgtcgctactgtaaatgggattaaaacaacaacaacaacaaaaacctattgaccattactagtgtataggaaagatatagatttgcagggaggggaggcttaaaacaacaggcagagcaggactccctccacttcttccacttctgtgatacacacacacccattttccacacttaaggccatctgtcaggtgcagatttctatttttagcccagagaaacacacttctttgtgtgcactatacaaaagagggtaaggcccccagtatagtagtagggagatttaaaatttacaaaacacaatacaacagccaagttcttggggttaagaaatacattcataacataaatacattttctcagctaataagatctcttgcattgagtccattctttcaaatctccaatattgttctactttataaaaaaaatttcagtgaacttacaagaaccaatatttcaaaaagcagctcccaaaggtgcatattagcgtttattccaatatcctctttctctttctttttttttttttgttttttgaggcagagtcttactctgttgcccaggctggagtgcagtggtgcaatctcagctcactgcaacctccacctcccgggttcaagagattctcctgtctcagcctcttgagtagctgggattacaggcatgcgccaccatgcctggctaatttttgtatttctagtagggacggagtttcactatgttggccaggctggtcttgaattcctgaccttaagtgatccgcccgcctcagcctcccaaagtgctggaattacaggcgtgagccactgcacccagccccaatatcctttctttcttactaaaggtaactgcttttgttttcagaccacaatgagcccagctgaaaactatttgtcccagcctctaaggtcctgtgacagtctggccaatgggaataagcagaaaccactgggttggggctgcaggaaaacgctgacaaagaggactggctccaggtacctttgtcctcactgctgcctgcctggaacataggttttgctgccgggggtgaggggtgggaacaggcaggagccatcctgtgacagcaaggtaaaatgcacattcctaagaaaggtaagcagaaataccagcattgagtcatgggtgacatcaagaagccacagtaacagcccttaagtctctctccagaattcatatcacatgagaaacataaactcctggttgttaaatcagctattgattaattttctttcccatgtagctaaatcaggtctgtaatatacgcagcaaaaccaaatctcaacagcaactagatctgacactgatgaggcattttcaggaatacccaagacacaaaaataaacaattttataagcacattgcataagcaataaaatatacagtatctgtctaaatggcattaggaaagcagacagctgagctattcactaggtctatcacataaggcaaagccagctctacttgtgttctggagctaaaaccttccccttctatcacagattccgaatgtttcctctgggcacagtggctcacacctgcaatcctggtgctttgggaggcccagctggaaggatcacttgagggtaggagtttgagaccagcctgggcaacacagtaagacaccagctctgccaaaaaatttttttaattagctggggatggtggtgtgcatgtgtagttccagcttcttgggaggcagagacaggaggattgcttgaactcaggagttcaagactgcagtgagctagcatcctgctactgcactctagcctgggcaacagagtaaggccctgttaaaaaaaaaaaagtttcccatcagcagtgaaacctgttaatccaaggtttctcagcctcagcactactgacattttaggctagctaattttttttgggggggggggggcaagtggggactgtcttgtgtattgcaggatgtttagcagcagcatccctggcctctacccattagatgtcagtggcacccctccctgcatctgtaacaaccaaaactctctccaggcattgccaaatgtccttccacagcaaaatccatcatgaacatatcccccaccaacacagtagagaaccaccgttctcatttaataccaaactagatctaaatggcaaggatctttgctttaaagtataatttaaccaaaaattttaaatctaattatttttaatatgatttttgctcaaaaaaagcaaggaataattgagtcactagttaatttctttcttagtggcaatgatccaaaatgtaggcaactcatagcacaaagatatctttcacagttacttataatgttgaaaggctttaaataaactaaatgtctaatgacaaagaaaagactggttgaataaatcgtggtacatccaagtgaatatcatgcagctcttttaaaaacaggccctcataccaaattggcagtagcataaactcacaatctcttggaaagataatatatgacataaacaaaggaaaaacaaatcagtaaatggaactgagctattattaatacacgctatttggtaaaaaaaaaaaaaaaaaattccacttagctccttagctgtatttgaaacttaaacacacatgtgcattgcctacattaagaccacacaccacctttttccaaagtagtctaatttttggaacattatgaaatggtccattctgatcaatggccttatagcttatctccatgcccaaagattttaaattgtaaacatacctactttccttttttttttttgagacagagtcttgctctgttgccaggctagggtgcagtggtgcaatctcggctcactgcaacctcagcctccagggttaaatcgattctcctgcctcagcctcccgagtagctgggaccacaaatgcccgccaccacgcccggctaatttttttttgtatttttagtagagacggggtttcaccgtgttagccaggatggtctcgatctcctgacctcgtgatctgcccgcctcagcctcccaaagtgctgggattacaggcataagccaccgcgcctggcctgaacatacctactttcaatgtgtttactttctcctattatttcacctcctaatattttcacataataacatttaatccctcttgaaatttgctttgagatatatatgcatggcttaaaataaggaactaaattgattctactatagaaataattttgctgggttcaaataatgctgggttgaaatgtaagagtaagattttttatattcatctagctactcttcatttcataagcagtaactgtgcctaaatggtactgtttaaatacagggactctcaaaagtctcaggacttctgcttaagaaattccaaaagtatacttcacataaagtcatcattatactttgtttttcattgcaacaagcctttcaagagaatcacagaattcagaaggatatctttaagcagacattcatagaatcctcaaactaacttggtgttataggatggtcttgaaagaaactgaggccaggcgctgtgagtcatgcctgcaatcccaatactttgggaggctgaggtgggagaatcacttgagaccagtctgggcaacacagacagacccccatctctattaaaaaattttaaaattagcaaggcatggtggtacacatctgtggtcccagctacttgggaggcagaagtgggaggatcacttgagctcaggaggtcaaagctgcagtaagccgtgatcacgccactgcatgccagcctggacaacagagcaagactctgtctttattaaaaaaaaaaaaaaaagagagaggcggggcacagtggctcatgcctgtaatcctagcactttggaaggctgaggtgggtggatcgcctgaggtcaagagtttgagaccagcctggtcaacacggtgaaaccctgctgaggtgggcagattgcctgagctcaggagtttgagaccagcctgggcaacatggtgaaaccctgtctctactaaaataaaaagagtgagctgggcaaaaagagtgagctgggcgtcatggcatgtgtctgtagtcccagctactcggaaggctgaggaacgagaattgcttgaacccaggaggcggaggttgcagtgagccgagataacgccactgcactccagccccaccccactcccaaaaaaaaaaccaaaaaacaaaaaactaaaggttaaaatgatgtagccactttagaaaaacaaatgctgaacaaagagttaacatatgaactagctattctactccaaggcacatacccaagagaaacgaatacatacattcacacaaaaacttggacacatatgttcatggtagcacttttaataatagctaaaacaatcatttgtccatcaactggtgaatggataaacaaaatggtatatatctatataatggaatcttactaacttagaagaagaaacaaagtaatgatacatacaacacagatgaaactttaaaacattatgctaagttaaagaaaccagccgggcgcggtggctcacgcctgtaaccctagcactttgggaggccgaggcaggtggatcacgaggtcaggagatcgagaccatcctggctaacacagtgaaaccccatctctactaaaaatacaaaaaattagccgggtgtggtggcgggcgcctgtagtcccagctactggggaggctgaggcaggagaatggcgtgaacccaggaggcggggcttgcagtgagccaagattgcaccactgcactccagcctaggcgacagagccagactcctctcaaaaacaaaacaaaacaaaacaaaacaaaacaaaacaaaacaaaaaaacagatacaaaagactacacatggtatgagaccaggacagggaaatctggagacagaaagtagattagtggttgtcaggggttgggatgtgggtgagaatggagaataactgtatgtacccagtctctccttggggtgttgaaaatattctgaaattaagatttagttccacagctgtgaatatactaaaaaccactaaactgtaccttttaggtgaattttatggtatgtgaaatatatctcggccgggcgtggtggctcatgcctgtaatcccagcactttgggaggccgaggcaaatcacgaggtcaggagatcgagaccatcctggctaacatggtgaaactccatctctactaaaaaatacaaaaaattagctggccatggtggtgggcacctgtagtcccagctactcgggacactgaggcaggagaattgcttgaacccagaaggcggtggttgcagtgagccgagatcgcgccactcactgcattccagcctgggtgacagagcaagattgtctccaaaaaacaaaaaacaaacaaacaaaaaaaaaaaacaaaaacactctgggccaaggcaggaggatcatttgaggccaggagttcaagaccagcctgggcaacatggtgaaaccacgtatctacaaaaaataaaaataaaaataaacacataataaataaaaataaagccaagcgtagtgatgcgtgcctgcagtcccagctacttgggaggcaaagctgggaggatcacttgagcccaggaggtcaaggctgcagtgagcagtgactgtaccactgcactccagcctgggtgacaaagtgagaacctgtctcaataaataaataaataaataaataaatgaaataaaaatggaactcctgtattaagggcatattttgccaatatttctcaagaaagactgaaagtgaggttttgcctcacactcaacagtatcagtacttttttttttgtcctcagatgttgtcaagatttttctgtattgcttactctttcagatgtacctcaaatttaaactttcttttggctgacttcaaaaaaaatacattatagatatgtgccaagtcttcatcggaactgggttagcttctccatttgagtcttccttgtcgcttaatagagtttcgcttcagtctcctctgttccctttcaggaatttctatcacagacttggggaagtgctctctcctaacgctcatttcgcacacctctttcctgagttctgagagatttttctcaagccacctcagtgttctgcattatctactctgctacttggtactgaacattctattttaacaattgtgtgttataactttaaaaactctttactgttctcagtttcttttcttttctccacctgctcttgtatttggacacctgaattacagctgcctctacctcatactattttgcatgccctcaatgatcttggggtgaatttttcgtttgtctaacaacatatgtttggtcatctttacagaaagtgaatacacacatcagttcttaacccacacctgtgtggccgcttacactgttcactatcaactccttaagtctcaaatatgtgggaaagacccttctctagtgtgaagtaatcacaaaggcttgttcttaccactgcgctttggtcacttcaatgataaatcagaaaacaacaacaaaagcttccagtgcatgggattacaagaccttaatagtcctgggaaattacacttatttgtcatagttgttgttttttgttttttgtttttttttgagattgagtctcactctgtctggactgactggagagactggagtgaagtggcgccatctcagctcactgtaacctccgcctcccgggttcaagtgaattctcctgcctcagcctcccaagtgactgggataacaggtgcacatcaccatgcctggctaatttttgtattttttagtagagacagggtctcaccatgttagccaggcttgtcttgaactactgacctcaggtgatccgcccgccttggcctcccaaagtgctgggattacaggcgtgagccatcaccttcatttgtcatagttttctactgcctttcttgctgtcaatttttacctctatttacacaattatgcctaacaactctttctttttaaaaacttcaaacttcaggccgggcgtggtggctcacgtttgtaattccagcactttgggaggctgaggcgggcggatcacgagttcagggagattgagaccaggtgatctgcccgcttcagcctccccaagtgctgggattacaggcgtgagctaccacacccagctcctgatttgttttaacaagtgaagctataaaacaaaggctcatattctgaattttaaagttttaaggctgggtgcggtggctcacgcctgtaatcccaacactttgcggggcccaggcaggcggatcacttgacattaggagtttgagaccagccttgccaacatggcaaaaccctgtctctactaaaagtacaaaaactagctgggcatagtggcacgtacctgtaatcccagctactcgggaggctgaggcaggagaatcgcttgaactccggaggcagaggttacggtgagccgagaacacaccactacaccccagcctgggaaaaagagagacgccgtctcaaaaaaataaacaagtaaaattttaattttattttacttatatttttgagacaaagtcttgccttgtcactcaggctggaatgcagtggtgtgatcacagctcactgcagctttgacttcaggggctcaagtgatccccccacctcagcctcccaagtaggtgggactgcaggcacaccaccatgcctggctaattttttatttttatttgctatgttgcttagactggtctcaaactcctggtctcaagcaatctgcctgcctcggccttccaaagcgctggtatcacaggcgtgagccatggcgcctggttttgaagtttttattttaaaaatctatattactgcaacttaatttccatcattatcggggtgaaatagttataatattttattaaataatgtcaaataatatttttagtatttcgtacatagctttgttctatgtatggcatacagaaaacattacatcgttagaccaaattctccctcgaactgctacgatgtagtagcaaataagaacttaggaaattgaaaaagaataatcttctgttaaattttaattttataaggtaggaccttaagataatcccaaattgataatgagtttctccttatgggctaacatacctaagtttctttctttatactttaggtctctaagtgaatcctaaattatatgatgaaaagtgttccctttgttagtcagatgtttgtgcatatactctctacaaagatgctcagaaaaggacacagtgaagtatgaagaatcttgcatactttgaaacaccattactttaggatggtaaaataaccacttacttatagcccttaatatgcctgccactggctggggagagaagatccctggtggagtaagttcttttcttcactacatttttttttctttgagaagctctctttgaggaagagagtttagagactaaaacagctcactgtcactgaaccctactgtgtgtcaggcatgtgctatgtgcttttatgtgtgttatctaagaggtggttacaaatgagaaaacagactcaacttccaagatttatactgcagttaggtagcagatacagataggaatccagtacttaactttagcatatatatatatatgtatatatatacatatacatatatatgtgtatatatacatatatatgtgtatatatatgtatatatatacatatatatgtgtatatatatgtgtatatatacatatatatacgtatatatgtatatatacacgtatatatatgtatatatatacgtatatatatatgtgtatatatatatatatatatatagagagagagagagagagagagagagagagagagagaaaagcgtgttgttttttttttttttttgagacagagtttcactctgttgcccaggctggagtgcagtggcgcgatcttggcttactgcaagctccacctcccaggtttacaccattctcctgcctcagcctcccgagcagctgggactacaggcgcccgcaaccacgcccggctactttttttgtgtttttagtagagacggggtttcaccgtgttagccaggatggtctcgatctcctgacctcatgatccgcccacctcggcctcccaaagtgctgagattacaggagtgagccaccgcgcccggcagcacatacatatttttttacttatatttacatatatttatatacatatgctccctatgtatacatggattacatggacttggcaaaaattaaaccgtacaaaagggtatatagtgaaaaagttaagtcacattctcctctccctcaatcctttcccttaggtgataactgtaaccagtgccttgtatattttccgagacattctatccatatataagccagactgcctgtctgtcttcctccatccaagtatccatcccaccctcacaaaacagatattagcatactgttttgcactttgatttttcacttagtatatattaaaagtacttccatatagataatgagttctttttaacaatttaatagtattcatcacttagccagtcatctataatgggacacataggttatttctaggttttagctgttataaataatgctgctatgaataacctttcaaagaagctatatcaatgtatactgtcaccaataatataagaaagtgcctgagcttcacctacacaattatattaatgaactttttcatctttgtctgataggtgaaaaatggtattattatagtcataatttgaaattgttattattgtgaaggtgaacagctttacctgtttttaaaagccatctgtatttccgctctctttttgatatgtagttctttacatattaagaaagtttagtttttgttatatattgaaaatatttaaaattttttatcttttgacctttatggtatttatgtcaaaaatttaaatttttatgaaatcaaacttaaaccttttttctctaggtttctgtgacatggcattaaaaaatcctttttcactctgttgattacaaaaaattttctccattgttttcttatataattttatggtttcatttcttttatgtttagattattgcccaaccgggactttactgtagtataaagaatgaggcagggcaggcatgttggctcacatgtataatcccagctctctgagaggtgggctgatcacttgaagtcaggagttcaagaccagcctggccaacatggggaaaccctgtctctactaaaaatacaacaattagctgggcgtggtggtgcacgcctgtaatcccagctactgaggaggctgaggcaggagaatcgcttgaactcagcatgcagaggttgcagtaagccgagatcgtgccgtagcattccagcctggggccacagagcaagactctgtctcaaaaaaaaaacaaaaaaacaaaaaaacaaaaacaaataaaaaacccacaaaaaacatagaacagaagcagttcccactgttacgaagttactccaactttctagggctaccctgattgatgtaccaggtcctttactgggactagaggggtacaaactctaggaatcctgtagccttacctcaaaccacaggaagaattcctagaagtactatgaagtaaactgtaatgagaaattgatagctttcagactataaaaccgttcaaatatagtgaaagaagaaataaaataattcagtatcagattttccttaggggaatgaaagcagtttgaaaaaaggttataaatgatcagtgacacgaaccaaatgaaactgacagagcaaacggcatattaaatcagacatactggatttgaaaagttattcattgcattcccttcctccattcctctcgtttgaaaagtatccaaccttgagccagtttctttgttttgagacaaacagtgctgggattacaggtgtaagccaccagcccggcccctgaaatcagtttcttgaccacaatttcttatcctagggatcaccaggtgggcctatgaacctactaaaaccacatgctaagtttgcgggggattgtatttgtgcggacatttcctctcataaacatgtttcatcttaaaggtgtctaaaggtatctatgatctttaaaagcaaggatttcactgttaagtcaaaacaacttcttgaaccattagtagtactgtaccgtacatagaacattaaatcggcacaacatttaaatacatttaaaatggcattacattcattcttaaaagctatttcagataatggcactgcagggcaatgctattccaattaagaatgtaacaggctggacgcggtggctcacgcctgtaatcccagcaatttgggaggccaaggtgggtggatcacctgaggtcaggagttcaagactggcccagccaacacagcgaaaccccatctctactaaaaatacaaaaattagctgggtgtggtggcgcatgcctgtagtccctgctacttgggaggctgaggcaggagaatcacttgaaccagggaggtggaggttgcagtgagccaagatcgtgccactgcactccagcctggttgacagagtaagactccgtctcaagaaaaaaaaaaaaaagcctctccctctccctctgcctcctctccctctccccacggtctccgtctccccacggtctccctctccctctctttccacagtctccctctgatgccgagccgaagctggactgtactgctgccatctcggctcactgcaacctccctgcctgattctcctgcctcagcctgcagagtgcctgcgagtgcaggtgcgcgccgccatgcctgactggttttcgtatttttttgggggagacggggtttcgctgtgttggccgggctggcctccagctcctaaccgcgagtgatccgccagcctcggcctccggaggtgccgggattgcagacggtgtctggttcactcagtgctcaatggtgcccaggctggagtgcagtggcgtgatctcggctcgctacaacctccacctcccagccgcctgccttggcctcccaaagtgcccagagtgcagcctctgcctggccgccaccccgtctaggaagtgaggagcgtctctgcctggccacccatcgtctgggatgttaggagcccctctgcctggctgcccagtctggaaagtgatgagcatctctgcccggccgccatcccatctaggaagtgaggagcgtctctgcccggctgcccatcgtctgagatgtggggagtgcctttgccccgccgccccgtctgggatgtgaggagcgcctctgcccggtcgcgaccccgtctgggaggtgaggagcgtctctgcccagccgccccatctgagaagggaggagaccctccacctggcaaccgccccgtctgagaagtgaggagaccctccgcccggcagccgccccgtctgagaagtgaggagcccctccgcccggcagccaccctgtctgggaagtgaggagcgtctccacctggcagccgccccgtccaggagggaggtgggggtcagcccccgccaggcgagccgccccatctgggagggaggttggggggtcagccccccgcccggccagccgccccgtccgggagggaggtggggggttcagccccccgcccggccagccgccccgtccgggagggaggtgggggggtcagccccccgcttggccagccgccccgtctgggaggtgaggggcgcctctgcccggccgcccctactgggaagtgaggagccccttccgggagggaggtggggggatcagcccccgcccggcctgccgcctcgtccgggaggtgaggggcgcctctgcccggccgcccctactgggaagtgaggagcccctctgcccggccagccgccccgtccgggaggaaggtgggggggggtcagctccccgcccggccagccgccccgtccgggagggaggtggggggttcagccccccgcccggccagccgccccgtccgggagggaggtgggggggtcagccccccgcccggccagccgccccgtccgggagggaggtgggggggtcaacccctcgcccggccagccgccccacccgggaggtgaggggcgcctctgcccggccgcccctactgggaagtgaggagcccctctgcccggccaccaccctgtctgggaggtgtgcccaacagctcattgagaacaggccatgatgacaatggtggttttgtggaatagaaagcagggaaaggtggggaaaagattgagaaatcggatggttgccgtgtctgtgtggaaagaagtagacatgggagacttttcattttgttctgtactaagaaaaattcttctgccttgggatcctgttgatctgtgaccttaccccccaaccctgtgctctctgaaacatgtgctgtgtccactcagggttaaatggattaagggcagtgcaagatgtgctttgttaaacagatgcttgaaggcagcatgctcgttaacagtcatcaccactccctaatctcaagtacccagggacacaaacactgcggaaggcctcagggtcctctgcctaggaaaaccagagacctttgttcacttgtttatctgctgaccttcccttcactattgtcctatgaccctgccaaatccctctctgtgagaaacacccaagaatgatcaataaaaataaaaattaaaaaaaaaaaaagcatagaacagaaaagtttagttttcttctactcaggaaagtgagagcttatattctttaaagttagcctgtggaaatgtatctcttcctcagttatcagctgctatgtcttaaattttacatgctaaactgattgaggatttagtatatggctaatcactcttatccaaagtaagggtggtattattaaaagttcagtttattagttggtttaaatatcctctgactctcaacagctttccattaagaaaaaactaccttaatggggcattaagttaaggaatagagagtagagaatctagatgaggatttccaagggaaacaaatcatacgtaacgtttattcaagaaagtgaagagcacactatgttaattttaatttcgcgtacccagaccttatctgtccatctctctggtttatctggactatttggagaccaaagggaagaaggggagtagagagtggacaggtaagaggacaaagacaaggtagctaaaagaacagcaggggactgagagagctgtaacagttctccaactgggaatcagaaattctctgcagagtaactatctggaaaaagtaaaaagggcttttaagattctggttggccaagcactgtggctccccagcattatggaagggtgaagccggaagatcgctttagcccgggagttcgagaccagtctggacaacatggtgagaacctgtctctacaaaacataaaaaattagccaagcatggtggcgtgcatctgtgcagtgagccgtgatctcatcactgcactccagtctgggtgacagagtgagaccctgtctcaaaaaacaaaacaaaacaaaattctggttaagggctgggcatggtggctcatgcctgtaatctcgccacttcgggaagccaaggtgagcagaccacttgaggccgggagttcaagaccagaccagcctggccaacaagaacaacaacaaaaagaagaagaagaagaagaaatttgtcaggcgtggtggtgtgtgcctgtagtcccagcttctcgggaggctgaggcaaaggaccacttgagccaggagttttgagtctgcagtgacctacgatcgtgccactgcactccagcctgggtgacggaatgagaccccttctcaagaaaaaaagaagattctggttaaaatcaagaaatcaaaaaagaggcaactagaaaagctaggagacaaacgcaactatctggatttccgtaattatagatatcagtaatctataaacacatgtcaaaggcaaaacaatatgatttctaggtatacattccccattggggcacccatcccaaggctgctttcccttcaagcagtggtctttaccttttgagggatcacagacaaatccactaagaaactgacaaaagctacagaatcacctagaaacgaaatacctgggaacacacgtacataaaatttagcagtttcaggagatttgcaaatacctttcaagtctgatccctggatcccagacactgttttaaaggcctcaagtcccaaaatgaccctacctattataacacatccactccctcctagccatcaaaattaagacgattccctctgtgccactgatctcaaatagatcataagaagaaagcactacaggtagtcacatgggtaaattagggcagtgctgaaacgagaatcagaaggactggatttgagtcccagttatgacactagcagatattgtaacatcagataagtcacaacactgtattggcccagtgtttcctcagccataaatgaggggtttggaataaactaaggtgctgacattttaaaagggaacagttttcctgtgtttactgaatatttactgagcatctaacatgtttcaggtcccgtaggtaggtggtgggaaaacaaagaaaaaaaaagaccaccctcaaggagctacacagaacagacaagtagacagttacaaaacaatgtggttcatattctaataaaagaatatagagaactaagaaatgagagaagggggagcatttaactttgcccaaggagactacggtctagtcttgaagatgtttcccaaatagatatggtaggcatggagtatatccaacacatgaagactccaaggtgtgagagagtagccaatcttcaagggaattcagagtttgtgcaaccatgtaaaagcactgagattagacagcaggcaggagaatgtgtaactagtaggcaagggaagtgttttagaataagacagctttgattcacctgcctaactggctgccccgctgtaagtatgagaagaacagtgtgcacttgatatctgacttctaaaaattagctgactcacaaatggtaaaaattgttctctagcaatatttgaactacaaatttctaataaagaaaaatggcggccaggcgcagtggctcatgcctataatcccagcactttgggaggccgaggcaggtggatcacaaagtcaggagatcaagaccatcctggctaacacggtcaaaccccgtctctactaaaaatacaaaaaattagcctggcgtggtggcgggcgcctgtagtgttggcgggcgcctgtagtcccagctactcagaaggctgaggcaggagaatggcgtgaacctgggaggcagagcttgcagcgagccgagatgacgccactgcactccagcctgggcaacagagcaagactgtctcaaaaaaagaaaaagaaaaaagaaaaatggccaggcacagtggctcatgcttgtaatcctaagcctttggaaggctgaggtggacagattgcttgaactcaggagttgaagaccagcctgggcaaaatagttaaaccctgtctctacaaaaaatacaaaaaaattagccaggcccagctacgtgggggactgaggcaggaggatgtctaaagcccaagaggtcgagactgcagtgagctgagatcacgccactgcactccagactgggtgacaaagtgagacccagtctcaaaaagaaaagaaagaaaaagaaaaaaaaagaaagaaaaaggaaaaaaagaaagaaaaagaaaaatgtggctgggcgtggtggctcacacctgtaatcccagcagcactttgggaggccgaggcaggtggatcacctgaggtcaggagttcaagaccagcctgacaaacatggtgaaaccccgtttctactaaaaatacaaaaattagctgggcgtgctggtgggcacctgtaatcccagctactcgggaggctgaggcagtagaactgcttgaacctggggggagcagaggttgcagtgagctgagatcacactactgcactccagcctgggggacagagcaagacttggtttcaaaaaaagaaaaatgaagtcagtcaggagttccattgtttataaaccctaattaatcaaccaatttccaagaggctgaggtgagaggctcacctgagcccaggagtttaaggttgcagtgagctatgattgcaccactgcacttgtactccagactgggcaacagagtgagaactctttaaaaaagaaaggaatttaaaaataaataagccaaattccttctgagccatcacttcttagaaacaacccataacatagcttttgcgattccccagttttagtcttttcctcagtaggcacacagactccattccttctctctgcctttctcaaagctcagcctgatgaagacagcaatcagcagtgacaaaaggaaaagccaaaaagggatcatgaacattactcaaaaagtcagaattaacctcacacaatcagaccaaattaaacttttccaactgcaccctttgttttgctgttcttgttttagagacaggatctcactctgtcacctagtctgtagtgcagtggcacaattatggctcactgcagccctaacctcctgacctcaagtgatcctcccacctcagcctcccaaagcgctgggattacagggatgagccaccgcctggccagcactctttcacgatcaattcttccacctgtgtgctcttggtcccattgactcttgctttctaagatttctggctccaacaatcatcccttctatttcaacctccacctctctctttaggttcatccctgcaatcacataaatatatcaagttgccctttcctcgtaaaaagtcattcattcagcacatattttcaagtgcttactaagcacctgatactgtgcaaagcactggcagtgccttcatgaaactctgaagaagtaataaaaaatataaactcagattaacagagtctgttctgctccaacccaataattcatttctaagaaacctcctattatcaaactcatgaaataaaagacacttttcaaaaggagcaaaaaggaataagggaccagagttccagactcaaaatactaaattcatttttcccgctagaatttcaacaaggtatcaagttctcctaccactaagcaagtccagcttttagttgtactcagtttttgctcaagagcaaagcctttcttttcccagctccatgagcattaccaaaaaaagcacaactcttcaaaaacattatcagaaacatcacccactgctgtgctaaacaaagcagaaagccaccttaaacacttttttcctactcaagctgtgttactttcaagatagtggtttgcttaatgcaaattgtgttcccgaaatcatttgctgctgtatgacatccaattcccgctatgaaaggggaagtcttgggatgctaaagaagtacgcaacaggggctcatacccagcatgggcaggtcaagaaggcctgccaaggaagtgagacttcagggatgagtaggaggcagtttaagcaagaaaggaaagagaaggggggaaagttgtgccaaggcaaagagaacaacatttacaaacgccctaaggggagaatggacacacacacttccaagaatacaacacagtggaaaagagggaggaaagtgataggggaaatcaagcaagagacacaggccatgaggtcttgtgagccggaggaggggctgaatttacactgtgagcaacggaaagccgttcaagggtttaagtgagaagtcacacaatcttgcttcattttagctacctctccccacttcttcaagttgggcttctaaaaagagcagtgtacacttggtagtttgcatttcctcctaccttctctcctgaactccaggtatctgtcttgtgtagtccgctgacacaactccctttaaggtatctgttaatctagctgctcaatgtcatggccctctcaggctggcccttacctgtcaggtggccctgctcaccctcaactccctccactgctttcctccccacttctgtggttgttcctcaccagtcttttttgcaagttcctctttctccacccatccttttaaatgttgtctgtcaagattctgtccttggcctttgatatttccaaacgctctgtatcttccctagatgatctcatcaatgtctaagacctcaaatatcacccatgtgttcatgatttccaaaatcacatttactcagaccctctctcccgaactccaaatttatacattcaactagcttcatttcagtgtctcgcaggtacctcaaacagaattaaagtttcaaaaccaaacttgtacataacgtatacccctttaccatttcatttcaaatctgtatctcccctccatccctcctgccactgcctaacagaagctcatcatgtctcttcaggtttactccaaccgactactgccctgtgctgcgtgcctacactttcctcatccagtctgctagcagtcagaacgatcttgctaacaagtaaatatgatcagcccagagcagtggctcatgcctgtaatcccagcactttgagaggccgaggcaggcggatcacctgaggtcaggagttcgagaccagcctggccaacatgtcgaaaccctgtctctactaaaagtacaaaaaaatcaaccgggcatggtggtgtgtgcctgtaatttcaactacgcaggaggctgaggtaagtgaatcacttgaacccaggaggcagaggttgcagtgagctgacgtcgcaccactgcactccagcctgggcgacagagcgggactctgtcaaaaaaaaaagaagcaaatatgatcatggtatttccagacttacaattccacaatgagttcctattaaacagctcaaattccttagtctgatctaggctctgccttactctccagcatctcaacttcacaccagtctccaggctaaactgtgggtggttctctcagcattccctcagtgcctttgtgcactccctccttgctggaacagtaattctcttcacctcccttgtcctcttcccctggccaatgtctttcaagacttaggtgaggtcctccctccctcgagaagcttcaccagaactcccatgtgtacccctttttgggaaatacaggactcctaggtaactcaactccacaagaccctgtgcttcaagctagctttacatgtatcactttaacgttttcatcagcttacctatttacagggctgcatccttaaaaactgggactcctgtcttttaacaagaatcctcagtgtctaacactagcacataacaagcatgttatgaacgaatgaatgaaaatatggaactacaatgaggccccaaaagaataagccctagagtgagcacctcgagggtaggaaacttgccaggagcattctctgctgaatccccaaggccaggagcaaaagctgcaactccactgggggtccgggcatatttgtggaatggctgaatggatgttctaaggccacaggagaacacatagctcaaacttcctgacttgctttccattactaactttcttggtttgtgacctacttttactgtaacaccagtgtgcatgccatggtttctactgaccaaactaatggtcttgttttcaactaggaaaaaataatatgagcattgaccaaccaaggaaactacaggattcctcggtaagaatctatagaaggatttccttatctttttgaaaatgcatgtgaaatctccagtggatgcgagttaagttcatttttctggaaagaggaatcacaattctcattgaattttcaaggatattaatgataccaaagaaaattaaatttcttaaaccaaaatgttaagctgaattaagttatattcacttttctcttttcaaatctatttcgatatataacctatcccttagagagacagcagcctctgctaaaacaaatgtaactggagaagatgcagctggcaggctctctcacatgaagattcctaccagaatttgcgtttcagattgtctataattggaagagtccttaccagcattctttaaaacttagatccctattctaacatactctgtatcatgggaatcagaatatttatacttcccactaatgtgttcaagaagaaaacgttactttctgaacacatttttcactgccatctaattaaatggaaaggggaaaaacccaggatcatccatttacaggaaagcccgtcttttactttacacagagagaaccaaacatcagaagcagcattaacttaaccgtcaccaaattcaatcttgggaataatacgacaaggattaaacgaaggggaaagcagttacatcattttaaaagagataaagttttgtttgaattaaaaggtagtctagttgacataaaaaaagcgaatcacaggtgtttatactacatattgcatctatgtgagctgaacaggcacgattagggcgataggcatcggaacaccgtgcccccggggaggggatgagggcactttctcagggcaaggaaaggctattttgatttgagggggcttgcaagaggggattcatttgtgacacccgtctgggagcacacatgaaagctgcgtttcactgtagggaaagtatacctcagtaaggaaaactataaagagaatgacacgctatcactggacgaacacaagcaaagcctctttcgttccgggaaggttctatgggggccgaacccacgctgggcgctgctgggccacgggggaaaatgaagacggagggtcccgagagcgctgccctcgccagaggccacgagccacccccaaccaccgcggctccgccaggagagcgagcttcgcctcgcagagggctgcggcggccggcccggcgcccagagcggcctgctcccacaggtcctgcgcgggcgccagctggacccggacgccgcggcccggctcgcccgcccccgccctcaccgctcccggggacgccagctgcccacccggccacaaaacacccggccagagaaagagctgtccgcgagcaagaaccaagcacagcggcgtgggagctacggcgaagctgcggcccgggggcgcgcgcccgagcgcccccacggctttcccaaggacccccagacccgggccgcgcaacgctggtggcgcatccacgcgctccccaagaagccgctgtggcaccgccctccagaactaactgcgcttgcgctaaccatgagctgctcagctcaagtatgctttttttttttttttttttaaaccaaaaggagcaagagagcggtcagcgcaggcgcgcccctgacgcggaccgcgccgccacttccgccccgagcgagaggctagaggcgagaggcgggggaggcgggagggaccctgcggacagggcacgagtccgggtctcggaggaggtcggcgactgccgcgtgggtccgcgactcaccaagtacagcggctgccagcgacgctgagtatccaactcttcgaactcccgctcgatggtggtgggcatggctgcgggagcgagctggcgcgagcagagcctgcgccggcggagaggctcaggccccgcacgatccggggagagcgctggcgctgcggcgcatgcgcgctgcgcgccgcgccccgcccccacgccaagccctgtcggccgtggggaaagtacctggagcgtcggacgtcagcgcgcagactcggcgcccgagc

SEQ ID NO: 388 - DNA, 98858 bp, Homo sapiens; identical to SEQ ID NO: 387

SEQ ID NO: 389 - DNA, 98858 bp, Homo sapiens; identical to SEQ ID NO: 387

SEQ ID NO: 390 - DNA, 92034 bp, Homo sapiens
gagacgaagtcttgctctgttgccaggctggagtgcagtggtgcaatctcggctcactgcaacctctgcctcccgggttcaagtgattctcctgccttagcctcccaaggagctgggactacaggcatgcaccaccacgcccagataatttttgtatttttagtaaagaagggatttcaccatgttggccaggacagtctccatctcttgacctcgtgatccgcccgccttggccttccgaagtgctgggattacaagcgtgagccaccacacccggcccaaactgttttttttgtttgtttcttttgagatggagtctcgctctgtcgccctggctggagtgcagtgacgtgatctcagctcactgcaacctccatctcctgggttcaagcaattctcctacctcagcctcctgagtagctgagattacaggtgccctccaccatgcccagctaatttttgcatttttagtagagatggtgtttcaccacgttggccaggctggtcttgaactcctgacctcaggtgatctgcccacttcagcctcccaaagtgctgggattacaggcatgagccaccgcgcccgaccaaactgtttttaaatgataactgccccctttaaaatacttaagccttatgcagaaatcttatgtggcatataaagagacaaggcagagatgctgtggttgaaagtaacctcttgacccacctggacatccaatgagcatagtttgaaaaccactgaaataaggtatgctatccataataatgtatgctatccatgcctcctagcaattaaatttgtaacaacaatttcaagtttaagtaagacaaattaaacactgaatggaatgttgaaatctgaggaaagctagcattcaaatgagcagttaaattcattaaacagtttgctttaaaaaatattcattaagttaaaatgacaatgtaaggtttgcatataatcatactatttattgaagtagaaagaaactgaaaagtgtttacttcaaaacttcagtctagtaaactgaaattatgaatcataaaatgctgcttcttacttttgcttcctaaatcataatctaccccaactacattgaaattttcatgaaaaataaacatatcaataatgggatttacagaaaccaatttctttacaaagtcttgaccaactgtttacctgactatcccagtaaggagaattttccttcaaagatatttttaggaaaaacttttgtttctttgtttgcttttctttttaaaatggggaaaactgtaaaacataaaagaaatgcaatatatagtagaaattgcttattccaacttctaactgctcatatcaaacttctctttagaaaaatggaaaatgtatccagtacaattcaatcgacatacaatttatttttttagtaacagatttttcaaattgagctcttaaaaagtacagttaactacaaaagattaaatagatacttataaaatatatttaccctgaaatgcttaagaataaaagtgttgatgcccatgtcaatagtacattatacattacacacattatttaaatgtcattttctttccaataacgtagataaaaccacaatatttattgcttatatcaagtgcaggttaaaatccagatagcctccaaaaacaaatcctgtgataaaggatatctcaatgttggtcaggtgaaatactgtgtttgacatgtatgaatacagttgcaaaatttaccagtttttaacaaacatgaatgtctttattttagacagccatttacagtttggggttcagaggaacctgcagtcaagagtcctgagatgttgggcttgtgactgtaaatatcacttatctggttgatgtctattctactgcaccgtttttgggatatgaggcgtttgctgcagacaaacccctatgattaatgtagcactgtcagttactagtgcagaagcttgctgggcaaaattaattgtttatagggcattttgctgaaaaaacagtgtccagccaacaaaagcgccaaccaaaatgactgacataaaccccatcttagtgagaataggttgccaatataaccacctttttctttttcgttcattctcatttagcctctgtttcatctgctgcaccttctgagctgtggtggcctttctgtcctctcgaatacgtttccgtagagcactatgaggaaataaaaacaagtgaaaggaagtgcacacagagcaggacttgagtactctaacacagaggacctaggcgcaaataaaaccatccacatagttttcaccctatttgaacactggaataatgaggggaaaagcctcaatattcttttgagacagcgtcttgctctgtcacccagcctggagtgcagtggtacaatcttggttcactgcaacctctgcctcccacgctcaagtgattctcgtgcctcagcctcccaagtaactgagactgcaggcgtgcaccactatgcccagctaattttttgtatttttagtagagacagggttttgccatgttggccaggctggtcttgaactcctgacctcaagcaattcacccgccttggcctcccaaagtcctgagattacaggtgtgagccacggcgcccggccaagaaaagcctcaatattctttaatgattcagagatgtaccttgacaaccattcctggtacagttttatattgataactgcttttagtgggacctgaaaataagcaaggtactttcttgacacgtgaattgatgactgttagttttctttccttccttgttaactagtcagcaggagcaggagtgggaagacaagggggtaccacttgcatctgatcccatttcctggtcacgtttgatggttaaggctcttataaaagctagctatttaatatttccatgaatattctgttgtgggagcacttattcttttatttgaccatacacatttctacctcccattttcatagtcaatacagaaatttttttggggtggtgggggaggcggggtggatggagtcttgttctgttgcccaggcgggagtgcagtggcacgatcttggctcactgcaacccccgccttccgggttcaagcaattcttctgcctcagcctcccaagtagctgggattacagacgtgcaccaccacgcctggctaatttttttgtatttttagtgagatgatgtttcaccatgttagccaggctggtcttgaactcctgatctcaagtgatccgcccacctcagcctcccaaagtgctgggattacaggcatgagccactgtgtccggtctcagaaattttgtttcagtggaaggtctctgactctcaagatacttagttctggttctatataaataataatgccatccagctactcaggaggacggcttaagcccaggaattcaagtccagcttgtgcaatatagcaagtcttgcctctctataaaagcacacccacaaaaacaaaaaaacggccaatggcaacatataggttactatttcttccattccctcttttcacttttctgtattacagcaaaggcctaaccagcttccctgccctcaaattaaatattattgccatggtaatttttctagagcatacccctggacacgtagcttgatttaaaatctttttttttttttttcgttaccgggcctagtgcacgatggtgcttaaaaatctcaaatgcctcttcaatgtctcctacattgagactacctttttcctggccaagacgtttaacctgaatttaactatgataaataatgattaaagaaatgcattgtatggggcattctaaaagatatctggcctagaagcttcaaaaatacaaatgtcaagcaaggaagaaaaaggcagggaacagttccagattaaaggagaccaaagaatcacatcaactaaatatagtatcaatctttgattaatcttgaaatattttttaaacagctacagaagttgggatcaggaaaatgttctaaaattagatcgtggtgccagctacacaatttggtaaatatattaaaagtcactgaattgtatactttaaatgagtaaactttatgctatataaattatatttccataaaactttattaaaaaagctatatggtgaatctttcagacaagagaaatctgaattgaactatgtattagaatattttaatcaatgttacacttctttggtgtactggaaccttctctccccaagagattgttagtgggaatgtaaaatggttcagctgccacagaaaacagtttgacagctcctcaaaaagttaaacatagagttaccatatgacctagcaattccactcctagatatgtacccaagagaactgagaacacatgtccatgcaaacgcttgccaatattctcctgctatgcagaactttgttcttgccgtttttttgctgttctccaaatttgttccccactaaaatagaaaccttcccttctctcctgtcctctcatttcagttctactcttcaattatcttgctccaccccctctagcccttctattcttacggcatttaatttgaagtaatttataatttactaataatgtgctaacttgggtacttgttttatcttcatcacatattctgcaacttgaggacagactgggttttgctatctttgttcatcttatggtgctttctcatgtctttttcactttttgttatcatatatacaggtatccctggctgtctgaactccatctgaatatctgctataatgacttgcaaaaattcttactcagaattcactctctgaattgaaaattcactatcacaaatatgcatgtacctgttagtgaaaacatttgtgttcaagtgtaggcaaaatatgtataaaaacagagagggggttagcctcccatgggccctttattagcttttgccaggagcctgggggtatcgttaacaaggttccaatttagatataatctttaacgtattatttcattttttattttcattgcggtatagaaggcaattataatttgtatctagtattttgtcatttaccatacaagcccaataatgagtcccttaagtgttatatgattacataattagtgctttaaatgctacataggagtttaaaaggttttgtactatatttgggggaactggttatgctttctggttgggctgacaacacactatttttctcatttaaaagaatggaacagaggtttttgctttccaaaagtgcactatataattcaggaatggactagagacaaataccaaggcatgcctgtatctaatttaagaacacaattccagagaatgacaagactactctcgatttgtgataaaatcttttcttccttagtggggcctaaagaaattatgtctgtgtaatgacttgccaaatgggacctgcccaggttttcccgtatatttatgcaatttaggatattaaccaatgggaatgcctcctgtggacccttgcccagggaagatcatgtggcgtgatcatagctccctgtagcctcaacctcttgggctcaagcaatcctcccacctcagcctcccttaagactacaggcaggtcccaccacatttggcggatttttgtattttttgtagagacagggtttgccatgttgcgcaggctggtcttgaactgctaggctcaagtgatccacccgcctcagcctccccgagtgttgggattacaggcatgagccactctgcctgctccagacttttcgtatgtccaagttgtttctcactctcagtgatctgggtttctgggttgaactgtaattgagaatactgcctttcaaattcagactgcaacctacagtaagaaatagcatcacaacagagtaacctcacacacacacttacataggtacacaatgtatatgtaaatatatggaatttatacatcacacatacatatataaaaacaggttaaaattcaagttcaggggtacgtccatgtgcaggcttgttacataagcttgaaacttgtgtcatctccgtgacatgtacaacaagttttgttgtacagattatttcatcacccaggtattaagcctagtacccattagttatttttcctgattgtccccctcctcccaccctccatcctccgacaggcccccagtgttgttcccctctatgtgtccatgtgttctcatcatttagctctcaattgttagtaagaacatggggtatttggttttctgttcctccattagttttgctaaggataatggcctccagctccatccaagcccctacaaaggacatgatctcattctttattatggatgcatagtattccatgctgtatatgtacattttctttatgcagtctatcattgataggcatttagattgattccatgtcttttctatggtgaatagtgctgcaatcaacatacgcgtgtgtttacatctttacagtacaatgatttatattcttttgggtgtatacccagtaatgggattgctgggttgaatggtatttctgtttttaggtctttgaggaatcaccacactgtcttccacaatagttgaactaatttatactcccaccaacagtgtttaagcattcctttttctccacaacctcgccagcatctgttaaattcatgttattatttgtgatatgctgataatttctattttattctattttcttctttaaaaaatgtttataatccaataaacttcacgactatgtgatttgaccttcaatttgaaaaacactgctttggaggatgaatatcctccaaatgaatacaatgaaaatgaatacaagaaagtactgtgttctatttcttttgaaagttgaaattctggccaggtgtggtggctcatgtctgtaatcccagcactttgggaggctgaggcgggaggatcacaaggtcaggagttcgagaccagcctggccaacatggtgaaaccctgcctctactaaaaatacaaaaattagctgggtgtagtggcgggggcctgtaatcccagctacttgggaggctaaggcaggagaattgcttgaacccgggaggtggaggttgcagtgagccaagactgcgccactgcacttcagcctgggtgacagagcaagactccgtctcaggaaaaaaaaaaagaaaaaaaagaaacttgaaattcttttgataagacttttatgaggatctttaatgcaaagctatctataggtattaaaaattactgggactgattaaaaaataaaactgttcagagtaacctttacttcacaccctgatcctatgctcttcttttacatttttttttttttgagataagagtcttgctctgttgcccagtctggagtgcagtgttatgatctcggctcactgcaacctcctgggttcaagcaattctcccacctcagcctcccaagaagctgggacaacaggcgttaatgcctctttaatttttgtattttaaaattcgtatgtccaagttgtttctcactctcagtgcctggttaatttttgtattttcagcagagacggggtttcaccatgttggccaggctggtctcaaactcctgacctcaagtgatccacctgccttgacctcccacagcactgagattacaagcgtgagccaccacgcccggcctcctctttttcatttctgtaaccttgtttttgtaatcagacttctccgcttagaattctgacttttctgttgggactctctgctttcaaacatgcaccagtctcatttatcagacagggaaggaaaaaagggaaagaagaaaacaccgccaccacatgcgaaaacatgtacaggcacataaacacacacacagaccccataaaacagtcttctgcaatcactctataactccttagagttatagactctagagtggttttagtagtctcctctgtatttgcaagcttgtatgagtgatttaactcactaggattaacatggttgttctgaatctttgtagattaaaactcaacacttctgaaatactaagaatgccatttcagtcatcaagcctgtttttcatttaattctgcagatagtactagataaaaggggggaaaaagcagtaacactaggaatctgaaagccttattattgaaaaagctaaggtaacttaaaactattatttcctgatttaaagatattctatttaagatgaaaaaaggaaccaaaaaaattatgctttctcttgcagtctaaaactactgaagtcaaaaattgggaataacattactaaatcataataaactcttccactataatatataataatacatgtattatatattggaatatgttagcatttataaaatttcaggtatttaatttttatattaggaaaatacagcagtaaagctataatgtatggcagacttcgactattttcattccaatctaacaaatataaccacaagataaaattccccatgataagaagtatatttggcaaaaagagaagaagaaaagttattcagagatgcaggagagaggaaagaaaaacctcattcactttgctatgtgacttataccaggttatcagcttcctaatctgtgagagacagtcttagaaatgtaattgtaatttaaaattctgaatagatgccacattcatatggatttttaaaaaacgcctttttctttctccagtaatgcaattaagcttacatgtttaaatgttttattaaaggcatattatcagttacattataattatagtacaaatggcaggtattcatactacttattttctgtaccataccatatattttagcacccaattatattaacttttacactcaatcattattgttttaaaggatttttgaactggtttctaagtattggctgaaagctccttaagaacacctttgtcatcatatactaaataccctcaggtaagaaataaaggttatattaatttggctgggcacggtggctcacgcctgtaatcccagcactttgggaggctgaggcgggtggatgacctgaggtcaggagttcaagaccagccttgttaacatggtgaaaccctctctctactaaaaatacaaaaattagctggacatggtggtgggcgcctgtaatcccagctacatgggagggctgaggcaggagaattgcttgaacccaggaggtggagcagctaaggttgtgccaccgcactctagcctgggtgacagagaaaaaaaaaggttatattaattcaataaaaaaaagggcctatattatttcatatatcatatccacataattatttatttattattattatttatgagacagggtcttgctttgtcacccaggtgggagtgcagtggtggtatgtcagctcactgcaacctcgacctccccagctcaagtgatcctcccacttcagtctcccgagtggctgggaccacaggctcgcatcaccacacctggctaattttgtttattttctgtagagataaggtctcactatgttgcccaggctggtttcaaactcctagactcaagtgatcttccctccttggcctcccaaagtgttgagattacaggcgtgattgtattttcctaatataaaaattacatacctgaaatcctatggcacctggtcccataaaatttatttttaaaataaaaaagcctcatctttcagcctgtagttatagaaagcttacctctcactgttctcctccattgtatcttgcattttagaggaaagtcctgtacatcggtcacctgtcagtttttcttcttctagacctattctgttcccattgtatttttcagtcattattttgtttggtgaatgatcaaaggcaggagataagtcttccttagaaagttctttccatcgtttctaggtagggaagagaaatgaaaaacaaatgcaaacattaaaaatttattttccttaaataaaaaaatttatgaattaaaatcctatattcaagttaagaaaacccaatgatgctaaaagatgagtgaaaaagaaaaaggcattttgccatactgtagcttgtaacaactatgcttattttaatttcaaaattttataataaagcatttagtatttatgtacatgagtatatagttgaatataataatcttaataaaatcttgtggacttttacctatttgagacaaactatactgggaccacactcaactattagtcacagtaatataattttaatattggtagccagatccatgaaactcgacagcacactgaacacattcaatgcaaagaggtcctctctccaaggtacattataataaagccatcaaaagtcagacatagagaattctaaaagcagcaagagaaaaggatcaagtcacatgtaagggaacctggcaggttgctattaacagatttctcagaaaacctgtacacgccaagaaagaacagactgtagagaatgggataatatattcaaagtgctgaaagataacaactactagcaaagctatctttcagaaatgaaagaaaaatggagtctttcccagacaagcaaaagctgcaagaatttattaccactagactagccttacaagaaatgcttaagggagctgctttgactggaagcaaaagtataattactatcatgaaaatatatgaaaatataatctcactgacagaggtaaattaattaccaaattcagaaaactccattgctgtaactgtggaatataatctttcaaatctccattatgaaggttaaaagtaaaaaatggttaatggtaactacagctacaagttgttaaggaccacacaatataaaaagatgtaaattaagcaacaaaattataagttgtggggggagggtaaaagccaaaaatattttatgagaccaaggttaagttattatcagcttaaaacactctaagatgtttaatgtaagccccagagtaaccacaaagaaaaaaagtaactacagcagacacacaaatgagaaagagaaataaatcaaagcttatcactatagaaaatcaccaaaccacaaaggtaaacaataagagagaaagaaaggaataaagaatatgaaaagcaaacagaaaacaattaacaaaatggcaggtgtaagtccttatctatcaataatacccttgaatgtaaatagattaaatacttcaatgaaaagatacagtggctgaatggatgaaaaaacaaaaaacaaaatccaactctatgttgcctacaagacactcacttcacctgtaaggacacactaagactgaaagtgaagggatgagaaatgatactccatgcaaattaaaaccaaaaagagaagaggagtagctatattttgataaaatagactttaggtcaaaaattgtaaaaagaaacaaaggtcaaaggggtcagttcagcaggaggatgtaatgattttaaatatctatgcacacaacactggtgcacacaaatatataaagcaagtattattacatctaaagggagacatagactgcaatacaataatagcaggagaacgctacatcccactttcagcaatggacagatcatccagacataaaatcaacaaaaaaacattggatttaaactgcactctaggccaaatggacctaacacacatttacagaacattccctccaacagccacagaatacacatttttctcatcagcacatggaacattctccatgatggaccatatgttaggccacaaaaacaagtctcaacaaattaaaaaaagaaaaaaatcacaatcaggccaggtgggtggctcacacccaagaactttgggaggtagaggctggaggatcacctgaggtgaggagtttgagaccagcctggccaacatggtgaaatgccatctctaccataaattagccaggagtggtggtgggcacctgtaattccaagtatttgggaagctgaggcataagaatcacttgaacccgggaggcggaggttgcactgagccaaaatcatgccactgcactccagtctaggggtcagagtgaaactgtctcaaaaaaaaaaaaaaaaaaaagaaaaagaaagttctcaaataaacaacctgatgtacctcaaggaactagaaaataataaactaaacccaaaattagcagaacaaagaaaataataaagaccagaagaatggaaataaagtgaccaaaaaaaagaaacgaaagatcaacaaaaccaaggatcatttttttgaaaaggcaaacaaaatcaacaaacctatagcagactaagaaaaaaaaaagactcaaatcagagatgaaaaaggagatattacaactaataccataaacaaagtattgtaagagactattataaacaactgtatgccaacaaattgaaaagcctagaggaaatggctaaattcttagacacacacgaactatcaaaacggaaccatgaagacatagaaaacctgaactgaccaataaagagtgagattaaatcagtaataaaaagtctcccatcaaagaaaagcccggacttgatggcttcatggctgaattctaacaaacatttaaataatactaattcctttcacactattcaaaaaactgaagagggaaatcttccaaaatcattctgtaaggccagcattaccctgataccaaaaccagacaaggacacaacaaaaaagaaaactacaggccaatatccttgatgaatatggatgcaaaaatcctgaatgaaataatagcaaattgaattcaacagtatattaaaaacatcatttaccatgaccaagtgggattcatccaagggatgaaaggatggttcaacatatgtaaatcaataaacatgatctctcaaaaatcaacagaatcaaggacaagaaccatatgatcatttcaacagatgcagaaaaaccatttgataaaattcaacatagcggctgggcgtggtggttcatgcctgtaatcccagcactttgggaggctgaggtgggtgaatcacttgaggtcaggcgtttgggactggtctggccaacatggtgaaaccccatctctactataaatacaaaaaatagctgggtgtggtggtgcatgcctgtaatcccagccactcaggtggctgaggcatgagaatcgcttgaacccagaaggcggaggtagcagtgagccgagattgcaccactgcactccagcctgggcaacagagcaagactctgtctcaaaaaaaaaaaaaaattcaacataccttcatgataaaaactctcaacaaattaagtatggaggaaattgtgcctcaacacaaagccacgttatgacaaacccatagttaatatcatactgaacatgaaaaagttgaaagcttttcctcttaagatctggaacaagacaaagatgcctcctttcttttttttttttttttttgagatggagtcttgctctgtcaccaggctggagtgcagtggcatgatctgcaacctctgcctcccaggttcaagcgattctcctgcctcagcctcccgagtagctgggactacaggcgcgtgccagcatacccagctaatttttgtatttttagtagaggcagagtttcaccatgttggccagggtggtctcaatctcttgacctcatgatctgcccatctcagccccccaaagtgctgggattacaggcatgagccaccgcaccgggctaggatgcccactttcaacacttttattcagcataatactgtaagtcctagccagagcaattagctaagagaaagggtattcaaattggaaaggaggaagtcaaattgtctctgtttgcagaagacataatcttatgtatagaaaaccctatagactctaccaaaaaactgttataactaataaaaaaaatcagtaaagttgcaggatacaaaatcaacaaataaaaatcagtagaattttatacatcactaacaaactatctgaaaaaagaaatcaagaaagcaattccattttcaaaaaaattacctaggaataaatttaaccaaggaggtgaaagatctctataatgaaaattataaaacattaatggaaaaagttgaagaggacacaaatggaaagatagcctatgttcatggattaaaattaatactgttaaaatgtccatactacataaagtgatctacagattcaatgcaattcaatgaaaataccaatgatattcttcacagaaacagaataaataatcctaaaatttgtatgaaatcataaaagaccccaaaagccaaagcaattttgagcaaaaagctgggggcatcacactacctgacctcaaaatatactacaaagctatagtaaccaaaatagcatgctactatcataagaacaggtataaagaccaataaaacagaagacagagcatggaaataaatctacgtatttacagccaatttatttttgacaaagatgccaagaatatacactggtgaaggacagtctctttgataaatggtgttgggaacactggatatctagatgcccaagaatgaaactagacccctatctctcaccatattaaaaaatcaactcaaaatggactaaagacttaaatatgagaccccaaacaaatatacatactagaagaaaagatagggaaacacttcaggacattggtctgggcaagggaagggtcttttgtataagacctcaaaagcaaaaacagacaaatgggattacatcaaactaaaaagcttctgtatagcaaaggaagcaatcgatagactgaagagacaatctacagaatggaagaaaatatctgcaaactatacatttgacagggattaatatccagaatatataagaaactcaaacaaaattcaatagcagaaaacacaagtaatccaattaaaaataggtaaaagacctgaatagccatttcttaaaagacatacaaagagccaacagatacatgagaaaatggtcaatatcactaatcatcagaataatgcaaatcaataccacactgagatatcaccacaccccaattagaatgactattatcaaaaagacaaaaaataaatgctggcatgaatgtggagaaaggggaactcttgtacacggctggtggaatgtaaattagtacagccatcttggaaaacagcataaaggttccttaaaagattaaaaatagaactatcatatgatccagcaatcccactactgggtatttatccaaaggaaatgaaattaggatttcaaaggcatatcggcactcctgtgcttattgcagcactattcacagtagtcaagatacggaatcaacctaaatgtccatcaatgaatggagggagaaagaaaatgtggaaaaaaaaaaaaaaaaaaatatatatatatatatataatataatactatttggccattaaaaaaaaaagaaatcctgtcttttgtggcaaaatggatgaaactggaggacattaagccaagtacacaaagacaaatactgtatgttctcactcatatgtggaatctaaaaatgttaatctcatagaagcagagagtagaatagtacctactggaggcttcgcagagtagggaagagggggcatagtgagaaactgaacaacagttcaacagggggatgagttctggtgttttactgcacagaatgactatggttaataatatttaatatttcagacagggtgtggtggctcatgcctgcaattctagcagtttgggaggctagggcgggcagatcgcttgagcccaggagtttgagatcagcctgggcaacatggtgagacccagtctctacaaaaatttaaaaattagccatatgtggtggcacgcgcctgcagtcccaattacttaagagactagggcaggaggatcacttgagcccaggaggcggaggctacagtgagcgagccatgatcgtgccactgtacaccagcatgaacaagagaatgagaccctatctcgaaaaaaatttatatacatacacattttatatacacataaaatcctctcttctggctatttcgaaatacttatatatacttatatatatttcaagtactatgaaatatattagcacataataatatataattaaatagagatttcaaaatagctggaagagaggattttgaacgttttcaccacaaagaaaagataaatgtatgaggtgatagacgtgctagtctaatttggtcattacataaatgtatcaaaatatcacactgaaccccataaatatgtacaattactaagtgtcaattaaaaacaaaggccggggcatgcggtggctcacgcctgtaatcccaacactttgggaggctgaggcaggtggatcaagaggtcaggagatcgagaccatcctagctaacatggtgaaaccccatctctactaaaaatacaaaataattagctgggtgtggtggcacacgcctatagtcccagctactcgggaggctgaggtaggagaatcacttgaccccaggaggcggaggttgcagtgagctgagatcacaccactgcactcctgggcgacagagcgagactccgtctcaaaagaaccaaccaaccaacagacaaaaaaacaaaataaaaaataaagtagcactgcacaaaaaacacaaaaatttttaaaaagatttcagccaaggtagattttgcttgaatcttaatccacttctaatccagaggtatgtaacactggagtagtcaccacagtggtgcttgaatgtgatctggaaccttcttgctccttgccactgttcagtctaggggagaactaacggtgagatctccaagctggtccttgtgatgctaaaggactttaatttggttgtgtctatcaggtacgctagcagctccaggcagctggctagcccaccactgggctagagaaacaccctccagcatgcctctagcatggccttcaggagtagatggcaacacaaaccaggattcggaccaagatgaagacaaatttcagtttcttctatgaaagaggatgtcatcatctaccctgggagacagttgtgattaatgagatggcatgtgaagcgcccagcatcatgtctagaaaatatgtttcctgtgctctcacttgtcaccattcctagggacaaaggtagaggaagaagagtgtatctgggcccctgcagatgaaagcagtgacaattgtacatgccagagaagaaaaacgcatatataacctatgcactgggactatagtctctcaagtccttgaaaggatgaaacatgatccccatctatgtatctgccagtggcaagtggtagaggcagaagcagtgggagccaatggttttgattacctatgactgacactggcccaaatgacttggtatggacagggatggccttctttgaagatcctatcaaggacgcaaggagtcttggatctaataaataaggaatactctacttattgcccgaggagtctaatgattttggacagagatgtaacattgcaacttaaagttttttagaacttatggaatattcattccctggagttactcttgtgcaatatggtactgttaaaagcaatgcttgtattcagatctttaaaaaatctctgggaaatccattcatacaatggataaactagtttctaatttgtctcattgtcatcatgtaccagaggtattaaaaagaaaaaggcacgcctggcacagtggctcatgcctgtaatctcagcactttgggaggctgaggtgggcagatcacttgaggtcaggagtttgagaccagcctgggcaacatggtgaaaccccatctctaccaaaaatacaaaaattagctgggtgtggtggcacatgcctgtaatcccagttacttgggaggctgaggtagaagaattgcttgaacccgggaggccgaggttgtagtgagctgagattgtgccactgtactctagcctgggtgaaagatgagactcggtgtcatggagaaaccctgtctctactaaaaatacaaaattagccaggcatggtggtgcaagcctgtaatcccagctacttgggaggctgaggcaggagaattgcatgaatctgggaggcggaggttgcagtgagccgagatcacgccactgcaatccagcctgggcaacaacagtgaaactctgtttcaaaaaaaaaagcattttccacacttcaccgttcccagatatggctattttacttagctgcataatcaatgtacctctttttatgtttttaatttttttagagatggggtcttactctgttgcccaggccagaatgcaatggtgtgatcacagctcactgtagcctcaaactcctgggctcaagcagtcctcctgtctcagattcctgagtagctgggactataggagagaactaccacggctggcttttttgttttataatagttgatttacagaagatttagaaaatgtgaaattctacagtttgttgtgtttggagaacagttagtagtacagtttggtacaatttgtctagaggatggaaaacacgcaaagcttgagtaggagagatgaggctggaaaggaaatagacctccgggaaagaggtctctggacttcatgagtagtggggtagaactgaaaatcctgagccctaagagggcgcaaaccatgtccccgaaagaatactgtgccaacaatcaagaaactacaatataatggaacacaggagtaattaaggatgtcttcacttagatgactgtctattttctttgttcccttgtttgttttgttactcaatccaaatcttttatagtgaagacatggagtacttgctactctccatgccatattctaacacttcaaatgtgctagctcttaatcctcacaataaccttaggagataagcactaatactaatattaccattattacaccctttttacggaagatgtggggagaataattaggtaactcgcccaaggatatgcacctaacaaatagtagagacagaattttaacctaggcaagtctgggttgactatgctgtgaccccttataaagatgtgtgttcaacaaagtaccccacaaaaatgttaaattgtctccagaatttacactggtcaatttttgaagtttccactcttgactgagacctagttatgtaacttggccttatagctggacaacactcaacaatgtcaacaaataagatgacaccaaaaatcaagtctcactggaccacttcccagaatatgcaacaaattcagaatacgtcaacaaggaaagcactcggcagagagagaaataaaagagatatttaatgctagtgaattaaaaaaaccccacaaacccaacaatgtcattttgccatggctatgttcagcaaactcactcatggctatgttcgacagactcattcatggctatgatcagcagactcactcgtgcctatgttcagcaaactcactcatgcctatataggttcagcaaactcactcgtctctgtcctccctgtgacacacaagggagccagcactcctgagtcacctgcctcaggtcattaatgctgactggtgaagccaaggaattacatttcactaaactataacctcaaaggagctctcattttgaggcctggtactgtttcatctttctttctaattctgtgctcacgttgcaccaacccatgagtcactgccactaggagccatgccccccacacaatgcctagaaccctagctctacccatttctctcactgaagaaagctttaagcaatgcaattaaacttcaaatcctctgtaatttgttaaaagtttatcatttacatttaatactttattagtaatatcaaattaccagctagagatcttacaacattagttctgaattgccaaactagatatttactctggggggttaactgtcatcatcaatactgggaatatgctaataaatatgtggtaataccagcaaccagcttaagtatttatgcctgaccttgtgctgaaaggcaattgcaaatagcctatatgtctataggaatgtcaaagtcattggaagttttctgtaaatgaatacatgctttaagattataattacacatatttacagacttaagatacaatcactttgggctgggtgcggtggctcacgcctgtaatctcagcactttgggacgccgaggtgggcgatcacttgaggtcaggagttcgagaccagcctggtcaacactgtgaaaccccatctctactaaaaatgcaaaattagccaggagtggtggcaggcacctgtaatcccaactactcggaaggctgagtggggagaaccacttgaacctgggaggcagaggctgcagtgaaccgagattgtgccattgcactccagtctgggcaacaagagcaaaactgcgtctcaaaaaaagaaaaaaaaaccagtagcatgtgtggtatgtatttattaatccaactttatcagtaatcacttcatatgccgatggtctaaatgcaccaattaaaaaagattctcagaatgccaagaccatttctgcagaaattaaccccttggaatgggcagcatgcttttctgatcctgagtacctgaaggataaagatgtttccaatatcctatctggaataggggcagaaaatgccttagaattgagagcctgaggacaatatcacaccagataaattaacagaaaaaaaatccttcctagccacaaactgcactgtcaaagactccacaaaaaagtgtgtccagaaaaactcatctctgtgataaaaaaagatccaccctcagataaagtatgtattctaaaactaaagacacaaaacttaaaaaaaaaaaaagcagtggtaggaaagacacaatccaaaggacaatacatttccctcccagttacccgtctcatcacagccaggaagcaggcagggaaggcggcatgcaggctgtgaaggcatggggaaatctgattgaactacttttctttttgaactccagatttaagttggtgaaagctcactgtgattagaaagggaaattttcctaatcttaaacatctgaaataacttttacttcacctaaatcactgatcactgccaaagtgaccctggcaaatccagtgttcccaaagtctggcgtctgaagcaggacatgttctaatgggctgagtttcccaaacattgcgtattttggctctgagtgccctaatgtttctgtgcattaagaatattttaatgctatttaaagatttggaaaaaatctttttaaataaacctttattctgacaccaatggtccgatctaatttacattcttatattggctagtaatcagagaaatgaaagtgctagtaaatatgttcacacatgagaaacataatgaaaagacagtcgatcttcttatattatgcatcaacttacagtatctgcttatgtccaatactatgtgattaaaccagacaaaaaatggagtctgtggttgtttctattttacattttaacttagtacataacacaagtttctgatcagtctttgaacttaggttctacaaatatgcagtaaaaatagcttaatgagaataaagccaccaaccagaagaatataacattttgctggaatttcattatatctgccataaatattcaagttgcttgttgttataaagtcaaatatcacataaaccaagtatcagtgtttaatgaaggcaaaagtatctcaagtttccagttactttaataattaaaagattaaccacccccaaaatgaaaaattcagtttctttaatgaaatcttgtttctacaagggcttttaagtaacacacaggatttaacctgaggctgagtatatatgaggaagctagctaaaattttacaattttaagacagccagctggatttaccacaaaaattcaaatacactctttgaaacaaagacaagggctcaagtggagtgcagttatttgatgctatgtgtatttaacaaatagatatgatttaaaacctgtatgaagtttacctgtatactagaatctccctttatacattttgctccttctattatagccatgtatgagaatctcagttgatctggggtctgaataagacccattcggtattttctcatgttcagtaacacttgttttatgttaatatcatctcctttttccatctgcaagaaaggcaaaaaatgagacaagtcttgttattggaacccaggaaacagaatcaatgcaagatcattgctaagatttttgctatgcattttctcctctgaaagaacaacgataatttaaccctccagctataactgttatgtacacaacaactatcccagcctactcatccctccccacatctcaacccctcaagtagttggaggactttgattctttagctgattcacaactgattccaaaccaatcatagtaatctcattccttctggccagtcattggttaaaggaaggatttataaccagttctggctagtataaggactatttttttttttaaaagtcatggcaggagtcaacctttctgctcattccccttccgcctccttcatgtctgcactacagacacgatgtctggatatacagcacccatctaacaatggtggaaaagaggccaggcatgatggctcatgcctgtaatcccaacactttgggaggccaaatcacttgaggccaggagctagagaccagcctggccaacatcgcgaaatgccatctctactaaaaatacaaaaattagctgggtgtggcggcgcatgtctgtaatcccagctacattggaggctgaggctggagaatcgcctgaacccaggaggcggcggttgcagtgaggtcagatagtgccactatactccagcctgggcgacagagcgagactccatctcaaaaataaataaataaataaataaataaataaataaataaataaataaataaaaatgtggtgggtcacacctgtaatcccagcactttgggaggccaaggtgggcagattatgaggtcaagagattgagaccttcctggacaacatggtaaaaccccgtctctactaaaaatacaaaaattagctgggcatggtggtacgcacttgtagtcccagctactcgggaggctgaggcaggagaatctcttgaacccgggaggcggaggttgcagtgagctgagattgcaccactgcactccaccctggcaacagagcgaaacttcgtctcaaataaataaataaataaataaatagaataataaaataaaatgaagaaagacggtggaaaagacagcaaaagcccagatccacgataacactgctgagctacagcactgctctggactactgacctagtgttagaatccccacacccaggctcaccaaaaataaaagaaaaaaaattgttgaagttatagttggcagggaacaggtgtcattaacaaaataatcaccagagttttaaaactttgatgtaacaatctaattttgattgaagtatactatatatacgcagagtggtaaagtaatacagatgtttagttaagactcaaccgttcccaattcctagctttcattagagatgcaacgtctgaaatgttcttccaagagtatcactccttccaagagtatcactccattgatcaagctccttgtgtgtgtgtttacaatgaaaagcatcatcatattaattcacctgggaatctactttgtgctggcagtcatggtggaaagcataagaatgctgacataactgcaatgaagcatagctacgttttacagaaacatcgaagagactaatacagggccttaaagtcaaggttaagaacaccagtcttgtgtcaagcgtggtggctcaaacctgtaatcccagcattttggcaggctgaggcaagaagatcacttgagcccaggaatttgagactagcctggccaagatagtgaggccttgtctctactaaaaataaaaaagcaaaaactagttgggtgtggtggtgcaggcagctacttgggaggctgaggtgggaggatcacttgagtccaggaggttgaggctgcagtgagcagtgattgcaccattgtactccagcctgggtgacagggcaagactctgtctaaacaaagacaaaaacaaaatccccaccagactgaataccaggacaagctaaactgcttaggttattgataatcttagaacacgctcagaaagcagaaactaagctgcagggactactgaaggagtagatggcatggaaatcaaagcagacagtattattgttgggtttgatcctataataagaggaagaagtaaagacagaagttaggagaagtataagggcaaacagaagtttcatgtatcccaagtaacgaaaaaataaaggtcctaaaaagagaagaaaagatctaggctgtatacaggctgggactgggaatgactggtggagaaagaattagccgttgggggcacagacaggaacctcaggggagtaacagtaatactgacatttatggaatgctcagaaaacatcagggactcttctaagtctccttaatgtattaattcattgaattctcacaggaaccctgtgaagtatgtctatcattatccctagtttttaaatttaaaaaatgagataaagtatctgtctgaggaggaaggaattcaatattacatatgaatttatatttgaaaaaatgtgggggagagacctattatttctgtaatataaagctaccaggaagaaaaacaccttcttagggatctctaaaatcatcatggatacattcctaccagtcatgaataagaggcagttgcaacggtggaaatgagatttttaggtttttccaaaagtagaagtttaagttgaaaaacctcagttctgggatacagcatcagagtttattcactgccagtggaagcaatttaaaaaaaaaaatcaatgagattaaaatgagatcgtaagaagcacttaccaaaacaagacaagtgtctaccagagagaaggtgccagagcgcccaatgcctgcactacagtggatcaccgcaggcccatggtcagggttcaaggagccagattctctcactttaaacaagaaattgagaaatgaagctggtgattcagggactccaaaatctggccaggtagtataatgaaagtgagatattgttctggtttcaccactctaaaaagtgaaaatcaagggagaagttagttctaacttttttcttttaaaaaactacttcagaaagatcatgtgttttatataattctttaaagccatataggctgtttatactatgatttttccatttgttttctgacaatcccatatacaaactagggaagattttctttagtggaaatttgtgatgtattaataatagctaacgcatacaacacttactattttggaggcctgttctaagcactttacttattaactcaatccacacaataatcctattaaagcccattttcctgatgaggaaactgaaacaaagggtaagatagtttgcccaaggtcacacagctggaacatggcagaaccaggatttgaagcaacctggggcagcctttgggttctcagctactaatctgttaccatacatgttaccaatattttctttaattcatgtatcatgaatgggctatttttttctattttaaaaaatttctgccgggtgcaatggctcatgcctgtaatcccagcactttgggaggccgaggtgggcagatcacttgaggtcaggagttcgagaccagcctggccaacatggtgaaaccccgtttctactaaaaatacaaaaaattagccaggcgtggtggcgcgtgcctgtaatctcagctacttgggaggctgaggcaggagaattgcttgaacctgggaggtggaggttgcagtgagcagagatcgtgccattgcacgccagcttgggcaacaagagtgaaactccatcttcaaaaaaaaaaattttttttctaccagtataattttacattctttaacattttcctttttatgaatttcaaagtttattttttaaatataatctcccgttcacatgattatcttttagattctgctacacaggcataggggagcaactcaagaattaatctaaagaaacgatctttatatttttaattggaattgctcctctaaattgttgcctttccccatggcaataatttccaatcctaaagctgtttatatgcttttgctgatgtgctaaagtggtttaccaacatgctaaatgtttcctgtctcttaagcctgcctggtattcactatcgcttcctggatattcctgatgatctgtatttctaactcattatgaaaatgttccttagctttttgccaattgccttttgccccaaggagcacttctctgctttatactcttcatttgtgtaaacgaagcagtggtcttccactaatatgtctttgtgcaatttttcagttttattgtaggaggttttttttttttgagggaggaggcatagaaacaatgtaaaaaaccttgatgtttaatggtttaacaactaaagattattattataatatcctgctcccaataaaaattttcaaaattagaagttagctttcgctttaaaaatataaattttcggccgggcgcagtggctcacacctataatcccagcactttgggaggctgaggcgggtggatcacctgaggtcaggagttcgagaccaacctgaccaacatagagaaaccccgtctctactaaaaatacaaaccttatctgggcatagaggtgcatgcctgtaatcccagctacttgggaggctgaggtgggagaatcgcttgaacccgggaggcggaggttgtggtgagccgagatcgtgccattgtactccagcctggacaacgagagcgaaactccatctcaaaaaaaaaaaaaaaaatccattttgcagtagaaattaagacttctatgtcccagactcagtatataaggtataatactaataaaatacagtgaaataaattttctaaaaagtacatacttttagtgaccttttaacatccagcattaataatttcaaatacagtgtgatccacaagttctcaatatactaaaagcaataaaaaatttctccattacaaattaaaatgatcatggtttctacgctttaagacatttatttttaaattaattatggtaagtgaacaaagccagactaaaggctatatactatactattccatttttatgacattctggaaaaggcagaaaaacagaaacagaaaccagattactggtttctggctgggggtagaggacaggactgactgtacacaagcaacacaagaacatctggggcaggggagaggtgacagaaccgatctatgtttctgttatgggcagtggttacatgactgaatgcactgtcaaaagtcacaacacgactgtacaccaaaaggaatcaatcttattgtaggttaaaaaaaaaaggtaaattaaatttattgcattaaaaaagagaattcaaaacattctaaaataagaagggtaaactctagtctccttttacaaagcagcaggtgggcagttaatacggcaacactgacacaggaatgagctagagaggtgggttcttgacagcggggggtgggggggatacagttaactcaaagtcaagttttcctttaaatgaggttaagattccagtggatgttaataacccactttgtttcttacttgctgcggccaccagcaggaccagactcagtctgtgtgggccttcatgtggtctgctttgagcaggggcctgcagtgctctgtgggctacggcccagtacccctacggggtcctgcgcacaattacttcatcaagtcctggctcaaacatatggttaccccacaatcttgggcaacagcttgctttctctttgcttgtatgattttggctcaaaactagtggtctcaacttttttcacattcaggtcacgctgtctgggatattggaagccagttcccagaaatgctcatgactatttgtataatatagtcttccccactaatagatttttgaaaatcagttgttgttttttttcccccctacagaaccaggacttttttgagaggttaactttgattaatttatccttacagaaacaagattaaaaaaacacagctttccaaaatcataattcacagttacaaaggaccacacgaaggcataagatgcatatatttactactctggtatagaaacattcatatgcatgactggatggacccctttccctctttttcacgcaggaaaaaaaatgagaggggaaaaaaagggttgccaaaggatacagagctaaaacgaaattcatctttattccaaacaaggtctgcatttagactttacaatttttggcaaactccttattttcaaaactgtggaagcacccttttcttctccttggtcaccgagtcacactacttctcctctggtccccagctgctgccctccacccttctcgctgcttcacccccctccctacacacacgcgggttgcacccacaattataggctgtccctgtctgcagccgttccacacatgcctgccaagttttctgtgtaaaactctgcattatgtatactacattctgcacaaaatgtcagtggcttgctgttctaaggcaaaatcccatttacatttttaaaagagaattctaaatttaaagtctttgaacagcaatgtcaaacttgcatatatgaagccaggaaaataacctgtgagttgagcaagtgtaacaacaggaattgttaggccacagcaatttaagcatatgccctgttcacagccttcaaatgcaagttaataatcatcataaatatataataagattatacattttccaattatcataaaaaatctatacagctctatgaccccaggcccaattactttcacactttaggtatatatggaaggtaccaagattttgtttctaaaagactttcactaagccccagttctgtcatctgtaaatagggttaataatactacttaccttacaaaactgttgttaaggaataaataaaacaattaatgtgaagtgcctgccatatccctgcacatggtaaatgcttaacagatactggatatttttaaaacaactatactcaccaattgcctttattgtggcccctagaaagctccagtcaattgtaaaactcaacacattttcaacctcttcattgggtatttcctctacacctaaagagtgacaaagtttgtcaaccctatgtcctaaccagatgtcaaatctgtaccttcactatcactgccttagttgagtctctcatcaatttttgccagggtcagcatgtcagtgataaatatttactgactgggattcattgtgaaaggcagatcaaactcaccagatcaggaggagtggcagaaacggctagggacaggcttgcattctcagcagagagaaagcaatatgcaaaggcatgccacccacccccaccaaggaattcacctattagagaagtctgtctgttagcacgaacaaatcctggatacccgaaggagagggagttagacaaggaggcaaggaccaggctgagctgggtcatggtcttgtgcactggacacagactttttttggtaaccaatggaagccacagaagaattcttagaggatggtggaaagattgcatctgtgttttacaacaatcactcaggtgtaatgtgcttaaaatgtactcttgtgtaatggcgggggggtaccaaggcagcagataacttccaaccccttcgaagttaaaaacctcattatggagtcaagatttacatagagagatgtattgaacaagcagtagaatgataaaatttaaattactgaaaaagtataagaagaatcatagctgttagggatcaatgtgtcatagatacatgttaggagagacctaagtaagaagtgggccacaggggttactaaggacgtgcagagaagagagaggacattctaggtagaataaactgtttaaactattttgaaccaaatcccagctaagcatcataataattagagactctcatcttgctaaatctttagggacagggaaatagaagacagtcagcattataacagtattcctggaactcactaaacgtaaagcgggccaacattacagaaatagtgaagggcaactaaaaagaaaaaactgaaagacaagtactctagatgaccttatatttttaaaatccctcaaaattatctccatagcttaagccacaggccacactgaaagccgagatgcaatctcttcttcaggggcaagagttcaaacttttagctttaagtaagtcactaaagggctcctggtatgtcattttgctgttccattagactggaggaggcgcagggcttgcttagacaacagctttacctttggacttgttaatagatacgtgtcagactcccttagatgcaaactggatctctgcaccccagcgactccaataaagacagagatctgcgtgttgagattggctatcagccccctactccatcatcactttttctcactcccattggttctttctttcttgctagtatccttttcaactactcccggttcctgttgtcccttccaattcattactgttacaaaaaggaaactgatcaactaaaaaggtaattgtggctcccgcaccatcatgatattaactcacttgatccttagagcaatcctatgaagtaggtacgttatcaccctcattttatagatgataaaacaggtactgtttatcatctatagtaaagtaatgtgacccaagtcactcagcaagaatggcagagtcaggatttaaacttgggctatctgattctagaggttatctacttaggcaaatgtaattctgcctctcatactgaaatgctactttatccttctaaagaataaagaatccctagttctaattaaaaattataaagtagaacacaaacaaattcttgctattatattgtggtatgttctaaacccaggccaataaaaaatccagtgatcatgtcattataccacacagttgctagcaactaaaacagagtggctggccaactcacatgatggcctcaactccagaaagatgcttcagaatcaataatctctctttacaacaattagcatcttttcaaaaggacttatccccatgtcaaaagttaggagatggccgggcgtgttggctcacacctgtaatcccagcactttgggaggctgaggcgggcagatcacctgaagtcaggagttcaagatcagtctggccaacacagcgaaaccccatctctactaaaaatacaaaaaattagccaggcgtggtggtgcacacctgtattcccagctactcgggaggctaggacaggagaatcacttgaatccaggaggtggaggctgcaatgagccaagatcatgccactgcactccagcctgggcaacagaatgagactttgtcttaaaaaataggggaccaggagaactaatgagatcagtctgtcacttattagctaagtaatcgatggaaaaattcctataacctaatggattttaactattattttttataatataaaatacggggataataagaatatttacactatctacactaactgaagactactggtcagatgatatatatgtgaaagcattttggaatctgataaacaaaacacaaaaatcattctattttattgttacttaaggtataatcaattctcaataaggactgtttcagaaacagggaaacacatctatgcccttcatctaaatcaattttaatgccataagcaaatgagtaattacctgggataaataccaagagaagatgattcagagaactttcagaaccttgtggaaatacagttctgtttctgggaatgaacaatgtacagctcagtccagtatcaaagagttattgatgtatctcaatgcagtttaagacacatgtaaatggaaagagttgggacaaaataaatatagtaatgggaatgtataaataaatctaagcattatcattcgtaattttgagcctttttaggtgactcaagagactgtataataagcttagtacggatgtcacgggaagctggacagaaggaaaaccagaacctaggcctcacgcacagagcatgcacctgtgcttactcaatgcagcaaaaaacacaagtgtttcaagggatccaccataaaagggactgccacacatctaaaaagcatgtatatatctcccttctctttaaggtttttttgtattgttagtgatcacttaatttacttaatggttaactaaaacagtatttcacttatagactacatacattcctaaagtcatatgaggctaaacattctcctattttcaagctatcacagtttctattagcatctcagaattactctcatttcattattttctagtttattctattacaacacaaagagggcaaaagaggtaaatggcgaaagggggagaaatgcctcaatcatcaccctggcaacagcaggttcataacccactatgtgtatgtacctcaaccaaggcccaaggaacagttcatatgtttctggggaagaaaaatgcaagtaaggcctggcatggtggctcatgactgtaacctcaacactttgggaggccaaggtgggaggatcgcttgagctcaggagtttgagaccagcctggataacaaggcaagaccccatctctattaaaaaaaaataagaaaattaggtatggtggctcatgcctgtaatcccagatactcaggaggctgaagtgggaggatttcttgaggccaggagttggaggcctcattgagagctgtgattatgccactgtactccagcctgggtggcaaagcaagactgtctcaaaaaaccaatcaaccaaccaaccaaccaaccaaacaaacacccaagtaaatgttcttgagaccacatgccacatttatacatgtgtgtgtatgtatgtatgtatgtgtgcgtgttacatatatatataaaacaccattttttttccaactcaatagggacaaatttttgtgttgtgaatcacttaacaatagctttgtaagttattttcttgactattttgctattcttggcagtcacaggtcctgggagctattgcttgctgggcatttactaaggtcaggtgctctgcatacacatcctcatttgaccttcaggacagccccggagggaaggcgtggtaacctccattttacagatgaggaagggatcagtgagggtggggaacaagtctaaagtacagctctactaagcagcagagctggatctgaatccaggtttgcctgattctaaagccctctctattaatcctcatgtatttctattaattaatttttaatccccaaatatcaaactgaactttgaaattcttagtttctactgtttcttcagagtcctcagaaagctactagatgcagacacacaatctaaaaacacgtgattatggctagatactataggaattatccaaatgcatgtgcttatcaaacttcaaatctaataataaagaataattctttaaaccatcatataaagtccacaatttcgggcaagaaaggtcttacattgatattttctaattgtagtagatgtactgtataatacgacttcacatcttctgacaagagcttcacactgaatcctgtttctttaaacagcatctcttggtcatctgttggccagtactgtgcacatttaacctaaatttagaaatatgtatatgatttttttttagtttatagacatcatgaaaccataaagttaaaaaatgaaaacaaaccagatatatacatgctatattttttcaagtacccaaaactaagaagtcactactatattctacgcttaatgtattttagtaagattgaaattttatagccgggcgcggtgactcacgcctgtaatcccaacaatttgggaggctgaggcgggaggatcacctgagatcaggagttcgagaccaacctggctaatatggtgaaaccctgtctctactaaaaatacaaaaactagctaggcgcgatggcgggcgcctgtaatcccagctacttgtgagagtgaggcaggagaatcgcttgaacccaggaggtggaggttgcagtgagccaagatcattccactgcactccagtctgggtgacagagcaagactccatctcggggagcagggcgggtagagattgaaattttataaagcattttttatgtgtgtgcagtcatcactgtaagccagttttagaacatttctctcagactcagaaatccccttgtgtcctattcccactccaagccacaggcaagcactgatccattttctgtctccataggcttttcttttcttttgagctggagtcttgctctgtcgcccaggctggaatgcagtggcgtgatgttggctcactgcaacctctgcctcctgggttcaagcaattctcctgcctcagccttctgagcagctgggattacaggcgtctgccaccacacccagctaatttttgtatttttagtagagacagggttttgccatgttggccaggctggtcttgaactcctgacctcaagtgaaccaccaacctcagcctcccaaagtgctgggattacaggcgtgagccaccatgtccggtcttataaggtattttttaagtgttcctgtaacttataaactaaaaaagccataggtatcatattcataaaataaaaataaatttatcattcttaaagcatgattacctatattttaacgtcatgggacattcactttatgtttctaaaattatcaaactcttgcaataattttatcttcaaaataaatgttgctggccaagcgcggtggctcacgcctgtaatcccagcactttgggaggctgaggcaggcggatcatgaggtcaggagatcgagaccatcctggctaacacagtgaaaccccgtctctactaaaaatacaacaaattagccgggtgtggtggtggacgcctgtagcctcagctatttgggaggctgaggcagaagaatggcgtgaacctgggaggcggagcttgcagtgagtcgagatagcagcactgcactccagcctgggcgacagagcgagactccgtctcaaaaaaaaaaaaaaataataataataataatgccttaagaggaaaataaataattttttttttttttaagagacagtgtcttgctctgtagtagcccaggctggagtgcactggggtgaacttggctcacttcagcctcaatcttctgggctcaagcaatcccccaaccccagctgggactccaggtgcgtgccaccacacctggctactttttgtattttttgtagaggcagggtctcactttgttgtcgaggctggttttgaattcctgggctcaagtgaccctcctgcctcagcctcccaaagtgctgggattataggtgtaagccctccaacctggccagaaaaaaaaaaattttttttaagtaaaatagaaataaagagataaacaggattaaagagaacgtgacaaataaaaaaggtaggcaaagaaaatccaacatacgtataataggaagacccaaagaagaacattaaagcaagcaagggagcagaacaaatactaaggactgtaattcaacaaatatttctttaacaaaaagtatttaaaaaattttaaaaagtacttgaagtcaaactctcaagaacacatcatgtacctgtaaaaactgacccagaatggccaattactaagacatatttttggtaaaactaataatatctgaagaaaaagaaaaaaagaattctttgggtagtgcagataaaaagaacaagagacttataaaggaaataagatgtccattagactttggtggaataccagaaggaaatggaaaaaaaaagttgttcaaagaatagcacatgagccaaggattttatatcccgccaaactgactttcagatattaagacagcagatgaaccatcactgacatgtaaaaaaatcagactataatgctcacaagtccctccttaggagccactagagaatgagctttagtcagaatgactggagagacatcagcaaagactgttgatgaatattaaataatgcttgcttgtagaactaagagtctacaagagatgtaagggagagactacagtttgtaaagtacaactcagaaacaccaggaagagaatgaaaaaaatattaaaaattgtaaaccattttcagtaattattttggtagcagatgatatcatgattatggttatatattgtatatgatatgggaagaaggaaatgagtcattacaagatagtttacatctctcatatctttgagaaccaggattcttggtatgaaaaaggaaatagcagatgtaagatggaaggggctaagcaacacttatagttccaaatttgaactgggaatatcattatgaactcttgaagtatgttatcttaacatatgcatattgttccttagcttttgtccactgaaaagccctaaaaacaatgaccagtccagttgcaatatatatccttatttttgctgtgatcttgaaatactgctgcccattaaaagaaaccaaaactccttagagaaatggctggttccaggtctgggcagcaagagtttgagatgagcctgagatgcagtcattacagacagcaaaaaaaattttttttttttgagacagggtctcgctctgtccccaggctggagtgcagtggcacgaccatagctaactgtagccttgacttcctggcctcaagtgatcctcctgcctcagtaccccaggtagctgggactacaggcatgcgccaccacacccagctaatttttgtattttttgtagagacagagtttcaccatgttgcccaggctggtctcaaactcctgggctcaagcgatccacccaactcagctccccaaagtgctgagattacaggtgtgagccactgcacccagccaaggaaactattaaaggtttgttaaaaaggactcagagctgggtgaggtggctcacgcctgtaatcccagcactttgggaggccgaggtgggcgtatcacttgaggtcaggaacttgagaccagcctggccaacatggtaaaaccatctctacaaaaactagctgggcatggtggtgggtgcttgtaatcccagttgctcgggaggctgagacgggagaatctcttgaacccgggaagtggaggctgcagtgagctgaaatcatgccactgcactccagcctgggcaacaggcgagactctgtctccaaaaaaaaaaaaaaaaaaagaggactcaggacccaacctaaagacattgctgctagccaatgacagggtaatttgatcaaaaataaggaaaataactgcaaaggagtaaaattaatccagtatgtccaaacccataataattcaacctctcctgccactctccaccagaaaaactcctaattggtcatctgttgagaacagatgacctcaatagggaatcaacttttttttggaaaactgcttttaagagaagtaatgacagaattggattatcatcatttgtaacccataatgaattaagaagctgaacactgaccaataatggctattaatgaaataaaaagaacaataatcagacattatgggtctcttgatgaataacacattacccaccacctctgaagtaatcttccccaaaataattaaacctgactcttgttaaccatctaggttcaaccaccataaacatgatttctaaattctggtggcagtgttatcttattaatacagtaattatactccaaaatgagagaaataaaatttgcaaatcatgtagtctacaatggtgctcaaactgacaatgtcataatccttgatttttttttttttcttttttgagatggagtctcactctaccgcccaggctgcagtgcagtgggttttgagatggagtctcattctatcatccaggttgaggtgcagtggcacaatctcggctcactgcaacctccacctcctaggttcaagcggttctcctgcctcagcctcccaagtagctagcattacacctggctaattttgtatttttagtagagacggggtttcaccatgttggccaggctggtctcaaactcctgacctcaagtgatctgcctgcctcggcctcccaaagtgctgggattacaggtttgaggcaccgtgcctggcctaatccttaatttttaaatgatattgaagatcaggaaaaacccctgtaaatgactatgctgatactgctggaaattctggcatgtcattgccacatctaattagaagtggattaggaaattttcatcatcattaaaaaccagcaattatgaaatgtagaataaagtaagaaatctgaagtagaacagtacaagatcttaaagctggaagaggacttattgacaataggtcaataaggattcctagggattccaaagatctatatgtcactgctagtccatatttattccattgtatttctatcttggagatgaaaggtctgcaattgttataaaaatacttaagaaaggaaaaggatacatgagtttttccggacagaaacactttgaccgctagcctttagcaattaaaggccaaaactaaggaatgaatattggccccaaaatgaaaatctttatatgctaatgatcacatacagtatactaagttgtaaatattaaatattactcaccgattctttctccacaatgcggttcagcatgacaactgctttggtcttctgctgccaaaccataagccagaaatggcagcatgtgttaggaagtggaccctgtgaagagagaggagagagagcagatgagggaagcagacagaaagagcaaggctccaggaaggccttgttaagtctgctcctgggatgttacaagacagacagcggacgggcttataagaagtaaaccaagacttccaatctacctgatttcaaaaacaggtctgtgttagttaggatttttggttgtaaatgatcaaaactgacttttattttctcaggcaaaaaaggaattgtgtaagatatcaagtggctttcagagttgaggactagagagacaaacttgggtaggaaccaagggttaagacacaagcaaggtcctgccccaaagaaagtcaacctgggatgctgctcttgataccgtcactactatctccttgcttttgctggcactgccatatgaaggtggctatagtattcatgtacaatctataggcaaatcagagacaaaatcacgagtaggagtatctgactgatcatgttctagctgcaaagaaggtagaccaaggaaatttctgtcctcttcatcttctacagccaagaggatgtgcctcccacacatcatagaaaatccatgagaaaaaagtctgtaccatcactggccagccaaccaactcaagtcaactacaaaaagatttctagaaaaagtaggaatcattaaagtacctgaaccacaatgaaactgttaatctacaaatgcacagtatgtacggcctcaatggaagagtattgggcagagttaaaaaggggcaacagtccatgttacaacaatgccatggggataaaagcaaaatatttcatgtatttccaattgctttcacattttaatgatagcatagggcaaaaggaagatctaataagagatgaaaagcctatgtacaaattttaacgagttttaaatgagaaggttaaaatgagatgtagttttgctacacctaaaataactatgaacatgcattcaactcacatggaatgtagcagagtggtatgagttaggggcagagtcaggagtgggggctagggctgcccagagcttcagacccacatacaacaagggggttaaagtggttctagactaaaagcattttttattttttgagatggtgtctctgtcacccgggctagagtgcagtgtcacgatctcagctcactgcaacctccacttcccaggttcaagagattctcctgcctaagcctcccacggagctggaattataggcacccgccaccacacctggctaaattttggatttttagtagagacagggtttcaccatgttggccaggttggtctcgaactcctgacctcaagtgatccacctgcctcagcctcccaaagtgctgggattacaggtatcagccatggtgcccagctgactaaaagcatctttaggcctggtgtactccttggtatgtagcagatactcaataaatattacttaaatgaataaaccaaggttaagttgtaaaaatgctagaagtctactgaggatcctgacaaactacaacctaatatttgagagtggcgttttcctcactcaacttatttttctattacttgatctacttctaaaacaaaacacagtctaaaggtaaaaacagcaatgaggaaatccccagtaaaatgaatacctttttctttaattaggaaaaaaaaaatggatgtagcaatttgccagtgaggttactccttagtgtatacacacaatcacaacccatgccattccactggtgattctaaagactaaataataaacaggaacacagctggagtcttgctctgttgcccaggctggagtgcaatggcacgacctcggctcactgcaacctctgcctcctggattcaagcaattctccctccctcagcctcctgagtagttgggattacaggcgtgcaccaccatgccaggctgatttttgtatttttagtagagacggggttttaccatgttggccaggctggtctcaaactcctgacctcaggtgatctgcctgcctcagcctccccaagtgctgggattacaggcgttgagccactacgcccagccataggtttttaaatcagaggaacagagattcacatctcagctcttccatttaccagcaatgctaccaatgttcttcatctgcaaaacagacataatacaccaaggaggtgacttttaaaaaaatactaattcataaaactcagaagaaaaagatgactgaagtaacaatctacaaaggacaatcagaagagctgggttactgcatctctagttttctgtatcctccattccaaacaacctgctagatgcaaggccaagagctagactgagatgcagtcttggctctttaagagcttgcaaaggtagaaggagaagtacttgtatgactaatggacacagttaagtagtacaagagtatgggcaaattaaaccatcaggtcttagggagcaggaaaggctgggaaggaaactacagaagagcctcgaaaaaggtcctaatacagagagggaatgcagaagaatgggagggagttagggtccactccaggccctccaagcataaggcaaagtgcatgaaagtttagggcatatttgggaaaagacaaatagatcagtgaggtagaagtggagggatgtagttggtgactacaccactagagtgacagggatggtgccaaggggagaccttaaaaagctgctgcaacaggacaggtgtaattgaagagagctctgaaaaaagcgaggggcaatagaagatcagaaagaacttggcagacaatgaggacagtctcaatcccaatgagaaaaataggaaggcagctaccttggtaaaaaagacagagaacatgcagactttgaaatccagtaaaaatatccaatagagacctgaaaaacatagagaggaattcaggagagaagaaaaagccagacacaggcttctgagttctcgcattaaatgggcagggctccttcaggacacacacagcgacaagaagttcaaaaacaattactaggaggctgggcacggtggctcacccctgtaatcccagcactttgggaggccaagacaggtggatcatctgaggccaggagtttgagaccagcctgagcaacatggtgaaaccttgtctctactaaaaatacagaaattagctgggagtggtggtgagcacctgtaatcccagctacttgggaggctgaagcacgagaatcacttgaacccgggaggaggaggttgtagtgagctgagattgcatcactgcactccaggctgggcaacagagtgagactccatctcaaaaaaaaaaaaaaagaaagttatttaatgtctctggatctccttagattcctcgtgtataaaataaaggtaatactatttaccacagagggttgtcctaaggtttaaattatacaaagcatgtaaaaacaccattacaaaatttttaactgttattatttcctattataatgtaaaattcataaaattcataatagggtttttatgaaagtctgttttatttaaacaatgcctgccacagagtaggtctcagtaagtctttgctgggtgagtgaatacccagtgaaatgctggcaccaagattccagcacaggtaccatgacagtagtctaccctatcttaggttacaaaggttgaaaaccatggtcttaaagggctgtagtgcagactggaggagaaaaaaaaaagctaatttagaatcttaagacctatgtttttaagaactaagaagagaacaaaaaaccagtaagtgataatggagaagaacagtacagagggagaaagggttgtgataagggatctagggtggtaattcttctctattttttaatgtaattagttgtccctcaatatacacaagggactggctccaggacccaacctgccccccacccactgcagtataccaaaatccacacatgtccaagccccactggtggccctgtagaacctgcagatacaaagagtcagccctctgtatgcatggatttcacatcccatgaataccgtatttccgacccgtttttggttgaaaaaaatttgcctgtaagtggactagtacagttcaaccctggatggttcaagggtcaactataggtatttcaaacagaaaataaaatttttaactctaaatagtagtttaaaatacaaatgcacataaaaaaaacttccaatattacagaaaggaataaaatggaaaattaaagtctctattcccaagctccacaaattattactaatggtatatgtatgattaacttatttaaccagtcccttacagattgcttgagtctgatgcgttaaaataagactgcaatgaacatgatcacatatgtcttttttttttttttggacagttttgctctttcgctcaggctggagtgcagtggcactatcttgcctcactgccacctccacctcccgggttcaagcgattctcctgcctcagactcctgggtagctgggattataggtacccgccaccatgcccagctaatttttgtatttttagtagagatggggtttcaccgtgttggccaggctggtctcaaactcctgatctcaggtgatccatctgcctcagcctcccaaagtgctgggattacaggtgtgagcctccgcgcctggccgatcacatatatctttatgtctgactgtatttctctaagtagactttcttggtcggtcagagtatttgaacactgagtattatacactttgaaatctctccttttctgacaggtgaaaggcccattccctggttactgaatggagcatttcttcatgtgcaaagtgtccacctttgattctttgaactaggagtttatgtcctttgccagttttttccatgggctgttttttttctttttgacttgcaggagctgtactacctcaagtaaaaaatgcattttagtttcctgtgaattgacgtagtataatagctcatagttacattaatctgcatatctttttacttatcaaatatttttctctttcaaataagtcattctgatttaagttatgttttcaaaaatctcaaatattatggtatatcttttgaatatttaaaaatctttagggggaaagacagccctgttgataatcaagtctttattacttgatgaataaagagtagctgtggatacacaaaaatctctcctactatctcagaatggaaggaagaatcatgcttgcacacaggtgtggctgatgcgctcagaggcaactgggcagaaggccacagggagcacaaggccttgtggctgggcctctggagcacctggtctcagcacccgctcaggtccttgaagacgaccagacaccatccagggcttggtgtactctctgaagatatatgcgaggcagggggagctacagaagagctgtccagggcctctggttttgccacagggtatgggaagagaaaagaagacactaagaagcataagcagcactctgtgtcagatataatgtaaggaacacaatctgccaaagaactggcctaagccatttcctaagaattttccttcacagaacgtgtaatatcaaaaataacttgccttttatcttaaatactcaaagcttcaaaaccttataatgtccataattcattacatcgtcagaaaaaaactgaaataccatttcatttccaaaagaagtcaagatatacttttacctatgatttaaagcagaacaagcacaaacacatcattttcagacatttgcgtggtatcgtattacttgcctgtgttaagatgtaactcctttgtgcctcttctatgtcaactaaactggcattaatataatcattctcagcattttgcagtttaacacgactgtgatcatctgaaaatagagaatgataaaccacaactgtcatttcaaaattactgtttttatcttcatattaatattctaggtatttataaaaagacagaagaaataagaaaaatgaattagcatcataatagagttgagacaaatcctaaactattctctactttttttgtaaggagtataaaatgcaatcttgtttattactatagtgctggaaaggaagcacttctgtttgtagcacattagccattgtgacttgaaaaatcgaccaggagtaaacatagttaaatgaataaagtacttaccttcctaaaagtaaaaggatcattcagattcttggtacctaagaattgattggtctacctacaaaacgataactggtctcaaatagatgagactagatttccgaggttactatatttcaacctcttcatttctcaacagataagaattccactatatttaaataaattttagcactgaactgtgtttaggttaaatgctgaaaatatttaaagacagttggaatattccaactgtattctttaaaagaccactgaagatacttcactacttagactctgttaacagtttagagatatttctagtttttaaaagtaaaaatctcatagattgagaatttatgctaatttaaatatgtgaaatacaaaatgtgaccttatacatttagatgggaaagcaagagaagcatgacaccaggagaaaaagcccatgaattaactcagaatcctcaacacacaactgccggatgcatatcactgaattataaaactaaaaacatggtgtttgatgtttaactctagagaatgcatactattacaagttgtccctctcaaagaaatccatactaaatagccagtctctccttacttttaaatgaaaaaactgtttatattatctccatatgaaagaaaatgtaaaatggctttagtttcacacatcaatttatctgagatgtttctgctggactgaacccaagacctctgtaaatattacatgtcatttgccaacaggaaaaactaagatcttgttatagtaaatcacatatactagtgttctcagaaagatgatgtcaacaagcacttttttttaaaaatcacttttttaaaaaacagtttaatcaccctttaactgttatattatgtaaaatagtaaaaaggtcagcaacttaattaaaataaagaccacatatctcctagacaacataccaaaaaaagaaagcctggttttagaaaactacatgattttaaaattaaagttccactaaaatatcacaccaaaggaatgtatttcctcatgttgtaatcacagaaagaacactaaccaaaggctactcatatctattgcacaactgaaaacagccatttagctaacatgcggtaggaatccataaaacccgggaaggtccacctcacagggtgctgggaatctggttaccccacatggcaccaccccacacccttgcccagctatgcaggaagtaaacctagagaaagaccttcagccagagtatttgatacctcaccctcaggactctgaactaaaattcactgctattttccttctatctgtaaaatatgcacgaggtgttacctcaatgctctataagcacagtaaccacacaccagaaaagcccagatccagtcctgggaggcagtagggaggagggcactacctgcagggcactgggtctgcagggctcagcccctggcagtggcctcgcttcctgtttaacattaatatacagagtcaacaaaagcaaaggaacggtgaattttctcaggaaaatttttttttattttgttatcagataatactaaaaaagaaaggtaatccttgggaaaactctatagctatttagaactgactacaaatgttatttgagcctgtattttcttctcaaggctgattaaaaacaaaactgaaatacctacatcactagatattattttaattcttctgttcttttaagaaaaacacatacaaaggaaaaatgaaaaacaatttaaaaaggaagaaatattaaagcaaaaaggagaaataaaactttaaaataaatttaaaatacattaaaattataaaaacaaaaattgaaaaagattaatataaaataaaaagtatatataactttttgatttcgaagaggcagtagagaaaaaaataaaacacatcaccttaaaataactattgcaaaagattgtgaatatacacatttcaggaagtgaaactatcaaagcctctttatgagaaactgtgactttataatttatactctttagtgatgataacaaagaagggcactacctcttctccaattaaggatcacaacacacggtttcgagtttgtgagagcatatacacaggttcccttaacaacctgagtcacaggtctcttttccctgcccagatactatcagtcagccccaaatctgtaaactaatcattaaaaaacaaacttttgacttctgaatgagaacacacagaaaggtacatcctttctcctcttccataggaacctctgacatgagattatcataacagcagcatcccataacctttgggctgtataagtaagccccaaagcccactatactttaccatccttgtaagtctggttatctcaccctttcctcttttaaaggatccagtaaagggagaaaaatgaagatagttcaaactcttttgcatgggataccacaaaagcaaccaaaccacacttcacaggaaatcttatttctcaacctctactagcactagtagcagaactatcaagaacatacacttttttttctacaggcatcatctgccttaattcttgtcactgagtaaatgaagaaatgcaatacccaaacagaactgtggtttataacttggattaaaattaagccaatttctgacaaggagtcccttcacctcctaccctcaaacagcatgttttctgagaaacagctccacctctcaagaaatgactagtgctagctgtggctgtgctgacaatacagattagtttcctctttcaatactgtcatcataagctttaaaaaaaaaaaaacaacccacagctttcaccaaatatatcattattgtaaagacatctccttttggaaagttttccaggtcaaacagaaaggagaatttgtattcattgtaactggttacaattcatcctgaacaggttaaatcacagcaaagatcaagcatccttaacttacaagtcaggcaagaagatgaccaattctaatagtacagcgtgaaccagtgacttttcccctttagattttcccattctcaactaagggtaatcagtacgttttcaaacagtgatgtccaagaactcaaagcattttctagatttgtcaactctcttcaatcctgcaagtaaaatagtcgaacaacaaatattatgcattctctctcataaatcgagcaatgaaccaaaaacaaagctggcactaaacaccaggtcaccatatactcccccatattaatggagaatacaaactttagtacacatagaatattaacatttcaattgtttgctctgcaaagaaaattctacttgatgaaaggtttccaattgaccacaaaaccaaccagaaccactgtctagaaccatttggtgcctacgacatgtcaggtttgtgtgacactcgtcactgggtcacctctctcagtcctcacagccctatgaagtgcatatgaatatggatcacacccatcgcactgtcactcagggaagtcaagtcatcacaagtgtaacacactagagcacaaaaatgaaacctagatttgtgcaatttaagagattacctatttcctgcattctgcattccatgtctccctgatccatccagttggtgcctttaccatcctttccatacatcctaaattcttgctgacatcaccttttcacgttgctctccactcaggtgtgacttccaactcctctctcacataaaccccacttctgtgccgatgcagtccatgacatatcttctctaactagacgctctgatggaatgcctccatgatgaactggtctgttccctgcattgaatactttcagcaatcatacacaatttttagtcaacaaacatattttaacctatagggatctaaaggtaagacattatttgtttgaagcttttaaaaaggaaaaaagaaattatattaagccgtgactctgagtactgatactttattgcataaaatattgtgggaaggagcttgagtagttgctacctgaataggcctagtgagatcagcaggaaggggaaattccagcagagggcacatcataaagaggaatgaaagggaatggtgtagcggcaggactggcagattcagaaaggctggcgagctggctagagagggctccccagacacattaagggcggaccctgaagggcacgtgggccgtgctacaggcacaggctctggacagggccccagtgaagttctttaaaggactggtataaacacatttgattttcatgaaaataactctcagcagcatagaagatggactgaaccaagaagaaggcaacttcatacaccaatacactgaaagcgtaatcaaaaggtgatgaggcctgaatcaagtagtggcggtgggaatgtaaagagtatttccaaggtagcaccatcacagctttgctaataaagtatacattgtttaggaaacatttggtaagttcaaccttttccaaacaatagtttactgtccttgaaatcatcagcgtctttcaacccatcatgatttcaagatcctaaacttgacaggacaatgtcactaattaaattctgattccacaaatctcctaattgaaaaagtcctctttaatctgtccccaagagtctgcaatgaaaagaatacctgagaaatgtctttacaaaataggtaaaattcattagtttggaaaacagacatttttcctctttggtagcttgtataaaataagacatactaatcttcactttaaaataatcagtaagtatctcaccatttttttttttttttgagatggagtttcgctcttgttgcccaggctggagtgcaatggtgcgatctcagttcaccacaacctccacctcctgggttcaagcaattctcctgcctcagcctcctgagtagctgggattacaggcatgtgccaccacgcccagctaattttgtatttttagcagagacggggtttctccatgttggtcaggctggtcttgaactctcgacctcaggtgatccacctgcctcggcctcccaaagtgttgggattacaggagtgagccacggcgctcagcagtattgcaccattttctttgaaactcagactctccgcttctaggagagttagagcctaaacaaattgaaggtggagggacttaggggaaaagatttaactttcatcacatccaaaggcccatgagacaccatgcaaacaatgcggaccaaatatctatattggtgatatagcaataagcataactaagtaaagtatatgagtaataaatgctaagaaaaaagagtaacgggactcacagcgctggggagaggggcaggttgcaattctaaacagggtggtcaggatgggccttgtggctgaccacccaggtgggtcacatgtaagcacagatgtggaaggggtcagtctcacggatattttagttaacagtgttccaagcacagagaacggcgaatgacttaaggtggtacatacctaacatgtctgagggacatgaagaatgtggctggagccacggggacaaagcggagaggagcagtctgcagtttaggttcggagagtcaagaaatcctgtactgattcatttctcctaaatttgactgtcagggaaaaaggactgctacttccattttctcagcgggcctacctagtagagtgtcataacaatttaagtcagcaagtattcaaacattgtttatatgatgaattccagaagattttcacatattcaaattcctacacctgctagaattttgttagaatgacaaatcactatcaacccattctgaaccataagcaggaaatgaaatgacgttaactgactttcttaagcgtaaactaattcggcagaaaggaaaagcgcagaaaccttcaggacttcttagtacaggtacctggaattttgcgacgcagatgaaaaacatgggtgaggggagtttgagggatctaaagatgtggattctgatctctcttttggctctaccaacctacatgattccagacgtagtcatgatttcccagaaaagggtgactactacttgagaaacactatcagcatcccagtcgccgacagtcctatgataaggggcactcaggggtctgttttcttgtctgtcaaaatcagtggctcgaatggaccagtccttcttgattattttcactgacaaaccctccttaataccctaagagggtattaaagtacaaaattccttggtaattcctattttaccttaaacatttaaaggaatttcagaattctacttgatcatgtatctgtattttaatctagaaacaaccacaccctcaccccaatcccgagtacagctgactgtcctggactccagcactcccccactgcacgcttccacagctccctccacccagcgtaagtgctctagggcagaccagcccacccaaggtgctgtggcttttaagaggggcctcttagggcaagattctgatcagctccgctggtggagggcagcaggagcacccaggcacccagtagcagccttcttgccacagttaagctctttgcagccagggacgctgtcagactcaccacagagccccactcctagcaatgcgctgtccagggcctagttccagaaggccatcaaactcagaagcatgaaaagacactgctacaatccacagaccttattttgatttctccagttctacaggcactcatttgtgtgtgctcagttctatgccattttaccacaaacaaattcacatgaccaaaacaacacatacctattccatcagcacaaaggttctgtgtgccccttggcaggcacactcttccccattccacccctaaccaccgatctgctctccctctcgagaattctcatcatttcaagaatgttatataaatggaatcatgtactatgtcatcattggaaactggattgttttcacccagcgtaagtcctctgagagctacccatgttgttacgtcaagtttcttcctttttattgctgagtagtattctgtgttatgaatataccatagttaaccacttacccactgaaggacatgtgggttgtttcgaatctggggctactacagataaagctgctgtgaatattcatgcacacacttttgtgtggacattatgactgcatttctctgggataaatgcccaggagtgcaagtgctgggtcatataagctaagtatacgttcagctttttaagaaactgccaaactattttccagagtggctataccagtttacattcccaccacccatatatgagatccagcttctctgcatttttagggtattgtgatctctttactttagctgttttagtaggcgtctagtgacatcccaccaccatgattttaatttgcattttcctaatggctaatgaagttttttatatgttcataggcttatctgccatctgtgtcatatcttttgcccatttcctaactggggtttttgtttctttttactgttacattttgagagttctatatatagtccagatctaagttctttgtcagatatgtggtttacattttctccaagtctgtactcatctttttgtcctcttaacagggtgttttgaggagcagaagttttttatttcgatttagtataaattattgatattttaaatgaattgtgctctaggtgtcatagctaagaactcttcatctagccttacatcctgaattttctcccattttcttatgaaagcttttacattatgatccatctatgatctatcttcagttaacttttgtgtaaggtgtgagatttcattttaaattgctttgcacctttgtcaaaaaatcagttcaccatatttttacaagtctatttctagattatgttccactgacttatgtatttatccctctgccactaccacactgttttgattactgtggttatgcattaagttttaaaactaggtagagtgattcttctagtttttattttccaagatcattttagccattttattttagttcctttgcctttccacataaaagaataagcttgtttttatctacaaaaaaacttcctgaaattctgacagaaattgtgttagatctttaggaacaatttgacactatgagtcactatagatctatagaacaatttggggaggactgattcactatgctaagtcttccaatccatgaacatggtaggcctttttcatttatttaggtcatcttttgatttcttttatccatgtgtttggtgctttcaacatacagatcctatatgtattttgttagatttattccaacatattccattttcttagagcaactgtaaacaacaatgtgtttttaatcttggtttccacgtgtttgttgttaatatacaggaatacaattggcttctgtatgctgaccttgtatcccacaacctcgtttaactcacttattagttctaggacattgttgggtagattctttgcaatcttctacatgtcatctgctaataaggtcatttttatttcttcccttccaacctgtatgccttttatttccttttcttgacttcatgtactggctaggattcagtacctcaagtttatatgtatttttaatttgtatgtttaaataattttaaaacttacagaaaaattccaagcacaaagaattttcttcccaagtcatgacagcaagttgcaaacatacctgattattccatttttttatcttctacaatgacataatcctacttactcatagtatagccatcgaaattataaaattaacagtgatactttactaacccagacaccattcaagttctaccaactgtcccaataatgtcctttaaacaaaaggatacaatctgttctttcacggtattttttaaccttttgaaactgtaagtcagttgttttatagtgttcctccatttgagttgtcagatatctatttccctatagatgagttcagtttgtatatttttggcatgttcatctcagaaagatgctaagtattcactgcatcttatcgggtggttcaggattctgacatggtatatctcatgactggtcatgaccacatatttaaggctggtgttggccagacttctccagtgtagaggtactattcctcttcttatatttaataagtattttgtaaagggatacttcaagattatgtaaataccttgttcttcaccaaattttcacccaccaactttagtatccatttcaatatttattagttggcaacctatacaaaggtagaactttccctatccctcatttatgtattcatttgtttctttacatcagtatagacacattaattcctattttattcaataggttgtaaccattatttattttcatgctcagattatcccaggtttggccagtggactcagcttggcttctacatccttctgatatgtcttcatcattttttgggcatgtctttatgttctgtcactacaagacattccaggctattcttacactttccctgtcgcagacgtggaaccagccatttctccaaagctctattctcctcctagtggagaataaaatttggtatcaaaagctaagcatgcccaatggctcatcagctatcgctgctctcaagatttcccagtggacagggataagaaatataggtatatacacatacctatgttcatatttatctgtgtatctatactcactgaaaaccatgcattcatacctggatacagcaatgctaacccaatattacaggcttctttttcaaggacattaccacctttactcacatgccttccacatgtgggcccaaccccaagtgctttatagatttaattattcagggacagagaaagagaaacttaatgatatctttaatactctctttactaccctatgacaaaactatgtacaagatttttgtcagtccaaaaaaaaaaaaagtttcatctgttaaggaattcacaatgtaataggacagaaaggtgaatgcgggaaattggtgagaaagagatgaacaggggcaagaaatgaagcatacaagaaatagaccaaagtaatctaatgcaaccctctataattcattcacaaatattctctagaagatctgacagtgagaagatccaccctctgcgtgaatacctccaataacaagtgtactagttcagagggttcgtttgtaggtttaaaacagctcttaagagctaatgctaacctgatattcaccagtgctattattcgctcatgaaccctagttctatattttgggcttaacacaggataaagaactcttttttccatgtaaaagttcaggtatctaaagtcagctatcatgctgctctgtttaggttttctctttccctgtctaatcaatgctagcttcttctctaagagttctagttcttcttccttggaaccactccagtgcatcaatagcccgcaggaataaattattaacatcataaatagctttgatttggctttgattaaaattaaagatttttttttttttttttgagagggagttttttttcgctcttgttgcccaggctggaatgcaatggcgcaatctcggctcactgtcacctccacctcccaggttcaaacaattctcctgcctcagcctcccaagtagctgggattacagatgccagccaccacgcccaactaattttgtatttttagtagagacggggtttcaccatgttgacctcaggtgatccacccacctctgcctcctaaagtgctgggattacaggcataagccactgcactaggccaaaactgaatatttaaaaaaaaaaaaaaaaaattgaagatagaactaaagaccctaacagtgagtgagaaaatcttttagtaaaaaagctgtcaacaacggattttgagaaggtaaagcactacactgacatctggtctttattttcaaactttaatgggataagaaaaaatgttagcaaatatttacataatagttaccataaaatttaacttaaatctatacttattcggattattattatagaactaagtttttatctaaatctgctattactaagaaagatgacaagcactttctggtaagtttaaaggtttctttttaatgatttgaaggtctatcatcttataattctaagactatcaaaatgtttcttaataattctttgacttgtctgcacatttctagaggggttatctacgaagcaattcgtatcatctatagtggtgatggttttaaaatatgtccacaattcactgatacttcctccatcaaactaataagagtattaagtaccctctccttgaacatgcatggccttagtgagttacttctcaaacggaatgttgtggaagttgtatgtgacttctaaggctaggtcacaaaaggcaatgaagcttctgccttgctctctaagaatgctcactcttgaaactcagttgccttgtgataaagtccaggtctcatagagatgccttgtgtaggtgttcctggtgacagcccagttgaggtcacagtcaacaagagtaaagaagttgcttcttcaaggtgactccagccccagcccccatttgaaatgcaattacacaaaagaccttgagcaagaatcacctatgtggggttagtcaacccctagatttgtgaacataataaatgtctcctattgttttaagccactgttttggggtggtttgttatatagcaacagataaaacttttatacttttattcctcttactgaaccttcctgctttggctatgaaagttctatagtggcctcataaacagattaaaagacagttaatttatttctttccaatccttatggcttttatttctcattcttgcttactgtactaactaggacctagagtataaggtcagggagacagaagtataatgttaagtataagtggtaagaatgaacacacttaccttgttcccaatatttttttaaaacaatgctttcatcatgtcatcattatgagtgatgttgttgcagttatctcttagaaatcttagaagttcccttctatttctagcttgctatgtgtcatttttaatcctcagcaaggactttaaataatctttccacacttattgagataatcatatggctctttctcctttgttactgtggtgaattataaaataatctaggccgggtgcagaagctcacgcctgtaatcccagcactttgggaggccgaggcagatggatcacctgaggtcaggagctcgagaccagcctgacaaacatggtgaaaccccatctctactgaaaatacaaaaattagccagacatggcggctaacgcctgtaatacaaactacttgggaggctgaggcaggagaattgcttgaacccgggaggtggaggttgcagtgagccaagatcgtgccaccgcactccagcctaagcaacaagagcgaaaccctgtctcaaaaaataaataaataaaaaataaaaaaggtattctaatgttagctacccttacattcctgaaataaacttaatgtgaacataatgtattatctttttaatacattgctatattcagtttgctaatcctttgttaggatttctacatctatattcacttgcattattatgaaacataccggtaaaaccagctggcccagtgttttctttgtggattttgtttattaatgtctttaagtggactcttcagactctacttctgcttgagtcagttttggtaaattatgtttttctaggaatctgttccattttttctaaaaaatcatatttactgccataaaattgttggcagtattcaattcacgctttctttgtatacctgtatttatgtgcccactctttctcctgatattgtttatatgcaccttctttctttcttgtttgattgatcgtgctcgatcttgacagagttgatcagtcttaccgaggctaacatttagtttagttggtcccttgtgctgtaactgtgatttctatttctgctcctttgttgttgttacttctttctgctttttttttctcattctcttatttttactctaaattaggttagacagcacattaattttaactttcatcttaaaatactgggctaggcacagtggctcatgcctgtaatcctagcactttggaaggccgaggcaggcagatcacttaaggtcaggagtttgagaccagcctggccaacacagtgaaactgtctctactaaaaaacacaaaattagccaggcctggtggcacgtgcctgtactcccagctactcgaggggctgaggcaggagaattgcttgaactcgagaggcagaggctgcagtgagctgagatcacacccctgcactccagcctaggcaacagagcaagactccatctaaaaaataataaataaaatataatataaatatttaagacaatatattttcattgcagtactgttttagctcctttacacaagttttgataagcagtattttatatattgtttatttttaagtttccattataattttgtcttgacccacgatttagaaatgttaaaacttccaaatttatggaaatgtttatctttttattaataacctatattttaattgcattaagataaaaaattatgagctataagataggaattttttttttttgagacagagtttcgctctcgttgcccaggctggagtgcagtggcacaatcttggctcaccgcaacctctgcctcccggattcaagcaattctcctgcctcagcctcctgagtagctgagattacaggcatgcaccactatgcctggctaatctttgtatttttagtagagacgaggtttctccatgttggtcaggctggtctcaaactcccgacctcaggtgatccacccacctaggcctcccaaagtgctgggattacaggcgtgagccacagcgcccagccaggcattcttaaattttaagatttacttgacagcctagtcaatggtccattttttacaaatagaccatgtcagtcctagaaaaatgtgcattttctaattgctggatatagggttctatgtatttttcttcttatattaaggttaataatattatataggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaagaaaaaagaataatattatataaatctatttctttacaaatatcttgtcttattaagaagcccatgaacatggatttgtcaatttctccccaaaattctattcatttttgcttaatacatcttggggctactttattagctgcatacaaatctcagagctgatactgacatctgcattcaaagtagttatgccatttgctaagatcatgcagggagcgtgccgaaagcatagaagttttcccttccttcttccccctctagtaactcatttaaaaagtatgtttatttgagaatctttttgttttgtagagcaacaaaccatggactatgtaacctgacactaccagaatcatgagtctctgtgttaatttcctttaaaatctgactgtttcacatggatgaaccttgaagacagtatgtcaaatgaaataaaccagtcgcagaaagacaaatactgcatgattacacatatatttagtgtctaaagtaatcaaactcatagaaacagaaagcagaatgctggctgccaggggctgggggaagaggaagatagggagtttttcaatggatttagagtttcagttatacaagatggaaaagttccagaaatctattgtacaacaatgtgcatacagttaacaatactgttaatatacacctacaagaaatttatggtatgggtttttaacacacacacacacacacacacacacacacacacacacagattgtttcatggccagtgaaaagacatgacagttgactcaattgctggcactcccttttagaccaaatagtaaactgggatttctacctgtactgcaaataggaagatctcaaaatttggtggtagtctctaatagtataaagacgtttcccaaagtaaccattacaagctactctcttttcaaacaacgaagttcttgtccatctcttctacaatgtctcacagttaactgagacaactgaggcatctctaggttgtagcagattatggacctcttcaaatcctttcaattttcttccttttttgagacaaggtctcacattgctcaggctggagtgcagtggcacaatcacagctcactgtagtctcaaattcctgggctcaagcgatcctccctcctcggcctcccaaagcgttgggactacaatcatgagctgctgcacccagcccaaattcttcctaatttaaaatatcctttttcctttatgtttctcgtattcagaactccaaatgtagtttccatatgtcagtctgaggagtggtgccatagtgagtgtaaaagaatcatgttaagattgtttaaaaataaacatttccagaccggctgaatccaaatctagaaaagaaagatctgggactctgaatttttaaaaaattctttttccattcccctttatttacctagttcaggctaccattctttttcttaaaagccatccctgcctccttgggcagagcctcttctcagctccatcaatgcactgtcatatcttacaatatctgtaacatgcttatgtgttaatctcctcaagtataccataaattattcgatacatagcatagtatcaaacatgtagctggttttcaacaaatgttttctgaaccaaatcagcaactgtcaagtactatgtatagaaatgcatttaaaaaattttttagagacagtcttgctctgtcacccaagctggagtgcactggtgccattgcaactcactgcagctttgaattagtggtctcaagtgatcctcctgccccagcctcccaaatagctgggactacaggcatgcatcaccacgtcccagctaattaaaaaaaagttctgtgtagagatgttgcccaggctggtctcaaactcctggccttaagcaatcctcctacctcagctttccaaagtgttgggattataagcatgagccacagcacccagccagaaacacatttttaaattacataatgactatcagttggaaaaggtacagcaacaccatcccagcttttaaaaaatacacattcctgagcccctctggacttagtgaacgagaaccaccacctccactggatgagaataccactcacgggaaagaggttgttgagctggtatttgcagaaggagaactttgattgagatgggtcagagagaggaggggaagaatatttcaaaaagggaatgacatatttgaagccactgaggtattaaaaaccagtcacgctagaagaactccaagtgattcagttttactgaaatgaataatttctaggaaaatgggtagaaaagatttagagaggtgtgtaaaggggtcaatctccaaaaagcccagtatgataatgctaaagaagtttaactttttcataaaaattgtgcagcactattagagaggagagtggaaaacacacttgcattatacaaagattactccagataccatgaaaatggactgaagtgggaacagaagggaaacaaggagatgggtttggaggctactgtaatgacgaggaaaagcgtagtagggcctgaaccaagccaatgtgaacagagaagaaaacagatttgaaatacattacggaggctgagcacggtgcctcacacctgtaatcccaacacatcaggaggtcgaggcaggtggactacatgagtccaggagtttgagaccagcctgggcaacatgacgaaaccccatctctacaaaaaatctaaaaaactagctcagcatggtggcatgcacctgtagtcccagctactcaggaggctgaggtgggaggatcacctgagcctgggaggcggaggttgcagtgagccgagacggtgccactgcactccagcctgagtgacagagccagaccctgtcttgaaaaaaaaaaaaaaagaaaaaagaaaaagaaataggaatacatcatggaaatggaaattagtattagtgacgtgggaaatgaatgagggaagaatctgtttctggcttcagaaaatgtgtaaataacggcaccacttataaacatggggaaaaggagaaaaggcaggtgtggggctaaggccagtgaagtgtgtcagggaggaacactcactcagtgtatactgagtctgaggtggctacaggacacccagacagagatgatgacttggatacacagacctgtagacagaaaagtccacgactgcagatgagatttggggttataagcagagatggaaactaggcccacagcagatgagatcattcatccaagtgttacagtgagaaggagagagaaacagactcctgaagaaataaaggcaaagtgaggaggagacaccctgaaaataggggaggggccaaagaggaaaatcagaaaaattacggggttaggaaaaaaggcacggtcggctgggcacagtggctcacacttgtaatcctagtactttgagaggccgaggtgggccaatcacttgagatcaggagttcgagaccagcccagccaacatggtgaaaccctgtttctactaaaattacaaaaattagccaggcgtcatggctcgtgcctgtaatcccagctactcgggaggctgaagcaggagaataatgtcaaaagtcacagagaaggaaaccagtggaaagtctctcattgcatttgacaactacagctacagtgcttttagaataagtttcagtggggaggctggagaagaagcatgggctgaagtgtgcatggtggggagggtggagagacaaatggcacattgattcttttaagcctgtgtacaggtaagaaatgtccatccatgtaggtaagaaaggaagtgggggctggggtaggatataagggttgagacaaaagagagcgaaccatatttatacaaaagagaagaagttatgagatagaaagaggctgaaaacacacaaaaagcagtgatgatgaagagcagggcccatgaggaggatggggacgaaggattcggctaggacagagggaggggaggcttctctcctgggactttagggaaggataggggcaaaagaaagtgagtttccaggtgatagaacatgaagctaaggtggtgtttcctgatttttacaatttttatctgtagaattgaaagcaggacgatatcctgagcatggtgaggagctctgagagataatttactcggtgcagagctggaacacggtggcagtggggcagacgagggcatgaggacagcaaggcaaccccaagcccacctaacactggagtccacccaaggcacacgctcatttgcccaaagtgcagagaggatgaatgactgatttttcctaagttggagcttcacaaaatggtggaattaaaaaatccagagttattttttaaatataaaaacaacaagaaagttattaatagttaggttagaggacaaagtaatatgcttcactacattttttaatcgaaatttcaattcaatacatttccaacttcacaatacatgaaaaagtcaactaaagatcctgctgaagtcaaagagcaggtacagtgggagtaagcaagtgaaagctggaatgacagaaagtagccctcaaggcagcagagtttcagatttcagaggtgaagatgactaaaggtcaatgtcagcggagctgaacaggtctaggaactctagcgcaatgagccgtagttctttcccagagacatgaagtcacccaggatgaggaaggtgggaaggagagggtaaggagaaagacagtgaatgactgaagtcaggagaggagaggtgccaaggcggtgtggggatgtgctggccagcacaagccttggaagagatcatttccatttgcaggctgaagcatattggctcagactagaaaatcctgtggctacgtgagaagcaagaatgagcagtctctttctgagagatcaggagaacatggcttactagggaggcatgtgtggggagggagggggcaaagaagaagaagagtaaggagaacatgcactgggggctgctcccagcagagcacagctccagaggacaaccactgcatggtccgcaggagggaagcttggttctctcaaggctaagtgcttttcaatgagaaggcatacaggaagagcctggtcccaatgatgatggagggaggcctgataacgcatattttaaagagtctccctgcagccttcaactgcaggtatacaacataagtctaaaagctgaggagaaaaatcataagttttattgatgtatatacttgaggataacttaagttgcaaatgtttttactttaaaataaaacatctcaattccagttaaaataaaattatcagctgggcatggtggctcatgactgtaatcccagcactttgggagactgaagcaggcggatcacttgaggtaaggagttcaagaccagcctggccaacatggtgcaactccatctctactaaaaatacaaaaataagccgggcatggtggtgcacacctgtaatcccagctacttgggaggctgaggcaggagaatcgcttgaatccaggaggcaggggtttgcagtaagccaagatcacgccactgcactccagcctgggtaacagagtgagacaccatctcaaaaaaaaaaaaaaaaaaatcccatttagatcaattcgataaaactaattaggggactcaaatgtagtgtagtgcatccaataattgcaattacaacaaatatataaaaattaaaggcaacaccaggttagggaaggaggatccaagcaaggagactgtggccccagaaaggcagtgcaagtgaccctgtgatgggaatgctccactggtttgcatctagactgtggtggtgattccaggaatctacacgtgataaaactgcacagaacttacacgcacacacaaatgagtgcatgtaaaactggtgaaacctggatggactgtattgtttcaggttcccaggtgtgatattggactgtagttatgcaagatgttaccactgggggaaactaggtgaggggtatactcgatctttctgtattatttctcaactgcatccaaatctacaattttcaaaatcaaaagtttttaaaaaattaaaggcatcaaagcaaggtgtacaactggaaaatactgtcttcaaaactcatggtaacattagagaattattctctgtagctcagtgattctcaatcagagatttggaggcaggggaagggcacctaagtatcagaattactgcccacacccgctattccctgaacgcacacccacactggaactgccaccgtgatgagccacctgtttcagaggaagtgggtcaaatcttcaagtgtgctgcaactgaagaaaatggaaaaccactcttctagctacttgtctttaagaacacttctaactggtagtaaagaaaaaagcattaagagaaacatagtatttaatagtaatttataacaaacatgaaagattttcagagactgcttctcatttgatttgcccaaaatcagccaatacacccttcttggaaatgtatttggtcaacataagaaaaacattctattcatgtaagaataaaaataaggatttttttccagtaactgatggatttttcagtggtacatccagaccctaaatatcttatctataaccaatgactacaatgtatataaaggtatacagtctgtgtccttgaacagtgaaatggttcaacctacacaggagatcttagcaggcagcaccataccctagtcaacaggcgaacaatcagtaacaagcaaaaaccagaatgtgatcaatctgatactgtttttcaagtccctaccaacagggagccctaaagagaaaacctatgtttagcccactaaagtcaaacatagggaaatatgctgaagcacgaaggaggcccaatttaatatctgaataagctgcatgaatcagaacaaaaaataaaatcaccgcatgatgatgaatacaccaaagaactctagtattataattgttcacacaattgtgtgcgtctgtgtgtgtatacatcataatctaaatgtccaacaacagggaacttatgcaaaagagtggtatatccaaagccactgtcaaagcaattaaaaattgtttataataaaaaaaagtttacaatgtactgctaagaaaagagctacaaatgagtatgtggcaagattctaattttccgtttaaagtacatgtttatttttaaaaactccaaagaatataaacccaagttattatttatttttaaataagtttgttccttatactcttctctgttttctaagttttctacagcgagtacatactactcttataacttggggaaggaaaaaaaccaaactacaccaataactattttaagcaaaacttacaaaggggatggaatgatatgaaaaggaaatacatatggatattatatagacatctataattacaattattttaaagaaaggaaaactgtgcataagaaaaacaggttgtgggaaatacaccaaaataatggtgcctatgtttgaaggatgaaataattatgggtaattatttttccttccactattctacacctttaaattcttaaagaacgtgtcttacgtaaataggaaaaaaattactgtatttatcaacactgaccccaagccctccttttcactacatcctgcctcctaaaacaaaccaaaaaatacacatgcacacaaacccacaagtacttacatgggcttacatctctgtatctgtttcgatttctgttttctggaaacttggccactctatgaggatagtcatgggactcatttcgaatttccttaaaataacaaaaatatattttaatatccctcttaaattctccacagcaaaacttatcttcccagccagcgtaaaataacatgaagcacttatgatatgccaagtactatggaaagcacattgtttacatcaattaatcatttaatcctcacaatactaatggaaacgattttcttccccattatatctgtgagggatgaaaggctttcaaaggttaaaaatccaccaaagatcccatagctagtaagtggcagtcccagcattgaaccaaggtccttcagatgccaaagtctgtgctctagatctgtttacttactgctaattaggctctattcaacacctacaagcaagcatcaaacactttatgaagcagaattaatgcaatggaggtatctatggtcagccacatcatattcaaattctgactaaaactcacagcatctacctaaattttggagtttctacctgaaaatatttatttcttcatgttcacgctatttaactgttactttattttgaacccagaaatatcctcaaattttatttctatcatgtttgtcattacttctccttaaaaaaaaaattatttctagagccataaatgttcagcaacaagcctggcgcagtggctaacgcctgtaatcccaacactttgggaggccgaggcaggcggattccctgaggtcaggagtttgagacgagcctggccaacattgtgaaaacccagctctattaaaaatacaaaaatttggccaggtgtggtggctcacacctgtaataccagcgctttgggaggccgaggcggggaatcacctgaggtcaggagtttgagaccaacctggccaacaaagcgaaaccccgtctctactaaatatacaaaaaatcagctaggcgtggtgatgggtgcctgtaatcccagctactcgggaggctgaggcagaagaattgcttgaacccgggaggtggaggttacagtgagccaagatcgtgccattgcactccagtctgggcgacagagtgagactctataaaaaaaaaccccaaaaaaatacaaaaattaggctgtgcgcggtggctcatgcctgtaatcccagcactttgggaggccgaggtgggtggatcacgaggtcaggagttcaagaccagcctggccaggatggtgaaacctcgtctctactgaaactacaaaaattagccaggcgcgatggcaggcacctgtaatcccagctactcgggaggctgaggcaggagaatcgcttgaaaccgggtggctgaggttgcagtgagccgaggtcgtaccactgtactctagcctgggtgacagagtgaggcggaaaaagcaaaacaaaacaaaaattagccaagcctggtgacgagcgcctgtaatcccagctactcaggaggctgaggcatgagaatcgcttaaacccaggaggcggaggctgcagtgagctgagattgcgccactgcaacaaccagcaggcctgaggctcatcctaggcgccttcgggttctctgcatttcaacatagaagacattctgtaaggctatgtccgcactaagctctcactactgatgtatccagaatggccaggtttgatctcccaggaaacagtgttctaagaattcaagtaaatacagaaatgtaacagaaaccaaaaaaaaagcattttaataggaaaaattaaattatgcttttgctcacattattacatgtaagaaaaagcattttaaaagttaggtgccattttgtttatttgtttttatagacatagggtctcactttttgcccaggctgttctcgaacacctgggctcaagtcatctacctgcctcagcctcccaaagtgctaggattacaggtttgagccaacaccatcagccgagtatctgaagtttttatttatgaaacatgatgcacaaatttctaatatgaaacttctccatttttctggaagtgaatggactggtaagtacttttgcaagatataagacactgttattagcctgcacgtggaagagaaatttaattttatcccttccaaatggaaagttaattgacttaataccatttattggtttctgcatttatcagtaacacctgctctatcataaaccaagtttcagcacacgcaggagtctgtttctagatcctcattctacttcacagaagcatttgcttgcccttgagacagtatcaaattttagttactacagctttgtaatcaatgcatctggaaggcaagttgtcccctatttattctccccatttgcattgccgttcatgatattttaattaattttgtagttttcttcataaaggtatgctaaaggttagcataaatgtataataaaggtttattcttagatacctgataagttttgtcgctactgtaaatgggattaaaacaacaacaacaacaaaaacctattgaccattactagtgtataggaaagatatagatttgcagggaggggaggcttaaaacaacaggcagagcaggactccctccacttcttccacttctgtgatacacacacacccattttccacacttaaggccatctgtcaggtgcagatttctatttttagcccagagaaacacacttctttgtgtgcactatacaaaagagggtaaggcccccagtatagtagtagggagatttaaaatttacaaaacacaatacaacagccaagttcttggggttaagaaatacattcataacataaatacattttctcagctaataagatctcttgcattgagtccattctttcaaatctccaatattgttctactttataaaaaaaatttcagtgaacttacaagaaccaatatttcaaaaagcagctcccaaaggtgcatattagcgtttattccaatatcctctttctctttctttttttttttttgttttttgaggcagagtcttactctgttgcccaggctggagtgcagtggtgcaatctcagctcactgcaacctccacctcccgggttcaagagattctcctgtctcagcctcttgagtagctgggattacaggcatgcgccaccatgcctggctaatttttgtatttctagtagggacggagtttcactatgttggccaggctggtcttgaattcctgaccttaagtgatccgcccgcctcagcctcccaaagtgctggaattacaggcgtgagccactgcacccagccccaatatcctttctttcttactaaaggtaactgcttttgttttcagaccacaatgagcccagctgaaaactatttgtcccagcctctaaggtcctgtgacagtctggccaatgggaataagcagaaaccactgggttggggctgcaggaaaacgctgacaaagaggactggctccaggtacctttgtcctcactgctgcctgcctggaacataggttttgctgccgggggtgaggggtgggaacaggcaggagccatcctgtgacagcaaggtaaaatgcacattcctaagaaaggtaagcagaaataccagcattgagtcatgggtgacatcaagaagccacagtaacagcccttaagtctctctccagaattcatatcacatgagaaacataaactcctggttgttaaatcagctattgattaattttctttcccatgtagctaaatcaggtctgtaatatacgcagcaaaaccaaatctcaacagcaactagatctgacactgatgaggcattttcaggaatacccaagacacaaaaataaacaattttataagcacattgcataagcaataaaatatacagtatctgtctaaatggcattaggaaagcagacagctgagctattcactaggtctatcacataaggcaaagccagctctacttgtgttctggagctaaaaccttccccttctatcacagattccgaatgtttcctctgggcacagtggctcacacctgcaatcctggtgctttgggaggcccagctggaaggatcacttgagggtaggagtttgagaccagcctgggcaacacagtaagacaccagctctgccaaaaaatttttttaattagctggggatggtggtgtgcatgtgtagttccagcttcttgggaggcagagacaggaggattgcttgaactcaggagttcaagactgcagtgagctagcatcctgctactgcactctagcctgggcaacagagtaaggccctgttaaaaaaaaaaaagtttcccatcagcagtgaaacctgttaatccaaggtttctcagcctcagcactactgacattttaggctagctaattttttttgggggggggggggcaagtggggactgtcttgtgtattgcaggatgtttagcagcagcatccctggcctctacccattagatgtcagtggcacccctccctgcatctgtaacaaccaaaactctctccaggcattgccaaatgtccttccacagcaaaatccatcatgaacatatcccccaccaacacagtagagaaccaccgttctcatttaataccaaactagatctaaatggcaaggatctttgctttaaagtataatttaaccaaaaattttaaatctaattatttttaatatgatttttgctcaaaaaaagcaaggaataattgagtcactagttaatttctttcttagtggcaatgatccaaaatgtaggcaactcatagcacaaagatatctttcacagttacttataatgttgaaaggctttaaataaactaaatgtctaatgacaaagaaaagactggttgaataaatcgtggtacatccaagtgaatatcatgcagctcttttaaaaacaggccctcataccaaattggcagtagcataaactcacaatctcttggaaagataatatatgacataaacaaaggaaaaacaaatcagtaaatggaactgagctattattaatacacgctatttggtaaaaaaaaaaaaaaaaaattccacttagctccttagctgtatttgaaacttaaacacacatgtgcattgcctacattaagaccacacaccacctttttccaaagtagtctaatttttggaacattatgaaatggtccattctgatcaatggccttatagcttatctccatgcccaaagattttaaattgtaaacatacctactttccttttttttttttgagacagagtcttgctctgttgccaggctagggtgcagtggtgcaatctcggctcactgcaacctcagcctccagggttaaatcgattctcctgcctcagcctcccgagtagctgggaccacaaatgcccgccaccacgcccggctaatttttttttgtatttttagtagagacggggtttcaccgtgttagccaggatggtctcgatctcctgacctcgtgatctgcccgcctcagcctcccaaagtgctgggattacaggcataagccaccgcgcctggcctgaacatacctactttcaatgtgtttactttctcctattatttcacctcctaatattttcacataataacatttaatccctcttgaaatttgctttgagatatatatgcatggcttaaaataaggaactaaattgattctactatagaaataattttgctgggttcaaataatgctgggttgaaatgtaagagtaagattttttatattcatctagctactcttcatttcataagcagtaactgtgcctaaatggtactgtttaaatacagggactctcaaaagtctcaggacttctgcttaagaaattccaaaagtatacttcacataaagtcatcattatactttgtttttcattgcaacaagcctttcaagagaatcacagaattcagaaggatatctttaagcagacattcatagaatcctcaaactaacttggtgttataggatggtcttgaaagaaactgaggccaggcgctgtgagtcatgcctgcaatcccaatactttgggaggctgaggtgggagaatcacttgagaccagtctgggcaacacagacagacccccatctctattaaaaaattttaaaattagcaaggcatggtggtacacatctgtggtcccagctacttgggaggcagaagtgggaggatcacttgagctcaggaggtcaaagctgcagtaagccgtgatcacgccactgcatgccagcctggacaacagagcaagactctgtctttattaaaaaaaaaaaaaaaagagagaggcggggcacagtggctcatgcctgtaatcctagcactttggaaggctgaggtgggtggatcgcctgaggtcaagagtttgagaccagcctggtcaacacggtgaaaccctgctgaggtgggcagattgcctgagctcaggagtttgagaccagcctgggcaacatggtgaaaccctgtctctactaaaataaaaagagtgagctgggcaaaaagagtgagctgggcgtcatggcatgtgtctgtagtcccagctactcggaaggctgaggaacgagaattgcttgaacccaggaggcggaggttgcagtgagccgagataacgccactgcactccagccccaccccactcccaaaaaaaaaaccaaaaaacaaaaaactaaaggttaaaatgatgtagccactttagaaaaacaaatgctgaacaaagagttaacatatgaactagctattctactccaaggcacatacccaagagaaacgaatacatacattcacacaaaaacttggacacatatgttcatggtagcacttttaataatagctaaaacaatcatttgtccatcaactggtgaatggataaacaaaatggtatatatctatataatggaatcttactaacttagaagaagaaacaaagtaatgatacatacaacacagatgaaactttaaaacattatgctaagttaaagaaaccagccgggcgcggtggctcacgcctgtaaccctagcactttgggaggccgaggcaggtggatcacgaggtcaggagatcgagaccatcctggctaacacagtgaaaccccatctctactaaaaatacaaaaaattagccgggtgtggtggcgggcgcctgtagtcccagctactggggaggctgaggcaggagaatggcgtgaacccaggaggcggggcttgcagtgagccaagattgcaccactgcactccagcctaggcgacagagccagactcctctcaaaaacaaaacaaaacaaaacaaaacaaaacaaaacaaaacaaaaaaacagatacaaaagactacacatggtatgagaccaggacagggaaatctggagacagaaagtagattagtggttgtcaggggttgggatgtgggtgagaatggagaataactgtatgtacccagtctctccttggggtgttgaaaatattctgaaattaagatttagttccacagctgtgaatatactaaaaaccactaaactgtaccttttaggtgaattttatggtatgtgaaatatatctcggccgggcgtggtggctcatgcctgtaatcccagcactttgggaggccgaggcaaatcacgaggtcaggagatcgagaccatcctggctaacatggtgaaactccatctctactaaaaaatacaaaaaattagctggccatggtggtgggcacctgtagtcccagctactcgggacactgaggcaggagaattgcttgaacccagaaggcggtggttgcagtgagccgagatcgcgccactcactgcattccagcctgggtgacagagcaagattgtctccaaaaaacaaaaaacaaacaaacaaaaaaaaaaaacaaaaacactctgggccaaggcaggaggatcatttgaggccaggagttcaagaccagcctgggcaacatggtgaaaccacgtatctacaaaaaataaaaataaaaataaacacataataaataaaaataaagccaagcgtagtgatgcgtgcctgcagtcccagctacttgggaggcaaagctgggaggatcacttgagcccaggaggtcaaggctgcagtgagcagtgactgtaccactgcactccagcctgggtgacaaagtgagaacctgtctcaataaataaataaataaataaataaatgaaataaaaatggaactcctgtattaagggcatattttgccaatatttctcaagaaagactgaaagtgaggttttgcctcacactcaacagtatcagtacttttttttttgtcctcagatgttgtcaagatttttctgtattgcttactctttcagatgtacctcaaatttaaactttcttttggctgacttcaaaaaaaatacattatagatatgtgccaagtcttcatcggaactgggttagcttctccatttgagtcttccttgtcgcttaatagagtttcgcttcagtctcctctgttccctttcaggaatttctatcacagacttggggaagtgctctctcctaacgctcatttcgcacacctctttcctgagttctgagagatttttctcaagccacctcagtgttctgcattatctactctgctacttggtactgaacattctattttaacaattgtgtgttataactttaaaaactctttactgttctcagtttcttttcttttctccacctgctcttgtatttggacacctgaattacagctgcctctacctcatactattttgcatgccctcaatgatcttggggtgaatttttcgtttgtctaacaacatatgtttggtcatctttacagaaagtgaatacacacatcagttcttaacccacacctgtgtggccgcttacactgttcactatcaactccttaagtctcaaatatgtgggaaagacccttctctagtgtgaagtaatcacaaaggcttgttcttaccactgcgctttggtcacttcaatgataaatcagaaaacaacaacaaaagcttccagtgcatgggattacaagaccttaatagtcctgggaaattacacttatttgtcatagttgttgttttttgttttttgtttttttttgagattgagtctcactctgtctggactgactggagagactggagtgaagtggcgccatctcagctcactgtaacctccgcctcccgggttcaagtgaattctcctgcctcagcctcccaagtgactgggataacaggtgcacatcaccatgcctggctaatttttgtattttttagtagagacagggtctcaccatgttagccaggcttgtcttgaactactgacctcaggtgatccgcccgccttggcctcccaaagtgctgggattacaggcgtgagccatcaccttcatttgtcatagttttctactgcctttcttgctgtcaatttttacctctatttacacaattatgcctaacaactctttctttttaaaaacttcaaacttcaggccgggcgtggtggctcacgtttgtaattccagcactttgggaggctgaggcgggcggatcacgagttcagggagattgagaccaggtgatctgcccgcttcagcctccccaagtgctgggattacaggcgtgagctaccacacccagctcctgatttgttttaacaagtgaagctataaaacaaaggctcatattctgaattttaaagttttaaggctgggtgcggtggctcacgcctgtaatcccaacactttgcggggcccaggcaggcggatcacttgacattaggagtttgagaccagccttgccaacatggcaaaaccctgtctctactaaaagtacaaaaactagctgggcatagtggcacgtacctgtaatcccagctactcgggaggctgaggcaggagaatcgcttgaactccggaggcagaggttacggtgagccgagaacacaccactacaccccagcctgggaaaaagagagacgccgtctcaaaaaaataaacaagtaaaattttaattttattttacttatatttttgagacaaagtcttgccttgtcactcaggctggaatgcagtggtgtgatcacagctcactgcagctttgacttcaggggctcaagtgatccccccacctcagcctcccaagtaggtgggactgcaggcacaccaccatgcctggctaattttttatttttatttgctatgttgcttagactggtctcaaactcctggtctcaagcaatctgcctgcctcggccttccaaagcgctggtatcacaggcgtgagccatggcgcctggttttgaagtttttattttaaaaatctatattactgcaacttaatttccatcattatcggggtgaaatagttataatattttattaaataatgtcaaataatatttttagtatttcgtacatagctttgttctatgtatggcatacagaaaacattacatcgttagaccaaattctccctcgaactgctacgatgtagtagcaaataagaacttaggaaattgaaaaagaataatcttctgttaaattttaattttataaggtaggaccttaagataatcccaaattgataatgagtttctccttatgggctaacatacctaagtttctttctttatactttaggtctctaagtgaatcctaaattatatgatgaaaagtgttccctttgttagtcagatgtttgtgcatatactctctacaaagatgctcagaaaaggacacagtgaagtatgaagaatcttgcatactttgaaacaccattactttaggatggtaaaataaccacttacttatagcccttaatatgcctgccactggctggggagagaagatccctggtggagtaagttcttttcttcactacatttttttttctttgagaagctctctttgaggaagagagtttagagactaaaacagctcactgtcactgaaccctactgtgtgtcaggcatgtgctatgtgcttttatgtgtgttatctaagaggtggttacaaatgagaaaacagactcaacttccaagatttatactgcagttaggtagcagatacagataggaatccagtacttaactttagcatatatatatatatgtatatatatacatatacatatatatgtgtatatatacatatatatgtgtatatatatgtatatatatacatatatatgtgtatatatatgtgtatatatacatatatatacgtatatatgtatatatacacgtatatatatgtatatatatacgtatatatatatgtgtatatatatatatatatatatagagagagagagagagagagagagagagagagagagaaaagcgtgttgttttttttttttttttgagacagagtttcactctgttgcccaggctggagtgcagtggcgcgatcttggcttactgcaagctccacctcccaggtttacaccattctcctgcctcagcctcccgagcagctgggactacaggcgcccgcaaccacgcccggctactttttttgtgtttttagtagagacggggtttcaccgtgttagccaggatggtctcgatctcctgacctcatgatccgcccacctcggcctcccaaagtgctgagattacaggagtgagccaccgcgcccggcagcacatacatatttttttacttatatttacatatatttatatacatatgctccctatgtatacatggattacatggacttggcaaaaattaaaccgtacaaaagggtatatagtgaaaaagttaagtcacattctcctctccctcaatcctttcccttaggtgataactgtaaccagtgccttgtatattttccgagacattctatccatatataagccagactgcctgtctgtcttcctccatccaagtatccatcccaccctcacaaaacagatattagcatactgttttgcactttgatttttcacttagtatatattaaaagtacttccatatagataatgagttctttttaacaatttaatagtattcatcacttagccagtcatctataatgggacacataggttatttctaggttttagctgttataaataatgctgctatgaataacctttcaaagaagctatatcaatgtatactgtcaccaataatataagaaagtgcctgagcttcacctacacaattatattaatgaactttttcatctttgtctgataggtgaaaaatggtattattatagtcataatttgaaattgttattattgtgaaggtgaacagctttacctgtttttaaaagccatctgtatttccgctctctttttgatatgtagttctttacatattaagaaagtttagtttttgttatatattgaaaatatttaaaattttttatcttttgacctttatggtatttatgtcaaaaatttaaatttttatgaaatcaaacttaaaccttttttctctaggtttctgtgacatggcattaaaaaatcctttttcactctgttgattacaaaaaattttctccattgttttcttatataattttatggtttcatttcttttatgtttagattattgcccaaccgggactttactgtagtataaagaatgaggcagggcaggcatgttggctcacatgtataatcccagctctctgagaggtgggctgatcacttgaagtcaggagttcaagaccagcctggccaacatggggaaaccctgtctctactaaaaatacaacaattagctgggcgtggtggtgcacgcctgtaatcccagctactgaggaggctgaggcaggagaatcgcttgaactcagcatgcagaggttgcagtaagccgagatcgtgccgtagcattccagcctggggccacagagcaagactctgtctcaaaaaaaaaacaaaaaaacaaaaaaacaaaaacaaataaaaaacccacaaaaaacatagaacagaagcagttcccactgttacgaagttactccaactttctagggctaccctgattgatgtaccaggtcctttactgggactagaggggtacaaactctaggaatcctgtagccttacctcaaaccacaggaagaattcctagaagtactatgaagtaaactgtaatgagaaattgatagctttcagactataaaaccgttcaaatatagtgaaagaagaaataaaataattcagtatcagattttccttaggggaatgaaagcagtttgaaaaaaggttataaatgatcagtgacacgaaccaaatgaaactgacagagcaaacggcatattaaatcagacatactggatttgaaaagttattcattgcattcccttcctccattcctctcgtttgaaaagtatccaaccttgagccagtttctttgttttgagacaaacagtgctgggattacaggtgtaagccaccagcccggcccctgaaatcagtttcttgaccacaatttcttatcctagggatcaccaggtgggcctatgaacctactaaaaccacatgctaagtttgcgggggattgtatttgtgcggacatttcctctcataaacatgtttcatcttaaaggtgtctaaaggtatctatgatctttaaaagcaaggatttcactgttaagtcaaaacaacttcttgaaccattagtagtactgtaccgtacatagaacattaaatcggcacaacatttaaatacatttaaaatggcattacattcattcttaaaagctatttcagataatggcactgcagggcaatgctattccaattaagaatgtaacaggctggacgcggtggctcacgcctgtaatcccagcaatttgggaggccaaggtgggtggatcacctgaggtcaggagttcaagactggcccagccaacacagcgaaaccccatctctactaaaaatacaaaaattagctgggtgtggtggcgcatgcctgtagtccctgctacttgggaggctgaggcaggagaatcacttgaaccagggaggtggaggttgcagtgagccaagatcgtgccactgcactccagcctggttgacagagtaagactccgtctcaagaaaaaaaaaaaaaagcctctccctctccctctgcctcctctccctctccccacggtctccgtctccccacggtctccctctccctctctttccacagtctccctctgatgccgagccgaagctggactgtactgctgccatctcggctcactgcaacctccctgcctgattctcctgcctcagcctgcagagtgcctgcgagtgcaggtgcgcgccgccatgcctgactggttttcgtatttttttgggggagacggggtttcgctgtgttggccgggctggcctccagctcctaaccgcgagtgatccgccagcctcggcctccggaggtgccgggattgcagacggtgtctggttcactcagtgctcaatggtgcccaggctggagtgcagtggcgtgatctcggctcgctacaacctccacctcccagccgcctgccttggcctcccaaagtgcccagagtgcagcctctgcctggccgccaccccgtctaggaagtgaggagcgtctctgcctggccacccatcgtctgggatgttaggagcccctctgcctggctgcccagtctggaaagtgatgagcatctctgcccggccgccatcccatctaggaagtgaggagcgtctctgcccggctgcccatcgtctgagatgtggggagtgcctttgccccgccgccccgtctgggatgtgaggagcgcctctgcccggtcgcgaccccgtctgggaggtgaggagcgtctctgcccagccgccccatctgagaagggaggagaccctccacctggcaaccgccccgtctgagaagtgaggagaccctccgcccggcagccgccccgtctgagaagtgaggagcccctccgcccggcagccaccctgtctgggaagtgaggagcgtctccacctggcagccgccccgtccaggagggaggtgggggtcagcccccgccaggcgagccgccccatctgggagggaggttggggggtcagccccccgcccggccagccgccccgtccgggagggaggtggggggttcagccccccgcccggccagccgccccgtccgggagggaggtgggggggtcagccccccgcttggccagccgccccgtctgggaggtgaggggcgcctctgcccggccgcccctactgggaagtgaggagccccttccgggagggaggtggggggatcagcccccgcccggcctgccgcctcgtccgggaggtgaggggcgcctctgcccggccgcccctactgggaagtgaggagcccctctgcccggccagccgccccgtccgggaggaaggtgggggggggtcagctccccgcccggccagccgccccgtccgggagggaggtggggggttcagccccccgcccggccagccgccccgtccgggagggaggtgggggggtcagccccccgcccggccagccgccccgtccgggagggaggtgggggggtcaacccctcgcccggccagccgccccacccgggaggtgaggggcgcctctgcccggccgcccctactgggaagtgaggagcccctctgcccggccaccaccctgtctgggaggtgtgcccaacagctcattgagaacaggccatgatgacaatggtggttttgtggaatagaaagcagggaaaggtggggaaaagattgagaaatcggatggttgccgtgtctgtgtggaaagaagtagacatgggagacttttcattttgttctgtactaagaaaaattcttctgccttgggatcctgttgatctgtgaccttaccccccaaccctgtgctctctgaaacatgtgctgtgtccactcagggttaaatggattaagggcagtgcaagatgtgctttgttaaacagatgcttgaaggcagcatgctcgttaacagtcatcaccactccctaatctcaagtacccagggacacaaacactgcggaaggcctcagggtcctctgcctaggaaaaccagagacctttgttcacttgtttatctgctgaccttcccttcactattgtcctatgaccctgccaaatccctctctgtgagaaacacccaagaatgatcaataaaaataaaaattaaaaaaaaaaaaagcatagaacagaaaagtttagttttcttctactcaggaaagtgagagcttatattctttaaagttagcctgtggaaatgtatctcttcctcagttatcagctgctatgtcttaaattttacatgctaaactgattgaggatttagtatatggctaatcactcttatccaaagtaagggtggtattattaaaagttcagtttattagttggtttaaatatcctctgactctcaacagctttccattaagaaaaaactaccttaatggggcattaagttaaggaatagagagtagagaatctagatgaggatttccaagggaaacaaatcatacgtaacgtttattcaagaaagtgaagagcacactatgttaattttaatttcgcgtacccagaccttatctgtccatctctctggtttatctggactatttggagaccaaagggaagaaggggagtagagagtggacaggtaagaggacaaagacaaggtagctaaaagaacagcaggggactgagagagctgtaacagttctccaactgggaatcagaaattctctgcagagtaactatctggaaaaagtaaaaagggcttttaagattctggttggccaagcactgtggctccccagcattatggaagggtgaagccggaagatcgctttagcccgggagttcgagaccagtctggacaacatggtgagaacctgtctctacaaaacataaaaaattagccaagcatggtggcgtgcatctgtgcagtgagccgtgatctcatcactgcactccagtctgggtgacagagtgagaccctgtctcaaaaaacaaaacaaaacaaaattctggttaagggctgggcatggtggctcatgcctgtaatctcgccacttcgggaagccaaggtgagcagaccacttgaggccgggagttcaagaccagaccagcctggccaacaagaacaacaacaaaaagaagaagaagaagaagaaatttgtcaggcgtggtggtgtgtgcctgtagtcccagcttctcgggaggctgaggcaaaggaccacttgagccaggagttttgagtctgcagtgacctacgatcgtgccactgcactccagcctgggtgacggaatgagaccccttctcaagaaaaaaagaagattctggttaaaatcaagaaatcaaaaaagaggcaactagaaaagctaggagacaaacgcaactatctggatttccgtaattatagatatcagtaatctataaacacatgtcaaaggcaaaacaatatgatttctaggtatacattccccattggggcacccatcccaaggctgctttcccttcaagcagtggtctttaccttttgagggatcacagacaaatccactaagaaactgacaaaagctacagaatcacctagaaacgaaatacctgggaacacacgtacataaaatttagcagtttcaggagatttgcaaatacctttcaagtctgatccctggatcccagacactgttttaaaggcctcaagtcccaaaatgaccctacctattataacacatccactccctcctagccatcaaaattaagacgattccctctgtgccactgatctcaaatagatcataagaagaaagcactacaggtagtcacatgggtaaattagggcagtgctgaaacgagaatcagaaggactggatttgagtcccagttatgacactagcagatattgtaacatcagataagtcacaacactgtattggcccagtgtttcctcagccataaatgaggggtttggaataaactaaggtgctgacattttaaaagggaacagttttcctgtgtttactgaatatttactgagcatctaacatgtttcaggtcccgtaggtaggtggtgggaaaacaaagaaaaaaaaagaccaccctcaaggagctacacagaacagacaagtagacagttacaaaacaatgtggttcatattctaataaaagaatatagagaactaagaaatgagagaagggggagcatttaactttgcccaaggagactacggtctagtcttgaagatgtttcccaaatagatatggtaggcatggagtatatccaacacatgaagactccaaggtgtgagagagtagccaatcttcaagggaattcagagtttgtgcaaccatgtaaaagcactgagattagacagcaggcaggagaatgtgtaactagtaggcaagggaagtgttttagaataagacagctttgattcacctgcctaactggctgccccgctgtaagtatgagaagaacagtgtgcacttgatatctgacttctaaaaattagctgactcacaaatggtaaaaattgttctctagcaatatttgaactacaaatttctaataaagaaaaatggcggccaggcgcagtggctcatgcctataatcccagcactttgggaggccgaggcaggtggatcacaaagtcaggagatcaagaccatcctggctaacacggtcaaaccccgtctctactaaaaatacaaaaaattagcctggcgtggtggcgggcgcctgtagtgttggcgggcgcctgtagtcccagctactcagaaggctgaggcaggagaatggcgtgaacctgggaggcagagcttgcagcgagccgagatgacgccactgcactccagcctgggcaacagagcaagactgtctcaaaaaaagaaaaagaaaaaagaaaaatggccaggcacagtggctcatgcttgtaatcctaagcctttggaaggctgaggtggacagattgcttgaactcaggagttgaagaccagcctgggcaaaatagttaaaccctgtctctacaaaaaatacaaaaaaattagccaggcccagctacgtgggggactgaggcaggaggatgtctaaagcccaagaggtcgagactgcagtgagctgagatcacgccactgcactccagactgggtgacaaagtgagacccagtctcaaaaagaaaagaaagaaaaagaaaaaaaaagaaagaaaaaggaaaaaaagaaagaaaaagaaaaatgtggctgggcgtggtggctcacacctgtaatcccagcagcactttgggaggccgaggcaggtggatcacctgaggtcaggagttcaagaccagcctgacaaacatggtgaaaccccgtttctactaaaaatacaaaaattagctgggcgtgctggtgggcacctgtaatcccagctactcgggaggctgaggcagtagaactgcttgaacctggggggagcagaggttgcagtgagctgagatcacactactgcactccagcctgggggacagagcaagacttggtttcaaaaaaagaaaaatgaagtcagtcaggagttccattgtttataaaccctaattaatcaaccaatttccaagaggctgaggtgagaggctcacctgagcccaggagtttaaggttgcagtgagctatgattgcaccactgcacttgtactccagactgggcaacagagtgagaactctttaaaaaagaaaggaatttaaaaataaataagccaaattccttctgagccatcacttcttagaaacaacccataacatagcttttgcgattccccagttttagtcttttcctcagtaggcacacagactccattccttctctctgcctttctcaaagctcagcctgatgaagacagcaatcagcagtgacaaaaggaaaagccaaaaagggatcatgaacattactcaaaaagtcagaattaacctcacacaatcagaccaaattaaacttttccaactgcaccctttgttttgctgttcttgttttagagacaggatctcactctgtcacctagtctgtagtgcagtggcacaattatggctcactgcagccctaacctcctgacctcaagtgatcctcccacctcagcctcccaaagcgctgggattacagggatgagccaccgcctggccagcactctttcacgatcaattcttccacctgtgtgctcttggtcccattgactcttgctttctaagatttctggctccaacaatcatcccttctatttcaacctccacctctctctttaggttcatccctgcaatcacataaatatatcaagttgccctttcctcgtaaaaagtcattcattcagcacatattttcaagtgcttactaagcacctgatactgtgcaaagcactggcagtgccttcatgaaactctgaagaagtaataaaaaatataaactcagattaacagagtctgttctgctccaacccaataattcatttctaagaaacctcctattatcaaactcatgaaataaaagacacttttcaaaaggagcaaaaaggaataagggaccagagttccagactcaaaatactaaattcatttttcccgctagaatttcaacaaggtatcaagttctcctaccactaagcaagtccagcttttagttgtactcagtttttgctcaagagcaaagcctttcttttcccagctccatgagcattaccaaaaaaagcacaactcttcaaaaacattatcagaaacatcacccactgctgtgctaaacaaagcagaaagccaccttaaacacttttttcctactcaagctgtgttactttcaagatagtggtttgcttaatgcaaattgtgttcccgaaatcatttgctgctgtatgacatccaattcccgctatgaaaggggaagtcttgggatgctaaagaagtacgcaacaggggctcatacccagcatgggcaggtcaagaaggcctgccaaggaagtgagacttcagggatgagtaggaggcagtttaagcaagaaaggaaagagaaggggggaaagttgtgccaaggcaaagagaacaacatttacaaacgccctaaggggagaatggacacacacacttccaagaatacaacacagtggaaaagagggaggaaagtgataggggaaatcaagcaagagacacaggccatgaggtcttgtgagccggaggaggggctgaatttacactgtgagcaacggaaagccgttcaagggtttaagtgagaagtcacacaatcttgcttcattttagctacctctccccacttcttcaagttgggcttctaaaaagagcagtgtacacttggtagtttgcatttcctcctaccttctctcctgaactccaggtatctgtcttgtgtagtccgctgacacaactccctttaaggtatctgttaatctagctgctcaatgtcatggccctctcaggctggcccttacctgtcaggtggccctgctcaccctcaactccctccactgctttcctccccacttctgtggttgttcctcaccagtcttttttgcaagttcctctttctccacccatccttttaaatgttgtctgtcaagattctgtccttggcctttgatatttccaaacgctctgtatcttccctagatgatctcatcaatgtctaagacctcaaatatcacccatgtgttcatgatttccaaaatcacatttactcagaccctctctcccgaactccaaatttatacattcaactagcttcatttcagtgtctcgcaggtacctcaaacagaattaaagtttcaaaaccaaacttgtacataacgtatacccctttaccatttcatttcaaatctgtatctcccctccatccctcctgccactgcctaacagaagctcatcatgtctcttcaggtttactccaaccgactactgccctgtgctgcgtgcctacactttcctcatccagtctgctagcagtcagaacgatcttgctaacaagtaaatatgatcagcccagagcagtggctcatgcctgtaatcccagcactttgagaggccgaggcaggcggatcacctgaggtcaggagttcgagaccagcctggccaacatgtcgaaaccctgtctctactaaaagtacaaaaaaatcaaccgggcatggtggtgtgtgcctgtaatttcaactacgcaggaggctgaggtaagtgaatcacttgaacccaggaggcagaggttgcagtgagctgacgtcgcaccactgcactccagcctgggcgacagagcgggactctgtcaaaaaaaaaagaagcaaatatgatcatggtatttccagacttacaattccacaatgagttcctattaaacagctcaaattccttagtctgatctaggctctgccttactctccagcatctcaacttcacaccagtctccaggctaaactgtgggtggttctctcagcattccctcagtgcctttgtgcactccctccttgctggaacagtaattctcttcacctcccttgtcctcttcccctggccaatgtctttcaagacttaggtgaggtcctccctccctcgagaagcttcaccagaactcccatgtgtacccctttttgggaaatacaggactcctaggtaactcaactccacaagaccctgtgcttcaagctagctttacatgtatcactttaacgttttcatcagcttacctatttacagggctgcatccttaaaaactgggactcctgtcttttaacaagaatcctcagtgtctaacactagcacataacaagcatgttatgaacgaatgaatgaaaatatggaactacaatgaggccccaaaagaataagccctagagtgagcacctcgagggtaggaaacttgccaggagcattctctgctgaatccccaaggccaggagcaaaagctgcaactccactgggggtccgggcatatttgtggaatggctgaatggatgttctaaggccacaggagaacacatagctcaaacttcctgacttgctttccattactaactttcttggtttgtgacctacttttactgtaacaccagtgtgcatgccatggtttctactgaccaaactaatggtcttgttttcaactaggaaaaaataatatgagcattgaccaaccaaggaaactacaggattcctcggtaagaatctatagaaggatttccttatctttttgaaaatgcatgtgaaatctccagtggatgcgagttaagttcatttttctggaaagaggaatcacaattctcattgaattttcaaggatattaatgataccaaagaaaattaaatttcttaaaccaaaatgttaagctgaattaagttatattcacttttctcttttcaaatctatttcgatatataacctatcccttagagagacagcagcctctgctaaaacaaatgtaactggagaagatgcagctggcaggctctctcacatgaagattcctaccagaatttgcgtttcagattgtctataattggaagagtccttaccagcattctttaaaacttagatccctattctaacatactctgtatcatgggaatcagaatatttatacttcccactaatgtgttcaagaagaaaacgttactttctgaacacatttttcactgccatctaattaaatggaaaggggaaaaacccaggatcatccatttacaggaaagcccgtcttttactttacacagagagaaccaaacatcagaagcagcattaacttaaccgtcaccaaattcaatcttgggaataatacgacaaggattaaacgaaggggaaagcagttacatcattttaaaagagataaagttttgtttgaattaaaaggtagtctagttgacataaaaaaagcgaatcacaggtgtttatactacatattgcatctatgtgagctgaacaggcacgattagggcgataggcatcggaacaccgtgcccccggggaggggatgagggcactttctcagggcaaggaaaggctattttgatttgagggggcttgcaagaggggattcatttgtgacacccgtctgggagcacacatgaaagctgcgtttcactgtagggaaagtatacctcagtaaggaaaactataaagagaatgacacgctatcactggacgaacacaagcaaagcctctttcgttccgggaaggttctatgggggccgaacccacgctgggcgctgctgggccacgggggaaaatgaagacggagggtcccgagagcgctgccctcgccagaggccacgagccacccccaaccaccgcggctccgccaggagagcgagcttcgcctcgcagagggctgcggcggccggcccggcgcccagagcggcctgctcccacaggtcctgcgcgggcgccagctggacccggacgccgcggcccggctcgcccgcccccgccctcaccgctcccggggacgccagctgcccacccggccacaaaacacccggccagagaaagagctgtccgcgagcaagaaccaagcacagcggcgtgggagctacggcgaagctgcggcccgggggcgcgcgcccgagcgcccccacggctttcccaaggacccccagacccgggccgcgcaacgctggtggcgcatccacgcgctccccaagaagccgctgtggcaccgccctccagaactaactgcgcttgcgctaaccatgagctgctcagctcaagtatgctttttttttttttttttttaaaccaaaaggagcaagagagcggtcagcgcaggcgcgcccctgacgcggaccgcgccgccacttccgccccgagcgagaggctagaggcgagaggcgggggaggcgggagggaccctgcggacagggcacgagtccgggtctcggaggaggtcggcgactgccgcgtgggtccgcgactcaccaagtacagcggctgccagcgacgctgagtatccaactcttcgaactcccgctcgatggtggtgggcatggctgcgggagcgagctggcgcgagcagagcctgcgccggcggagaggctcaggccccgcacgatccggggagagcgctggcgctgcggcgcatgcgcgctgcgcgccgcgccccgcccccacgccaagccctgtcggccgtggggaaagtacctggagcgtcggacgtcagcgcgcagactcggcgcccgagc

SEQ ID NO: 391 - DNA, 77959 bp, Homo sapiens
acatgagaggaagaggtctttataaataactcctggtttaaatggagctgaaaataggaagacaaaagaggaagccaattgctaagcacttattgagtcaataacattggcttggaagccatagtgcaagtggctggtttggtttatttccttctcatcaaaagagctaacgcaggattgaacctgggggcaccaagaccgcatgtgtgtccgaggatgtgtctgaaaggatgtggtgcttctcagatgatgatgtctcgactaagacataacccaggccttgggttagatctctcggtgtcacagaagaacctgtcgggtggtgtggcttggctgttaagtccctggacctcttgagatcactttcttcactggaaggtctagtcactgggttggcttctaagctctgagatttagatagcaattcatagctaagtcttcgatataaaacacaggaaccaaaagtgtgaataaaatcttgactgtgctcaagtgtcctgtgaagtgtcctgtctccactctcaattccattctctgtagggtcttccttcagctgcaacaagggcctgcagtttgtgctctctctcggatgacaaaattgggtggaaatgtgctttattcacttgccgtccccagggcccctgatcttggggtgtggcccagcagcatgctagccagggcaggtggacgcactgggcggatgcaccggtgggggccaggccaggaggctcagcacagagctgactctgccccggttcctaaccctgcctccctaccccaggatccaagtacagagctgaacaatggagggagagacagcctgaacgccaggaccccacgctgcccggttcggggctcccagttccaccaggagggacagcaggagagggggcgccgcttgccgggcagcctggctggcagccatcagcagcagctgcaggtgcccgtgtgcacgcggaggatgcctcggctgtgcaagtgcaggaagttgaagatctcagagggcatggcgtggaagccgggacgcggcttgacgttgtcatagtagtggtgagtgatgtagaggcccgaggggttcatggggaaggcccagaagccaaagaggtgcacctcctcacagagctccagcgccgcagtgaccagaatgaggccggtgctgatgcgcttggcgcgcacccccaggctgagccagtagcgcgacacgttgaccaggtactgcggatggaagtagtagacagcttgcggcgattcgaagtcgtccagcacgtacttgacgcggatggacacgtcggtgttgcgcgtgttgtagaaggcaggcagcagcaccgacgcgttctcgtacacctgcagcacgcgatagaacggccgccgccacttctccagcttgtggaacctacacagggcgcgagtgagaggtgagcacccactcctccgtgccctcaggcccctcgcttccccacccttgcaccctggggctttgcaaaggacggaagggactcataaggccacctgcctcctgacacctcacgcacctgtgcagatgaaggtgagaactctctcaggggcagttgagttttttaagtgggtgcaggagagggcagttgggatccaaagggacagatatccagggtgtggctgcagggggcagggcaatgctgaatccaaaaggatgagggtggcccaagggaggctcagaagggaagtggctgcgggagtggaggcttgctctagaggcctcacgccattcacctgtactgtcatccccaagctccccagggacaaaccccaaatgcagctgcctgtcttggctcagacgcttcctctcctgcagcctccgtttctctctcacacactagtgtgttgttatttttagagacacggtcttgctctgtcatccaggctggagtgcagtggtgcaatcatagctctgtgcagccttgaaatcctgggctcaagcaatccccccaccttagccttctgagtagctgagactacaggtgtgcaccacaacacttgcctattttttttttttaattttttgtagagaccagggactagctatgttgcctaatttggtctcgaactcctggccgcaagccacactctggcctcagcctcccaaagtgctgtggttataggcatgagccaccacacctggccccatttctttacattaagcagcgttccctcttgggccctctctgactttgctgtctcttcccgccccttaaatagctgctccctgggcatctgatccaattcaatgaccccctcctctcatctcccactgtcccctcctcttacatgtcctctgacctggttggtgtggctacgcccggggctagggtttcaacacttcccctaaaaccttccagatgaaccccaggaggggagccaggaggggagctgagatctcagtgtgagcttctccccagtacctcctggacacagccaggtagggagctgcctgccctggtcacaccctggaaagctgacccacccatctctaggtgaaggtagtgtagaccagcaccgtccaaaagaactaatgcaggccacatatggaatttaacaatgtccgagtaagcacatatgaaaaaatggaaatgggtgaagtttttatattttctttaacccactatttcgaaaatactattacttcaacgtgtaattaatataacaagttaattagatatgttatcctgtttttgtattaagtctttgaaacccagtgtgtgttttacactcacagccagcacacctccagactaacaacacttccagtgcccagtagccgcatgtgactattggctaccattttggacagtgcagctctagaaagagggccactgacctctctgtgatgatgctggggttcacagtgaccacatccgtcttcacccccacatccatggtgtacttctctgagatggggggcaggttgcacctgcagaagagaaaaggcagcccaaggtggttggtcattcaataggtcaggctggggagggtgcagggggaggggagggatggtgatcatgtgggcagagggatgcaaaggcaaccagctaggcaggttctctgtagccaggtgataagacagtggtccttctgctccttatcaggcactaggacagccaacaggccttgctgaagttccagacacatggggcagagaaatcactggttgtaaaatgcagttacaagcttgggtagtccctggacctttggaggatgggattatggctcttagaggacaggtggctggggagcatctcctttcctagggagccaagacttccctgaggaagcaatgcttgagcagaggtctgaaggaggaattgagcaaatgtcctgtggcaggagaagagctacataaacatgcgatatgttcgaagatgcatcttagaaatgcaacacatattgcatgcaaaagcaagttgccaccatttgtagaaagccccatagtaggaagagtaatagcccccaaaggtgtccatgtcctaatccctggaacctgtgactatgcagccttacgtggcagaagggactctgcagctgcaatgaagtttaggatcttgagatggagccattgccctgagttatctgggggagtccagtgtcatcacaagggtctttataagagacgatgtgacaaccagggagagagaagaaagtatgtggcaacagaattggagtcagagaaagagactgaaagatactccactgtgggctttgccatgagccaaggaatgcaaggagcttctaggaaatgaaaaaggaaacaaattctccctgagagcctccagaaaggaatgcagttctgcagacatcttgattttagtccagtgagacttctgacctccaagactgtaagataataaaatctgtgttgtttaaaccactaatttggtggtatttttttatagcagcaataggaaacgaatacggccctaaacaagcatagtttaacaatacattgttcaggggtacatctacatatgacaaaacaatttttaacaatgagagaatgattaagtactcaattcaaggtagcgataccttcagggggaaacggaggtagaatgggaaggagcacaccagttgatacaaaggcaccatacaaacattcaacttcttaaatcaagtggttggtctacaaatattcattttattgttttgcttcatacttatgtggtacaaatattcttcacatcaaatactacataatgaatgaataataaattttgaaataagcaggtgttagctggttgaatgtggaactcatgagcattccagacacaggtcctgtgcaaaggtcctgtggtagatgagaacaggaagcacccaggagtgactgtggcccggtgactggagcacaggcaaggtgggagtggtacaagctgagggcagagagggaagaaggggccagactataagggacggtgggccatgtgaagaatgcggtctttcgtcaaggggaagccatgggtttaaggaataattgtgcagaagaaccctattctataacaggaccaggactgtcacctactttatgatccaaccatacccctctctatcagaccactatgaaaggcaggttttatattgtccttaaagattgagtgcgggagggggtggggtgtgtgcagtcaattaccatttttttgagcatctgtggcatgccaggaactttcataggattatatgagacatcaataaccttgggtggcagatattaggctcactgtgttgcaaatgagaaaccaggcattcagagggtcaagggacttgctgctattaggtggtcaaggcagggtggaggacgggcctgtctgactccaagcctaggtctcgttcctagtgcaatagcatctaggacatgcctagaacaggacggagtctcagggcatcttggcgtgcacatacaggcacccagcaaggctttgctgctgctgtactgctatgatgatgatgacgatgaggatggaagggcccacagcatctccaaaagtagcacaaacaactgtgtgctctcacagatcttaacagatcttaggtggtgggacaagagaccagcccctccgagggagacatttactatcatattatcgagctagagaaatgacatggtatcacagaaagaatgcaagaccagaagtgtatcccatttctgactatgaatagccccatgaccctagcaaggaatatcatcccctcccaaaaaattgttttttatctgtaaaatgagaggaatattttaaaataacattttccttataataaaacttagtatgtgtcctgcagtgtttgaagattttaaacatattaattcatttattcctcatactgaccccaaggggtagttactattatcatcctcatctttcattttaggagataaaggcagagtggctaggtaacttacgcaaagtaacacagctttttctaactcaaaccaggctccccagcttcagagcctgtggacagaaccactatacgctccacttcttagccctgaaaatcacacaagtccattctttcattcacgccttcattccttcatttaagactaatttttctgagtagttatgttgtgccaattacatcagttactgtaaacagaagttctctttgtgtttccagcctgcaagagcgagaccactcagcgggtccctggttatagggttaggttgttaaaggcctcatgataggtggacaccaggttccgtgggagcccagaaaagggtgcaagtgggtttagccagggaaggagtgggtgattcttgagctaagcttggaaggacaagcggcagttggcaacgcaggatgtaggggctggggagacagcattccaggcagagggaacaggacctggaagcgcagttgccggcactaactgggctctaatggtgtgtccagtgctggaggtactaagagctatacaatcattatgtgatttaatcctataactgatggagctgctatccttatccccattttgcagatgaggaaaccaaggcccagaagggggacatgacattcctgaggtcatgtgcctagcaatgctggagcctggatcaaagttcagggagaccccagagacctgggcttctccccaaaagaccatcttgaaagaggctttccttgcctttcctggcaggaatgtggctgggctaaggagtcagtgagggccagagatttcggtgttggaggaagcttaaccttcaattctggactcgactaggcgtccacagggagcacatgggcagactccagatcacagagagaggtgtgtctctcacactccgcctgtgacagcaggtgacgcagggtgtccaaggcttccttcttctagagacaggggctggggttggacagccaagaacccgaaatatgcaggagtccctttatttaaggacctcaaatcacaccaaacctgctctaccctccctaacctgacaccaactgagtggcccgatgattgtggatccatgcttcatgcgaccccactgcagactcaacccaagtctctttgctttaagcttttattttcaacccaccttcttcaccccagctaaagatataaatgaagatccacaaagagataagaggggggctttacggaaggaagaagtgcaaggaccagtctctggcttagttaaagccagggtgaagccaatattggtgtctgccacaaggcttccctggttccaaccactgcttctggaagggcagcacccacccaaggagacggtgcccagaggacctcccgacacagctgcaagctcctaagtcctcagtgccttcaaatctgtgatgtcctttgctcttaacacatctcccattgtgcagatgtggaaactgaggacctaggagttcaacgacttccccaaagggatggggctggagagaagaagggatatcccagacctgagggtctgcaggggtgggaagtggggattacttgcttaaagggtagcattagggaaccgggggaagaatatggaggagagggccatggggtagtggcaagggcagtgccagggtttcttttaccggaagacgaagtcggcgctgttgatctccctcccgcagcggctgttcttcaagatgcctccgttgcccactacagcacacttcttaaactgggaccggtagtagggcatgtcctgggggaggcacaggcacagctgtcagagccaagccaccccctgcctcgacctgctactctcacctctgcaagcacacccacctatattagctcctggtcccaagaggcagccttgtggggaatgtgggaggaaagcggctttccactttacagatgggaagagtggttgagagtcttgttactattagatggcaccaaaggccactcccatccctgaagcccagggcctgctgggcagctttcctcctggcacacagcggctggcagacctgcatgaaatgggccaggcctgcagcctgggcttccggtgggaccagcagcctggtggggtctcatggagagccatgctgccctggggccatcaggaatcaggctaaatttaagggggacttctgcgggagactgtccttatttgtggtccattttccctggatggacaggcccagtgagccaaggcggggaaaacaggggcctctcacagccagtaggtgagtaaactgcactattagacttgtaccagagaaaggcaaaaaaaaaaaaaaaaatagtcattttcagaaaaatcatcaaaagtttattatgttccatatggctgtttcctaaacttctgtaagttaagaattacctgggatactttctgaaaatataaatttctgggctccatcccagcaccacagaatcagagtctcacagataggaggctgggaagctgaattttttacaaagagatacttacatttagggaagttcaggaaatgtgattctatgtcacattgctttaattcagggacaagcgaactacatacagcccgtgggccacatctggcctaccgtctgtttttgtgtaacttgcaagccaggaatggattttatatttttaaatggttggaaacaacccaaagaagaaactattttgtgatacatgaaaactatgtaaaattccaattttggcatctaataagattgaaagtgttactggaacatagccactctcattggtttactcatgtctgtagctgcttttgtgctagaatgatagaggtgagtagtagtgacagagagactatgaactgcaaatcctaaaacagttaccgcctggcactttctggagaatgtctggtgagccctgctgtctgtctctggccttcagcggtccataggctgcttctccttggatctgtatgtcatactaagttgtgttacacccactggcattacctgcgtgagatgcaaatccacctgctgtcaccagcctcatgttccaggccttgtaagacccacctcataaaggtggctcagcaccatcctcccttagggccacagtgattgagaacacatttgacgccgctcacctgcagctcctcccccacatccccagaatgcatgagtcttacctatacactttggtaccagtcacagaatgcagggaactctgggctttgtttcgcactcagccaagaagcaaggcagccaaggccttcagatttcttccaaaaagacctctacatgcccccactcagaatttctataaactacattcactgaatgctgtcctgggcccagagctctcctgaatgtggttatgaacacacccatgcaaccttcctcctcttcagagtccatacgccaccacacctgggtaattgccagaactggctgaaagcgcaggttccagcgccccttctctgagagtagtgcggtgagtctgcaccaaccgtcagcccaggtgattgcaggtgctcagcatcagtgatctgaacagttcacgtctgcagctcactcactgcggtcctcaatggccaaggtcagtgatctgaaccattcaggtctgcggctcattcattttgtggtcctccatgaccagggagccaccgtgccagccctgcacagcctacctccagaattcttttatgtgaaaggaaaaaaataaatatctatcttgattaagactctgatattttagaagttctgttataatcagccaaatctattcatagtccaagccccagtgttacaaataaggagattgaggctttgaaagacaaaatatctgcccacggtcatcaagtgagctgaatctttcagagtctagatctgcactgggttgttctttcttgtgctcacaacttctgcatgtgcgtttgctcttgtgcctacctcaggagggggacgaatgtgttgtcattctctccctatctgcaggatatcctctgcaagcaatgcaatacccagaattttctagtcactttctcgccaaaagtcactcaaatcatagacagttggcagtcatggttctcagacagaacccccaaagaaatccagagggtgggcttctgcacctcagacaactggtcaaccaggaccaagacaactgagtccagaggaccgtgagtgagtcaggcaaaaccccagggacattgccacggagggctactgctggattggctccctcgccccacccagaccgcccccgcccaaagcagcaccttgggaaacatgcggaagatctcctggttgatgtggtagatgccactggtgtccacctcatacttgagctttgtccccaggggagtgttcttctgggtggtgaagagaaaggcaggggcgttgcagcacctggacagagtagacctgccaggcagggagacaggcaggaaagacgtgatgcaggaaagatgtgatggagggcagagcacaacctcacggagaacagaggggtggagccgaggcctctcctgctcacctatcccacgcttgcccccaccctgcatggagccgaggcctctcctgcccacccatcccacacacatccccaccctgcatggagccgaggcctctcctgcccactcattcccaggcttgcccccaacctacacctctgctcatgcagtcccctcccttttcaacgcctctcccaaggcccctgccttctgccactcattcagggcccaggccaggcttctttccatgaagccccacccagctgcccctgtctgcactgtatggaactcctcgacggagcctgagtcctggccactaatagagggtaaggaggagctttccaaagagctcccagccaggcctggcatggaaacttgggctgccgtcctggtgtcaagaggcctggattcttgcttctgctctgccccgaccagttgtgaggctactggaaggtctctctctttctctctgggccctagtttcctcatacaggcttggctcttctacctctaatcctctgtaatttgtgattccagcttgcaaaagccaggaatgttttatgatttttttttttttttttttgagacagggtctcactctgtcacccaggttggagttcaatggtgcgatctcggctcactgcaatcttcgcctcctgggttcaagtgattcttctgccacagcctcccaagtagctgggattacaggcaagcaccaccatgcctggctaattttttttttttttttttttagtagagtcaaggtttctccatgttggccaggctggtctcgaactcctaacctcaggtgatccacctgcttcagcctctcagactcccaaagtgctgggattacaggtgtgagtcaccatgcctggcctataatgtttttttttttaatttcatctcttgcaggtacttcactgggaagcctagctggctcccagtcacagagagcagaatttcctgtggagagctgggtttcagaatgtaacagaagcttcccagagaggagaccagaggcctggcaaggcagggccatggattggcattacaaactggcatctgggccttttagctttgctagttcagaagctcagtcttgtcagcccactggagatcactcctattgagggatactgactcacactaaccaagctcataagtgactgatatacaaaccagaatgtcagtgtgcctatttgtaggcagcagggtgggagaaggcctgttacaggattcatttcctgtaattcgaaagctcatgcctgccttctagcacccacctgacactccctcatggcaccaggttcctgccagcctgaatgaagcatctcatcattgttccatgagcttgaaatgagagcaaagggaggcaatgaccagcctggaaggttttctcacttagagcatggcaaggcctgatgtcactgccttttctcacacctgaaactgctccacacccctcatgcccagagctccacccctgcactgtgctgtcttgtccctgccaaaggctcccacactcatccctgtttttctcttgccacatcatttccctattgcttcatgtttcctgagatatgtgagtcctgctgctgagacttttttttttttttttttgagatggagtctcgctctgtcgcccaggctggagtgcattggcatgatctccactcactgcaacctccacctcccgggttcaagcaattctcctgcctcagcctcccaagtagctaggattacaggtgtgcaccaccacacctggctaatttctttgcatttttagtagagacagggtttcaccatgttggccaggctgatcttgaactcctgacctcaggtgattcacccgccttggcctcccaaagtgctgggattatagacgtgagccaccatgcctggtccactgctgagacttctattctgccctaagtctggacaacaggcttttgcctctcactgacctggtccaggctgagtgttttatcagccatactctcagtgtgtcaggtctcactcgcccccaggggcacctctgtgcagtgtgcacagtaacatttctaaggggccaattggcagcacagattatggttctattctctactctcccagcactttgctcaagctcatgttctgtttcttatgataggtgagtctctgcaaactactgtcaggcctttgcttggtttctgtagtctcccagaggcctctggcacctgatcttcaagtgttatcactttaaacattcgcatttctaaaaatgtgcctcttaaaactactactctacctctagacttggtctggagctgcagcaaattggaacaaatgatttataaagaaaaagcttagtcatctttgcttttcacaatcttgtgcaggactccttcatgcttagagctcctcagtacatttaaacttggacctgagtgctgaaatccagtatagacacaaattgccagattacatcaactccataaaataaggtctacctgcactaaaataatcccataagcttacagaactttagagatggagaagaccctaaagttcaccatccatcaaaaagaatttttggacatctgttatttgcagagttcccacaggacaactttaagatccagctcttacctctctggaagtttataatctgctcattttggttagagagcatttataaaataatctgcagcagggctcaaatgtctcgtggaggctggaagaactcaaatgctctgagaaggagagaagctactgggtcagagccgctgccccaggacaggggaggtgaggaccaggaggctatagaggatgcgtaatgcaccttcacacaggcctgctggagaccgcccacacatgcttccctgctaatagcttcagtgaacctcagctgtgtactggagatggcaccaccaacctcacaaggctgctgcaaggactaagggagagaaggtggaggatagcacctgggcaaggtgcctgcctcagcctgcatgttgaatcagatctcccccactgcccggattcctaagcccagtcagggtctgctctggggaagatgcacgctgagagctgggccttgcaggacaatggagaccagaagaggtggcagtgaggagaatcatacaaggagaagggaggacagacgaatcatagatacttgaactggttggcctcagagatgttcatcgcccatttgcacatctggaggctcttccacctgtcgaacagctctgactgcttcacccttgggagtagaggacagaagagtacatgagcagggtaggcgggacagagcgcgatcattcccagaaatgctccctcctgatctcccataggccaagtccagtcctggggctggcccttggcattgaccatgttttcttctctttctttgtttcttttttttttttaagacagggcctcacaccgatgtacaggctggagtgcaatggtgtgatctcagctcactgcaacctccgcctctggggttcaagtgattctcgtgcctcagcctaccgagtagctgggcctacaggtgcaccaccatgcctagctaatttttgtactttttggtagcgatggggtttcactatgttggccaggctggtttcgagctcctgacctcaagggatccttccgcttcggtctcccaaagtgctgggattacaggtgtgagccaccgtgcccacctggtattttcttattttctatattcctgatgctctggcacctggtgccttgctaattcctagttagcaaacaactgtcctgcaagtgtgcctttcatgtgcaaaccaaccaatcagagcccacaccctcaaccacctcctcactgacaggccaccatcccctccccaccccccaccctaatcatcccagggccaggtatcggacaaacagaggcagtccctatgcctcagagcctgccagaattattcaaactagccaatcctaaacctggctaccctgccgaccctgccttatccattccctcccctgaaaacctcaatagtctcacccacactttcccctcactgctgcctcctgaccggccctggggctgccctgcagggcatgcctcctgtttctagggatctgtgagtataacgtcttacttcatgatggtcattttcatgtctgcgtgtcctactgtacctgattaaaacaaatcccagaaacactttgaaaccttctccctcacgtgcccaccccccagggcctgcatagttctcttgggaacatctgtctataaagagagtcagaccccagtggaacacccatcaaacacccacacagttcagcacacagtagggctcatgagcagggcatgcccttctctttctcccttctcaagggtggatcacagtttccaaatgacagaaaggatgagatgagaaacctgagactgccccttctccctgaaaaaccctcggccagcctctatgctagttggcatttaaacatctcagcatcatgacattctaaagcactctcaggaaagggaacgtctaaaccacacagcattctccctttgaccgaaacctgcaaaaagaactcatttttaatttacacatttacatcgacttatttataattatgcatacatataatcatttcagtgctgtatccccagcttctagaacagtgcttagcaaaatatagatacttgataaatatttattgagtgaatgactgagccaaatcaaaaatacaaattcccacaaacactaactgaccaatatgagatcctcatgtacattaacctcaaatagtcgctcacccttcttatcagtttctcccctctttcagcagtgcctaagctcagagccaagtccacattcccaagctctctctgtcacagatccgctttagcatctccattacctatccctatctttagttactccttccgcatttcagttaagaaattgttccttgcatcctaaccaattccttcctgctttcacttacacttggttttgcgggtgattctcctattctacagaaatgtccagaattctctaggatcccagctgttgaaggttccactgaggccctggcctggtgagagtcatgagatccagaaagatccaggaagctcctcaagccaggccagcacccactccttcttaaggaagggagcacaagacacattatacaattgggcgagcccttcctgatgaactccagatctttggcaaagaattatgcatctttttttttgtttgttttttaaggtggatcctatggtcaaatatagttggggaaagctgagctaaataaagttaaatgcttttctttactgcaagacttctcagatcccttaatatgtctcatatattgtgaatttccaagaaaattattggatcgtctttttccattgagtagttcgaaaaattgtaattctacagtaaaactgcgaaatgcagacagatcatacactccttaaaggcagcaccatgatttctctctcttgatcatgcacagtccccactttagggccaggcattctgtagctgtttggggtcacctggctgtggcccactaagaagctcattagtcttgggtgctggtgcagacaggagcccttgaaaggaagctgtcctgtttgatcataaatgggaaagtgaccagccttcaggagctgagtgttaccaagaaactactatcactgtggctcttaccctggggtccactgaagggctaaaggaagtgcctgtaccccccgattttgttataggcaaaatccatgtctatccacccacgtgcatatctttggggagaatctgaagctttcttcaggttcctacaggggtccattatttaaaaaaaaaaagcaaatacccactttaaaaaccctttttaggccgggcgcagtggctcacgtctctaatcccagcactttgggaggccgaggcgggcggatcatctgaggtcaggagtttgagaccagcctggccaacatagtgaaaccctgtctccactaaaaatacaaaaattagccgggcatggcagtgcgtgcctgtaatcccagctagttgggaggctgaggcaggagaatcgcttgaacccaggaggtggaggttgcaatgagccgagattgtgccattgcactccagcctaggcgacagagcaagaatccatctcaaaagaaaaaaaaaaaaaaccctttttaaaaaaagggttcattttgtagaggcatgtcctgtgtttaattggaggtggtaacagttgtcctcaaacaaggcaagcctcccctataggaagaatacatagctggcaggggaggggtgattgcaggaaaagtcatggaagatagtaactaaatacatggattttggaactagtgggacttgggctaagacctaagtcttagttcagatagctgccaactatgagacctcaggctggttatttaacctctctgagtctcagttttctcatctataaaatggatgtaataatagtctcttgccctcccaaatttgttgaaataattaaataggatgatgtgataaaagactaggcatggcacctgacacacagaaagcatccagtacatataagttattagtattgttacactgaactgccctgactatgctcactcacagccccctgtactttccacttttgtaaaacctatgacctatcatgattcctgatctttcccactagacagtaaataccatgggggcaggggatcaagcctacgctcatcactgtaactcaagtgctaaggcacatagcagatgcgtggtaaatatttgttgagtataccaataagttaatgaattaattgaaacacctgagttcaaatcaagtctcactatttgttgagttatctccatatggcaggaactagaaatacagtagtgaacaaaacaaccccttgcttccatggagcttacacaccaattggggaggaaaatggaaaacaaatatataatgccttgccaggaagtggcaagtgccaggaaggaaagtgaagcaggttaaagggacggggaagtgactgtttcagactgagtgatcagggaaggctttcctgaggaggagaaccttgcacagagacctgaaatgacacaggagtgagctgtgcaaatatctgggaaaagtgtattccgggctgagagaaaagtgagtgcaaaagccccagcctggcagctttcctcctcccaccctggctgacagaaggcaaaccttccttccagctttcccaaacctcccctctcaggacctcacagggtatgagggagaggtgccatcatacagcaacaccctggctcacccactgccccctgccccttcccactctctgcaatccacaggcccctagagcagccccctatatggccactgcttcaaatgccttctggaaacacagccctggcaaaactctaggcggggttccaagctctactgttaccagcgtctgggccctactctctctgcctccaatgccctcatcacaccctggaccaaggtcagggcctgggacacccagccttgaatcctggcaccatcccaatcttgcaatgtaaccttgggcaagtcatttaatctctctgagactcagctgctttatctgtaagttggatataacggctggctgctgcccttccagtcttaaaggttgtcagagagctcaaatggaatatgtgtaaaaagattttacaaattgctttacaaatgcagagatctttaaagatgaagggttgaccccaggcacttttctcctttctcccaagacaccactaacattccagaagaggaattaaaaaaggtacaagcccatagatgaatagaatgacagggaagggcatctcagtagaagagaaatttcaacaagtgtatggaagtacaagagagtagcacaaggacaggatgacacagcccaagtacctagagccaatctgcacatggaaaattctaagaggtgggtggaggatggggagggagcatggccctaaaaatgagaatcagttgtgagtctgtaagcagaaccatcaagcctacactccccctaccccaccaaaaaccatggcagccaaatgcttaatgtccagcagaggaggaggagagatggaatcagactattagttcctctgttaaaaaaaaaaaaaaaaaaaggtatcatttacagttaaaagatctggccgttctagcaacaaaagggccaggagcatcatgaacaacttcagacacagagctcctatcagtttttatttcaaggttaaatatggatagatagccaagggtcacctggtcaacctgaagtgagaccaagataacccatcagataaaatgaccacaaagacaactattggaggaacaaaacagaacttaaaaatattctacttagggtacaaagaaagaactcttgtgggggaggggttcaccagaagagctggaagatgaagtcaagggattttcccagtatgtggaagcaaaaagaggagagaaaaaagataaaattaaaagatatgaccagcctgagcaatgtaacaagatcccatctctacaaaaaaatgtttgaaaaacatcagccaggtgtggctgcatgcgcctatagtcccagctactcaggaggctgaggcggcaggattgcttgaggccaggagttcaaggctgcagtaagctatgatcacaccactgcactccagcctggttgacagagcaagaccttgtctcaacaacaataaaaagatatgagtactagaggtacaatccagaagtataggattattagattaaagagaagaagtagagagaaatggagaagaaggaatataaaaagatttgagagaaagttgaagagtctggacacaaactccaaataaaaagattccacatttcagaactgtaaagattccagaggaaaaaaaaatggatacttccaaagaaataaaacaaccattctcatgcttctcatgtatccctagatgctaaaagatggtagagaaggtcttcaacatcctaagggaaaatgattttcacctaaaataccaacccaccagactagcaatcaaaccaacaaccccacaacccaccacaccaacaatcaaaccaacaacccaacaatccaccacaccaacaatcaaaacaacccaacacaccagcaatcaaaccaacccaacaatccaccacaccaacaatcacaacaataatccaataactcatcacaccaacaatcaaaacaacaacccaacaacccaccacaccaacaatcaaaacaacaacccaacaatccacaacaccaatcaaaccaacaacccaacaacccaccacaccaacaatcaaaacaatccaacaacccaacacaccaacaatcaaatcaacccaacaatccacaacaccaatcaaaccaacaacccaacaacccactacaacaacaatcaaaacaatcccacaactcaccacaccaacaattaaaccaacgatccaacaacccaccacaccaacaatccaaacagcaacccaacaacccaacacaccaacaatcaaaccaaccacccaccacgccaacagtccaaacaacaatccaacaacccgtcacaccaacaatcaggtaaaagggaagaatccagtcatttagacacaaaaggactcaaaaccttacctcccacctgtcacttcttggtatttacttgagaatgggtggaagtaaaaggaagaagtaaacacaaaagaagctataggttctaagcaaaggtgaatccaacctcagaaggcagagaaaagaagccccaaaacaacagccacatgacccagcaagagggcagccagactggagcaagatgatgaagagaaaccctaaagggaatgcctgaccgatggagaggcagggaaatagatacagctataatagaggaaacaaggggaaaaagatggctagaagctccagaaaaagaaagaaacatgtacaagaaagttgatggagtcctggtgcctccctggccttcagtgaacaatatctacatcatcccaataatggaaaacactatttgttattcttcaaattttagagttaatctctagaaaaagcttcaaaaagggcttggtatggttacaaatagaatacaaatgttatcggccttgtcattttaaaagtcaacgcatggatgacagaagcgataggctggagggggaactgcagagtaggaataattttaatatccttatcttatacagtgcaggattaagagatactgttgatatttggtagaacaagaaatcgattacttaggtaatctatagacagactaaaaatattaatacccctcaattgtggaaatgtgggagggagctgggcactaattgtaatgaaatgagagtgattctctctttactcttctttctccctctttttttttctttttttttgagacggagtcttactccgtcgcccaggctggagtgcagtggtgtgatctcggctcactgcaagctccgcctgctgggttcacgccattctcctgtctcagcctcccgagtagctgggaatacaggcgcctgctactacgcctggctaattttttgtatattcagtagagacggggtttcacagtgttagccagaatggtctcgatctcctgacctcgtgatccacccgcctcggcctcccaaagtgctgtgattacaggcatgagccaccgcgcccagcctttctccctcttttctttcacagcctcctgtttgcacccgggtctcacccactccctctgtccacttattcatttaacacatgagtactgagctggcatagggccagactcagagatgccgaagcctgggtcctggccctccaggaacctccacctggcagaggacagagacttgtgaacactgcaatggcacaaaaggggctcccagtccagagagtgggcatttgcccagctggcctttgctcccagcctctttcttggtctcagtactgggctcagcacagagctcccagtggcagaaaaatggggaagggtgacaggagacgctggcctggggaattctccagcatgacccccatctgggtgtgagcacaggcagcaactgaagattcttattttaaaataaaggggctctagatgacaggtgtaaataattttagtaagaattagtgacaatgagttttcataacaaatcatcatggagtcgttcttcatgtatctgacactgtcagggagggaggcattttccatgtggggattttctggctgactgacttttaccactgatttcagcaattgtggatcagaattgttcccagatgaaccatacacctccctgtctcctcaaacaaaacaccagctgacattctgcaggcccgaaggggcaaagcacatccatcagcccctccattcacagatggactttaaccttttcccaaagactgagggttggaccctctatgagtcctcctcatggcactgggctggagcacagtgaagcccccgggtcccaagatagtgtcagaaccactcagatcagaggccggcctctgcagctctctgatttcagccctggaggacctgctgaccctcagcttggggactcaggaaaggaggcacacacactcatgccccaggaacagcccagcctctcgttccctctcagactcccagggcttggggtcacagagaggtaactactgtagaagagggagggcatgcaaagcccagctcagccaggggccccagctaggatggctgctcaccctaggagcccagcccctggggacagagagggtgccccaaggcagagatgagaaccaaagccaaatgtggagaggcccaaacaccaccaatgggagtccataacagggacaagtgatggcaagtggaatcgatggaaggtgactgtctctcatgttcctctctaaagagagtgcagagaccatgggctagtacagtcagaccatggggacatatgaggttgtccatgacactgaacagtgtttgtgttttgagctcaaaacaatggccctgggttatttctaatctggccctaaatggaagctgtgacaggggctgttgtgggctgaagtgtgtctccctaaaattcgtatgcttaggtcctaacccccaggaccatataatgaaaccgtatttggagatagggcctttttttttttttttttttttttttttttaggtggtgtcttgctctgtcagttatgctggagtgcaatggcacaatctgggctcactgcaacctccacctcccgggttcaagcaattctcctgcctcagcctcccgagtagctgggattacaggtgcgtgccaccatgcctagctaatttttgtatttttagtagagacagggtttcaccatgttggccaggctggtctcaaactcctgacctcaggtgatccacctgcctcagcctcccaaagtgctgggattacaggcatgagctaccgcagggatagggcctttaaagaggtaataaagttaaaatgaggccatcagagtgagccctgatccaatatgactgatgcccttacaaagagagattagagcacaggcaagactcagacccggggcaaccatatagggacacagcaagaagaaggccattggcaggccaaggagagaggcctcagaagaagccagctctgcagtatcttcatctcagacccctggcctccagaattgtggaagaattaagtcttgtgtaccttgttacagcaaactgatacaggacctaacagcaacatacagaaaatacatgcatagagggatgggaagttccccagaaggatgaccccattcataggatttcttaaatcttcctgtccagaccttcaaggaaccatgaagaaactatacattttataatttaaaaaaattagtcagctgggtgcggtggctcacgcctgtaatcccagcactttgggaggccaaggcgggtggatcatgaggtcaggagttcaagaccagcctgatcaagatgatgaaacccccgtatctactaaaaatataaaaactagcctggcacagtggcaggcacctgtaatcccagctacttgggaggttgaggcaggagaattgcttgaacccgggcgacagaggttgcagtgaggcgagatggcaccactgcactccagcctgggtgacaaagtgagactccatctcaaaaaaaaaaaaaaaacagaaattagtcatttattctctgaaatcttgaaggtgtgctttcaatcacagtgctctggatttgcacagtaaaacatggaagggcctgaaagctttgaattctgagaagacagactctctgctaccagcttctgaacttggctccaacagccatttttgccactaaatcaaaactccttggaggcatgtttaaaataccaaccagctcacatgccccaggccctgcttaaaaccattcccgtggctctcatggcccttggataaaggtaaaacccaaacctgggtctgtatcatgaagccccacatggtctggccctacctgaccctctagcaatgcagcttccgtgtcttccccgccggcattcgagctgccccatccttcagagcccgggacacagccagctccctcctggcatagggcctttgtacagactgttccctccacctggagtcctcctggcctagttaactcctgtcacacttcagactggagctccagtgtcccttcctcagagaagcgttgcctgacatcctccccctagtcccagcctgggtcaagttccctgtcactaccccagctccttagggtaactagctattaatgtctgtccccctcagtggctgtgagttccacaagggtgggcaccacagtggtatgtgttcagctcagggctcagtgaaactgataggtggtgtctgtatcccaccttctctggagagggtacagagaccatgggttagtacaggggccataaacaatgcagctaatcccagctggatgctggtctcacccttggagctttccaggaaccgctgagctatggagtctgtgcatgacagtccagaaaagctgctgctactagttccaaaaaggaaaggaaggaaggaaagagagagacgggtgctgacatttattgaacacctatgatgtgcgctactgagcatgaaggctgctgggctatctactttctttttttattttattttattttattttttgagacggagtctcgctctgtcacccaggctggagtgcagtgacgtgatctcggctcactgcaagctccacctcctgggttcacgccattctcctgcctcagcctccagagtagctgggactacaggcgcctgccaccacgcctggctaattttttgtgttttttttagtagagatggggtttcactgtgttagccaggatggtctcgatctcctgaccttgtgatcctgggctatctattttcacatgccttatttcggctagtctacagcaacccttaaagggtaggtaatagtgtccccattttcaaaggtaaggaaaggctcagagaagttaagacatttgcagaaagattcacatatgccaaggcccagagtcagctttagatctcaggtctgcccaccccaaaacccatgctcttcccctgatgcacactagttggaatcacatcagatgggtaaaggaacaacggtccctgcctgagggccagggaccccagatgcccctggggttatgtcaggggaccgatgagtccatctgagcacccaacattgcctgcctctgaataaactatattttttccacatccagatgtaactgtttgcaaataaatacagattctgtcatgactaatatagtaccaattcttctaaatgggtttgctgaattcatggcagttctgtgaagggcggaaacccaggtgggcacatgcatgctaaaatgttcagcatttaatgtgctttccctcctgtgggttgaaaagagctataggtgatgcattgttaagtggggagtggggagcacagctcttttaccatttatgtaaaaaaaaactttttaaatctccatacatagattcttattcatgcattgactctgcaaggatacccaaagccacatcgtcacctctggggagaactcggtggctcttcattgaataaccatctgtactgcacaaattttgtatcacctaaataatttaaaaatccaaacttttaataaaattaaaaccatcaaaggtgatagcaagagggcaacgcttaaccctgcggtgcaacatactgaatttcaggcaaaacagtcctgtgccctcttcaatttctacacaagaggagccagtaatgataatcagagaccagtaattgaggcggggactttaacaccgagtcaccagaggtgaccttgcaaacttggccttttgtcataaaacaggcacaatcatcactgtgttccagccctccagggctttccgaatgccagtggctctggggaaggagacctacttttcgctctataggaacctaccatgtgtttcctgtttccttccacccttgcccccacgcactcacccccaacccctgccccacctccacatgctccctgcacccaccacaaatggccacactcacatggacagcaccttcacttccaatatttcgtgcctcagctccaggcatcttgtggagttatattcaaaaggcccctcataaaattcaaagtacctggggaccaacagagacaggttaaacagagaagcaggtcaggatgtccagggcctgcaggggctcttgttgcagggtggagtgtctgtcccagtgaaataaataaagccaaccagccccatcccagcagatgtcccattaggggcttcaggcagaccatggggccctctggcttgatcactgggtggtcagttactctcagcgccccactcccttgggagtgtaggcatttacagaggcataaacagatttcagcacacagggaaattcagaagcaggtttggttccaagtttgtggctgggaaggagaggggaggaggagggatgctgtgtgtactgtgatcagagaaagcagagagaccagagccattctggcgcagcactgggagtccgacagtgagccttcaggcctccaacttgcccttccattccctgcccctttcccacttgatcctcgtgcctacactgtgacatagctgagactgatgggcctttctccccatttggcagctgacaatactgaggctaatcagacagggctccaggtcatactgtccgtgtagggcaggaccagggcttggtctaggtctacttgcagaacagaacaagccccttccagcaccagctggctccaggcatgtcacagccacctcagggtccctctgccagcttcatgcagaatatcaatgccaatttcaaccaacacttactaagcccttaccataggctaagcaccaggccaagcatttgatgtgaatggatgcattcacttttaatctttctaatcagcctatgaggaaattgacacaagcatcctgaacaggctctaggaattaactaaggtgcccagacccccggagctggaaggtggcagagccaagatgggaacctgcatgctgactcaaggctgctctttctgccacttggctatgagcacggctggtgtcccctggaaagggccctctggcctcctgtggcagaggcccggtgagccctctcctcacagcccccctcctcctggcggttgttcagaggcaggggtgggtggagcttggagggttggatcccaggacagccttaacatcatgaatccagaagcctgcagggccaaaccactataaacatgggatcagtggcctggcaacacgtagtctgcaagaatcagaggtgagaggggctccccagggccaaggattggaaattaggcatcgctcaagcatctcccagaaaccactacacacagcagtggtcatttcgcacgtacccttacacactggacaaacttatgtatgtgctgctttagaaatcttgaaatattttacccaatatattggcttcttttaaaaatattggtatttttattattattatcattgtatttgtattgtcattttgtcattaaaataatactgtgatactttaaaagttatgtttataaatatttgtccttaataattttaatatagttttaagtactataattacatatttaaataattttacataatattttaagatattaaaatattttccacaacaaattggtccctatttacaaaataaattggctccttgttctcatgtcataaaagaatttagaccaagttaataagaactaggtattgaagattcccaaaatatcaaacacctttgtgtcttacagctccttttctttctcatctggcaaactcaaatggattcttcagtacccggctcgagtaaccacactgctgggaagcctcctctgaccctgaccctgggctacccctgctcactgtctcttagagcaaataacatggtattgggttggtacaaaagcaattgcagtttttgcctttttttttaagtaatggcaaaaaccacgattacttttgcacctacataatagtacaattgtgtgtttatgtaattgtgttcctttccaaaccacgagcatctcaaacacagagacagtgtctttgttatctctatatcttctgtactacagagggaggaaagctaaaaatgacatttcccagactcctttgcaggtagggttctggatgcaatttaggttcagccagttagaagcatttgcatgagatggattcagacctgttataggggaagaatggcaaggctcaaggcatggttttgctggtgcagaatgtggcagaggtggcatggctcttggaaactgcagtagtggtaacaccttcatgattatatcagaggcagcagctttcacggtggccccatttcactgcaatttggggaggaattcttggaagttcagccatttcttcagctttccccatgaatctgagctagctgtgcccttaataaatccttttctgctttaactagctaatgtagattctgttatctgcaaataagaacaaggggtcagcctagggccacaaaacgagcccatgaccttggctctaactcacctaattttccagtcacacaacagtgagctctggtgtcctatcacaaagatcactgtttgtaacatgagctggtgtcaactaagccctttggaatccactgagtcaggtaaagtcatggtcctaggttgctgctaagaaaaggtccagattcaaatgatgcaggaaatcattaggtcgagacttatcctagagttattggggaattggggacttgcagacacatctcggatatggctacaaaccagctgtgtgactttgggtaaaacttcccctctctgcatctcttttttctcctctttaaaacaatctgtttgaactagggtagtacctcctcttcaatcagccagcccttccatttcctccacaaaggcattcctgccttgcctcttccttggttcctctttctcctgcatcctcaacatcactcatatacccaactaggcagcatcatgattccaaatgaccttgtgccgtggttttggtggtgcttaggtagagaggctttcagaactgggttcacatccctccacccctcattggcctctgtatggtctgaatgtttgtgtctcctctacaattcatatgttgagatcctaacaggcaaggtaatggtattaggaggtggggccactgggaggtactgcaggcagagcccccatgaatgggatcattgcccttacaaaagaggcccaagagagactcctcttcccttttactatgtaaggatacagcaaggagatgctgtttatgaaccaggaagtaggtcctcacctgaaacttaatctgccttgatcttggacttctcagcctccagaactgtgagcaatacatttctgttgtttataagctaagtcactcagtctatggtattctgacagccacattaggcctggcacttttctgctcctttgttttctcagctgcaaatcagcaaaaacaatgcagtgcatgtgcgacagggttgagaaaaaacactgctgagcatttcatggaatccactggcacacaggaactaccccaaaaatgctcattcccctctgtcctctttgtcccgccactaaagagcacgtgataccagtggatgccccaggaagtcccagggagtcagagacagtctctgatggtaagctggttgatggcaggcctgagtcagggatgaacaactcgaagtttctcactgtgtgcactggtgacatcctccttctgctgtgattagtaaacctctcccctgtcaccctgtggataaagcccacactaagtcctgcttggacatggacctgcttgatcacctcatctcactgaggctcattaaccatgtgcttctgatgctttgacacctggggccttgctgaccctggagggactgcctcttctagggctagccaattcctggagatagtaaaggactagcctgtgagtgcacctttcatttgcaaaccaatccagagcccatgcccctatcaggctcccatactcttggacactggaatagctcttccccactcaccccagggccaggtcctaggcaactagggataacccctatgccccagaacccactgaaattactcagatcaaccaatcctaaacctgcaaaccctgcctcaccagttcctttccatggaaatcccaacgacggctcttgcccacacttccccctcgctccctctgcctccttactgatctgggtgcttcttcccatggtcctgcagggcctcctgtttctagggatctgtgagtatcaaaacctcttccttcatgacagtcatttccatattttcgtgtcttaccatatccgattaaaacaaatcccaggcaccctgaaaacactccaggtagtaccttagccaagtcatcaaaactattccatgcctgagtctaaagcctcagttttcccatctggaaaatggagctaatagccctggcttccttctctatcctacctgggctctgcttttttggtccgtactgctctagctcagtctgtagagatgattgacttgaggttgctatggtctaaatgtctgtatccccaatacaaacattaagtttcatgtttaaacttaatccacaatgtgatggtattaagaggcagggcctttgggaggtaattaggttatgaggtctctgccctcaatgatgggattaggcccttataaaagaggcttcaaacagccttttgcctttccaccatgtgaggatgcagcaagaagctgccatctatgaggaacgggccctcgccagacaccaaatcttctgccaccttgatcttggacttcccagcccccagcactgtgagaaattaatttctcctgttataattataaacgacccagtctaagctattttgttatggcagcccaaaagaactaagataggaaataagattttgagaagcactgtcccatattctgcttctaacaggacgctcaagaactgcattttggagggtgtcatggaaattcatggaaattcccatttggtctggatacagatatacagacatcaaaaatgttgcttaaagtttttttgtctaatgacataagaagatgctcacatgacaatgttgagtaaaaaaatgcaagttacaaaactatgatctccaaaaagaattatatatacgtatgtgaaagcatgggcaaagggaagaattgtaacacaatattaataggggtttctcagaataaatgggatgatgcgttatttttttaaatacttttctgtgtttttataagttttctgcaatggggttatgattcttttattattggaaatcactaataaattcttttttaagtcccagaccttcttctaactatctcaagcttccccttaccctgttacaagattgagggaagcactttctccaaccttcttaaactccactagcctctcaaggtgagttcgtcactgtctctactttcaatgctagaaagactatctttacccacatcaaaggggagggcaccctggcaccatgtagggcatctcacaggtataaatagtcccagcgggtgatatcaggagcccaactcctctcaaatgccactcagtttccagcagccaaatatgatgctggtgccaggctgcatcattctgccccatctctctgccctccactaagtgagaagacaaatgcagaaggccagaaagaggtgaacacagtggccctgggcatcagttctctccctgcccagactgggctccagctctgtgggctaaggaggcctcctttctttttcttcctttccttctttccttctttcttttctttctttctttctttctttctttctttctttctttctttctttctttctttttctttctctctctttctttttctttttctttctctctttccttccttccttctcccttccccttccccttccccttcccttcccttcccttctccttccttcctttcttcctttctttctttctctcttttttttttttttgatggagtctcgctctgtcacccaagctggagtgcagtggcatgatctcggctcactgcaaactccccctcccgggttcaagtgattctcccgaagaggctcctttcagcatgcccagggtctggccctctgagagcctgggtctgtaattcctatgagcctttccccaaaagcctgccccacagaggctcccctgttggcctgattccctctccagagcttctccagggccatgtttcctttcttgggggcaacagtactctgggtcccagcaaccactggctgctacaagatgaggtccatgcattcagctttctatctaacacttccccatccccacccccagacactgatggtactccagagaatagaagcccaggggggtccctgtgtcacgcacaaacacctgttaaatctccactagccctaggtgaacagggaaactaatctgaacacctagactcctgtccagcttggtgcagagtctcagagaaccatggagttgtttatttattccacactggttagagacaccactagcccatatagcgcctctgtgcaaataaggaaaaagcaccattttccccagataaattaagccacatgcaccagacacatggctggtcaagtgagagtaagctgtacttcagcctcacttgactgcctggctgagtatctttgtgcagtgcccaccctgcacaactgtccatgacagcctgataccagaccatttaacttggtctcatttaatcctcccaatagccctatgaggcaagcataatttcccccattttatatctgagacttgaactacaagaggtaaagtaacttgcccaaggtcattcagctagtaaatggtggcactggaaaagaaacctgaggactgtgagagcccggaacccctgctcttaacagtgtcactgcacttcctctccctgactctgacagccatcgttctctggggggttttctcagtcagcagcccttccccctcccaaaggcaacagcccttcagtgagctcagcgctatttctagagccagaacagctgccgtctcgagatagcacacgacccgtcacagcaaacgcacagaaatcagtctgaaaattgcagcctgacaattcaaaggactgaagtgtcttcccagataggtaggagagaggcaagaacagctcagctgttaacaactgcgggtcacagctgtcaggagacatgccatggcagtggagagccccggctccaacccctggctggtccatggcccggctcagcagccttgaacttcacctgccctctttgggccacagttcactcatctgtccccaggaattatcagagctgttttgagatatcagaactggatgctaaaaagcctgatgttctcagtgcaaccctaaatagtcctgggattaatctgccccaggtgtgcacctcacaccaagcctgagggtcatttctggcacagggtgggggttgggggtagcagggcaaagcctggtgtctagcttcattcctccttccccaccccggagttctgcagggccccagatccagtgtttaacatattccctgtgagagtatgtacatgatgaccttattttccaggccagactagggagccctgaaaggcttccctttgtaaaattcagctcaacagccaggaatgcctcagtgtgtgaatgctagcactggccagtgcccctactgcttctcatggactttgaccaccatgcccacaggcaccctagccaagagatacatcctagctgcctccttctccttccttcatcttccgccaactctcaccacttctccttcctgagtagtccccatctccaccccagtgccagggaaaggattcggtcttctcccccctgggggagtctctctgtctggaatactctttgctttcttgctagtccctgcctactcattcagcagagtcagcccaggggtcagcttccactggctcccttcgtggccctccctcctctgtgcctgcagcccctgggcactcctccagaccagctcttattatgtggaattacacacagctcctccatggcctgtctgcgctgttgatgcgtgagaagggtttttctcctctttgactcatcaaagatttatagaccctctactgtgtgccaggaactgtttcaggccaggatgcactgatgaactggccagtgtccccactctcatggcacttccacaggggcgacaataaatgattcattcaatataatgccacatagccataactcttccaaaaaaaaagcaggacaaggaattggagggtgcctggaaggatagtgggtggcctaggaaggccactctggacaggggacatgaatagaggcatggagccctgtgcagatgtgtgggaagaacttcccagagaaggaagtgagtaaatacaatcacttgctctgcagtagcagctgccaatgtggctaggcagggttgtggaggtcagagaggtgagcaaagccaagtcaagctgggcctgtgggccacccagtatcatggggactcggcagaggaacaacgtgatctgatgtggggataaaggactgtaaagggagggagggagaactattgcagcatgaaaagacagtcgattgcactaaggggtggcaaagaaagtggggagaaggagacagacccatgaaatagtttaggaatggaaccagcaggatgcattgataatttagaaagtgaataaatcaacagtaactcctaggacttcagcttgaacaactagcgggatgacataaccatttaaaggttagagagatgaacaggtttggggtgttgggccctgtgaagcttcctgtgccctcagacatctagaggagatcacaggtaggcagtcagatgcacatggctgaggcccagtggtcagggctggggatgcacattccagagtcaaaggacaagggacttcaggaaacactgggagagagtgcagagagaagaagaaagagggccaaggacaggcctgaggtcagctcccacattcagatggcagcaaatgacactgagaagaaaggtctgcaggtggaagaaaacccagacacagagcccagggacatggaagctaagaggagggagcatttccaggacagatgggccatatgcagtgctgacccatatgtcttggaaatgggggtcaaagaagaggaggacagagaaggcaccactgatctagcaaccaggaagtcatcaatgaccttgacaagagcagattcaagggagaagggaacagatgcccctctgccgtaggtggaagcaaggccaggagtgggaaatgttggagatggtgccatggaagtctgcaggtgaaggagggctgagtgagtgtccgaagacctggtcctggggcaagtggagaggatgggatgtctcccaaagtgtaaagggatggctggaggaagaaaagagagacttcagtgttctgtgagcctccaaaaggcaagcctaagagccccagctgagacttagggaggaaaggtttacaatcagccagaggaagcacttcgaaccaggaggctcgcatggggaaggatggcctctttgggagcttcatgacctgctatcacttactagcttagcaaggtcttggtggccatcaagttgggggatgccgggctataaatggagacatgcagtggaaaactggaagagcctccagctgccttaaccttgtgagcatcccctaatctaatgggtgggtggatgcttggtccttccagcccgactccaactcccttttctttccttctttcccattctcatgccttcccctagcctcctgcctttgccaagtgattggcataaaattctcaaagatggtctacaagggaggaagcacaggatcgtgaagaaggagaagagggagaatgggtagtggaagctgaagggaggaacggagtctggggagttgacctgcagtgaagaaggggtgaggccctgacaggcactgcacccagctgatccggcctcctcagtttacaggaaagcagacaaggcccagggagggagtgctatccccccacggaagtgctgtgcgtctggggcgaacctaggcccactcagagaaccccaggagtgactgagcagggggggaagagaccccctcactccacctccacggagccctatggggacctgtgaggtgctttaaccttggagcactcagggagttacagagcctgtgacctcctttgtatcacccccagagttgggttaatgacctcagttttgcagatgaagtaattgaggcacagaaaggtttgtgtaagtggttatttgcccaggagactccacagagactcaaaagccataaagctttgggttcagagcactcctggagcaaccctgacttaaggaggaggagtctcccagtgccaacaactccacttccaccagcagcctcagccggccgcagcctgggttctgccaggccccaagaagcccacatcaggttcatgggaccaatgggggaagctgccaagtttgttttgctttttgtttctccagcatccagcccagaacattccaccaaacctgcatctccaaatccttcccagttgggtgaagctcaacagctctggccctttttccctccttttctgcagaagagaacattgacccggaaggctgaagtgagccagctgcacctgccacacaggagtgtgcttcctccgctgctctgccttcagcctggacgatggcattcgggactgcaggggtcgcactgcccccaagggctcctctttgaaatgtataattgccaggagcaggtggagggatgcatttttcagaggcaacaatcagaaaaacactaagcacacttgggaaggcaggagggaggaggacacagaagatagaaagtggaagagatagggaaggaggagatgagagaccctaaagatcatcttgtctgagatcaaccctgcagctttgacaacagttgcacagaagtgatctatttttttttttttttaattttttgagatacggtcttactctgtcacccaggctggagtacagtggcatgctctcagctcatagtggcatgatctcagctcactgcagcctcgaacttctgggctcaagtgatcttccgacctcagcctcctgagtagctaggactacaagcatgcaccaccatgtctagctatttttttttatttttatttttggtagagacgaggtcttgctatgtagaccaagctggtcttgaactcctagcctcaagcaatcctcccgcctcagcctcttacaagttctgggattataggcatgagcaactgtgcctgaccagaagtgatctacttaaatcaatatggcctttttattatggtctaacagcaaggagctgagggcagaaatagaagacctgaaaggacttggaaagaaaagacaaggaggctcacccagccctgcatgagctgtccacagcccagaaggaagaacccctctaacccctcccatgagtgctgggactgtggagtcacacaggatagatagatagatagatagatagatagatagatagatagatagatagatatagtgctccagctccacccaccacctggaagtgacctaatcttttggtgactaaatttcctcatctataaaatggagggtaatgaatacacccacctcaaatgtttgagggtaaggactgaatgggataatacatgtaaggcacccagtatagtgcctggccccagacactcacttggctcgctcttcagccaagaggaccctcttgtgtcatctatttggggcttgctcttttttcctgtagctggtgctaccctggccttgggaggtcttccacactccatcccagaagcccaggaagaagggtgcagggagaaggctgtcccacccacaggcagcctgggccagccccgctccggacctcagagacaagtgtctcctgagttgccttccacacctcctctttgccagcctgttccagaggtaagacccggagggccaagattggtgtggagtatggaaagggggccagtgaggccagccaaggagcctgcagctgtgcctggatctaggggatccagagggccctggagatgctcgcacaggtggtctagcccagtcctccaaagccagaggctcctcgggatttggggaatacctgagcaaacacagaaggattatgtgcactcgccagagggtcctctgtgtgtgcaatgacagaagttgccctgggggcagacgtatctacagaaggcagagttaaaggtgattcggttgggctggggctagcagggaaggcttcaaggaggaagtggatactggagggaggacaaggacctggatgtggagccagacccagttggcagaagctgagtgaagccctttgtgctgtggccatgggccaggctgacagtcagctctgctgggacagtgtctgggggactcctgcctcagctgtcctctgtccctgtgactgaagtgggggatgttttcctgaggcaatgcatgcaacactgcccaccctacaggacagaggccatcaccatgagggcaccgctgcctccccctgctctctgagcagttgctgggcagacaggcagctaggccagtccagagggaacagggttgcagctgaccatggaggacaagtaccctctatcctcctctgccttcccagaggggccatgctcggtgaggggtgttcaggaggaggtctagtcagttagcacaggagcacgtcatctgccttcactgccccgtctctacttttttttttagacggagttttgctcttgttgcccaggctggagtgcaatggcgtgatctcagctcaccacaacctctgcctcctgagttcaagcgattctcctgtctcagccgcccgagtagctgggattacagacatgtgccaccacgcctggctaattttgtatttttagtagagacggggcttctccaccctctctactttttatacctcacccccaccaactgtcagtcttccttttcccacccagaagcccacaaatgtcagcctgccctactatcagctcttttcaagagcgaattctctggcaattccagcctgtgaatgagtttctgattctaatgtgtttccagaaaggggacaacttttcaaagacagtgccaggagacaaggttgaatccaaagggataaatctctaagggaagactcaggaacactgaaatctaagttttctttcttaccaatagcctttactatttcctcgcttaattcattttttttttttacacaattcacatttattgagcacctactacataacaggtgccacgctaggttctggcaattcaaaacggaagatgcacaacaactgtcttactgagacgatggaagcacaaacacatgagaaatgtcttcacaggccttcctacttgtgcaaaacacccacttaaatagaaatatttgctgattgaaaattattccggctgggtgctgtggctcacgcctgtaatcccagcaccttgggaggctgaggcaggtggatcacttgaggtcaggagttcaagacaagcctggccaacacagtgaaaccccgtctctactaaaaattacaaaaattagccggcgctggtggcaggtgcctgtagtcccagctactcagtaggctgagggaggagaattgcttgaacccgggaggcgaaggttgcagtgaatcaagattgcatcactgcactccagcctgagcaatggagtgaaactctgtctcaaaaaaaaaaaaaaaagaaaaaaaattattcctatatgctcattaaatcagttcccctaaggatgcttattggacaacacttcatagacctagacttgaaattaataaagctatatgtcaatgtatatcttatagctcacacctttctaattcagcctgtacttccccagcctgtgaccaataagaagatctgaccacagccttttatgagcactatctggcttgaatttgctttgtagtgctgtttggagttttccggactaatcatttggactggctccttctgcctgtggctcctgcttgagtatatacaatgtatgagtcatttgcttctttgcccctcttcatcctctggttatatttggtacttcctgacttcctttccaaactgttaataataaataacaggttgtaccacacttcaacaccacacaactatagatagcaaaacatggcatgcactgaattattcaatatgtgaataataccatgaagctcatcccatcttccagatttggagagttgtcaattgggacaatgtacgtcgtgtcctcgttaggtcctcccccaagctctgcacagctgctgccaggagctgtcctgcccattttaaagaaggcagaagctgctcacacgccagggtaaaaactccagttccattctaactacgttaaccattatttcccacatgtggggactctacgtactgcagtccttcaactaggggggtacttcggggtcaactagaaatagagatttgaaattggaattgtcccaggaaaatgtgggaggtgtggtcatgccatttattctgtgactaaggaaattcttgctcaaatgggagcgctccagaaggaagtcaactcagctgctaacaatgttgcatcaaaggcacctgaattccaaaaccaacttgacagaggtcagctgtgtctctgaccctgcaggctcccggctgataggaaagaggaagctggcccagatcatggagagaggggcagagaaaataaagggcaagaggagtgagaaagggagtagggaagcaaggacgtggaggagagagggaggcaatggggaggaagaaaggaaggatggacaaaaacaggtaacaggaagaaaggcagaggagaacacaggtgcagtgagggctatgagaagttacaggtgaaaccgtggaaagaggaaggaaagacaaaagatactggcagcaggaaaagttaggaatggagcccatgcaatgacaatggtttcagccactgactggagacatctgccaagaaacagcttcccaggggcccgtcggtccgccttgctcacttgactcgcctttctatctttctctttcttttcttttttctttctttctttctttctttctctctttctttctctctttctctctcttctttccttcctttctttcttttctttctttctctcttctttccttttctttttctttctttctctctctcttctttccttcctttctctttctttctttctttctctctctctttcttttttttgacagggtttcactctgtcactcaggctggagtgcagtggcacaatctgagctcactgcagcctctgcctcccaggttcaagctattctcccgtctcagcctcctgagtagctgggattacaggcatgtgccaccacacccggctaatttttgcatttttagtagagatggggtttcaccatgttggccgggctggtctcaaactcctgacctcaagtgatccacccgccttggcctcccaaagtgctgggattacgggcatgagccaccatgcttggctttgactcgcattttctaccccaaacctcttgaagaactctcccaggagtccagtagggaggtacacacttgctgacttacctagactgctcaccacctgggaggcagggccgcttagcagacaggccagcatgggaggctcagcttcccaggacaagcatgggcccccaccttacccgtgatgtccagagctccctctgcacttccatggaaagaactgtggtcccaaaggccagcataagaccctccagcccaggccacagcgtgcgaccatccccacaccctcgggcatgtctgtggacatttgcttgactggtttctgacatcagaatctcatctttctcaaagcattgaataaaaacatacatatcaggggtccttgaaaaacccattacttctctgcagggtcaatttaatgtttgtgtgtcaaaatcaccagcaacaaaaatgcaagcctctctctcagggaaacggacgtgagagttaccccctccttaaaaatacaaaaattaagaaaccaaacagcttaatcagcccctgggaatgcttagctggcaggttccagtcatacccagctcccagcagagacagtatcctgcctcatctgcaaaaattctccacaataccctccctgcaatgagtgtgctcagcctgagaatattccatttttattcattcaacaaatattactgatcaagaggaaatagccacatgatggggcgcatagcaaatctcagcaccaccttgatggaaatggttctgctccagccaagggcaacctcccctgtgggcagggcagggagtacctgggcaagggacttcagagaagcagggaacacccacctgacacccgcttcttgatgccacccacccacacacacctacacacacttgctggctgatatccgaaatccctgcagcagggacagagctttggcccccacccctaaatggaggtttgagaccaagactccccaccctaccccctgatagaaggggccagtgaatccccgcttggttgtggttgggtcctatgcctcacccttcaaattcattcaccttcaagttaaaggaaccaggtgggataccaaagtgcagggagtttcgagccaccagaacaagacctgcttcttccaccctaggaagtggacaatgtggcaggggctgcagggccaccccgggttgagcttcccccactccctggccttttgccggggtctgtacctggagctggagtcactgccgctctgcactgctggatcatccgtgacattaaagagccccgtccaattggtcagctggtcaccactctgccaaccaaactggaggcctctggcaagaaaacgaggcagtcggtactcatgctcatttgctgggttaagcctgcctaccagagagccacattctgttgctgtgcccaagtgacacattgccttggtcatgcaattaaaggaggcgatggtactgactccaaccatgaggatggtgatcataaaccacagccctctacagtgctctctgcggttctgcatctatcccctcattccatctgtaccagcagggctgagagcacacatttcacacacagggacattgcgactttgcgagacaaaggtcgcagagctcttctacctcctataccgtgccatccctcaattcctgcctccagttaaaccaaaagagcgccagcaccacattttgtcctcctcaaaagccagacacacttcagagcttttaataaaatctacagtattccagcacacaaggataccacttttggttcaagacgtgcactcagcacatgcttatcttcactccttccccaaccctcactaaaatgacagcaaagggataaatacagacatgcatgtcgggagaaggccatagaaggggccagcaataacatgctggatgatgaaaagcacaaggtcatggacctccaccagacagtggacatcttacttcctgcaaaaagcagatctactcgcagtgaacaactcaggaaggctcaggaatgaaaggtccccagggccagcgaaggtgggagtgcacaatggagctaagagcagcattgtttgaagtctgcacaaaaagcagtcagacaaccctctccccaacgccctgtgaattcccataccaggccctcttcccaagcccaggcagcctggccactccacctgcccacctcacagatgtcaggagattgctttctggggaaaccgactcacaggagttctgcgctcttttctcttatcagagactctgcactgaaaacagtggatgtgcctgaaagtctgcttactgagtgcacctggcttctgaatgcttgggtcacacaccctgccttccaggtttgctgagggatgggtttctcaggagggaaactgatccgctcaaaagaaacagatatggaggaaagggttggtgcccgcttaattgccccagggcaggctttctcagcctggcactatggcatctggggttggctacttcattgttgtgggactgtcctgtgcattataggatgctgagcaacatccctgctctctaccaccagatgccagcagcattgtaccctggaccctcctgctgcagcaatcaaaaatgtctccagacattgccaatgtctactgggggcaaaattgccccagttgagaatcgctgtctataacaatccacagagcttccaagaaaccttctagtgactggctggcccttaaatataaacaagctattaagaccatcatcatgtgaagaaaactttaacagtcagagaacaaaacaaaacaaaataaaacagaacagctttctctgctcatgcccagtgtggtctcaatatgcagaacaatgccagtgagttcataaacctgtacctcccatggaaatgctccaccagcaaccattggtgccgaggaccatgggtccatgcaaaacgacatgggcgagattgacaaggttacgggcaggtttaacgaccagtttaaaacctatgttatccagagggccattcgcaggatgggtgagtcagattattccattctccgattggccaaagccaacagcatcgccccagaaagaacttttgactggacagaatcatggatgtggaatatttctctaaataaatagtgaggccaggcttgatggctcatgcctataatcccagcactttgggaggccgaggtgagtggatcacctgagctcaggagtttgagaccagattagacaacatggtgaaaccccatctctacaaaaaatacaaaaattagctgggcatggtggcacttgcctgtagtcccagctacttgggcggctaaggcgggagaatcccttgatcctgggaggtggaggttgaagtaagccgagatcacactactgcactctagcctgagcaagagagtgagaccctgtcttgaatgaatgaatgaatggatagatgaatgaataaatagtgaaacacttaaaaaaagaatgcagggggaaaaagacaaatgaaaaaagcagaaggccaagcgtagtggctcatgcctgtaatcccagcactttggaaggccgaggcaggcggactgcctgaggccaggagttcgagaccagcctggccagcatggtgaaaccctgtctctactaaaaatacaaaaattagccaggcatggtggcaggtgcctgtaatcccagctactcagaaggctgaggcatgagaatcgcttgaacctgggaggtgaaggttgcagtgagctgagatcgtgccattgcactccagcctgggtgacaagagcaaaactccatctaaaaaaaaaaaagaaaaaagcagaattttttttcaataaaacccttaataataaatagcctctaagctaagggaatggggcagcagatggtcactggagctgggaactgatccatccatatctccactaataggctgagtacctgagtctctgcacctctcaaggcctctgttcccatctttcaagaggactgtctcagttgccttcaaagtctttgactgcaagtatcacagatctgagccttcttctatgatgcccacgcacctccctcttcagaagtctagctcacctcctacgtgtgtgtcagcttagtctcccagccagaccctgggctgaggaggccccttggggccctgccagcagctctctgctgcacacatgaagtgctccagcgatgctttgctgagtaacagtagaccctgttctcatactctccaggctccacagcagtggggagctcagaggaaaaggtacaactcacagggcagaggccgaagccaaagcaaaatgcctgtccagttcttagtccattcaaaacacagaagggctccggtctggttctgattcaatagttattcatttatccatttatttatttattgaagtggttgtttcctttcaaagagatcaccaaggtatttcttggagaaaatttgggtttggtttattcagaagagagacactttgagcacctattatgaacccggccctttacataaatggtctcaattcctacaaacgcctcatgcagaaaatctcatgatcgggccaagcatggtggctcacacctgtaatcccagaattttgggaaaccgaggtgggtggatcacttgaggtcaggagttcgagaccagcctagccaacatggtgaaaccccatgtctactaaatatacaaaaattagctgggcatggtggtgcgtgcctgtaatcacagctactctgggaggctgaggcatgagaatcacttgaacccgggaggcagagattgcagtgaggagagatcatgccactgcactccagcctgggtgacagagcaagacgaaagaaaggaagaaagagagagaggaaggaaggaaggaaggaaggaaggaaggaaggaaggaaggaaggaaggaaggaaggaaaagagagaaagaaaggaaggaagaaagaaaatctcattatctccatttacagctgatgaaatatgcagcttagagaggtttagtagcttgcccaagtaacaagtagctaagctaagatttaaaccgagggctaactctaaatgcttctactcctaaaagtctttaccaaacagcctagaggccaagaaaacagtaatatttccacccgagattttgcaaactagttagttcacaaacatatcaaatcaatgtccagcccaggagtctgctacgaaactcatgggtccttaaaaaatagtctaaccagctagacttcttcccacagcatgcatgaagggtcagctagccagccacactgtcatcctcctacccatggtgagaccccatgtcccttcacatggcagtcccctcccaggactatagaagcgagggactactgagcagaaaatatgatgacttagcaagacactcattattaaatggcacgggtggggggggaacaagttacaaaaggagatacccaatagtagttccatttctgtaaggttttataccagaaagctggttacttttgtaggtggaattaaagtttattttttcttttagtttagcaatgtttactcatttacctcaaaaaaacctaactgcataattttcaaaaccaatgtattatataatttaaattccattcctgagctaaggataggatctattattagtcaaagaaacccaatgaggaaggcctgtggaggtataaaggaagatgacaaaatgaaaaaacatttcatggctgggcacagtggctcacgcctgtaatcccagcactttggtaggccatggtgggaggatcacttgaggtcaggagtttgagaccagcctgaccaacatggtgaaaccccatctctacttaaaaaaaaaaaaaatatatatatatatatatatatatatatatatatatatcctggatatatatatatatcctggatatatatatatatccaggaatggtggtgcacacctgtagtcccagctacttgggaggctgaggcaggagaattgcttgaacctgggaggcagaggctgcagtgagccgagattgtgccactgcactccagcctgggtgactgagtgagactctgtctcaaaaataataattaaataaaataaatttgtaaaaaaatttaaaaaataaaacattttattcactcattcatttatataacatttgttgagcatctactatgcattaggaactggtagttgctgggccaagtaacagcaaagagcaaacgcttgtttccaaaatgctcaccataaaattgagataattacactaacacacatagaaatattagcaaacaagatagggcaaaatcaagtgcttaaatggagtgctgtaactggttttttatgtctaatttattttttcaaaaagaaaagatttgaagtaaatacggcaggatgttaacatttgttaacactgctaattctcagtcatgactgcatgaatgtttgttatattgttctccatattcttttgtagtctataattccataataaaaatacacgttaaaataatttttaaggccaggcacggtggctcgtgcctgtaatcccatcactttgggaggccaaggagggtggatcacgaggtcaggagttcaagaccaacctggccaagatggtggatccccatctctactaaaaatacaaaaaaattagcccagtgtggtggcgcatgcctgtaatctcagctactcaggaggctgaggcagagtattgcttgaacccaggaggcggaggttgcagtgagtcaagatcacaccactgcactgagcaaacagagcgagactccatctcaaaaaacaaacaaacaaacaacaacaacaaaaaacaagtgcttaactgtgctaaactcgtaatcactaacaaggccttagagtagccaagggcagcttcctggactcagtcagccttgcagaatctttgcaccttgcaggttaagctagaattgaacacagccctgaacctaaggaaacagaacatataagaattatgtaaactgatttattcaagactggattcagatatttagaggcctcaagcactgaaaagtgtgtggtgccacctcacgcccatacttactcaaaagttatgtgcctgttaaaataaaaatagctctgtctggattttctgattataaaatctgggatatgtttatggaggctcagcttttctctgttgtgtggttattgctgacaacctggctcagccaggtccctggttgtgtaacccacagccatgtaacatagccccttgctctcatggcaatgaatcctacagccatcagaggatggggaaagctgcccatgcttccctgagccaactaccaggggaatttcaggacagaaggcaaaatcacatctcagagaagcaatttaaaaacaggtggaactacctccattaataataccctccaaatattgtaaggcattatcttattaaaatttttgccaatggattaaaatatatatatgttccaggcactgtgacagatttacatgttatttcaaatcctcccaaaagcctataggtgggcattagtatcaccatttcacagatgaggaaactgaacctagggagattagatttacaacctgcccagatattgtgaagagcagagaaagtattcaagcccaagcccggcgtcagggcccatgtttcttccttctctcctttaaccccatgttctcatgctcttttttggggaaaaaaagacttttccattgtccaatatttttaatattatttgagctgctgccattgctgtggactgtttaatgacgaagtctatataaaacaaaccatgcatgggtgtggtggctcacgcctgtaagcattttgggaggccgaggcaggaggatcacaaggtcaagggatcgagaccatcctggccaacatggtgaaaccccatctctactaaaaatacagaaattagctgggtatggaggcatgagcctgtagtcccagctactcaggaggctgaggcaggagaatcgcttgaacccaggaggcagaggttgcagtgagctgagatcacaccactgcactccagcctggtgatagagcgagactccatctcaaaaaaaaaaaaaaaactatagagtattataaaatgaagaggctgaacaaaatcatctctgagatcctttcccattttgattgaagtgccaaagttacagaatttctggcactggaggaggccagtggaggcaattttgtgggggacacaggaaggggaggaagtggcacatgcgtagctatccattcacagtgtgtgggctcctgcacaatctgccttcgcatatggtaggcctggggccaagcatccgcgagtgcccactcagatgctggaatctccagggtggttgaaccaaaagaggctgaatctatggggcacagggcatttggcactgtggacttaggttccccaaagaagccccacccctgatgccagagcccaggaccccatgtgctgactgctcaacccagtggggcacagcgtgcagcccaggtcaccaagagactggccatgtgctcaagacaaaatgcaactgaacccatccttgcaaaccacctccaagagcctcctgcttcaggctgaggcccccccacatgctctggagagtgagactgaagccactgtcattgctctgctctgtttttcaggtcagtagaggacaggaaggcagctgcttcctagatggtctcctaggtcttcatgccttccctgtccaacggcctgaacactgccatcagagtgagcttcctaaggagtatcccaatagcaccacttgcctattccagaaccttccaagactgcccacgacccaaaggacaggatcagaccctcaactcagtgccccaggagtggccctgcagtttcacttgcacccctctgcaaacctcagctttttaagccactattgtgctcccacaatcatcctgcgccccacctgcctcaatgtccctcaacctccaacgtccagctcaagcaccaccacttccctgaggcccttcttgaccactctggcccagcccaccaggccgtcccaccttggaactaagtcagcacttactctccaaccccctacaccttctcatcctgcctcactcagcggtcacctctgcctgtctatctgtgagttctgtcacccctacataattatggtccttcctagggaagaaactagactttatatctaaaactgagccccaaattgtctttctcaaagtccttaagcaaccagagtggggaaagggggccaggggtgggtgccttgaactccaccctccccagaggtctccttaggaaaattggaacaggagggtcttaccagtcctgggaaagaggaagaaacagagagaggggaggccagccagaaacacatgccagactgcttgttgagtccaaccctcctggggcaggcaaagggactgcagccatagaggtgttagaggtgttgccaggcaaactcccacccaagagacaagttttacagtggataatccagagctagtaaggggcaccaggcagggaggggtatgacttgaaggcccacaggggctgtcccctgtccctaaagtatcttacccattaacctgtcactaagactccaaaagaatgacagtgttgcgaccaacaattacaaacggacttcttcagtgttaggagatactgctgctgccctcaagaactgacagtccggttttaactgttatttgggaaatgaccaccttgcacaggtggggtcctcggaagagtccagaggttagggggtggtgagaggacagaaaatgcagtgaactggaggaggccaggccagggttctactaagaactgcagcactaatcccagaaattgttagttctcagtgaggggcaaatagctccaatgctaaacagcctttggcaggatttcaggcagaagtgccagtttgatgagggagaaggttctggataagaaggtgttatcagtgcctctccatcagtcacaaacctgcagctgccatgttcctttaaaggtgttaacaccagccccagaagtggccactttcttcagagcttcaatagccatccaagcagatgactcacctccaggcaatgcttgcctctagagattcttggataggggggctcgcattccaccattcactagcagtgtgactctcagcattgaacctcttgaagtctcagttttctcatccgtcaaaggggatgaataatcctcaacctaaggatataaacagtctacaaaagcagacatataaatgctaacatgcatataaaggcttttatatctaatatacacaattaaaatgtatttaacccaatgtttgcataaagaaaagataatggagtggttgatggacaaggtgagaagtcttcctttccatttgtacacacttttgtaacttttgattttatacatgcttgcattactttttcaaaaaataaacaaaagtaggcctggcactttgggaggccaaggcagggggatagcttgagctcaggagtttgagaccagcctaggcaacatagtgagaacctgtctctatcaaaaaatcaaaaaattagagcttaggaggctgcgtcaggaaaatcatttgagcacaggaggttgaggctgcaattagtcatgatcacaccactgcactctagcctgggtgacagggcaagatgctgtctcaaaaaataaaaataaaggaaataagcaaaagtaggctgggcacaggagctaatacctgtaattccagtgctttgggaggctgaagtgggaggattgcctgagacccagagttaaaggctgcactgagctatgattgtgctactgcactacagcctggatgacagagcaacaacaccctgcgtctaaaaaagaaaaaagaaacaacaacacagatggtcaccccaactaccaggtgaagtgaagatgaactatgtgtgacaaatggctctgtcaactacgtgagcgctagttgtttatccggagaagatgcaggtagcgggctgtagctgcctggttatgtcaagggggagatttctttctgtctttgcagtctcttagcagattgcctgtgatgagcactacgttctgatttaatgcttattcaatagtaaaaacattttatttctctaccaaaagaaaaagaaaaaggccttttggtaactcttttggcgttgcacaaacaggagggatggtagcgacgatgatggctggtattaacacaaaaatgaaaaataaggaaaacaaaacaagggcagttgtttcatgctgagaatgtcatgtctttctcctgagtaactgctactacccatacccctcggggaactagaggtcactgagcaccgggctcagggccccttcacctccctctcgccccagcaggagagcccaggcccctgtggagggcgaggactccaaggatcagtagccagagtggctgcagccactgatctgaaagtccttcctgacccaagtcttgaccaagaacaaagccaaatccacttcttctccttaaaacaactcaatcttaagccagcagccaccccagaacagacgcccttaccttcctgacggatcccatcctggccaggggagggccctgctcatcctatgaccatcatctctaaagttagggatggcaccataacatgcacactttcgctcaagaagctctccttagagagctcctctatgctcttcttggaccttttagagcatcacgcaccctgggtaaaacagccaataaaagtacaaccgcacattaatcatttatatttctacaaagtgcttcacttctaccagggagcaaattcaaacctgggcatgaggggcccagacagagaacgagcagagcgaaggcaacaagaacaggggagggtgtctgtgctgcccaagttgtgggaagacaggcctcgggttgccactttgctcatttgtccaagaggggcaggaagtccaggcttttatttttcatttcccagttcttaaaggttgccaatgaatccaaacttgaaacactgtgcagaccaaatacgacacgctgtaggctgcagaccacccattggcagcccctgagttgcagcatcttgctccatcctgaccccagtcctgtgagggagagaggtagagtgcaccatcagccatcacagctgaggaaacaggcatagagtgggaagttagctcaagccacctgggggcaaagataggcctggaacccaggagtcctgactcccagttcaggcctctcagcacccaaggtctggatcctgtcccgggagtcagttgcacccagcacacattggggtcttcccatattggggtgctgggtcagtgacctcagccttctggcctcatgcacaacacacctgttcacctttactgctatcctcacactggcccaggtgagcgcattccagggccctgcctgtcaccaccccctccctcttgacaggcatacaacaggaatgagaatgactgtactccctatcattagagggataaccttgagtaggctctattcgtaaaaaaacaataaaagaagaaaatcattcacaaacgttgctatttaacttttgtgggaggataatctattgaattattcatttgtattttccctcctccattccagaaaggtagctcggttttcttatcttcaacccagggccaactgggttgtgggggcgaaaggcttcaatgctcaagaaattgtgctgtgaagaaactgtgtgagagagtcctgggggaggtggggggccagtgcctctgggtctcgggagggctggtggaagtggtgagaccatggcccaaaccaggaagcccatgctagcagcttgagatcgctctgtccacatccctcacaagggatagcaggacctcagaaaggggcagctcgggaggctggacccagggctccagaagcctccagaaagcagtgagcagatcagcagggccagcacagcccagggggtccacggcactgttctgtcccacacaagacccccagggtcttcacacaaccctgggagggggaagaccccgaaggcggctcaacactggtggattcaacttcccacaaattggtgggtaaggtttagtcatgtttttaatgaaagaaagtttaaaaatgagccatttctttcacaccaagccaagcttgtgaaataaaatgtataattgcttttctattgttaatcagcaaatcacttgcattggacctcacagtgtatcgagggtacctttccttttcccattcattctattttcatcttgttatatatgcataatatttattttatgatattattctatattggtccaacagccatcccaggccacatactgaggctcaacagcgagcaagccaccaaagccttgccccagtgactcttaatttctaccagagggagacagatatgacgacaataaactaacaggcgacaaaatgcgtcatacgctaaagggtgaaaggtgttgtgggagaaataaagggaggaaagggggataaggggcttggggtgggggaggaatgttattccacacagggcagtcagggaggcctctctgggaaggggacatgtgagcaggacaggaagtgggtgatgaggggccagcccaggtggatgcgctaggtgaggactgtcccctgcagaggcagaggtgaggggaggatgagctttcactggggccaagtgagccaggggcagggtggccagtgatggggcatcagttcatggaagaaaggaacactgcctttctggggtccctcaaagccatgtgagaggaaggtgagtccaatttcatctctggaggagccaagaactcagccaggagtctctgtgggctgggcccagaatgtaggcttctccccgtccctagggggctctgaccgcccttcccccacctacctcccgaagccctccaccatccccaggtccaggtaaggagatgggcccctcagagaaggtgccaggaccttcccacccagattagagcggagatgcttctggttgcgccgcattctcagcaggatgaacgggcgcaatgaccaggttctgcgctcccttgcctgtccatgctcctgactcactctgtgacttacgttactttcctacgaagctccagaggataacaattccctcatcagaaaaaggaaggggtttcattcaccagggtccacctggggggcctttcattggaggcaaaagaaaagatgctgcagggcaggagtatctggagggaggagaggaacggagagacccccaacccctaggccgttccccacctccccccacccctgctctccaccctggcagtacacctggggttgcctctctaatcttttgggcagaaatttcactcttccttttccaggctccactcaaagcctaaatcttgtccagtggttcccaaattgactccgtggaacactgggtcaccctttgagcctctgcagaggagaggagggaaaatggtggaggtagggtttaggacaagggaactaggtaggcaggactggagcccccatcctgtttcaagcagagcatccttccttctaaggtgagcatgggctcctacacagcccttagccagaggggtctctctgccttctgactccagcagcaatgaacaagagtttgcactatccacttggcacttagtatataagatagttgtaaactcttcatgtgtgtttgagccttccctgccctaccccaagagagcaccctgtttcatccatcttggtaaatgtgatggttaactttaagtgtcaacttgattagattgaaggatgcaaaatactgttcctgagtgtgtctgtgagagtgttgccaaaggagattaacatttcagtcagtggactgggagaggcagacccacccttaatgtgggtaggcaccatctaatcaactgccaatgtggctagaataaagcagacttactgagtctcctggccttcatctttctccatgctggatgcttcctgccctggaaaatcggactccaagttcttcaacttttggactcttggacttaacaccagtgtttgccacgagctctcaggccttcggccacagactgaggactgctctgctggcttccctacttttgaggtttggggacttggactggcttccttgctcctcagcttgtagatggcctattgtgggacttcgctttgtgatcatgtgagtcaatactccttaataaactgccctttatatatacatctatcctattagttctgtgcctctagagaaccctgactaatacagtaaccaacgtctatagcagcaccaatagaaatataccaggagtcacatatataattttaaattttctggtagccacattataaaaaagtaaaaattcatgtaataaaattgcttagaactaaatacacagacttataaataagtgcatgcaaaattggtgaaatgagaattgatggattgtatcaatgtgaatttcctggttctgatattgtactatattgtttggggtgttttagtttttgagacagggtcttgccctgttgcccaggctggaatgtagcagtgctgtcatagctgactgcagcatcaacttcctgggtccaagcaatcctcccacctcagcctcctgagtagccaggactacaggcatgcaccaccacacctggataatttttttttttttcgtacagacagggtatcactctgctgcccaggctagtctcaaattcccggggtcaagtgatcctcccactttggcctcccaaagtgctaggattacagacatgagccaccatgtctggacatgatattgtactatattgttttgaaagatgttatctttggaggaaattaggggaagtggatacaggttctctctgtgttgttacagctgcgtatgaatctacaattctcaaaaagatttttttaaagtaaaaagaaacaggtaaaattcatttcaataatatacttattctaacctaatatattcaaatattatcatttcaacacacaaacaatataaaaaaattaaggagatacgtcacatcccttttttgtattatgtcttcgaaatccaacgtgtattgtatatgtacagacagcatgtctcaactcagacgcaacacttccagtgctcagtagtcacatggggctagtggctagtggacagtgcagggctagtacacaaagggcacacaatggatgctttctgcatgaatgatgaatgaaccaattaaccaacctgaactaagaggggcctgagattggacctgcagaatagcacctcaccagcagaagtgcaccgggtgggggtaggggcacatagatgtggggatattggctctgcaggcactgctgggtggaaagagaaccccctaaaatgaacttggattagaaggaggacaaaaacccagcctaacatggaaggaagagaaagcacttgggaattcttgcttcctttaaaccttcttttgggggttgtggggtgtggtttatttccaagaaatggcaatggtggtcttaggaagtattgatcctttgatctgctgaggaagaatggggagttggcaggttggaggagtgaggggagggaggtttggccttcctttgcccagatactcggcaaatgcagcacaaaatcagatggaataccaggctggagtgagcgtggatgcattttattctcccaggacaccccccgctgacccagtgtggcattaaacccccagaacccccacagtgtggcatcccatacacatatcctggcttacctgccttatttccattccctccacccacacagtccaggggctctgcaggacctgtgggccccctggaaggagccagcaaagcccagcctgagctgttctcctgagggaccagtcccttgtgccccacgtcaccagagctggaagagaggaagccaccttgcccacccactcacactgcatgaggctaaacagagaccagacaggccgtcagtcagcttcacagagctatggtgtctaaaaagaaactttcaaatctttgatagcttccatcacctgctcctcctgcctcaacacctcagcctgtcccccagatatccccaaatccagtctctgagacccaccagttcttcaaagcctctgtcaggtcccaccagggtactcccaccccgccccattgctgtctcctctgaaacctacaagatttatagtctatgccacaaaattgcgagtttatttatacactgtcttacataatttttcatgtttgtctctttaagtgttctgtaagtttcttaaggacatgaatcataccaaataattctttagtagcatcccctctcccccagcgcaaagctgagagggcgtttaacgaatgtttcttgattgttaggataaagtttcaggattcccttcgtatgaatccatccattcaacaattagtgtcaggcactgtgctaggacctgagaacttagagatgaataaagcatctcttacaagggtcttaccagctgtgtgactttacacatgttacttcccctctctgcaagaatatgaaatgaggaagactatgtatttaataggactatggagaggattaaatgaaataatcttcatttaggattagcttcttaggttagaacctgcctcatgatcccttagtgaatgttaataattaattttttttttttgagacagagtctcactgtgtcgcccaggctggagtgcagtggtgcaatcttggctcactgcaacctctacctcccaggttcaagcgattctcctgcctcagcctcctgaggagctggaattacaggcatgcaccaccacgcccgaataatttttgtatttttagtagagataggatttcaccacgttggccaggctggtctcaaactcctgacctcaggtaatctgcccacctcggcctctcaaaatgctgggattacagacatgagacaacactcctggccaatagttaatattattacctcatgaatccttcacctgtggggaggaggggtgtccctagggtaataggtagggttaagagctaaattagagaattattagataagaagtgaatgacctggatacatcaaaaagaagaaattaaattctctaagaggtaaatccctggaaaatagaaatgtcaaaaaaaaaaaaaaggtgggtggggcaaggaagaagagacggaatccgggagtaagagggtatcactgtgctcctgagagatatctgaggaaggtacaggaaactcacatccaacacctggtgcagggctgggcatatggcaggtcagagccaggattagaggaaggccagcaaggcacccagcacacaacatttaaagaggtcctcattctcaggctcatgtaagtacaaagttaacgcctgagagtagaggccaccttaaattttgttccctggatcacttgctggcctcacctcatctcagttttgcagcaagtgctcaggagaaacttgctctgaccagcgaaactgtaaagtcactctgctgacccaccacacacccaggctgcagtcagagcagcatcccttctttccagggcaccctccccctcgagaaccacactctggatagatcctccagtccctgtggtcccaatctcctggggctgtgcctgtttctcggggcagtcgaacagaaggctttgtcccctgggtcgggggagagttggctcagtgatgagggccttcgaatatacacatgtaggcagcacaaagtcaggctgtacttttccttgacccagtttcgcatcctcaagtctcaggcctgcactagccacatgcaggcagcccagctttttgccctgaaggtgcaggagagaggaaggctggagggaagacaaagcataggagggtcctctgtacttgaggcaggacaaaactcctggtctcatttcctgtccactgcacaatcacatagaaaagcaatgggacagtgctgagcaggatgtgctaagtagagacaccatggtgctgtgaattcagaggagagaaagaacaccgtgggctgagaccagaaagagaagcaggatttggactgaaagacagctgggaggggacagcgggtcggaggcagcgtgggtgaaggcccagagttaggacagatgtgacatgcgtaaaagacccttcactggccgggtgtggtggctcatgcctgtaatcccagcactttgggaggctgaggcgggtggatcacctgaggtcagaagttcaagaccagcctggccaacatagcgaaaccccgactctactaaaaatacaaaaattaaattggcatgagcctgtaatcccagctactcaggaagctaaggcaggagaattgcttgaacccgggaggcggaggttgcagtgagctgagatagcgccactgcactccagcatgggtaacagagcgagactccacctcgaaaaaaatagatccttggctgacaggggagaaacattcaacttccagagtgggcttcagcacagactgacaattaggcatgagatttttgtttggggaacagagacattcaaagatttctatttccaacaaagtggccaactgagaagccctctggggcaggtgctgtgacataccccaccacatcaccttcgggaatgaaggacttctccccacctgttgggggtgccatgagccgacagccctcagctctcattcctctttgagaattgccacaggtgagcagagccaccttgctcaaggttatgtcctcttccagggcatatacctcttccaggtataaaggtcaggccccctcaccccaactctgggcaagtatgaagagacagcccagctccagggctgcctatggggtccactgaggctttctctggaactgtattgcagctcaatttctccctatggccagtcatatttccttctctctttctcagatattgatcccaagaacacttctcaataaacatcctacactctaatctctgactcagagtctactttccagggaatccaatctgcaacatcctcccaataaaaaacactaaaataacaattaaaatgtcttttaattgccttattaaattgatgaatagtctggcaagaaaagaagtagtagatgcattcgtcagccaatctcggtgattcatgcttcccttgtaatggccaaagggccctcccaaggagggtcacactgggaacctcctcctaaagccaagaaagcacaaataatgcaaaagagaagaagggagaaaaggcaaggtatgtgaaacacacaaaatatgatggcagaaataaatccttagtcatcagtaatcacaataaatgtaaatatactaaactttctaagtagaagacagagattgtcagactaggtattaaaaactgtaagtatgtgctagttacaacagacatagaatgaaagacatgcaaatttaaaaaaaaagattcaatatcataaatatcatgttctctcaccacaatacctttgagttaaaaaaatcaaaaagataaggaaaaacttgaagcctctggacattttaaagcacttctaacttcatgagtgagtaaattatgatagaaattagaaaataattggaattcaagatattgaaaatacatctggtatttactagctgtatgaccttgaacaaattacttaacctcactgtggctcagtttcctcatctataaaatagcccctggtaacagtatctattacttgtgttatatggattcagtatgttaacacataaagcacatggactagtaactggcacatcgtaaatgcaatgtcgttctgagttcttgttatcatcatcatccccaaattgaagagatttaattaaagaaatatttagaggaaattttataacttcaaaagtttacattagaaaatagaaagactgttaactgaagagctaagcacccaacttaggaagttagaaaaatgacagaataaaatcaaagcataaaaattaataaaatagaaagcaaatatccaagagaaaatcaacaatgccaaaatctgatcattttacagagacaatgtaaaaaacagaaaaagaaacaagtaaataatgttaagaattaaaaaggggcaaaccgatggatatgacagagatgaaatacagcatattataaattttgccaataaacttgatttcttttaatttctagaaaaatataatttaccaaaattgattgaagaaatagaaaacttaaatactcttacaattactaaagaaatggatcagtaacttgattaataagtcttaattagtaagacttaatggattagtaaagttttcccatatggaaaacattaggtgcagatggttgtagaggtgaggtctaccaaacatttaaagaatagatgaatctcaaaaacgtgcataagtcattacagagaataaagttttaacattctcaactcatttgcaagactgattttaaaaccaggcaaagatagcatgataagagaaaattacatccaatagcattcaagaaacagaacagatcatcctgaataaaaataatagcaaacaaaatctcacatcatataaaacaaataatataccataaacaagctgggtttacccctaaaattataagttgaacatctattaaagtaattgaccacatcaaaaggttaaaggggaaaaactacacaccattcaatagatgtagaaaaagtacttataaaattaatatctaaatacaatttttggctggatgcagtggctcacacctgtaatcccagcactttgggaggctaaggaggatggatcacctgaggtcaggggttccagaccagcctgagcaacatcgtgaaatcccctctctactaaaaatacaaaaattagctgggcatggtggcgcatgcctgtaatcccagcttctcgggaggctgaggcatgagaatcacttgaacccaggaggtggaggttgcagtgagccgagatcaagccactgcatccagcctgggtgccagagcgacgctccatgtaaaaaataaataaataaataaatataattttcaaaataagaaaaaacaaaacttttaacacattctacaaatgtgtggaactttacctattagaaaatatcttaaaaaaataagcaaacatattcaatgatgacacttttttaacattccctttacaattaggattaatcataccatatacaaaaattaactcaaaatgggtcaaagatctcaatgtcagagctaaaactgtataatacttagaaaaatgtttaagtgtaaatttttgtgatgttggattaggcaatggttccttagatatgacacctaaagcacaagcaatcaacaacaaaaaaaaaatagcagaattggacttcataaaaatgtaaaacttttgtgcttcaaaggaacaccaaaaaagtgaaaagacatgttttgcaaatcacgtacctgataagcgacttatacttgaaatatataaagaactcttacaactcaagaagaaaaagtaaaataatccactttaaaaataggcaaagggacctctgtgggcagggcatagctgaacaaaaggcagcagaaacttctgcagacttaaacgtccctgtctgacagctctgaagagagcagtggttctcccagcatggtctttgatctctgagaacagacagactgcctcctcaagggggtccctgacccccgtatagcctaactgggagacacctcccagtagggactgacagacacctcatacaggcggatgcccctctgggacgaaactttcaaagaaaggatcaggcagcaatatttgctgttctgcagcctccgctggtgatacccaggcaaacagggtctggagtggacctccaggaaactccaatagacctgcaggtgagggacctgttagaaggaaaactaacaaacagaaagaaatagcatcaacatcaacaaaaaggacatctacaccaaaacgccatttgtaggtcaccaacaaaccaaaagtagataaaaccacaaagatggggagaagccagagcagaaaagctgaaaattctaaaaaccagggtgcctcttcccctccaaaggatcacagctcctcgccagcaatggaacaaagctggacagagaatgactttgatgagttgacagaagaaggcttcagaaggttggtaataacaaacttctccgagctaaaggaacatgttctaacccatcacaaggaagttaaaaaccttgaaaaaaggttacaggaatggctaaactagaataaacagtgtagagaagaccttaaatgacctgatggagctgaaaactatggtacaagaacttcgtgatgcatgcacaagcttcaatagccgattcgatcaagtggaagaaaaggtatcagtgattgaagatcaaattaatgaaataaagcaagaagacaagtttagagaaaaaagagtaaaaagaagtgaacaaagcctccaagaaatatgggactatgtgaaaagaccaaatctacattcgattggtgtacctgaaagtgagggggagaatggaaccaagatgggaaacagtcttcaggatattatccaggagaacttccccaacctagcaaggcaggccaaacttcaaattcaggaaatacagagaacaccaaaaagatactccttgagaagagcaaccccaagacacataattgtcagattcaccaaagttgaaatgaaggaaaaaaggttaagggcagccagagagaaaggtcgggttacccacaaagggaagcccatcaactaacagcggatctctcagcagaaaccctacaagccagaagagagtgggggccaatattcaacattcttaaagaaaagaattttcaacccagaatttcatatccagccaaactaagcttcataactgaaggagaaataaaatcttttacagacaagcaaatgctgagagactttgtcaccagcaggcctgccttacaagagctcctgaaggaagcattgaacatggaaaggaacaaccggtaccagccactgcaaaaacatgccaaattgtaaaaaccatcgatgctatgaagaaactgcatcaattaacgggcaaaataaccacctaacatcataatgacgggatcaaattcacacataacaatattaaccttaagtgtaaatggactaaatgctccaattaaaagatatagactggcaatttggataaagagtcaagacccatcagtgtgctgtattcaggagacccatctcatgtgcagagacatacataggctcaaaataaagggatggaggaagatctaccaagcaaatggaaagcaaaataaagcaggggttgcaatcctaggctctgataaaacagactttaagccaacaaagatcaaaagagacaacgaaggtcatttcataatggtaaagggatcaattcaacgagaagagctaactatcctaaatagatatgcacccaatacaagagcacccagattcataaagcaagtccttagatacctacaaagagacttagactcccacacaataataatgggagattttcacaccccactgtcaatattagacagatcaacaagacagaagtttaacaaggatatccaggacttgaactcagctctgcaccaagaagacctaacagacatctacagaactctccaccctaaatcaacagaatatacattcttctcagcaccacatcgcacttattctaaaattgaccacatagttggaagtaaagcactcctcagcaaatgtaaaagaacagaaatcacaacaaactgtctctcagaccacagtgcaatcaaattagaactcaggattaagaaactcactcaaaactgcacaactacatggaaactgaacaacctgctcctgaatgactactgggtaaataacgaaatgaaagcagaaataaagatgttctttgaaaccaatgagaacaaagacacaacataccagaatctctgggacacatttaaagcagtgtatagagggaaatttatagcactaaatgcccacaagagaaagcaggaaagatctaaaattgacaccctaacatcacaattcaaagaactagagaagcaagagcaaatacattcaaaagctagcagaaggcaagaaataactaagatcaaagcagaactgaaggagatagagacacaaaaaacccttcaaaaaatcaacaaatccaggagctggttttttgaaacgatcaacaaaattgatagaccgctagcaaaaccaataaagaaaaaaaagagagaagaatcaaatagatgcaataaaaaatgataaaggggatatcaccaccaatcccacagaaatacaaactatcatcagagaatactataaacacctctacgcaaataaactagaaaacctagtagaaatgaataaattcctggacgcatacaccctcccaagactaaaccaggaagaagttgaatctctgaatagaccaataacaggttctgatattgaggcaataattaatagcctaccaaccaaaaaaagtccaggaccaaacggattcacagccaaattctaccagaggtacaaagaggagctggtaccattccttctgaaactattccaatcaatagaaaaagagggactcctccttaactcattttatgaggccagaatcatcctgatactaaagcctggcagagacacaaccaaaaagagaattttagaccaatatccctgataaacatcgatgcaaaagtcctcaataaaatactggcaaatcgaatccagcagcacatcaaaaagcttatccaccacgatcaagtgggcttcatccctgggatgcaaggctggttcaacatatgcaaatcaataaacgtaatccatcacataaacagaaccaacgacaaaaaacacatgattatctcaatggatgcagaaaagtccttcaacaaaattcaacagctcttcatgctaaaaactctcaataaactaggtgttgaaggaacgtatctcaaaataataagagctatttatgacaaacccacagccagtatcatactgaatgggcaaaaactgggagcattccctttgaaaactcacacaagaaaatgatgtcctctctcaccactcctattcaacatagtgttggaagttctggccagggcattcaggcaagagaaagaaataaagggtattcaattaggaaaagaggaaatcaaattgtcccggtttgcagatgacatgatcgtatatttagaaaaccccattatctcagcccaaaatctccttaagctgataagcaacttcagcaaagtctcaggatacaaaatcaatctgcaaaaatcacaagcattcctatacacaaataacagacaaacagagagccaaatcatgagtgaactcccatccacaattgctacaaagagaataaaatacctaggaatccaacttacaagggatgtgaaggacctcttcaaggagaactacaaaccactgctcagtgaaataaaagaggacacaaacaaaatggaagaacattctatgctcatggataggaagaatcaatatcatgaaaatggccatactgcccaaggtaatttacagattcaatgccatccccatcaagctaccaatgactttcgtcacagaattggaaaaaactactttaaagtccatatggaaccaaaaaagagcccacattgccaagacaatcctaagcaaaaaaaaacaaagctggagacaccacgctacctgacttcaaactatattacaaggctacagtaaccaaaacagcatagtactggtatcaaaacagatatataaaccaatgtaacagaacagaggcctcagaaataacaccacacatctacaaccatctgatctttgacaaacctgacaaaaacaagaaatcgggaaaggattccctgtttaataaatggtgctgggaaaactggctagccatatgtagaaaactgaaactggatcccttccttacacattatataaaaattaattcaagacggattaaagacttaaatgttagacctaaaaccataaaacccctagaagaaaacctaggcaataccattcaggacataggcctgggcaaggacttcatgactaaaacaccaaaagcaatggcaacaaaagccaaaatagacaaatggtatctaattaaactaaagagcttctgcatggcaaaataaactaccatcagagtgaacaagcaacctacagaatgggagaaaatttttgccatctacccatctgacaaagggttaatatccagaatctacaaagaatttaaacaaatttacaagaaaaaaacaaacaaccccacctaaaagtgggcaaaggatatgaacagacacttcttaaaagaagacatttatgcagccaacagaaacatgaaaaaatgctcatcatcactggtcatcagagaaatccagatcaaaaccacaatgagataccatctcacaccagttagaacggtgatcattaaaaagtcaggaaacaacagatgctggagaggatgtagagaaataggaacacttttacactgttggtgggagtgtaaattagttcaatgattgtggaagacagtgtggtggttcctcaaggatccagaactagaaataccatttgacccagccatcccattactgggtatatacccaaaggattataaatcatgctactataaagactcatgcacacatatgtttgttgcggcactattcacagtaccaaagacttggaaccaacccaaatgtccatcaatgatagactggattaagaaattgtggcacatatataccatggaatactatgtagccataaaaaaggatgagttcatgtcctttgcagggacgtggatgaagctggaaaccatcattctaagcaaactatcacaaggacagaaaaccaaacactgcatgttctcactcataggtgggaactgaacaatgagaacacttggacacagggtggggaacatcacacaccggggcctgtcagggggtggagggctgggggagggatagcattaggagaaatatctaatgtaaataatgaattgatgggtgcagcaaaccaacatggcacatgtatacatatgtaacaaacctgcacgttgtgcacatgtaccctagaactcaaaagtataattcataaataaataaattaattaatttaaaaaaataggcaaaggggctgggcgtggtggctggctgggcgtggtggctcattcctgtaatcccagcactttgggaggctgggaagggtggatcacctgagattaggagttcgagactagtctggccaacatggtgaaaccctgtctctaataaaaatacaaaaattagccaggcatgatggtatatacctgtaatcccagctactcaggaggctgaggtgggagaatcacttgaaaccgggaggcagaggttgcactgagctgagatcgcaccattgcactccagcctgggcaaaacttcctctcaaaaaaaaaaaaaaaaaaaaggcaaagaatctaaatagatatttctccaaagaagatatgcaaatagctaacaagcacattaaaagatgctccacatcattagtcatcagagaaatgcaaaatcaaaaccacagtgagatgtcacctcaaaaccactgagatggctataatccaaaaaaaaagataataaaagtgttatcaaggatgtagacaaattggaaccctcatacaatgctggagaaaatgtaaaatgatacagccaccttggagaaccctggcagttcatcaaatggcaaacacagagttaccatataaccagttctactcacaggtataaacccaagagaaatgaaaatctatatccacacaaaaacttaacataacagtgaaaaacaactcaaatgtctatgagttgaagaacagagaaacagaatgcagtctatccatacaatgaaatattattctgcaataagaataaatgaagtactgatacatgatatgacatggatgaaccttgaaaacattctgcttagtgaaagatgtcaatcacataggacaacatagcatatgattccatttatatgaaatgctcaaaacgggaaaatctagggagacagaaaacaggttagtgcgtttgctcattcctaggactaggagggataggggtctgggaagcgatggctaaggggtacaggatttcttttgcagagtaatgaaaatgtcctaaaattgactgtggtggtagatgtgcaactgtatgaatatattaaaagccatttaactctacactttaagtgggtaaattttatttcaataaagctgtcaaaaaaagaaagaagaaaacgatgaggactaaaatgaggatgttcactccgacacttttattgaatattatgtcaaaggtcctagccactacagtaaaacaagaaccatatattaaggtataatggtagtaatgaaagaaagaaaaatgtctacatagaaatccccagataatcttcagataaactattatcagtatgtgcataatcaaggttgctgattataaaattaatacacaaaaaacaaatttatttctatatgccagctacgaatggttagaaaatataactttttaaaagataatttgtacgataataaacattttacatagtttttaaatagttaaaaactatatagctagacatgaattgttacggactaaataattgtttgtgtccccccaaaattcctatgttgaaatcgaatcccaaggcaatggtatttagaggtggaggcttggggggatgattaggtcagagagtggagcagtcacaaatgggattggtgcccacataagacgaggccagagacttagctacctctctttcatccccacatgaggaaacaagaagtctacaacctgcaggagggccctcaccagaacccaaccatgctatcaccttgatcttgaactttcagcctcttgagcaggagaaacaaacatttgttgcttaagctaccaaatctatggtaatttgttatagcagcccaaacaaactaagatgtaaatctaacagaaaacattcaaactctttatggagaattataaaactccattgaaagacacgggaagacattcaaggcccaaggttatttggttttcctgagattaagtttaaaagatagactcagaccagattattaaaatctaccatgtcttttttcctacctttaaataaacattgccctttccctgtccctctgttaaagtgtaaacacctgaagttgtaatactctagggctgtgagcttatatgaagatttcagcactaacaaaggggattggggtcagtgggggacttaaaagaagacggaacaatttccatgcccctcattgtggaaaatctttcttttaatgctttttcttctcagcattgacacctagaaagggtaacctgcgctccctgtctccacattgtctttccccactcactccctgcccactgaaataggatcctgtccccacttctctctcccaaactgtctttgcctctactgccaacccagcagacacctcaatcctatcccacccgagccctcttcctggcatgccacagttggccactctcactctgacgccctcgtcccttggtttccttaacacctccctctcctcattcccctccacctctctccagcctcggcttccagagccagctctcctctctcgaccccttataggtgcagacatccttcaaggctctcctttgtgcccagacccatcatcattttccactctgctctgtccttggtgactcatccaatcccattgctcacatcagtggttttctaactgagggtttcaacccaacggattgtaaaatttaatgggttgctctcagatttttttaataaaaactctttttattgtggcaaaatacacaataacataaaatttaccattttaaccatttttaagtctacagttgaatgtcattaagttcattcacattgctgtgctaccatcaccaccatccatctccaatactttctcatctttccaaactgaaactccatacccattaaaagatgactccccatcccacacccagcccccaggaaccaccattctactttctgtctttatgaatttgacaactctaggtctctcatatcattggaatcatagagtatttgtcctcttgtgcctggctgatttcacttaacacaaggtctccaaggttcatccatgttgtagcacatttcagaacttcctttctttttaaggccaatattccattgtattttttaaggaagtagaatggatttatttatttatttatttatttaatttttaaattttatttatttattttttgagacagagtctcgctctgtcacccaggctggagtgcaatggtgcgatcttggctcactgcaacctccacctcccagtttcaagcaattcttgtgcctcagcctcctgagtagctgggattacaggtgtgtgccaccacacctggctaatttttgtatttttagtagagacagggtttcaccatgttggtcaagctggtctcgaacccctgacctcatgatccaccagcctaggcctcccaaagtgctgggattacaggtatgagccaccgcacatggcaaatggattttttaaatgaagtaaaatagaaaacattagagtacatttctcgtaataaggccaagtattgcttcacaaaatgtttcagttgagtgtgtacataactgtgttcaaggtctccggctataacatatgccatactgtgcttcccaatcataaaagtttgaaaaacactgatgtcagtggttggtgactccaaatctacattactagtctggctcttcccaacgcagttctgggtagctccacgcacgaggatccagacccacagctgtcaccctccccgctccctcccagacacgccatcctcacagggtccctactttcttctcaggaattgggccctgcctgcctcactctgtccccagcaatatagctctaacccctgagtcatgcagattcactcaactcttgcctgcacttgtcaatccttgctcaaactcggtttcatcccccttcctttcacttctgcctatgcctgtggatcattcccctttcttgaagaccccttcaaatgcctccatgtaccttgaaacacagtgattttctctggcgcctcctccttgtttttagagtccctcgtccattcctctaggcgtgcctttctgtcttcccaatagccaccggctccctggagaccctggactgtgcctgccttgcacaccattgtatccctagcacttaaagagtaaatctgcatgaagtatttgttcaatcaatcaaaacagacatggagaagccaagagcatcaaggagtacgttcacaactttgtttcttgtctttttctcctcattcacatagcacatgctttctccattagagacactgagcccactaagccacctgcactgccccaccttctcccctcctgaccaagggaggtgctgcaaatggacccccagagttctgactgctctcaatggggtcctcccaaaagctctggttgcagagcacagggagagcccagggtccaaagaagtaagcacacatcgactcacagccccactgccatttgctctgggctgtcgctaaattctccctggaagagcctgcctttgctgtgtccctgaaatctttgtgaggtggcatcgcaccagctcagcacagaagcaaagaatggcagccttcaggaatcccctggctctgaagtggacctgctccctgcaacaagttcttctcactttcactgggctgtgacagtacctcccagcctctctacctctttaacccttcctgtaggagacccagctaacatccttcttaggggcttttatcctgccattaccctactccagggccaaacacagctcccaatggcccaatgaaccaaatgcaaattgttcttctcaatcttcaaaacactttgctgaggctagtgacccactgttacatctgccctcttcgtcccttccttccacctcacagcagttgtatccatttcttcattgtgtctcttcctgttacaatccctgcgcgcacacacatagtcctaccttcaattatttattcattatccaatatttattgagaacatcttatgtgctggacaccaagtttggtgttcacagtgcagctgggaacaaaacagagcaaattggttgggcgcagtggctcatgcctgtaatcccagcactttggaaggccgaggcgggcggatcacaaggtcaggagatcaagaccatcctggctaacaggctgaaaacccgtctctactaaaaatacaaaaaattagctgggtgtggtggcaggccactgtagtcccagctacttgccaaggctgaggcaggagaatggcctgaacccgggaggcagagtttgcagtgagctgagatcgcgccacggcactccagcctgggtgacacagtgagactccatctcagaaaaaaaaaaaaaagaaagaaaaagaaaaaagagcaaatccccactgcatggagctttcggtctagagcagtttctcaacctcagcactactgacatttggggctggaaaattatttgttgctgggggcaaactatgcattataggtctttacaacctctttggcctcttccctctgcatgcagcagcactctcctctccccagtgtgaatgccacagaagtctccaaacattgccacggggaataggggattgagaaccactggtctagagcagcaggaggagcttgttgcagcttgcagatcgcctggggagcttgttacaaaggcaggttagtagatctcacccgaagacagtcagattcaggggctcaggagtctgcatttcaatggtcctccagttggttctgattcaggccctcccagagcctctgcttgaagaacactggtcaagtgtttgtagacaggagacagactgatgataatcacatcaggccagttcattacaatcatgatatatggaggaaacaagataggtaagcaggtgctaggggtgacactgatgtgacagccacatccagttcaagatcaggactaaccaatgattaagccaagtgctgcagtgtaggtagggtcaggtgtgggagagacgggaggaaattgtgacacacttgcatctctgcacctttgctcctgcccactttttggatgtgcatgccccctgcccccaccctcaaatcttacccttccttcaaggcccactcaagttcaacttcctctgggcacagtcttgcctaacttctccagcctatcagtgcttctcttctcagacagtttaacattcactttctgtttcatttgtggctattttgttgccccaaatagacttcgagtcctctgagtaccaagaccacatcatctccttctttacagacccttatctacaggcacgcttccaggatcagccctatacaagttttgcctggttgattgggttgagtctctagagtgaggcctgcaagatagcatctatgcgattcagggggtcagggtctctgtgagggaggaagggaagcaccttgtgtgcctgctgaactcctggcagctagcccacccacccaagaccagggaggacttgccagagcaagcaggtagtttggttggcgtttgccatgggcggttgtattttccccctgttgacaaggcagaaggaatcccagcagccccagcaactttggggaggtgccgggagggggcaggaacccagagctgccctgctgaagagcaagtgccaagacagcagcaggcaatcggcctgcagggccgcagcaagctgtgggggacccagctgtccttgcataggatcatctcaggggcagcagtagccaaaacaagaggcaggcccaatcagatccaagaagccaggagactccgaagatggcctttaaagccaccagtgtcagacagcactcaggagctgccaccaaccagggaacgctccctgggaaggtccggagcagcaactggctgtaaacaaatgttcagaacaaggtgcctcattactccccagctccgggggagttacaaggaggggaaacagcctaagtgctcggcttttccactggacagcgacacctagcagcgatcctcaccctcccaccttcgtgggcagcccagattgggagcacccatacctgatgtatccacctcacccaaaggatgagaagagggctgtttcgttatggggaagtttagagaagaaggtgggatgcttacttagctagagagacatttattttcctatcaacctaggggaggggcggtgagagtagggagacactagcagcaaactaaaaaacagcccagcagctaggagagagggctcttgccaagagaggctctgatatgggtgtatcctagagcaagaacctcccctaatctctcaaaccaggcggaggaaccccaagtgtttccttaagccagcagagccggcagaaggaagtggctggcatttcagtgtatcttctgcaaatagagaggctgaggctgtgcccgaattgaatttctgagtgacacctcctactgctctttctcttggagtttaaccgtggattggggtggagtagggggagagcccaacgaggggttaacttatgctgcagctctgaccttttgcgctaaggatgagaaaaaaaaagccatctgtttcagaaggaatcaggttgttgagtttcacagatccagtggctgtgggattgtaagacttcactatcactatccctgtcgcatagccacagcccacactaccacccccaccgaacccgaagctcctggaggggaaaatgctttttctcccaagggtccttacgaaagttcaggactcgcgaggttataaacaaacaaacaaacaaacaaacaatcgatacgattttgagccctccgaccccggagtccaaacaaatggccatagaactgtgggtctggaggacaccgctccgatccatgcggtctctccgggtattaaatggatttatcgtcagcctggttgcttggaattctattctgtccttcatttttcacagcggaacaaagttgtctggaccctccagccagcgctgggcagaagcaagcaaggatgctcttggaaacgcggtggcccaagcctaagcggccatgctcggggctaggagcggaccccacggccactcaccccggggcgctgcgaccgaagctgccgcggccactgccacccgggggctcgccggccggctccgcgcatcccgccctctcaatggactttcttacctcttaatgtagttcctgccatacaggatctgttgcagcaaggtcaccaaggcaaaggcgcagatgaagatgaagagcaaagttcggctccccaacaaatcccggttggccgaggggtccgcgtagcgcatcctggctaccgggcgccgcgggcgcggggtacggggcggccaggcaatgactcgcggggttccggggccccggggggcgcgcggccgacttggcgcctcacggtgcggtcaggcaggcgggggacttcgaggggcaaagtttctggttggcgcggccggagctgggggcatccaagcgtcgcaggcgctggggcggcaagcaggacagggccggtggcagggagctctgccgcggccaggggccttccccacccccgggtacctttacctccaggcgccggtgccgggtagccgccgatttccccgcggaggggagacgccaggtgccacgagccggaggcggcccctcccgccgaggtggcggccaatggggagcaagacccgggctccgtcccctgtgcgccccagcgcgccgcgcatcgacccctccagtccggcgccggatcgcggttgcccagcgcgctgtgccctgccgggggcgggccacgtttgatctccgggcccgcagcaagggatcgcgaaggttggcctccggttctgccgatagggacggggggagggggcgtac

SEQ ID NO: 392 - DNA, 107474 bp, Homo sapiens
tttcaagatgataaacttcaaagtgtattttttaaaatgcaagttgcctgtatgaaataaattaaaaatttatatgtaatttcagtgtaaaacaccaaaaccgaacattaaaactgttcacagaaaatagaaaaaaaaacaaaaaaacaaatcacaattataaaagcacagagatatcagttataagaaccaagtaaataaactaatttctattaatattttcatttactttataaaactttgttgattaaattgggggagtctctgacaatctaaagggtaacaaaataacaaatatacatcatttctttataagtcataccacacaaaccaagttaagttttttctatctgattacagagtcaataaatattgcatctgtatttagagcagcaacataaaactttattagaaagaaatactatatctggaccaaaaaactgcaacatggtttggaaatctaatgactaagaaggtaaaactggcaactatgtgcaactactgctcgtagatttgggtttgtttcccccccaacatctttaaaataagcagcccccacaaagggataatccattgaataaggagacaatgtagccaaagaagggatttgtggaaaaccatatgaatttaaatcaacataaaaagaacacacaaaggccatggaaacttgagaaggtgaaagaaaaaaaaaaaaaaccccaagcaaggacaagtcagctccttggagctgcaccaactcttaagtaggatgtccctattctaacggaaattgatgagtccacacctgggcacttcagtttgagaaatcaattggttggactggccattaaaaaaaggactttgtttttaaggtagataaagcttagagagagaaagctaaacagaaaagtaccaaatccttgtgaactcaaaaatgatttaggaagtcaaatgaagcaaactaaaaaactggatgaaaatgtttctctaagagtaaaacccagttttctctgtgatttaaaatcaaacaaacacactatagaagagaaattttcaaagtgcacccaataaaacctcagaggttccctggagtgtttggggtagcatggattgagacaggaagtgggttcaggcccatctcccccaacccttcttcactttaattcaaacatttctaattctcttttgtcgtttgtagtttcaggtaagatatcattttaaaaaaatgaaaaaaaaaaaaaatctaatgctgtccctttccctaagtttgaaaatcactgctgagactgaaattacattggtgagaaatatgatcatcataaatctaaaacacattttctatgtagtgctaccaaaatacaaagtttcatcaaatatttcactactattctgtaaaataaatgagaaaattaagttgttgggaagaaattaaattttgttattaccacctcccaaaatctgctcttctgctggctccaagatatcaatatttgatagtgtgaacaaatttctaacaaacattccagtcacaccgtaccccaaagacatttcattcaatggctgcatagtttcttttttgagaaggcaagcctcaaatttatagaaaactctagaatgaaaaatgtacaattactaaaaacataataacacactttatgtcagggcagaatctgcatagtgcttttaaacataatcaccaatgaagagtagccaaatcccagaacttcacacagcactcattagcaaacaacgtcaaagtgtaaatgataagcaggaaaaaaaccaagtaacacgaatgccatttttctttgatgcaatcacgaagaaaagtggaaatgcaggacgaaaagtggaatccaagctttggccacgtactgaaacttcattacttcaatgaaacagagcaaatctccatggaaaggactcattcagcaaacattaagttctttccatatattttttttccttcacgtaaggttaaacagaagttgctgtcattctagaatcagtgattacaattttttttttaattagaaaaaaggttacttgaatatttacataattttattgctctttattttaacaaaaacttttttcactgatttgtagactccatccattaacgtatgaaagtgaaatccatctctcaggaagatacagttatggttgaatgtatctgatgctgagagtacagcataattaagaaaaatccttgcatgtcatttggttcttgttgcagtcttctgtgttcacccctcagaaagcaaaagaatccatctgactttcaataaataccaaattattaaaaaaaaaaaaaaaagaacgtttccacagactagagatccaagaaaaagcagttctgatgaatgattcccagaatcaagtgagtcctcctttagtccaatgagatgatgtcaggaatgttacttccactgctggttatgacccctgtctcactcctgctgctggatgaactaacatgagtactgctttcatgggagctggtggtggtgacagacgtactgcttgctgttaagggtgaggtgagactatccaaaaacataggaggacagtactgcttgaaacaaacaatgatgccaatgaggaagaggctacttgattttaaataaagagactagaaattattagatatgcacaagcaatagtcacatatttaaatcccagtgggatttaaaaattgctcaaaacttcacatctttgggtggaagatagcatgaatttagctattttacattatttagagaatgcagcatatattcttgattctctctaaacttgtggaacttgtttgctgaccacatacaaaggtaaaagtacaatgtcaacaataactgaagtcatttaatactaaatattggccctaatctcaaaaagaatttgctccctaactgtatttagttgggtgtcaattttgaaagaattgttgatcttacaccagcatttttgcttaataacatttttaaaagtatttgttagcctttcccggtatggattgagtatcaaacagatcctttatgaatgttaaggctgaccagctgaatgatggcattggactcctttgtacataaacgtaaaatacttgtgtcatcagaatgacaacattcattctaaaacacagactacacggtagctagctatcacaggatcctcaggacagaaaattatctcaggtaatcaccaagttttgcaataaatgttaaagaagatctaacctaatcttctcgtgatgcctgcttaacacccctttcctagtgctcatatttcacaagtccccttacaatcctggttactgatcccattactgatcccaaacaagtacaaacctgaatgtactactctaatattaacagaggagtgaagagagacaagccaaaagcattatatcagtatagaatatttttatgtgagaaacgactgcactgactttagtaaaacaagaggtctagtgatatcctgcaagagatggtttaagtttgtcattagttcaactgtatgaaagatcagtaaggatatctgattcatattccccattctaaagattatgcagcttatcattagagacactggattatggaacaggaatttaagtcaagttgtttagactacatgatttccaaggccggtgaataaaacaggaacaacagtcccaggtttaagttgccagccagagggacagcaacaagtaaaattcagactgctcttcaaaagaacaagttatttaatgctttggatagataactgttttggttcatcaataaaatgaatgccacatacagagtcaagggacattagttacagggagaacagttcttaaagagcttccaaggagctctaaagatggttgaattgtccagtattaaaactcttttctaaaatcaaatcaatttctaactttccactaaaactggggggtaaatctagaacaaagcccagaaacttacattttattcctgctgcctctcaggtagtttttgattgccttataggaaaaagatactcattcatgaaagttgtgctagatgctacagtgctgccatcaacaggctctgtgcgttgaattcttagtagtattcagattgcagccacttaagttctaaccctgcatccctaattgtagctacaatgacaagaattaagggataatatggaggtcaagtagtaaaacctaaggattctatggcaaactgaaggccccacatcacccttctactactgactcaccaaataacttagaccactactaaatatacaaaacagagctatgaaataaaaacctctaggttccaagataattttttttaaaagaactggtcacataaaaattagtaatcctcacatctgaagaatccatttcctagaaaaatacatagacactttcactaggtaccttcgttatatatactgctgtaatgaggtcaactccgaatgataagaaattcctcagtctgcacattaccttgggcccaaatttctgctgctgttcatgtaatcagatacagagtactgaaacaggaggctgatacaggacttgtgcttagctgactgagcagcccatgaagcagtgacccgtggttcttcctctatccctccctatactcaactcctctcaaagtcttttgttctatgtcattttctcccttcacttttctcatgccttctcctcctctgctctgcctctgctataagcctgtctgtgcaatccaggctcactgcaaggtcttcatgttgggacaccgagctactagggtttctcatctttgacagagaaaacggggatgattgacatatagcaactttaaactggggcctccccaaagtccaaatctgaatgtctttaaaaacaatgaagaatcaagttaatgagtcaagtctgtctaatcaggtttagctattgattttctatatacagaatgttttagctaaaaaataaaactgtatttgtaaaattttaacttctagccacccagcactgcttctattcattctaatcattcaaatgcttgtaggagatgccaactgattaagctaaataaaacagaatttaaaatttagatattaaagacaaaaatcataaactgaaaacaactttattccttcaaataaaattgtgaaatatttgcacagtacttcctttccatcaatgtaagtaattcagagatgactgtcctgattttatgcaactggtcatttttagttagtatgacataaccaacaatcaaatacaaattagttgcttaaattcaggatacatacctggggatcaactggaataagggaaagaaaatccaaacctaaaacaaaaatgctttgttaatagttgtctcatattttgggagaccagaattatttccctaaatcatctttatcacaaatcacaaaacatttgtggtaagtgcttaccactctgtcacagagaagttctataccatgatcagtgatatttgaagtgtttaaaacccaaagatgaatatattctctgataaaacaactggaaaaactagctcccagagactcaaatgcagaagtccaaaactttccagtgaaggactagtcaaaacaaatatttccccctttgccgcttaacagaatgagaagcaataaaaatgatgagctaatgatctggatttgaaccatctaaaaaaaaaaacatacttaagctcttaagatatttcacatttatttttcagaaatacagaggttcatctaagtatcgcttcttaaacagatgtctatttcaatgacagctctctgtccccgctgtccccacatcaagagcagtacatagtccaacgctctgcacaaagcacacactcgggaattgctgcgctaacagggttatcaagggttactgggttctgagctaatgtaattttctgaaccagagaactgtaattgtccaattcgattttagaaagaggaatgtgtaaaaggttgtccagtaatatacttttgacatattcaagtaataacaataaataaaatttttaggtctgaaaagtctagtaataaacttcaacatcagttcacctagacctccctgtgtgactaaactctctttaattatttcaaaacattaaaaaagaaaccataggtcattaagacaggccaatttctattcaattccgtgaatttttatgctggcattcagagacaccccgaatataaccaccacacagagaaagtctgacattatgcttttatgcaaaatagagaatatcagtgggtacatttaaaatatctactaaccagtatgaatttataactcaaaaaatttaagtatatttattctcttataatctccaaataagggtattacaaaaatgcttatcaagtgatacaagctatagcaccaatcatttgaaagaaatcattccaacgatttctaaagcctttttgaaaattgttgctacagattttttttttttcctttttttgggagacactgagtctgctctgttgcccaggctggagtgcagaggcacaatcataggtaactgtagcctttaccttctggcctcagcttcgcaagaagcaggagctacaggtgtgtgtcactatgcccagctaattattattattattttttttttgtagagagagggtctcgctatgttgcctaggttggttttgaactccagagctcaagtgatcctcccgcctcagcctcccaaagtgctgggattacagacataagccaccgcacccagcttgctgtaatttttcatttcatatgtctgtcactagctatatgacacagtggtttgagccaatactaaaccaaagagaattacaacaaacttttccaatgacttctctattaaaatgataataggtgagatatctcaataagcagattttgtcttcatattaataatattcaataaatcctctcccttcttatgccaaacaattcaaaatttgtctagcccttgtaataccttcagagttttgcattttcaatatttctattattaagtaaaaaaagtttattggaacattttgttctgcttcaaatggtataaccgttttctttttacagtaacttcttatcttttcagtttttcagttttcttcatttttacaatagcttctacctttttatagtttttcagtttcatatgttcaatcatctttaatatttgctgtatctctcagttcatgttagtaactgaaacctttttataacgctaagtattgacaatggtgttggaatattgtgtactgaagccaagccactcaaaaatgctcattttctaaatgttcaactatttcaatttcagaatttcaattaaaatacgcaagcttgatataaaacagtttgaaaattatatcaagcctatttattttaattgaaattaaaaattgaagctctatcaccagagaatacccactgaggatcctatttttgttatttcaattccagttcttcagatgtactgtaattctctttgatgatttcatgtgtgtggtaaatataaagtttatttagaaaacaattaagagatttacttatctgtatattgatacctcatccacggaaaattgaatgtggtgacttatacaacaccataataaaatacctagaaatttttctaaaatattggttggaattctagattgtttaccaagcattacaagggtgctgtctatataaaacctgtttaatgtaaatatttctctcactgaaaccatttttttctcaagtactaacagtgaagtttgatatggtattttagatgttattctttctaacaaaaaacgaaaccatcaaagtcttcttgcattttacattttaagcagaatattaaaactcttatataaaatcaagtttcatcagtagtgattaaaattttactgccttgtttcgtaagtttagcaaaatgctgtttcttatttcaccataagtttcaactgcagcgtgtcatactgatatatttttatgccctccgaagtatttcatggttgaaaatgctcaattacttttaactaaaaagcaggtagtgttaacattattttattaacactgataaaattttaatttaaaaattttaagtgcttcactgtgaaattgactcattagattttttctcattgatgacaacacattttccttatttgagtcataaacttttaacaaaacataactgctacatgattaaatatgtaaatgtttagcactttcaaattttaatgatacaacttttgagcaccattcgcacctgacaatatggcactagcaataataaggcagtcatatttttccttgaaataagctgttttccactccataaatacaaattatttgttttattttgtattcactgttgcacagtatcagaagatgttccaagcttcagttcattattaatatcatttcttctttgttctcctgcagattcagaagattcatgtttatgatgtttaaaaggaatgttaagaaatgtattaaaactttgttatctctccattcttggtgttctatttaatattttattataaattattaagtttatcaataccaaaactcttcacagtatgactaactacataaaaattatgcataaaaataaaaccaaattactaatcacaaaagagcacattaacaataaaatcaaagtaaaactaaactatttagatatagtaactgctacataattcatacatgatgataaactagcaattcttctaaagcaaaatagatcctattctattcagttatcaactggtaagaaagcttttcaataataacaaccagtatcaccataactgttaatactggctaaatatcagccttggatattagtcttgtttgctcaatatcagcttgaaacacatttttaccaaatagccagttcagacatattttactgcatttttctcaagtttgcacatttctaaaaagaaataaagtctcactttatgcccaaattctgaaataatgtaaatttcccccaattaaaaattaatccaggttcagagaactgaaaaactaacagggcaagtgattggtaaattgtgtctatgctactgctaaatggtaggatcactttaatgaacagaaatgctcattaccttttttcaggattaatttttaattcaaggtctttaggaaacaaatcctttcagaatgcttgcttataacacatactgagatgacatgcagacactcttccaacaacccatgttacagccataaaaggcagttgggaattaagaatctctgaatttccatctttgtcaccgacatgaatcctcacctgtaccttggcattagactttgtatatactttacaaatactttacaatttgtgctagctgggtctacaaagaacttcttaaaataccaactcccaaattacatgtggagtaactatatctaagaagcaaagaataactttaaaagccatttttttctatggatactataaaatgtctattcttttccactaaattttattcacataatctaaacaaatttcaagtggcaaaattataccgagccaattatcaattgtttcagtaacataaactttcaccaacaggataagcattgtgcttaaaataaagacctcactaaggggagaaaaaaaataaatcataggtcaaaattaacttcataaacctagagaagaaaactagtaacaggaggagagaattgtattccactaaaagggccttcggagagaagggaagtcatgaatgtactggttctaacttgctcaaatataattgacagaaatgtctgcaaaagcaatagctatggagagggaagaagagtaaaggagggaagtttaaattttgtaatatggccttggttgcagaagtcctgatactaaggtaattctagcaaccttaatattttacagtagattcccccttatccaagattttgcgttctgtgattgcagttacctgtggtcaactgcagtcagaaaatatcacatggaaaattccagaaataattcataagttttaaattacacactattctgaatagtctgatgaaatctcatgctgtcctggctccatcatgctccatcccacccaggacatgaaccattcttttgtccagtggctcccagctttgtcactcagtagccatttaagttaacagattaactatctcagtacacagtgcttctgttcaagtaaccgttattttaacttaataatggcaccaaagtgatgccagcatattgttataattgttctattttattattagttattgctgttcatctcttactatgcctaatttaaaaattcaactttatcatgagtatatctgtatagaaaagaacagtatatagggttctgtaatatctgtggtttcagacatttactgggggtcctggaacttatcccccgtggataaggggaaagtactgtacatataaaagatatcccaagtattaagccccactctagggaaacagatggtagactctatctttgtaaggagaataaaatccacagcttgtaggaaaaatcagccccaaacaacatcaatatattctgaagttctgatgagctaccaagaagagtatgagaaaatattctcccttcacctgtgaggttctataataaagaaaccaagaagaagtctctaagtacaaattcttcaaaaggaagaataaaatctctaacatttcctattctactatatttcttatcaccaggaatctatagattgctctgtagttaaaataacaactggatgtgatgtataaaaacagataagacctttacccgaagctttcaaatttccttagcacctctactgaaaatttcaaaactatactggcttcacagattaagattaaaaaaaataaactttcattaaaaaacaaaagaaacaaaaacactccacatacctggcaaatctgatgacatgcttgatattggcgtatggtggaatggtactgagtagtctgttaatgaaggcggaatagcagcaggatcaaccgaagtcacactgggcacccttacagaagatggctgatacatgagaaccctgttttaaatagcacgggaaattacaaacaatctggctgttagttcacaggagagaagagctgcaccactgggcattctcagtcgttcgttcaccagtttcagcacaactatatggcagctactcactacacagcactccactctactctcctctcccataatagtcttcattttaacatgaacatatcttggctctcaacagcagctgcgacataagagcaagttgacattcaaacacaatgtacagtgctggagtgagatataacacttccatccacaaatagaaatagacatcacttttattaatatgtatgtaatatgtatatgggtatcagtaattttatctataaagaaatttaaaactaacatagaagatccctaaggtttgatttaaatcagggaaccttgagaagtgaagctactcactgtagcacaatccaaatttcttcaagtctaactcgaattgtattaattatttgcaatctttcctgggaatcatctgagcaaaattacccaatcttaaagccgaccaacttgatggcaataggccacaatcagaaacgaggatgagtgttcaggatttaaaatataatatccagaaataaaaatgctggctaccatgatagcacctaccaggtaggtgaaatcctaagagagtttatgattttaaaattagctgttcatgctaccaaaaatacaaattaaacatatgtaataaatacttcacaattggtattatataaaactgtatatacactatagaattactttataatttcaagaagcagtataattaaacatacttttgaaaaagttcaagcttaaacagagattttttttgcattcttcctatttaacctgcattttctcttagcccagggtaaacaactacaacttcacaagaaagacatccttgaatgtatgtaggaaactgagcactgttactggtcttatggttgatggtgggaaccatggtcacaaagctagactgggataacctctgggcatcctttccctttcctgttattgctgattattaaatatcagtaatgagaaatgatgacaaattgcatgacattctttgtactctggaaaactatttcataacctcaatttaaatgtcaaaccacttaaatatggatatcaatacaaatgtggaaaacagtcatcttgagagtacatacattgttgagttggcaactatgttagtctcagaaaagtgaataaataacacaggtcagagttcagaaatctttgatcaaaaactgatccatttaggaagcttatgacatataatatgcttgaggcaataacataagcctggtatttgaaaatacattttcccgaggtagataaagacagaaggaagttatcttccaaaaatcaaccacatgtctgtaggttagaatctggagatttcttggcctccagtgctactcgaagacctaaaaccacaagcagtatgtgagcaatgttagaaaaggcagactctggaggaaaaagagaagttgggaggagataaaataagttatattgtatctaaagctcatcttttctggaggtttgaaaacagtggtcctccacagggatcaaacgaacaggacatcatcaaaagtttttcaaataacatgagaccacctctcacacacaagagtttatatgagaaactggaggaaggacacagtgggtaaggaggagagagagactggggtatacgtgagtgctggggaggggactaaagaagtggtctgattattctggctgtctcaaagtattaatatcttattgttttaaaaatgttaacaggcaggcttttgaagaccaaatatatatataaagtttcatttaatttaaaaagtttctacttaagagtacatttagagccaggcaaggtggttcacacctgtaatctcaggtctttgggaggccaaggcaggaggattgcttgagctggaagtttgagaccagactacggaacatagggagaccttgtatctacaaaaaaaaaaaaaaagccacatatgctgaagtatgcctaaggtcctagctacttgggaggctgaggctgagactgcttgagtccaggaggtagaggctgcagtgagccatgaatgctccactgcactctagcctagacaacaaagcaagacctcgtctcaaaaaaaagtacatttaacctatcgtgttttttttttctctgccactgaaagaaactaaaagactttctggtacaagaaaaagctaatgaatgtctttttcccactcccccttctcttcctttgctatttcacactggagattttcttttgttttgatcctgattgccctttcaacttgaaatagacttacacgtaacaacaataacagagctccctttccttccctgaccctttgacttacatctataaaaggagtcaagtgaatgtacctacacacctgtctgtcactacagtaacacctaataactgtacgtgtcctgtcacttagtaacatgaaactttaaatgagtaaatagctactccttacttaggcaacaccaaaaggttgactgtcaaaacatgtgaaatgtgaaaatccaatggcggtacaaattagtaaatcaacatctaaaacctcagcaaacatatgaaaagctaaactacttagtgttggttaattcccattacctgaatgttgcaaccattaatacaaattcaactttacatagaatggcttaaagtagtcattagttaggattatcaaattacatactgggagcaggcttttgttatcaaaatcttcacaaagaccacattcagaaacaaaatgattctaaagcctatgcaaaaaatagatatgagtaacagattccatgaaaaaatgtaaatggctatggatggtgaaatgatggatgtaaaaatgtgatgctatatgttaataaaaagatttaaagcttttaaaacttgttactgcctcttcataggattggtaaacacacacagatacgtgtatacattatgcaagtgaccatttatattttaaacgtttgtaactttatccataatatcacagcacaaaagtgaattgctagaatgctgctatatagcaaatattagtattccggattatatgctggatcagagaattgcatgaaactcacatttgctcagacttggatgtctgaaaataggttgaccatttctatttataaccctgaagttcactgtatgctcccactttatgatcataaaagtataaaaaagatgcaattttgctaccaattcttaatgattatcaatctggagacatatagatttatccttattatgtttcctgtctttagaataccttcttattaaggcaaagcaaccactcatttttcagaaggggcacaatatgtaaaattatcttttaatatggaaaaacatcagaggttttctaaatgtcttaagattaacatacaagtttcttctgacaggtattataagactgcatttaaagactccggttcgtaagcaaagaaagggaataggactgccatcaaaatggcaatgattctctctaggtgagatattttttgctttcttcttggtgctttgtaaaattgtttataagaataatttttactaaaataataatacctcttaaaagatagttgctcacaggccaggcgtggtggcttatgcattttgtaatcctagcactttggcaggccaagacaggtggatggcttgagctcaggagttcgagaccagcctgtgcaacatggtaaaaccccatgtttacaaaaaaaaaaaaaacacaaaaaaattagctgggggtggtagttccagctacttggagggctgaggcaggaggatcgcttcaacccaggaggtcaagactgcagtgagccgcgatcacaccacggcattctagcctgggtcacaaactgagaccctgtctcaaaaaattaaaaaaaaaaaaaaatagttgctcacataatttcggggctgtaaattagagtaagttttcctgatttctcattctctgttctttctcatttgcttactatctttgatggccaagaaatcctatgataaacttacacagcacaggaaaaccataaaaactctagatgctgaactacaagaaaggatatgaaaaggacaaccaagaacaaagtcacaaaagtctaagagtaggaggggatcacagagatgatataactatagcatgagcctccactatgacactgtgacaggtggcagccactctaacacagaaaatatgattttgggacaaaagattaaatttcctagtattcagaaagctccaatagaaagtttatccatgtatctttagtccactggacctaaatctggtaataaagaacaaacttaatccagctagtcattgtctcccttttaagaactacaaggtgggtatcaaataatctcttctcctggtttaacagcttcagtccttaagatccactcatccatcttgctccagattccactattcaccttcccgttcccctgctctggccatactcatttgttaataccattcttgatgatcagcactgactgaaatgctctgagagtcatatagcctaaaatggaacaaaactggcatggtatggatcctggacactatgcttattttattaatgctaagaacaaactgatttcagtggtgaactcttcaaaccattaactgaaacctgacatttgaaagagtttctatcagaaatggcaattaatttactgaaggcctttccaacatccatgaagatgactacaaagttgtccttatgacgagatccatcttatcaatgtatttcctaatattaaagcactcctgggataaactctagttggtcacagatgtcattttaatatataattaaatgatttcctaagactgaattcagaattttcatttatctttctatgtgagtctgtttcttaagagttcttccgtgtattaatgtgtatgtatgtctaggttgggtgttaagggctacatcagcttcatggaacgaactaggtagctgcgctttatacagacttttaaaataaactttcatgtgttgctggtttagtcacaaatttctatcttatacttaccaatgttagtttttgttttcttttcagcctaaatgaggaaccttaacatttatctctatagtagctgatcacagatgtaaactatccttattcctctgcatactgaggtcatttcagattttgtcgcccactgtgtatgtgccatccctcctgtttcatggacttatcaaacacagataaaaatgtagtaaaggacagagggtagacccttgtggcatgccaccagagacatgctccaagatcacaacaactcatgagtcagcatcactaggcatgacctctcaacctggcatgaattcagccaactgcagtacttgcaactcatgtttttccactatattctaaagcgtatcattacagagtaaaatccagaaacatcacatctaagcattcattccccttcaaaatacattttgaacgtaaccatttcaaaattataacttcattttctgtttatcatttaaattacagatgtaccaaccaatttgtctcaaaggagcaataaatgattggcacaccaggaaaaaatccacttgaaatacttcctcattttgttccacacacacaaaaaccccacctcattctaattaaatgggtagaagtaaatatatgcctttaatatatgtgtaaattatatttggaaatgtaagtattttaacagcaaagaaggcagctgaaaaggtttaattcttaaaattataaaaataaacaatgttgcaaaacaagacattttatataaaatgtctaaacaggcattatagacacaaaaaaacgattgcctagatttggggtgtaaataggaataaactacaaaagaacatgaagaaagttttttgggtgttgaaaatattctactactgaatcatggtgatgattgcacagctctatgtatttactaaaatcactgaattgtgccattatatacttaagatgggtacattttatgctatgtaaattataactcagtaaagccattagaaaaccaagtggaccaagaggccaaaaagatgacactagcaaacccaagtttgaaagaatgtgttcgtagacagccaggagaactctcctgttatctccttttatggttcaaaacctctctgaaaaagcaactattgttaaatacccaaacctgatttttaatgcaggtcagtaatgccttctgccagataacttacagagaatccacgctaaaattcaggtagaatgccatcctacccacctatattttgccctggagagggtgaaaagggaaaggaatcaatttttattgggaaattaccacatgcctgacaccgaggctttctttcatctcattaaaacctgaaaatgatcctgtaatataggcgttatttagctccatttaacagaacacaaaaaagaggctcaatcaaattaagtatttcatctaagatcacagaacaagtaagcgatggtgtgccaaaattggaatccatacttgtcagattcccagttccacactccattacaccagactttctcatctggtctgagatgccaaatttccttacaaacaggttcaagaaaataacaaaaagtctcaggtaggaaataaatacctcacacgctcactttccaaagatgtaaatattttctccatcaaaatttgcttcctataaacaatgtgcttactcgaaaatatttcaactcaacaaaggcaaattaaaatagccttctacagttatgccatttcccaaagagacatttataaatctatccaagagcaattagttgcaagggtaatgaacaatagtgaactataaattaacaaaccctttggttgggctgctttgtgtttctgacataaagatgcatttccttttggcaggagggtcttcctcttcgtcagaagagctttctattgtaagatcaataacatctactttcttcttgcttgcctcactggctacagtcactgaacaaggcttactgaggacgcttgaacctgcatgtaaagaaacaaaaggaaaaaaaaattaaaggtataacacaaataaactctagtggtagagtctagtatattcagtatagtatgttcctgacaacatatagccagtgaagccacatactccaacccatggacaaataccaactccctaactccagacctctgtctgtaaaatggttgttcacctagggagacaggtgagcactattccttgacagatggttagaagtctcattcagacagaatgttcttagttatgcctccaataccactgaaggatttgtgcagctcctactgctcatcctgtctctgcaggtcagcagtcgttttacagaaagacacgcagagttagggaactggtctcaggtcatgggacaagaatgggtgagttcaacagctatgtattctcgcacacatgtggcacagttagctcagaaccagatatttccattctagcaattatgcttatatcaaagaaagtacagacttttcaccataagccagaacttgataaaaactttcatcttgataagttgaaaaaaacccaaacctctcaattaagttactaagacatttaaacttttcttatgaattatctgctaatcacgtaggttctttctacccacaaagacagtctcacataccatatttgttaactcacattttcacagaaaagtatgttattatctgtaatgtatttagttaaaaatgaatgacagttgataatggaaaagcaacagaaacttatcaactaaatcactccccatttttctgaaagatgagagaaaccttggtcactgcactcaggtttagtgtcaatcgcagaggaataattaataatggcataaatcctttattttttcccctttcttcttactccattcattacattgtttgttagaacttcaaatgtaatcagaacaaaactgaaatgcagtgagtagactgttagataaaaagaaactctaagttcacgtgtgggtttcaatgagactgttagataaaaagaaactctaagttcacctgtgcgtttcaattactccaaatgccctcagtttccctacttagtgtggatggatgcaggcagttgatggatgagtatacattctaggtaatcaaggcaatgttaaaattcttctccacaaagaaatggaaggtaacaatttgtttactttctgagcaactaacctgtgaccatccccaaaccaccaaggccattaaccaatgatgcagcctctctaacctcacctccacctagggttccacctacagatactctaagaacaattctgaaaaactgtccatataaattcatttgtgactttttgttttgtaacaaacatcatattttaaaatgattttagatgaatgtttcctttattctacacaggaaaaatatactatgaaatagctgataagatggtataaactttagcacattccttcaggaaagaataaaaatcatttgggggaaaactatatatcatcaaaagactgagtcaacaagctgaattccaaacgtatagttctaggggccaagattaatgataatgttgcacgagtctcactgctttactctctgctgctattctacacatactttctatttttgtacacggttggctggatactttcatagcttctttcttcggtctcattggacaccaagaaccatcttcttggaatttgatctcatctacatcagaacagtcattgagaatttccataaaaagcctaaaaaacaattaagaagtacatacatgtgatcaacagctttgcctaaaggtgaaataagaaagtaatacacattaccttgaaaacataagtaatgttagctgacccccttttcttttggtattgcaatactttatactttacaacaattattacactccctttgtcctatgttttaaatctgtaacaggcaacataatagttaagtaacttactgagcatcacctgtgtaactcaatgagtataaatggctagagagaagtagatacctggagcctcctagctgaggctggcagtaagaacaacctctaacacagcacaaaaaacaaacatcagcagataaaggttactatatagtaaaataatttataaactttaacttcgagaaaaaaggataatggggtaggggaaggagggaagaaaagggaaataaaagaagtctcaataaatttaaaataagtgtatttgaattaagttcaaattaagtccgtaccagaaaaacctgaaaacttggaaactaaacaaaagaaacatgagtcaaagataaaaataagattttaaactgaatgaaaataaaaatgtaataaaatttgtggactgtattatttaaacactgaagtagtatttaaaggaaaatttatagcattaatcttccctaattagaaataaagtctcaaatcagtaactttatgaaactagaaaaaaaagcaaattatagtaaaagcaagaaaagagaaataacaaagaacaaaacaaacaaatagaaaaaaagaaaaacagaaaaatcagtttctagtcaaacttatttacactcactccaaaagaaacagataatctaagaagccctatgtctattaaataagttggatctgtagttaaaaactttgccacaaagaaaatcctaggcccaatgtcttctctagggaattctaccaaatatttgaggagaaataataccactacttccaactcattgtacaaggtcagcattactctgataataaaaccaggcaggcattgcaacaaaactaaatacccaacattcccccatgaactctgcaaaacaaatccaacaacaaatatacacaggataacaaatcatgaccaaatggggttcattcccacaatacaagattagtttaatatccaaaagtcaatcaacataattcaccgtattaccagactagtcaatgcaaggcggtgggaaaacaaaaggcatccacgttagaaagaagaagtaaaactgtctctatttaaaaaacattactgactatatagaaaatcctatgtaatctataataaagctactagaactactaagggatgggaataacatatgttgatatgacagcaatatacaaaggtcaactatatttctatatattagccataatcacaaaaattttttaaataccacagagatatgaaatatttaggaataaacttgacaagagatgtacaagacacattgaaaactacaaaacactgttgagacaaataaacagaaagatacatcctgttcataaatcagaagactcaatactcttatgtcaccacagacttatctacagagtcaatgaaaaacaaatcaaaatcccagcaggttttttcccctaattgacaagctgattccaaaatctgtatgaaaatgcaaagaatctacaatagccaagataattttgaaaaagaagaacaaagttggaagagtcacactacctgacttccagcaaatgcagtattgacataactacagacaaataaatcaatagaacagttcagagatcacacatatagtcaattaatttttgtaaaaggtgcaaaagcaattcaatgaggaaaaacaaatcttaacaaatgatggtgcagcaatcacatggccatataccaaacaaaaacaaaacccttgttctttatcttacaccatacataaaaattaacttgatagaaataataaacctaagtgtaaaagtaaattataaaacttctacaggaagctcagaaaaaatatttgtgaccttgagttagggaaaatgtcttaaaataataccaaaagcacaatctttcataaaagaaaaacttggtaaaccagccttcattcaaagtagacacttctgctttttgacatacactgttaaaagactgaaaagataaaatgatagaaaacatttaaaaatcatatacctggtaagacgtttgtatccagaatacataagaaccaccaacattcaatgacatgaaaacaaaacccaactaaaaagtgggcaaaaggccaggcacggtggctcatgcctgtaatcccagcactttgggatgctgaggcgggtggatcacgaggtcgggagttcgagaccagcctgaccaacatggtgaaaccctgtctctactaaaaatacaaaaattagccaggcgtggtggcgcacacctgtagtcccagctacttgggaggctgaggcaggagaattgcttgaacccaggaggtggaaggttgcgctgagctgagatcatgccactgcactccagcctgggcgacagagcgaaactccatctcaaaacaaacaaacaaacaaacaaacaaaaaaaagtgggcaaaagtttggtcacttcaccaaagaaacgtacagatggagaataaatacgcaaaaagatgctcaaaacaattagtaataaggaaaatgcaaataaacccacaatggagtaccactatataccactagtatgatctaaaattaaaaagattaactggccggatgtggtgactcatgcctgtaatcccagcactttgggaggctgaggtgggtggatcacctgaggtcaggagttggagaccagcctggccactatggcgaaaccccatctctactaaagacacaaaaaattagccaagcgtggtggtgggtgcctgtaatcccagctactggggaggctgaggcaggagaatcacttgaacctggggggtgggggctgcagtgagccaagatggtgccattgcactccagcctgggcaacagagcaagcctctgtctccaaaaaaaaaaaaaaaaagagaagccataccaaatgttaatgagaatgaggagcaatcaaaactctccatatactgctggtggaaatataaaatagtacaaccgctttggaaaacagtttgacagtttcttgcagttaagcacacacctggcatgtgaccaggcattctactcctaagtatttacccaagataaatgaaaacagtccacacaaagacttgggcatgaatgttcacagtagctgtatttccaacagccccaaaacagaaaaaacccatcaacgcatgaaatgacaaactgtgggttagaatgcaactcagcaataaaaatgaactattggtatatgcaacataaatgtatctcaaacaagtatgttgagtaaaagaagttagacaaaggaagcacatagtttatgattccattcatataaaagtctagaaaatccaaactaatctatagaaacagaaagcatatcagtgtttgcttgaggactgagagggagagattgaaaacatacatgagaaaactttaggtgtgatgggtgtgttcattatcttgactgggataatgatttcataggtatataataagtcaaaatttatcaaattgtacattttacatgagtagttcttatgccaaaaatgcctacttcataagaggtttatttttctcaattatactgaaaattcagcataatgtaaatcaaaacccaaaaaggttctgtgtaatttgagaatgcttttattcaagtgaacatggcagaatgtattatgacactagtcaaaaaaattctgaaaagaaatggcctaagaaatactaccacataatagaaatctaataattaaaatagtttcgtattggcccagtaatactttgatcaatggaacaaatagcagttcagaagttaacactagtatttacaagaaatgtattagataatgcaagtagtatctcagatctgtgggagagattattcaagtaaatgtggttgagaataatctgggtgctagggtgacatgatccctaccttaatgggatcacctattccctactgtaaagttccttcctcatccccaattttcctcccacagtgtcattccttaccttcacagcactttacacttaatatacttttttttttttaccatctcccatactagaagtgccctgctcaccatttttagacctagtatctgacacatgataggtatttagtaagtactgtgttgaatgaattcatgaagcaatgtatgacggaacaactgcacaactggaaaaaggaatcacaaatgtgcctgatgaaaacaagcaagtgctcatataaaatctctacaactttctaaacactttcaaggaagacattcaaaaaggaaaagacaagacttgataaaaaaaaatgtaaaccttctgaatggagaacaaaggtcacaataaatacaaataaaagggaaactgggaaaatacatttggcacatgtggacagagaaattaatatcctcaatctataatgactatgtataggccagtaagaaaaagatgagcaagcccatagcaaaatcttttttaaaaaaggaatattaagaggcaatttgtaaaagatattataatgaccaatatatggaattaaagaaatatctgataactcctataatacaaaaattaaaaatcaaaatagctatcttttcaattaggaaattagtagacatttttatttgttgttccattttgttttgtttacttttgaaacagagtctttctccatcacccaggttggagtgcaatggcatgaccattgctcactgcggcctcaaactcctggtctcagacaatcatcctgccttggccttccaaagtgctgggatgacaggtgtgagccaccacacccaagagtagacatttttaaagtaagttttaatacgtaaggctgctaagagggctgagaagtggacgatgttatgcctgttggcatgagagtgaaatgatttactagaagggaaaaatagcttactcctcctgggaggcatcttaataataaatagtaaaagtcttacattccctttgagtatttctatttctaagaacttgaagaaaactccacagacatacacaaaatgccaccttcaaaaatgctaacatcacagggcaattttaaattgaaaaagtagaaacaaatatggaatatcaagaatttagtaaacacatcacaaaatattaatgtgcaaaggggcatgacatatgtaactctcaaatggttcaaaagaattctaaaaatggtaataatcatctctctctacattcacaaatgcacacaccaaaaatgtgtatatgcacacatattaagggagaaagtgataaaacaactgtgatagaatgttaacaactgaagcatctgggtcatagttacatgggaggttctttgtgctagtgttccaactcctctgtaggtttaaaattttttcaaaataagctaaaaataaaaattcagcaaaggaaagttcagaaaggaacattaaagtcccattcactcttcattccccattcctctccacagataatactcttgtaaaacttttgttgtttattttagagatgcaactcactatgttgcccaagctcaccttgaattcctgggctcaagtgatcctcccacctcacgttcctgtgtagctaggactacaggcatgtaccacagtgcctggcttaaaacattttcaagttgtacaagtatctttaaaactctaggatacttttcactatatattgagtaaaaatcatatgtatatattaatataaatcattacataaagtatcatttcagtcttttttaatgtcaataacaaagtcatcaccataggatggtactgctaattttattttcatcttttcagtaactgtattttccaaatcttacatggtacatggatgacgtgcaatttttaaaaaagtattatttgaaacaagatactaaaaattagttcatgtcattttccaaattctgacatgcaatataatatgagagatgatgcttaaagtttggactccagagtcagaaatacctgggcatgaattccagttttgaacttaagagctatgtctgtatctaccctatcacttcctctggtttttgcatagaccctaattgctacttcaagaaattctaggtaagcaaaatgacatcacaaagcaaacttttccctctttcctgtgggctttataaaatataatcttggaaagcaaaaacattgccctcaacgcaaatcatattatagagataaaaatgccactaaccacagtttaaaaaataagattgagtataattaggtataagacggaaaacatacaaacatctggatttatgctagagtagaatttatttagaatttagttcagtaagttgtagtgaacaaaggcattgccaacagctgttgtattagtccatatcagctgttaaaagggatatacttacccatctaatattagactttcataggcagcttttttgtcacacacaggacaaatccaggtgggctttttctcattcatttgtagatagagggcagcatcaaaacactgcagatgtgtacaagtcactgcacggcatgggattgtcagcctcatttttcctaactacaggacaggaaacacaaggaaaactatttcagaaaggagaatgagctcagagggaacatggtcagttgtaaaagtcggaagatgtcatacaagaagatgataaaaatgaaatagaaatccaaatcagaatgtattcccaagaagattacaatatatttttattcattgactgccctatgatttttgaaaaaccatttcactttttcaaaacgggttaacatgtaaatccagattcatatacattgaaagtatgactccttcttacctggtccccagtttccctatttagagaaccactgttatccatctcttgcatgtcctttcacagatgttctaagcataaaccaagtgtgtatttaaagaaatattttcccaggaatgatagtatacaatacacactgttttccaactcacttctgtcatataacttggtgactactgcacacaaatcggtatataaaaagctaccattatatgaaggtatcataatttatttaatcagtacactaatgactgacatttaaattgttcccaatcttttatcactacaaacaatgctgtaatgaatatttctaagatttttatatttataatatttataattcctagaagtataacttttggatggaaagaaaagtacatttgtaatttttgtcacattaacacactatcttccacaaaaagtacctattgggttatgcatacatgtgtattaacatgctttgttccactcaaccttttcaatataatgttattaaattcttcggtctctgccaatctggaaggtgacaaatatcccattacagttgtgaactacattcctcttattttaagtggtagttgagcctcttcttttacttctaagagtcacttgtgtttctaagaactttctacctataaccttttctcatttcccatttggttattaatcttttgttatctatttataggcactctttatataagaaatcacgtgtgtaacatgaactgcaaatatatttttcatttatgttatttataggcactctttatataagaaatcgtgtgtaatatgaactgcaaatatatttttcatttatgaaaatttgtttttatataatcaactgtgtcaatttttcaacatacttttgattaactttagtgctgttaaattcttattccaactagtagtggtccactggcaccaagacgtacacaacactcagatttgatcagaccaggttttcctacataatccttcaaacctccccatatatttcctttacagaaaatatcactgtttataaccagtcctgctattttgattgaaaatttgtttctcccactagatcttatgctccaaaaagacggtctagatctctgctcaccactgaatcctactgtcctagcacaatactagctgacagtatgtgctcagtatttgttgaccagataggagaatgaatggacatggactggaaatggggaaaagaacaaacaggaaacgaagaagacggacctatttttatgctataaagtttgaaagaattcatggcaaaattaaaacattcttagctctgcctgggaggcaggctttttaggatgttctttttcttttggttcatctgtaatttctaattcctctaaaatgaacacctggtaatgtggtaatttaaaaagaaaataatttagctgaatcatcaacacagaagtaacgtttatatagttctacctacgtgcaaggtacagtgttgactactacttcacattactctcaaaaacactttcacaattacataacaattatactaaaaggatggtattattaccatccccatgttataaataaggaaactaaggcacaaagaagctaagtaacctaacgttacaaagttagaaaatggcagagcaggtctgacctgggaagctccagccctgcagagtccactctctcactgctatactgcctctatctaagtgtctaaccagagttctaaaagggagcctcgaaattactgtgattcgatcaaggtatgtggcacgatataactcatcacttagaacagaaaaaggtcagaataaaacctggggcagcttctcttcttatgatacatctttctatatttttcctgcctttaaaaacaaattatttcttaaacagaatcttacagtatgcccaaggcttttatataaatctcataaaatcttcataactctatgactccagaaaagctggtatctacatttctatttctgaaatgaagatgctgaggctacaagaggttaaaaccacacactcactgagacacagctgatggagctatatcacaaatccaaatggtcctcacatcccagagacatgccagttttataacattacaaatggtgttagttttttaatttaattacccaccttttcctcctttgctaagtttttgttctattaaaaatgaacgttgactaaatacctattcagcacccaatgagataaccggttttttatatcctttcaattataaaatgaataattttaatagattttcatattatcctttttaaaaatcacatgttattctttttaagtagtaccaacataaatattggctggttatttagaaattttccaccaatgtaagtgagttggcttttttacacaatcactgtgtggaaacaactcaatcactaaacttattattaaattacactatacctattcaacaaaatgcccacaatgattaaaataagaccaatctacacatactaatatacttaagatacactgttaattaaaaaacagcaagccataggacagtatatatactttccaataaacatacatataattatatagagaattaaatctggaaaaatctatcatgctactagtaatgttacttctgaataacagaccttgtgaatttaaaatgatcatttttactttttggttctatttgaataatctataagtacctatttgtcaatttttataattttttctttaaaataacgttctaactcagcctaccacggtttttacagttatcagttctcatttggtttcaaaacccctttaaactcttaaagattaagacctaggccaggcacggtggctcccagcactttgggaggccgaggagggtggatcacctgaggtcaggagttcgacaccagcccagccaacatggtgaaacccaatctctactaaaaatacaaaaattagctgggtgtggtggtgggcacctgtaatcccagctactcgggagactgaggcaggagaatcacttgaacctgggaggcagaggttgcagtaagccgagatcataccactgcactccagcctgggcgacaagagcaaaactctgtcaaaaaaaaaaaaaaaaaggccgggcacagtggctcacacgtgtaatcccagcattttgggaagccgaggcgggggaatcacgaggtcaaaagctcgagaccagcctgaccaacatggtgaaaccccgtctctactaagaatataaaaattagccgagcatgatggcaggtgcctgtaatcccaactacttgggaggctgaggcaggagaattgcttaaaccaaggaggcggaagttgcagtgagctgagatcgtgccactgcacttcagcctggatgacagagcaagactctatctcaaaaagaaagaaaaagaaaaaaaaaattaagacctcaaagacattttatgtatgtgggctatagttatcaatatttgtatattagaaattaaaacatatttttaaaagacaagagtacacaagcacacattccattagccatcagagcaatgacatcatcatcatctattgggtaacccacgttaaacatcactttatgctcctaagagaaaaagaacacaaaatgccaaaattgtgtgtccatattattataaaaagttttaactttgtagttcttttcaaagagtgtcagggaccttcaggtatccatgggccacattttgcaaactgctgtttagggattgtttttgtcgttttcttctatgctgtttccatctctcctgtcacagccttaaaatttccacagcatacagaaacgagaatatccaggactataaaagttgctgaccctaaatttaattctactctagtggtcttataagaactaatgagcatttcctaagaaggaatttgttaccagctagcaaaattttatcaattgcctagtgactatggcatgttattaaaaaggacctgaatgtgccaccaaaataaattctaattctaatttaatcagatgatgatgcttttttgaaatttattatttttatgaatggttatctaagtaatgcaacacttttttcctataaaatgttaagctggcattatccaaattctattcactgtagactaattactaccaatctaaattaagagagtttttaagttgaaaaggcccaaaatggtggtttccaactcttttcagcaggactttttttttttttttaaacatactagaatctcaagagataaaatcaaacctagctttctttctttctttttctctcccccagctacccagtccacctctgcaggacagactgaaaatcactagctgaaatcaccaaagtgaaactcctatgtaaaattcagatatggtgttcagaaatataattatgcacactcaattagatcctcttcagtaactactgtgacattaccttcctttagtcccaaggacagaggttttagaatttgctcccacttttcagactcacgtccactgcaaatcactttacgaaaatactgtgaaatgtaataaacatttattctatcaccctacactatcattttctcttgtttttgccaaataacccagggttcacttcttatttaagtgcctgggatttatttttttccttctccgtttcccattactgcaccagatcccatgttatttccattgttagctggctggactccattctgctttctccaactgataataggacttactctttctcaaacactgctttcatcatctaacttctgtcatccatccaccaaatctaatcaaaacacctgtgtctggtattctaattaatatataccacatattacagtttagctacccaactttatgttaacactactactatagcccaaagagtagcattcattcttttcttagaaagtgctctgaaaagattgatgaacccccaggaaaagctcaaaagacagtctcacgaatagacctgttgtcacttctgagcagagagaaaaaaacatttcagaaacttaaaacaagatttcaaaaacctatttgatctgttacttcatttcttcaagtaactgaaaagttaattttcttaaaaattggtaatgtttggaaggaactgctccctattcttacatagaaggaatcctaacctctctgatacactactttcactattattgaaagtttggctaggtgagatggctcatgcctgtaatcccattattttgggaggccaagatgggcagatcacttgaggtcagaagtttgagatcagcctgggcaacatggcgaaagatctctacaaaagacaccaaaattagccaggtgtggtggcgtgtggcggtagtccctgctactcaggaggctgagatgggaagatcacttgaacccaggaggttgaagctgcagtgagctgtgttcatgctactgcattccagcatgggcaacagagagagaccctgtctcaaaaaaaatttaaaataaattaaaaaaaaaaaaaaggatatgttatgaatgcaaaaaaaaaaaaaaaaatttaaaaagcctgagaatctgttagtatgtttggccattgtattttgttttggttgctctcatgtagaatggcaaactgtatgaagaaaaaaaatttaaaagattctaagaaaatggcactgcacaactgtaaaactccttaggtaagttgtgtagactttcttcctgatacaatagtttgacatctaaaacataatggtgacacgagtttcctccccatatggtgactgtatgtggaatagagctggcaattaatgtttgctgaatatactagggatacataataaaaaatcgtcaatatccaactgttttttaaccaacaaaaaggcaatttcacttgtttcaatctactatcaattttgattttaacatgagagcgaagaaaagtataataacctgaagatactgaaaagaactcatgcctgaaggtttgcatagagcctgcactcagaggaagtcgtgtgtccttccgcatgcctcctagaacctctgccaacaccctcagggctttcaggtcttaccctactggaactgcacacctcttccctgcgtttgctaagagcaggttcccagtatccaagcaatcctcatatcaaaaaattatatttcaataaaggcaaattcatgtttttaagttaatgaagattaaaagagtgacacttcaaaaaaagatctgcaaataccactttccagaataaaagagatgtacttgtaatcaggacatgtatatttcagcccaatctggcagcatggtatattggaaaaagaacaggaatatcagaacactacaatctttatccttgttctaccaataactgtgtaatttgggttagccaacctcattcagtctcagtttcttcatctacaaaatgaagacaactcctccacacaggtttgctaagacagttaaataaaagaacatacagtagagactcaacaaatcattctcttttctgacacaatttctccccatttaaaaaactgcacatttctcaaaatggtgggtagtcatcaaatacccacaaaactacattataaattcctgattccatgactttttctcattaagttcttcttaaccggaaagggttcccctccaattcattcactgctcctgaccctcccatctcctcttggtagtaaaacagcctaactgtaagtgaagtctgcaccatttttatgggagttggttttatttttcaaactcaattattaacattctaagcaagcctcaatattttctcccacaattagctcagtggcaagtacacaggaggatgtgagagttgctgactgatttctccctcatactttctatgtaaggagatataaaagaaaaattattgtgcaatttaaaagaacattacaaagacatcctacacatcctaactcactaaactaagaccatcaattagcatttatcaggccctagtcactttattgctatttttcagtatcatttatattctgataaaaggagtcagctcttaatatatttttattactagctgtatattatctacaacattaattacaacagattattctgagcctaaagctatcttccctcttctttgtattctttgcatgcccaaataatacaaagaattgtgacttaatcatgaagattccttaatgggaaaagacaaaagttcagcattcttcataatatatcattcattcccacacttacttttataggaaagttaatcatttataaaaagtcaaattccccaaaatgttttgttgctttacttacagggcacatcaaggatacccgaaggctagttgtagcaatttcactatcaggatctgcagtaagtttttctttaactttaaaaagaagagaaaaaaaaaaatttaaaaaaattaagggtgacaaagaaatggaattatagaaatatatagcatcttaaaacaaaatgttacatattaatgtattgacaacacgatcacactcccaatataagttaaagaattatgaacatgcaaatttctttgtttaaattcttaaaatttctttttaaaagtaaaactgctggcaagcaagactttcaaaatagaaagctatgtaagacttaagaacaaaacaacaattaggagaggaagctggaatgcagcagtaccctgagcgtcaaagcttttccaacacacattcatcacagtttttattatgcactattgtttgtttccaacaattattaaatttgtaaacagaaaagataaaaatatttatacttcctttgataattaaaaactactatgtggtaatgtgtctacaattttactcaccagtaatgtatataaattagtatatacacaagctaacaaatatatactaatatattgatgtgagcaatatttaaagcattaaagtatctcatatgctcaatctttttttttttttttaaatgcttggtcttattaaacattacttacttagtgctctggaatgatcagggtttctaatacctttcatttttaatctctgtaataacatggctgatgtaagctgccgtacaagatatacagacatagagtaattctacaaacaaacaaaaaaaacctgcattaaagatgagagataatattctctttgtttacatgaaatacttatttaagaaactctggtttctaaaaataacattcaaaataacttccatggaatggtcaatcactgcgaaggggacaaaattcaccaagctacttcactgaaaataaaagctcaatcattttaaaggtatttcttgatcatttatcactttaaaacattcgctggtatgggaatataggttagatcaatggtttccaaactatggttcttatttagcaaaactggtaccttaggggccaccctgaaaatgtaccctcctatgactaaccagaatcttgctaaccaaaatcattctgcttttatcgactttatgtaatgaggttctcatattttcacttaaaagaggaattccactgcagaaacaaattccaaaggccagtggtctgaattaacactgcaaatccagagttccaaagttctaattctggcagaagaaaccacctgctactacatggcctttgagtaaatcacgcaaatgaaccaggtatcagctttcttctgaggaaagctttgataaattaactcctgtaccccaaatgggtattttattgacaagcagcagctactatagtatgtaagacacatgaagaatgataaaaattaaaaagtcaagccagaaaacaacagcgtccaatcccatacctgttagatctggcacaaaggaaccttcattagctatttatagagctatgaacagacaaaatataatttcacataaatgttaaaaaaaaaaaacctatcttcccattttattaaatatattcattcaattgattctacaataaacatcatacttttaatagctgccaaaccaagtattttaaatattttttaatgttcttttagatatctaaatacccaacttatggtgtaaattctaggtcaattaatcattttaattataaggaagagtattatccccattacatggcaaaagttttcaatgtctacaatcatttattccaatgtctgtaaagttactcccagctctgcaattaccttggtggtaaaacaaaaaattcctgctataaataatgcctcaatttctccatccataaaacaggaatattattctgtttaggaacatgtaataagaacactgaaactgatgcttcatgtaatattaacactgaagctgatggtcagaaattaactgaaatctcctttccattcattatttcagttatataaacaagtaattctaaaatgtaaattccttgttgtattaactggtatctcaaaattgacataatttattataagaccaaaaatcaacagaaagtcaagttcatcaacttgaaggtatagagaaaatattataattctaagtaaatatttttatacaaatgcttacaggttatctgaaatatcagttgtttatagaaaggctagaacagattatttctaatcacaacatgtgtacatttaaccatttctcccccaaacggataaaactttctttgttcctcttcataaatatttatcatccaaagcttctagtttattaaaatactaaacacaaacatacatacaattgtggttaaaccattaccttaagaaatataaatatgcatatttcctttccaggaaaataaagagatgatattcaggaaagctcagagttaaagtttttaactttaagaatctccacactgccacctctaaactgaaaattactgctttttagagattacaatccaaaaacagaaagagctgaagccaacagcttaagaaaaaacacagaaagtcaaccctcagtggggtcactgtcctgctacccaaaacggagagcttttaccttcccaatttctgatgcccaagaaatggaaatttggtttggcacagctgaagataacctaactaaagatgtaatattcaaggggcgtccagggcgcttctgttcaatcccatttttaggcggtggtgcatagccctataaccgtaagaaagaaaaattatttcaaatcatctgcaggaagattaaacattttctccaagatagatacaggatcctgcccaatttcagttacactatttttattttagcctaaaaatcatatagcccttatgatcattatcaacccaaaataggaaaataacctttgaaaaaaggttacaaaatatttcacaagtccagaaaggtaggaaaaaaatccatgttccaacattaaaattaaagatgctgacatcttgccacattggctatgaatggttttcctttttcataggacaccaagctttacagataaagtcacaactttttataacgattcatccttagcagtccccattcaaaatacatgcacatattggaggtgggaaagaaaaaaaccaaactgggaagtgaggggaaagaaagaacaaactaatgaatttcatttttaaaatctggtgagtgataaaaatattttccactgccttttctctgggtggaacagaaatggtaatcttttaaaccaggttaagttaacaaataaggataatcaacatttcagttgtcattaaatgagcctgatggctatcaaaatactgctatttatgctttaatctacttttatgtagtcatcaaccgtatttttttttttttttttgagacggagtctggctctgtcgcccaggctggagtacagtggcgcgaacttggctcactgcaagctccgcctctcgggttcacgccagtctcctgtctcagcctcctgagtaactgggactacaggcgcctgccacaacatccggctaatttttttgtatttttagtagagacagggtttcaccatgttagccaggatggtcttgatctcctgacctcgtgatcagcctgcctcggccttccaaagtgctgggattacaggcgtgagccacagtgcccggccaactgttcgttttaaatagcaagtatactcatttctgattcgcagtatatccaattcccaattaccgcaagacttcactctgatttttcagagccaaaataatatattttttagaaaattaaaatgtcttagctgcaaaaaatctacatattgaaaagtagataccatatttcactgatgctaggatgtcagtgatgtaatttaattatgtactattgagaaagagaaaatactatgtatatatggcaaagaaatggaagcaaaatgaattaacatattcccttttgtacagaagaaacttctgaatcacttttcactcagtcattaatgcatacatttttccacatgacactctcctatgtgcaagcaggaattttagagagaaaagtatcttttaaaactgtatttcattccactaatgtctcagatttctctgcaagtcactgacaccattaactggatgtgttaatggggatacaatctggatcttatgagaatccatcaatgaaaagttttcagacaacagccaggattcatgcttctttctcaaaatgtccttaaattatttattaactgaaaagccagggagtacagctaaccagtcacgccatgccaataacatcaaagttgcacaggtgcaggcaatgataatacgtcacagctgacacctggtcaccagcaattttaagacacttctggatttcggcaatgctaaaatatgcaccttaggaccaatgaaaactagtactggtagtatcacaagcaaagaggaacacaccctgtctaccacaacttgggaacacccttcactgtctcataagaggcaagacagtaattattaaatggtagtccacatgataatgtgtaatctataacttgcaacaaaattctgaaaatcattaaaaacgtttgagcaggggaataaaagacaaagagaagaacttcaataacttgcattataatatggaaatgaaagagagagacagtgtgtgtgtgtgtgtgtgtgtgagagagagagagtaggaaggttatgcccatcttaagttgctcaagtgaaaaaaaaaaaaagttgctcagaaaaaaaaaaacaactcctaagaaaagtcctctcataaagactcaaggagctgattcaatgagcatcaagcacaaggagtatcaacaccagtatctaggtaattttgaacaaaacttttgttttgcctgttttgggcctggaagataattctgtctgctggtatgtccactggtaggttaaccaaataaaaataatgttacagggtctgtcagaaggatagaaataactcatgaactaaaatgtgcactctggaaattagaatttaagacataacactgtctgacacagtagaaaagggcaacagaagcagggagagtaacactcatgtaagaatgaagtgtcagcaaactcagaatcattttagtctcactcagcataaagtgttttcaatctattctgtatcccatttgagtagtgtgactttactggtaattctgagttatctgataacttgtattctacctgtaaccatcagcaccacccctacccaaccatcaatttcctggttattgataatatattaatagttggaattttataaaatataaagtttagccttcacacatatttctaacaattttccatatttaaagcaaaaataaagtcaagttcatgtgacagggaaccagtggggcaaatatgcgagctttctaagcaaaggccactggacagcaccagcggaacactttgtggtagtactgtgacacactcaaagaattttttatgtttcatgctctgatgacaccctaccctacttgcaactgtgacaaaagttgtccacaattattgtactttaacattttcctccaaattttctaattaccactactacttgaatacttctaacaaagatttactttttaactttaaattacggaaatttcaaacatacacaagaaaggaacaaatagcagggacccaccaaccaggttcaataattatcaacatgttgccattcttgtttcaaatgcttttggccccaaagccagtctgccctaaaacacacacaccacaaaaatacacatttctttttgtccttatttaaactcaaattctagacatgccatttaacccagatatttaacatgcatctctaataagactttaaaaacccacagcattacaaccccacaaaaataatcacaattttaaaaaatcacctaacaccttgtctttcgattcagatctcccaggtgcctcaaaatttcttttcctgttatccttttattgttgaaaattttaaacatatacaaaaatagagaaaaaagtataatatgtatatatctaccagttcagtaatgtacttacccatgaacaatctttacctactctacccaactcccactctagattattttaaagcaaatctcagatacattttctattttctccagatgtagtttagtatagatgtccttttacagcttgaatcagaattcaaaactagagccccacaccgcacttagttaggtctctgaagtctcctttattctataaacataacccctgccatctccaaacacacacactttttccccaatgctgttgttctactggagaaaccaggacttttgacctgaagaatgacttcgcattctagattaggtatattgcttcctcgaagtataaggtttgttgctctacctcccatatatttttaaagccagtcattagttgtataagcttgattaaacttggggtaaaaattttagaaacaaaaaacttcacagaaaatgttgcatacttcatatggtgctacatcataaggcacagaaggtggtttgccctgttttcagtggtgtcaagattgatcaggagttcaggggatgtcagcctgattcctctaccatgaagttccccgtcaagcttcggcatccattgatgatagctacctagacccattatatgattatgaattgtggaataatgattttctaattctattacccttttgattgtattagccgaaatgtttccataaagagcttgaccacatcaacagctggtcaccttgaaataaatgattctcttccttcatcaatcttcggagcagcagtgagttagtgcaacctccagtggctttagtataattattataagcacacttacatatttgatagttttgagtctactataatcattattctttcagatgtcaaaattatcccttctcaggtaaggaggtgcctcttcaaattggggtgagtgtgcacacaattatgtgttttaaaagaagaaatgttgagtttatgtcagtcctgatttactatgagacaggccatcagggtaactaacacacaacatcagggaacataaatccatgaactcagaaatacaatttataaggagaagggggccagtactgctaagtcttctggctgcaccaaaggaactacttggagattgctgccagctgaattacagcacatatcctctctactctttgggatctttaaaagaaatattcttgtcaacccttcttcctttcttcaaccttagagctacacaagatttatagatatttctcacaaattgtttagaagaaaaataatccagcttcttaaaataactccctaaacaaagagggcctttttctttcttctgcccattaaaaacatggaatgttctcatctggctgtcagtctgtacactggcagcccttggagtcaaagatgggagatggtctctgcagcaggttcttgtctgtccacactgcatgtcaccatcccacaagccctactatgagctgctgtcttccttgcaccaagggaacctggaaaatgaatgcatgaaggtgttttgtaaaactcagcatcttgatgtaggttaaaaagcacatatgctgcttgcatcactatttgatccttaacagtctagggacacgttgccattttcaaagtaataccatttcccattcctatgtttactttgtacatgaagtatagtggtcaactgccatgggtccataaagactgggtattacagtaagatcatacacataaggacttcttccaggacacagacaaatgccaccatattcagagctctaatgggcaattcatgactgtgtcaagcttttccctccaggattcatggttcaatacaccaggatcacgggcaaggaccacctatcaaatttcttttgtggcttgttgatgcttcttaaaactggaacaaagtccctgaggctctccatggtggcaagagctcactataactcctatagggccacagcagctttcttcttctgaggctgcagcatactcacgtaattcttaaaaactgcagaatcttgttttatatttaaaaagactccacatttcattatcccaatcaatagcaactgtggatcaagtggtggtttaagatgttttccatcagatgcgcatgtgaatttctgtcagctgttctataggactttacggagctagggtaaaaagactctttgggaaaggcaggcatttgattttctttgggatggccctataagggtcaggcaaatcctccccattgccttctatttttgaaaatatgtctttgcctttctctcaatgctctatttcttctcctccttcacaactgcccatggagctgctgcaggcccctggctccagggatgccagactcatcagacaaaggctgctttatgtagtagtcaatatgttcacaaatagtctaatacaagtaatcaggggttagtgggtgctttgggacagaaatcagcagtaactaagtaacaatgccccagaggaagtactcaactgcctaaattcttctccctcaaaagaactggaagagtaacaaactccaagccatcctcagtggtactgtagacctcctacaggaaggtatcatcccaaaatgtgacactgactggtccatttggaaattctggtaacgtctatgtttacacatctgtagccaccatattttccatagcaatgccacagagtttaggcacaacctcacacatttcagatgcagctcccatcactggcacagtcacacgatgatacaggataagccttcaaggtgagtccacagacaccaagaagccctccatagtcttatctttcatcacagataatgggaggggcaaatagcaatgagagtcaaaggtcaaagaaatcttagcagccagacgcagtggctcacacctgtaatcccaacaccttgggaggccaacataggtggatcacttgagcccaggagttcaagaccagcctgggcaacacggcgaagccctgtctctacaaaaaatacaaaaatgagccagccatagcggtgcatgcctgtagtcccagctactaaggagagtgagatgggagaatcgcttgagcctctaggaggctaagactgcagagtgagccgagactacactaatgcactccagcctgggcaacagacctgagagcctttttttttttttaaataaaaaaaaaaaggaaaaaatgaaatcttagcacatctagggcaaagaaaaatggttatgaaaaggccatgggacaggtgcacagggttgtgtattaatctgttttgccaggctttctttgtcacacatgcagttacccattggtatctttcagctccaagtagggctgcttcttcccttggttcagatctttgtgcaaactagccaaataaaagataggccaggcgtggtggctcacgcctgtaatcccagcactttgggaggccaaggcaggtggatcacgaggtcaggagttcgagaccagcctgcccacatggtgaaaccctgtccctactaaaattacaaaaaccagccaggtgtggtggcaggcacctgtaatcccagctactcagaaggctgaggctggagaactgcctgaacccaggaggcagaggttgcagtgagccgagatcacaccactgcactccagcctgggtgacacagcaagactctatcttgggtggggatgggaggggagtgggaaaaaaaggatagctcctgagaatcttgttgctagtagccggaaacctgacaaactaaatgtcccacccggggaaacatgtatgggccatgtaagcaatcccccctgaccatacctactcagcctctgcaattccccttcactcccaggactgtctcaatggatttcagtctcagatgcatctttcaaaaagagtcacgtcagtgatgcagtgttgctcaagccctttaaaggttcacaaaacaagtatttctcaggtctctaagtccacaggctgtgtatgcgacaaatgagactcctgacaaccaagagaagtcagatccctctgtccacaagaccagggtcagtctcagtcatggaatttcttcactttggggcccaattcttagcacttggctctggagagcccagagtcctagatcatattgtctgacttgcttggctactcgtgagtactgctcatatattagtccagagcccagtctcgtgttcagcagggatattacacagcttccccatttcctcaatagttgcgaagagtgtcagctctggtgaaatgacaactgggcctagtcagggagtcactgctctcttagtgattcagttacagtaaatacacctccaactttgtagtgcttgacaaacgtgccatgttgtactatttttttgattatggctttgctggccttcttacagaatggtaccaatttagtaatgtatccaaaatggaaaccaatacatagtccagttctacatttattattttattttattaagacttgactatcaggatttgaagagtcaaaagccatctattaggccagagacaggctgcatgcatttacattgtatacatcctaggtgctgaagcccatatactctctcactgcttaaatgtgttgtcaaccaactattattgcacccacccaccacaagtgaatgcatcatcaaggcccaagctgggaatttttgatctctgtagttagccactctcagcagcctctgcttttccccatgccatccacaggccaggcccagctaatgcagacatcccacacatgctgtcctatacatgaaagtgcccaagtcctccccttcaactatgctgtttgatatgatcccaagagtgtttcacagcatccttgatttcttaagtaagatgctccaggctctagccaggtacagtggtgcacaactgtattccccactactcaggaggctgaggtaggaggattgcttgagcctataaattcaaatcaagcctggggaacacagtaggaccttgtctctttaaaaaaaaaaaaaaaaaaaaaaaaaaaattccaggcttatgttttccatctccttcagacctgaaataagccatttattatttatccaagaagccatgggttaccctagtggaaaatagtatttaatctggatgctaaaactgttcactggtattcagctgtcactgttgcactgtttctaggccttgtcagtgtttatattaaacttatatgcaaatctggtgaataaaaagcaacttacaggcaaaggaaatagcttcccatttacttttatacatagactatttggatagttatcttcttgagggcaacttgtctctgccaggcaaagtctgcattaataaaagaaaaaagtattcttaaatagtgtgctcaaacattcttatatgttttaaaattcagaactacatgcacatagtaagcaagtataaaactaaggtaacagaaaatttcaaactcacctcaactgaacttggactgtataatctctcctaccacctggcaaaaaatccctgttggaaagagaaagaaaatgggttaaaaaagtacaatgagaattctcagaacagtctccccaggaggaaaaaaaggaaaagcattatttgtatttttcttattccctgaaaggtgatcaatatactaccaataatataagccttaatgaaatcactgtaatgatgataaacctgacttgcttaacttctagccacgtctttatggcaattttaaggtaccttcaatgcacaggaactttgatgatgcaaaatttatttcaatagacatcaaacttggtaacatgcaaggaagcagcctaagttcggaaagagttttaatcagcaaatctatttgcttagagcattctaatcacttgaagacttttttctttttcttttgttttttttttttttttttttttttttgagacagagtcttgccctgtcgcccaggctggagtgcagtggcgcgatcttggctcactgcaagctccgcctcccgggttcacgccattctcctgcctcagcctcccgagtagctgggactacaggcgcccgccaccacgcccggctaattttatttttatcagagatagggtttcaccgtgttagccaggatggtcttgatctcctgacctcgtgatccgtccgccttggcctcccaaagtgtctcattacaggcatgagacactgcacctggccaaagacttttcttttactataaagacctattcactggatattcttattgatctcaagtacagcctaagcattagtttttatagctactagggggattctaatatagacccaggataaagaattagtgcctagagtctcagcatctccataccatgcaacttcataattatgtatccaattaaagatacagaacctcttataatttctagatgagaatctaatggtcccatgtaaaatatatttcatactgaaccctccaaactcttgccacgcaacatggagtctacggggaagcagcacttattccttaggagcttgttggaaatgcagactctcaggccccatcctagacctatagaattagaatctgcatgttaacaagatcctcaggtgacatgtatacacattacagttttaaaaagtattgcccttagccattgtcataaatcttggactctgtcagagagaagatcactagagtgtagtcctttcttgagaagactggagtacactgagcccccatggtgctctaactgggccagtctactcaccgttcccaatcctcgagctccactggaaggcagtaaagcacagcagtgacaaccaccttaagttctacagtcccaagctgcacaacattgtgcaaatcacttaaccattctgtgcctcagtttctacatctgttaaagatggaaaattactgcaccaacctcatcaagttgctgtgacaattaaacatgttaacaacacatgtcaagtgcctaaatataagatgtgctcaacacatgggagcagctggctgctgtgactgtttccactgctcccactgttctccttaccaagagcagccttctcaaatggctattcaaaacatccccatatccttgacaatactgacctcttctgagcaacccatatcactccactcattcatatcaagacacatttcatattctgggtgctggagcttcaaagacaaatacaacacagtatttgcttcaaaggatttatatgctaagtaggtaacagaaatacaacacctaaaataaaatatggtaagtggtacagtacattataaaaagtaagtgctacagaaaaagggaaaatttttgtcttgaaagttcaaggtcattatcacaattagtccaatctaactagaaaacagggtttttacagcagtggttctgcctacttctgcttagtggctccactaggaacatgagtaactgtgggtatctagtgcagtaattcccagaaaaaaagaaaggacagagatacagatcagaaacttgttagatgggaaacacgatgtgaagaaagagaaaagacaagacatgagcctagaaagatggatgggggcataaagggttttgaacagctcactaaggagttacactttattctggcaagggaaattaacaaaaactgggaaatacaatgtgctaaatatcttcacaaacattatgagtaatgaccaaggcatcttctgacattcatttctgccaatcactgttctaggaagttttacatactggtccatcagatacaaaagaagcatttaccatatgctaggtactgtaatgggttgtgaggtgataaaaatgagtagaagaatgctgctttcattaagaaggttgcaaatgcaagcagtgaaataaatgcaatgatgccttaacagaaaataagtacatggcacagtgagagacaaatgacacattaaagcaaatctggaaaggcatcacaggggacgtatgaattgaactggcccttgaaacatgactcaagaagtttgccaggcagagtacagagaaaaaaggcggcaaaggtgcaaagatgtgaacaccatagttaacctaggaaacacaaatgggaaagcctagtcagagtacaggttgttagaaaagagtaacaggagataagattaaaaaaaaaaaaaagcagagcaagatgttgaaaacaactgccaggcaatggagtgtggactttatgaggtaccattagagtgtgtttaaagcatcaaagagaaaaaactgaatgggctttagaaagatcatatgtaggagctttctaatggaaagatctcataattaggagaccattacaattgaagaggcaaaaaacaagggcttgaagctgggcgcagtggctcacgcctgtaatcccaacatttaggaaggctgaggtaggtggagttcaggaccaggctgggcaacacagcaagaccccatctatgcaaaaaatagaaaaatcagccaggcatggtggcacatgcctatagtcccagctagtcagaaggctaaggtgggaggatcaattgagcccggacattaaaggctgcagtgagccttgattgcggcactgtactttcagcctgggtgacagagcaagaccctggctcaaaaaataatagtaatttcaaatgagggcctgaaagctattaaacataaataccactgagtgatattcacacataaaaaatggtaagacttgatgaatgactagatgtgagaaggcaggataagggaaggggagtttctaggagggtatccaggttttggaatgctgcaactgaagagatggccatgctactcaccaggacaagaagaggcagagcaagttatagcatcaatctcccaaaccacccagtgaggtggtgatcattattccaattttgcatgctgagaaagtgaggtttagtcacctgtctaggggcatacggacctaagtggttggttcagaattcactttatacttagtattactctaaagaccatactagctccctcaaaggtagagttgccttgctgagttttaaatattcagaatgacataaaagaatcaatgaagggccagacgcggtagctcacgcccataatcccagcactttgggaggccgaagcgggtggatcatgaggtcaggagatcgagaccatcctggctaacatggtgaaaccctgtatctactaaaaatacaaaaaattagccaggcgtggtggtgggtgcctgtagtcccagctactcaggaggctgcggcaggagaatggcgtgaactcgggagtcagagcttgcagtgagccaagatcacgccactgcactccagcctgggtgacagagcgagactccgtctcaaaaaaaaaaaaaaaaaaaaaaaaagaatcaatgaagtgcagcaaacagacaggatgtggtaaatgaagagtggcctatcacaaagaggcctctgtcaaggcagattccaatgccattaaggaaacgagtaatgcagaaggaaatatactaagcaaaaatctccttgaggccagtctgtttttcaacttcgcatctttggtgcctggaatattgtctggtccatagtagacagttaataaatgtgtgctaaatgaatgaataaaagaacaaaagataagcaggtttgatggaaggcaagctcaattttagatgtgttgtgcttgatgcccttgtaggtcaaaggagaggcactgaaaaaggtgtctagagggaggtgttggtaattttgcagccacccatataaaaataacaaagcacattaatgaatattatcatagagtagcaagaagagaatcccagattgatcccttaaaatgggtacaagaagtcagtgtgaggaactgagagcatggttaaaaatatactagtaccaaatggaaggagcagcgctaaagccaaaaagagaactgaatccaatgttcaatcttcacaagatgtaacagaaagaacaaaaaaacctggacaagaatgtattcaagcgtctagtctagatcttactaccactacaggcaaaggggagggagctagaaacacagctgtggttctcaagttggctgcataccagaaacctgggaaactttaaaaaccactcatgtttgggttcaatcctgagattctaatttaactgatgtgggataaaacctgagtatgagaatttcctaaatctccccagctgatgctaatatgcagcaaagtttgagaaacatggggagagaagtagttaaatgacacaagaagcaatcatccgaatccagaatgtacaatatgctagatcaaatagatcactttttttggaaagtagtgttacaaaataaagcctaatgagagaaaccagggctccctggagaactgatcaattccacagttgcagcagagaaaatacaagataagccttcagcatttttgttgcaagaaattaaagagcgctcaaagtgggtttcagggagagaggtatatcaaaagggcataggagccaacctgaaagaacttctaatagccaaagatagaacaatttgagcatatcaattactgtaacactggaatataactcatagagcacccatgagtccacactgttataaacgaataaacgggctgggaatgctggctcacatctgtaaagccatacctgtaaacccaatagtttgggggacaaaggagggaagatcacttgagcacaggtgtctgagactagccgaggcaatactgtgagaccccatctctataaaaaacataaaaattagccaggtgtggtgttgtacacctgtagtcctagcttcttgtggggctgagatgggaggatcatttgaccccaggtggtcaaggctgcaacaagccatgatcaccaccactgcactccagcctgggcaacagagcaagaccttctctcaaaaataaaataaaataaaaggccgggtgtggtggctcacacctgtaatcccaacactttgggaggccgaggcaggcggatcacctgaggtcaagagttcaagaccagcctgaccaacatggtgaaaccctttctctactaaaaatacaaaaattagccaggcatggtgaagaatcgcttgaacctgggaggcagaggttacagtgagccgagattgtgccactgcactccaacctgggcgacggagtgagactttgtctcaaaaaataaacaaacaaaatgaatgaatgaaagaaagaaaagaaaaggagacagctcctccttgtaaaaataaaataatctcaatgtaaaaaagattaaggacaacagaacacaagaatgtttttgctaaagtaaccactaaagccaagattcacgagtgaacactgaattaatctgcaaaagtttgaggaaaaacagaatactaggtgcctagttgcaaagttatctttgcaaaatatttatcaacaaaggaacaaacagtaactttacagtgcagatacctggcagctagtatcagccaagtgatcaaggttaacatcaccaaaaataagatatcaatattatgttgcctgatatggtaccctgagaagggcacataacttgaggtattcttgccaaaaatgcacaacctccatctaatcatggtaaaacatcagccgtacccccaaatcagaaagagtctacaaaacacctgatcagtactcttcaaagtgtcacgctgtgaaagacaaaaaacaaacaaacaaaaactaagaaactgtaacagattgaagcagagtaggatgactcaacaattaaatgtgatttgggattgtatctaggaacagaagacgtttattgaccaaaaaactggtgaaatctgaataaagtctgtagttaatagtactgtaccaatgttgatttcatggttttgatcattgtactatggtgatataagatttaatattaaaggaaacagggataaagaatatatgtattatttctataatttttatctaaataaaaattactacaaaatataaagtttttatgccgggcatggtggctcacgcctgtaatcccagcactttgggaggccgaacaggtggatcacttgaggccaggagttcaagacaaccctggccaacgtggtgaaaccccgtctctactaaaaacacaaaaattagccaggtatggcggcacctgcctgtagtcacagctactcaagaggctgaggcaggagaatcgcctgaaaccgggaggtggaggttgcagtgagccaagatcatgctactgcactcactccagcctggatgacagagcgagactctgtctcaaaaaaaaaattatgtaattaagtacagaatttcccaaacttacttaactgcaacaatcttatttttgaaaaactcttactatcatctcaaagagtgttctaattaatatctgaaaaggaagtaaacacctctaatttactcaattccttgctctgcttttaacattacagccccccaaaaatcattaacctcccagaagccttagttttatcatgctgaatcttttaagaatgcaactttaaagagtcatataaataatgttttgttaacactaaaggtgtgtgtatacatatatacatacatatatatacacatatatacacatatatatacacacatatatatacacacacacatatatatacacatatatgtatatattcttttgagatagagtttcactcttgttgcccaggctggagtgcagtggtgcgatctcggctcactgcaacctctgcctcctgggttaatgtgattctcctgcctcagctttccgagtagcagggattacaggcgcccgccaccatgctcggctaatttgttgtatttttagtagagatgggtttcgccatgttggccaggctggtctcgaactcctgaactcaagtaatccacccaccagagcctcccaaagtgctgggattacaagcatgagccaccacgcccagcctttttaaaaatatttttaattggaaaattaaatgctacagatttccttttctttcttcttacatctcttagttcatctgctctttacaaatgggtctaccaatacttttcataattgttttcatatatctggtaattttttggtcaggatgactatacagctcactttacccataactacctcagtttatgttcttatctcagaataattattagtaatgtttactttcactctcaaaaatgccccagtttggaatgataaagcttatggtcaccctgtctttgggctactataaattctttttatattgctttacccaatatatatattttttcagatggggtctcgctttgttgcccagtctcgagtgctgcagcatgatcacaacagctcactgcagcctcgacctcccaggctcaagtgattctcccacctcagcctcctgagtaggtgacactaatttctgtatttcttgtagagacagggtttcaccatgttgcccaggctggtctgaactcctgggctcaagtgatactgccacctcccaaagtgctaggattacaggcatgagccaccatgcccaacctgggaataaatttttcatttaaaaaattattgccaaatataacaaaaagtaatctaaaagacattgaggttttattcaaaggttaaaaattttattctaacacacagtatttactaaatatttggctgactttagtcaaagtatactaccctttcatgagagaaacaggtcaactgttatggactgaattgtgtatccccaaaatttatacgttgaagtcctaacccccaatgtgactgtatttggagacaaggcctttaaggaggaaattaaggttaaataaagccacagggtaggtccccaatccaatatgacagtgtctttaccagaaaagaaagacaccacggatgcactagcacagagaaaaggccatctgagacgtgcaagccaaggagaaaggcttcaggagaaatcaaacctgccaaaaccttgatcttggacagaagcctccagcattttgaaaaacaaaagtctgttgtttacactgtccagtctgtgaaattttgttatggcagccctacaggtgaataaaccaatattcatgagaaatatattccaaatattcctcttacctggatatgcatatctctctaacttgttgaggtgtcaaagcaaaaataaaaaacttctcttgaaatcgctgaatactgctttgaactgggaagaaaaaaaaaaagaaagataatatttcaataacaaatccaacactacaaccacctgcaataaccaggcattttttataaagtacctgccaaattctgaaacgttatggttaaaatactccaaaatcaggaagtactaaactgcattcatcttggaatcatgagtaaagtcactacaaaggggtttctttaacgttaagtacgtaaccattctttattctaaaatactaatgcaggctgggtgcagtggctcacacctgtaatcccaacactttgggaagccaaggtgggtggatcacctgaggtcgcaagttcgagaccagcctgaccaacatggagaaaccccatctctactaaaaatataaaattagctgggcatggtggtgcatgcctgtaatgccagctacatgggaggcggaggcaggagaatcacttgaacccagaaggtggaggttgcagtgagccaagattgcaccattgcactccagcctgggcaacaagagtgaactccatctcaaaaaaaaaaaaaaatactaatgcacagtaaaaatataacaaaacgcttcaatattacatttcattcttaactataatattatctaatgaaaggaagtcaaaatgctccccaggagaactgtattcaagaattaaatgttttttgtttatttttctttgttgtattttgcttttggtgctctgtatttaattacacaaaacactcatataagaaaattttgaatgtcaaaacttttaagttttgaagatacctaatttgcatatgaaagtcttcccagttaaaaaatattgcttaatgaagtcacccttatgtatattattacctgaaatgtatttatgacttcacaaaaacctgcaataggttaataatgaattattcaataatgttctagtgtccattaaaacaaacaaaaaagttaatatatatagaggcctcaagtcttttgcttcctaacaattgcaacatcacccaagtaaaggcaaaatgaggccgggcacagtggctcacacgtgtaatcccagcactctgggaggccgaggcaggtggattacttgaggtcaagtgttcaagaccagcctggccaacatggtgaaaccccatctctactaaaaacacaaaaattagccagtcatggtggcacgtgcctgtaatcccagctactccagaggctgaggcagaagaatcgcttgaacctgggaggtggaggttgcagtgcgctgagatcacaccagtgcactacagcgatagtcttcaaaaaaaaaaaaaaaaaaggcaaatggtccttgtatataacactgtccagttttcctgctacatgaagataaaaaagatgccagttggatatccaatgtcagagcggttcaaccacaagtcacatcaagtcagaaaaatattaattccctagctaaaatattcttttctataagcacagtttattatagcaattattctcctagaaatgtcacaaaatggttcatattttttcagaacgctttaaaaaggagggaagagggagatgccgtttaagatgaaggccaaaaagtaaaataaaactttggattataaacataattatggagcatcaaacacagaaacataagtaagcctctccatttctccagttcctattcactcctcaaccctttttttcttgttcggactccacttttcactatctgtggctaaggtcaccaatgacctcttaactgccaaatgtaataacgtgtattttgagattacaagtaaacatgctgcattttaatcttaattaattaatgacatgagcatccagtctcttcagccagaaacctcaaaaggtctaaagtaagtacaaatggagaactaaaagaagagagtgcaaaatgagacattaaaaaagaaaactacttgcagaaataatgaatcaataattctacctttgatggaggggaaaaaaggatttacaaatcaaactccatgtaaaataatacaaagaaaactacctagtcacatcatagtcatactattgattatgtttgattaatcttgaaagcaacgagagaaaaaagaaacaagggaacaatgcaaatcaaggccaacttctcatccgaagcaatataggccagaaggtatctttaaagtggtgaaagaacaaactcaactgaaaattcaatacccttcaaaagcagagtggaagaataacttttcagataaacagaagatataagaatttgctgacagcagacatgcattacaagaaatgtaaaacaaaatcaccaggattattttaaaacataaattcaaaactggatctctgggaatgaaaatcatacagtaaataagcataaatgtaaaacagtatgctgtattttcttcttgtaatttccttcaaaagactgttgacagctaaagtgatggcattgaaaggcaggatttctaacacagggaggaaatatgagaacagcaaaaagaatggagggggtagataaaggaaattatctccccaacagttgtgtttcctgcttttttctgataaacctgaaatctccctaaagaccctgataaacctaaatctccctaaagaccaatccactcttagcgtgccacaagcagcaggtatctacacctgtaaagttgggcacaagaccctctgtgaattcacgaatataaatgccagtatttgaggctctgtctgaatgactggagacaacctaccctgaaaagtttccaaaacccatgaaccttaacatttgaaaagagaatggttccatagtcatgttgtacatgtatgttcaacatgtacttttatatcaaattgtacttacatgttgcacatacgcaatatatatgtacaatttatagaactggcagcttaatgttagtagtctgtgtcataacagacatattctcggtgtgccttttatttttctgacatatctttgactttacctatatttgctgtcaaattttcaatccagattataatctcaaataaccacccagtatctatagaaaaatggatctgtgtcattgctatatactataaccagactccaggaacttacagcaacaaaaaattgtgcatatgctaataaaaatctaatttgtattaacattgacagttcttagataagtcaattttatgacagaacagcagccaaaagcataccaaactttccataaagtgaatttgttagctaaatggttattttaacataaccatgagaaagaatgcaggatgcaaagtatgcaggttttgcagtttattttctccccattgtctacaatttgggaatcagaaaaccaattctgcagagattccatgaatgcctttaagttaagagcaaatgaaatgaaaaaagatcatggctcaagggcatgaattaaatatggctttattcaaacctttcctttttcaacaacccttcataatgtagattctattttccaaatataaccacattatctcccatcatgtcctcctttttatgtaaacttgacattcttccaactgagtagtggggtctttatcaacctccctttgaatctgaatggccttttgtaatagcatcaaccaacagtgtacagtttaagtgatgctatacagctccaaggctgaaccataaaaataccacacacatcttccttgctctgtggggacactcattcttggaacctagctctcatgctataaagaagcccaaattagaccacatgaagaagccacatatgggtattccagccaacagccaagctaagtccaagtcatcaggtggcatagctgccaaacatatcagggaagatgcctccaagtgatctgagcttctggccaagtgcacctcaagcatatgtcttctcagctaagaccccagagatcttgggataagaaacaagccacccacacactgcccttccaaattcctgacctaaggaatccatgagcatgtcagacacagtaagttcctcttcaaaggtttaatttctgacttccctgttctttgctcttaagctcaacttccttgtcccttctcctaagctatctgctctgtaaacaactacttctgccagtcccaatctgtaactcacatctcttccttatttggaaagagtcctctttactcctggctacccattctgtaagctccccctcttgctgagacagctctccctgccgaaactacccttcccgcctttgccgcaccctgacatgcccaaacatgccttgtactgtaacagacagcctctccctttccgcctaattagccatattcaattttaaatggtagccaatcaggtcagtgtagattgtgccgtctgactccagccaatggggaaaggacacagaaccagagattaaccgtgttagggataaaaaccccttcccctcctttgtttggtgtgctctcgcagcggccagaagtgtgaccagcacccttctgcagaagtaaatttgctttgctgagaaatccttcatttggcatttgggtgcttgttttccttgtgactccaagctcttgtttctaacaacttgggggctcatccgcgattgcctttctcatccaggaagaggtccctgatcatctctcatgaggagatgcgtccccctgcctcactgtggtggcctcagggatgagggatcaagacctcccccagcatgatgaataaacctggactctcagcaacgcaggtgaaaaggatcctcacacaccatggcaaccaggtaactctgtacacaaaccaaggtaagaaaagtcgtgggggtgacaaagtatttccttggtggttgggacaacttggagcttgaatgtgtgtgaatgagatgtacaattaagcacaaagcaagcgtggagtctggatctgcagttctgtggtcacctcatatggcttatggcagattcctgttgtggggcttataccgacacaccgatgctaagagggacttaaattcccgtgagggaagcagccagagaaggacaaagcaaaaggagagtaaaaaagacctccagtagaggggggttaagcctctagagaagggaaggcaagaaatatctaatacgaggagggactgagcctcagcaaacctctagagaagggaaggcaagaaatctctaatatgaggagggactgagcctcagcaaacctctagagaagagaaagcaagaaatctctaatacaagggattgagcctcagcaagcctctagagaagggaaggcaagaaatctctaatataaggagggactgagcctcagcaaacctctagagaagagaaggcaagaaatctctaacatgtggcattgagcctcacatcaaacctccaggatgggaaacaccccacgtaagacaggaaatgaaagatataaagctagtgatgataacaacattccctctggtagtcccttaggtctcatgttaacatactggagggacagtgaaaggactaaacataataaaaaacaacaaatgacaaaatattgttgtttcatttggaccacagagctcatcctcacaccctcagttttctggccaaagtttcagtcaaatgaggattgaatttgtcaacttctaatagagtatgtcaatgacaagagtcccatctcccaggaggaaatagattatgccctgtattggcagcagggacccatccttctttaccccctaaaagctataggaagtaagccagaaatcagttcctctgaggaaagtaagacctctaccccaaaacaatccaccaatgtatgagacccaccagaccacccacctccgccaaatcccccaccccaagcaggtgcacaggacccccttcactcaattcctcctccatataaccctgagtcaatgcctgccccaatgccccgtgccctccctaaccacacgtctgagtctatgcctcctccaggaaggctctagtgtgagacagaacagtgtaaaaaggatattcagaactccttttcccctccacctctaaggaatcagccccaactcttttccccttgagggaagtgccccttggaggagaaggaatcggctttgtaaatgctcccccttcactagctcagaagttcgaaatttaaaaaaggaactcaagaccgggtgcagtggctcaagcctgtaatcccagcactctgggaggccgaggcaggtggatcacaacgtcaggagattgagaccatcctggctaacatggtgaaaccccgtctctactaaaaatacaaaaaaattagccagacgtggtgacgggcgcctgtagtcccagctacttgggaggctgaggcagaagaatggcgtgaacccaggaggtggagcttgccgtgagccatgatcgtgccactgcactccagcctgggcaacagagcaagactccgtctcaaaaaaaaaaaaaaaaaaaaaaaaaaaaaggaactcgagtcattattagatgacccatgtggggtagcagatcaaattgatcaattcttagggccacagctgtatacttgggcagagttaatgaccatcctgggcatcctcttttcaggggaagaaagaagcatgatccaaagggttgctatggtagtctgggaacgtgaacatcctcctggccaaaacattcctgcagccgaccaaaaatttccagcccaagaccctcgatgggtcaataacaatgcagctcaccaagagaatatgaaagatctcagggaaatggtaataaaaggaattcaggaatcagtacctcagacccaagatatttcctgagcattccatatacaacaaagaaaggatgaaggacctatggaattcctagagaggctgaaagagcaaatgagacaatatgcaggcctagacttagaagaccctcttgggcagggaatactcaagttacattttgttatgaacagttggccagatattgctaagaaattacaaaagatagagaattggaaagactggactattgaagagcttttaagagaagctcaaaaagtatatgtgagaagagatgaagaaaagcagaaacaaaagggaaaaattacgttacccaccttccaacaggggttccaaaagacaaggcccactgatactactctccattacctacagaccccacacccctaaacaagggctacagggggccaaagcttacaaaggatttaagtcctcacatgctaaaccatataaaggacatagagagacaagaccaggtaacctcagaacagggagggagggaggacaaaatacatgcttcaaatgtggaggagcagtcattttaagagagaatgtcctgaatgggagaaggagaaagaagtcattccatttaagggagtcaggggctctattctttttatcttgaattctaccaagagcccttgataaacttagaggtgggacccaaacatgaagttataacccttttaacagattcaagagcagctcgttcctgtttgtttccctttacctaatgtcccttgctcctcagaagaactttttgtcttgggggtgaaaggagaaaggtttaaagcaagaatcttagaagacacagaggtcaaatataaaaattgatcagcccactttcaatttctgttaatccctgaggcaggaactaacctattaggaagacatttaatgctaaaactaggtataggcctacatgtcagtccaaacggatttctcacctcattaaatctacttaccactgcaaatgaaaaatatattcatcctgatgtatgggcgagagaaggaaatcgaggaagacttcaagttgctccaatacatatgaagttaaaacccccaggggaaatagtaagaagaaagcaatatcccattcccctagagggcaggataggcctaaaacctgtagtcgaaggtctcattcaagataagcgccttgaacactgtatgtccccttataatactccaatatagcctgtaaagaaattagacgggtcatgctgactagtgcaaggccccagagctattaactaaacagtccagactacccaccctgttgttcccaacccttacactatcctcagcaaaataccatatgaccatcaatggtttacagtgatagacttaaaagacaccttctaggcatgccccttggctgaggacagcagggacatatttgtttttgaatgggaagatcctcattctgagcgaaagcaacaataccaatagatagtcttgccccaagagtttagagattcacctaacctctttggtcaaatcctagaacagattctagaacaaatttgtacccccaaaacacatatgcttgctccaatacgtggatgacctgcttatatctggtgaagctatagaacaggtggctgtcttctccacacaccttcttaaccatttacaagagaaggggttacgagtttcaaaaggaaagctccgatctgtggaacccaaggttaagtatttaggacacttaataagtaaaggcaagccaaggataaggcccgaacgggtcaaaggaatcgtgtccttacctttgcctaaaaccaagaaagaactcagaaaacttttgggattagttgggtattgctgactatggattgattaatatgccctagagatgaaacccttatacctgaagctcacccaggaaaagcctgactttctcctatggacttctgatgaaatccaccaggttgaggagctaaaacacctactcatcactgcccctgtcttagcccttccttccctagaaaaaccatttcaccttttcattaacgcaaacaagggggtagctttaggggtgcttactcaagaacatgggggccactgacaacctgtggcctttgtatcaaaagtttttgacccagtaacctgtgggtggcccaaatgtgttcaatttatcacggctaccgccttgttaactaacaaaagcaggaagctaacctttgggggaaacttggtggtgaccacaccccatcaggttagaacaatcttaaaaggcaggaagatggctcaccgactcaaggattttaaagtatgatgctatcttactagaaagaggtaacttaacattaaccactgataattcacttaacccagcaggtttcctgacagggaacccaaatctaaaaggccctgggcgtaaatgtttagatttaattgattatcacacaaaggtcaaggctgatttaagagagacccttttcaaaacaggacatctattcatagatggcccctctagggtaattgggggaaaaaggagtaatgggtattcggtggttgatggagaagctcttgcagaagtagagtcaggaagattgcccaataattggttggcccaaacatgttaatgcatgtttaacatgcattaaatcaggctttaaaacatttacaaaaccaagaagggaatatttatactgattctaaatatgtctttggggtagcccatacctttggaaaaatttggactgaacaaggtctcattaatagcaaaggccaagaccttgtccacaaagaattaatcacccaggtattagataaccttcagttgctagaagaaatagctattgttcatgtcccaggacaccagaaaaatccttcttttgaaagccgagggaataaccttcagaccaaatagccaaacaagctgccgtttcctctgaaacgcccgtttttcacctccctccttgcctttctccccctaccgccattcccatcttctcccccgctgaaaaggagaagttaataaaaataggagccaaggaaaactcagaagggaaatgggtgttaccagatcaaagagaaatgctatccaaatgtctcatgagggaggttttatctcagttgcatcaagaaacccactggggacctcaagctctgtgtgatgcagttcttggagtctccagatgtagaggaatttatactctagcaaaacaagttacagataattgtttaatatgcaaaaaaactaataagcgaatcctaagaaaaccacccatcggaggaagaaccctggaatagggccattccaaagcatccaaatagattacactgaaatgcccccaataggtcgcctaaagtatctacaagtaatactggatcaccttcctcactgggtagaagttattcccttttcaagtgcagccaccagtaatgtagttaaggcattaatcaaaaatatcatacctaggtttggatcactagaaaatattgattcagataatagaacccacttcgctgcacgtcattaaaaagctagcccagctattagaaataagatgggaataccataccccctggcactcaccttcatcaggaagagtagaaagaatgaactaaaccctaaaaagccaccacaccaaattaactttagagactcgactaccatggaccaaatgccttcccattgccttactgagggtctgaactacccctcggaaagatattggcttatctccttatgaaatgctatacgggttgccttatttacactccactgctgacattcctacgtttgaaactaaagatcaatttctcaggagttacatacttagtctgtcttccactttctcttccctcagaactaaaggccttttagcagagacaccacccttggagttcccagcatgtcagcatcagcctagggatcacgttctcatcaaaagctggaaagaaggaaaacgcgaaccagcttgggaaggaccctatctagtgcttctaactacagaaaccactatctgcacggccaaaaggggatggacagaccacacgcgagtgaaaggagtggcttccacagccagagaaaaatgagccgtcaccccagggcccacccccaccaaattacctctaaaaagggcttaatattattttcccttttctttccaacagaaggtcaccttgtcatctatgtgactcaaactaaccatcccttaacccttcagtttgacgcttgttcagtcatctcatatggagatgaacgaactcaaaggcagctatcaaatgtagataagtatctatgtccgtactgtagtgagtcaacaaagtataagcatggagccttaaaaagtccctgtggtgactggacagatgtttggtggaccacccaatatggaggatggacagccaggcccccttcttcaaacaagttgcaaggactgaaacagaaactccaacttacgtggtcccaccccatcaaattgtaagtcactgcaatgtaaccccttatccccttgttgctaattatagataatccccaaacaatggcccaagaaccctccatattcgaatggtatgggttaggagcagatgttataggacgggaccccataagaatcttctctctgagtcggttgaaaacaataaagaaatccagacccagagtccggggaatatatgggatccaacactttccccaaacatatcatgcccagcattctcctcccatctccagaaccacccaactaaggtaacggctgtggaggtgaaagaattaaggcagactatagctctagagacaggatacaaagatgcaaatgcctggctgaaacggattaaatattccatccgcactctaaacaaaagagattgttatgcttgtgcgcaccgcaggccagaggcccagactgtcccctttccactcagatggtcctccagccgaccaggcatgaactgtatggtagctctcttccaacgccccacagcctagggtaatgaattatgccaagctctctcttggctattccctgaagttcggcaccctatgggtcaggccctgagggccacgtcaattttacctcatgtctctcacaacaaggggacaacttagcatttcttggagacctaaagggatgcagtgagtttaagccattccgagagctgacctatcagtctgccctgatccatccgcaagtggatgtatggtggtattgtggcggaccatcactggacactctgccaagtaactagagcagcacttgtgctctgatccaattggccatccctttcaccctagaatttcatcaaccaaaaaggataaagacaaaggattgtataacaagagatagccctcatgggtcctttgaccctcacgtttatatagatgccactggagtcccgagaggagtgccagatgaatttaaggtgcaaaatcagatagtgcagggtttgagtccatactattctggtggttaactgtaaataaaaatgtagattggataaattacatctattacaaccagcaacgatttgttaactatattagagatgctagtaaaggaacagctaaacaattaggacctaccagccaaatggcttcagaaaatagaatagcattagacatgatactagcagagaaaggtggagtttgtgtcatcattggaactcaatgttgtacttttatacctaataatactgctcccgatggaaccataacaacaaaagcattacaaggtcttactgctttatccaatgaactagctaaaaattcaggaataaatgatccctttactaatttttttttttttttttgagatggagtcttgctctgtcacccaggctggagtgcagtggcgctatctcaactcactgcaagctctgcctcccgggttcacaccattctcccgcctcagcctcccgagtagctgggactacaggtgactgccaccaagcccagctaaatttttttttgtatttttagtagagatggggtttcaccgtgttagccaggatggtctcgatctcctgacctcatgatccacctgcctcagcctcccaaagtactgggattacaggcgtgagccacagtgcccggcctccttcactaatttaatggaaaaatggtttggcaaatggaaaggacttatgtcctcaatccttacttctcttgcctttgtaacaggtgtgcttattcttgtaggatgttatatcataccctgtgccagaagcctagcacaaaggcttattgaaacagctcttattaaaacctttttcaatctccccaccaccttattcagataagctcctacttttagaaaaccaggcagaataacagagtcaagaaatgttaaaaacgtttgaagaggaagaattataaaaatcaaaagaagggaactgtcagatatggctaagttcctcttcaaaggtttaatttgtaacttccttgttctttgttctcgagatcaacttccttgtctcttcttctaagctacctgctctgtaaacaacttctcctgcgagtcccaatctgtaagtcacatctcttccttatttggaaagcgtcctcttcactcctgaccacccattctgtaaactgcccctcccgccgaaacagctcttcccatcaaaactacccttcctgcctttgccgcgccctgacatgcccaaacacgtcttgtaccgtaacaaacagcctcccccttcctacctaattattcatattcaattttaaacagtagccagttgggtcagtgtagattgtgcagtctgactccagccaatggggacacgacacagaaccagggaataaccgcgttagggataaaaaccccttccctactttgtttggtgtgctctcgcagtggccaaaagtgcaagcagcacccttttgcagaagtaaatttgccttgctgagaaatccttcgtttgagtactcattttccttatgactccgagctcttgtttctaacaagcataataaaatacctgctttacaccactatgttttggaagactatattatacagcaacagtaaatgaaataatgccacaatttcatgaattttggcataatcttatcaattccaagtattcagattcatttataattactaaatgagtaggctactggtataatagttatgacagctctaaatctatggatccctttttcctctttataaatttttaaacttaactagaccagaatataacagtcctatatcctagccttagccctactggttactatccaagttatttaggaaatttacaagtctctctacacctcatttcaaatggaagtaacacttttctcacctgcctttttaagatggttttgtggactaaatgcaggaacatgtgaaagcattctgaaaacagtaagatactatacatgtaatatattttcacttgtggaagtcctcatcaaaagtctatgctttttaagataccaaaatttcaggaaaaaacaagcagttcaacagatatattttgtcacctactttgtaacattgactttatcttgataagacatttaggtcaaaaattaatattttaatgtgcctaaatgttaaatatacttaatataaaacctgccaagtcatcccccaccatcaccccctgcaagcactatattgacaccttttaataaactggtttatatttcagtaaaaatgcttcctaggctaggtgcagtgggtcactcctgtaatcccagcactttgggaggccaaggtgggcggatcacctgaggtcaggagttcgagaccagcctggccaacatggcgaaaccccgtctctaataaaaatacaaaattagccagatatggtggcccatgcctgtaagcccagctactcaggagactgcggtagcagaatcactagaacccgggaggcagagtttgcagtgagcggagatcacaccactgcactccagcctgggcaaccagagcaagactccgtctataaaaaacaaaaacaaaaacaagaatgcttcctagcggttactgccaaggttaacaggggctcatactatggctaacatagggaaaagataaaccaagaggttttttagggagttttgtggattaaaatggctcagtctagccaatctaacagtaaaataattcataaagtaacaatgaatgaatcagtttaattactctgcattttctaagatcctgagctatccggttctcatcacctaccagctactgtatcatcaccaactaaagaatgtcttctcccactgcaatgctgcactaaaataaaagggagtagggtaggagcaggacttctaaaactcaacagctaaaaacaactcaattcaaaaatggacaaaggacttggatagacatttctccaagtacatacaaatggcaaatatgcacatgaaaacatgctcaacatcactaatcattaaagaaatgcaaatcaaaactataatgcaatgccacctcacacccatcaggatggtcactataaaaaaaaatagtaataatagtaagtgcagatgaggacagggagaaactggaacccctgtgcactgctggtggggaatgtaaaatggtgcagctgctgtggaaaacagtttagtggttcctcaaataattaaaaatagaattaccatacgatcccgcaatttcacttctgggtgtatactcataagaattaaaaaacagaatcttgaagagatgtttgtatactcacagtcatagcagcatcattcacaatagctaaaatgtggaagcaatccaagtgtccattggagaataaatgaataaaacaccatgtatacatacaatagaatattactatgccttaaaaaggaaaaaaaatctgacatgttataacatggacaaaccttgaggacattacgtttagtgaaataagccaatcacaagaagacagataatatgacacgtaagtcaaataataagacatataagtatgattctacttatatgagaaatctagagtagtcagaatcttagaaagcaagatggtggttgccaggagctgggggaagagggaatagtgaattactgttaaatgcatatagagtttcagttttgcaagatgaaaagggttctctggagatagatggcagcgatggttccaacaatattaatatacttcatgccactggattttaaaatggtcagacagtatgtattttaccacagtaaaaaaaaaaaaaaaaaaaattggggatggggacagtggttcatgcctataatcccagcactttggaaggccgagacgggaggatcccttgagcccaggagttcctgaccagcctagggaagatggcaagacctggtctctacaaaaaaaatgtaaaaattagctgggcatggtggtgcacacctgtggtcccagctacttaggaggatcacttaagcacagaaggttaggctgcagtgagctgtgatctcacaactataccctgcctgggtgagagacagagagaccctgtctcaaaaaaaacaaaacaaaacaaaacaactgggcagggcaaggtacagtgacacacacttacagtgacacatacctatagtcccagctactcaggaggctgaggcaggaggttcacttgaggccaagagttcaaggatgcagtgcacaatgatcatgcctgtgaataaccactgcactccagcctgggcaacacagtgagacccccgtctactaaaaaagtaaaaaataatttttaaaaattgggacaaaaaatttaaatttcttcaaaaataaataggggctgaccctcaaacatgtagaaataaaaatacacacacaaaaagaacattctcatacagttgtaacagaagaaatacataaagtcaatacaggctctcttctatattagcaaactagctcatttttgataacctgtgtcttgacatgttggaactaacaggcacacacaatgctttcaagaaacactttacaactgcatctatatagcaatatccaattgtttacaaatacagttttcactgaacactgctttaaattataatcccattatatacagcaaagtttttctaatttaatcagatttaaatagaacatagcaaaactgagttatttgtaggtgatttatctatacagaaattatcattttattaataatcaccagtgatgcttcctctccattttcactaccaccaccctactgaaagcctattataaccttcttcaaatgaaacagcagccccaactcctgccagtctcccaccagtgtggagttagtccaccttattactttcaacccccttcctctgctcaaaatgctcaccaacgtcctatctctgaacgaccccaggctctttcctagcaaacctacatttcttcaagccccctccagggcttactcagttcaaagggcttactctacctgtgggtgtgtaccattttattttctattttattctgattaaataaatctgattaaattagaaaaactttggtgtatgtaatgggattataatttaaagcagtgataagtgaaaactgtatttgtaaaaaactgaatattgctatatagatgcaattgtattttattctatttatttctaaaataaaccattttattttctatttctgtgaccactcacagttctcccctttcttggcatttcttctcctacaaactctgccaatccaaagtaggcgcattcatccttcaaagctccctcaagtctcactacaagaagccttgactgaattctccattcattaggccaatgcagtaactgacctttagatgtacaactgacagtgcttcatcatgcaaacacctatctacttgctacttatttcgaatgtgaacattacctccctaactgtgtaacaaacaccttaaagcccatctcatacttctggcttctccacaattaagaatacacagacaccgggcacggtggctcacgcctgtaatcccagcactttgggaggccaaggcaggcagatcacgaggtcaagagttccagaccagcctggccgacatggtgaaaccctgtctctactaagaatacaaaaattagctgggcatggtgacacatgcctgtaatcccagctactcgggaggctgaggcaggagaatcacttgaacccaggaggcagaggttgcagtgagccaagatcccgccactgcattccagcctgggtgacagaacaagactttgtctcggtggcggtgggggaagactacatagccatatccaaattaagtccttattatatacttattaactgagttaataaaaataatatatacagtaaattagaatattatattttaatggctttaacattaatgtgcatatcatttgaatactgtttaatcatatccaaaagcttaatgagtgtgtcctaatgttcaagaatttaaggataaaaagagattgattcttattaatttttcacctttcagattagcaaaaattaaaagaccaacaatacaatgctgatgagtgtatagggaaaacagtacctccacacacacaaatggactacaaattggtgcaatgctgtggaagctactgtcgaatttccctctaaaggtgaatatcaaaatataaaatattcatattttgacccaacaacttcacatccgggcatttatccttcatatatatgtgtacaagtattcagaaatatatgcaaaagttgttcatagctgcaatgtctgtaaaactgcaagaatagtgcctgatacatgctatacacaaaaatacttctgaatgaataaacagtgaaagcccattgaagatgtacatcaaaaaagtactgggtaagttacggtacatctataagataatagaactactgcaataaatctgctgtaataaatttccaggaaatactgttaagaaagattgtcacggtgcaaaactctagggaacactattcacagatattacaaacagaatagtgcccccactccctcaaccagacactctgcagttggaaaaggttttaagagaccagcctggacaacatggtgaaaccctgtctctactaaaaatacaaaaattagccaggcctggtggcgggtgcctagaatcccagctattggggaggctgcggcaggaaaaaaaaaatcgcttgaacccgggaagcagaggttgcagtgagccaagatcacaccactgcactgcagcctgggcgacagagggagactccgtctcaaaagaaaaaaaaaaaaacaaaaagagagaagagaaaaagcattaacataacacaagcggagaaaaaataaacttgatatgactctagctgagcaatgaatgagattacgaaggactgtccctttcttatgatttttgattccaaatattaactacttttgtaatctgaaaagaacaatgaagaaattaaggaatcaaaggttcataaaactttgaaggtatttcacataacaccagccagccagacatatcaacatttatgatgcatataaacagcgaacaaagagtcacagaagaatacatataagaatataattatatagtgccaagcgcagtggctcatgcctgtaatcccagcactttggggggccggggcagaaggatagcttgacctcaggagttcaagaccagcctggacaacatagagagacctcctctccacaaataaaaaaaatcaaagcctggcagaatggctcatgcattttaatcccagcactttgggaagctgaggcaggcagctctcttgaccccaggagttcaagaccagcctgggcaacatagcaaaatctcatatctacaaaaaaatacaaaaaaattagccaagcatggtggtgcatgcctgtagtcacagctactcaggaagcctaggtaggaggattgcttcagcccaggaggttgaggctgaagtgagccaagattgtacactctaacctgggcaattaagtgaccctctctcaataaataataaataaattaaaatcagtcaggtgtggtggtatacacctgtgggtcccagcaacttggaaggcctgaggtgggaggatcacttgaacctgagaggtagagggtgcagtgatgccactgtactccagcctgaatgaaagagcaagaccttataaaaagaacaaaaacaaaaggaataccttatataaatttcagaagcaagctaactaaacttttttttacaaatacacatatatgatgaaataagcaaacaagagaaacacaaatccaggatagtgatttaactcagaaaagagagggctttaaagatatggtaatgttcctttttcagaaagtagcagcttcacaggtgttcattcccttgaatctttataacttaacatgttttatatacatattcctttatacagatagaatacagacaaatttttaaaacagaaaattcccaaaggatctcatgttttatttatttattttttatttttttttgagacagagtctcactctgtcacccaggccagagtgcagtggctcgatctaggctcactgcaagctccgcctcccagattcacgccattctcctgcctcagcctcccgagtagctgggactacaggtgcccgccaccacgccggctaattttttgtgtttttagtagagtcggggtttcaccatgttagccaggatagtctccatctcctgacctcgtgatccgcccacctcggcctcccaaaagtgttgggattacagatgtgagccaccgcacctggcctcatgttttttaaaaattatcttgccaggtgccgtggctcacgcctgtaatcccagcactttgtgaggccaaggcaggcagatcacttgaggtcaggagtttgagaccagcctgaccaacatgaagaaaccctgtctctactaaaaatataataaattagccgggcgtggtggcacatgcctgtaatcccagctactcgggaggctgaggcaggagaatcgcttgaacccaggaggcagaggttgcggtgagctgagaccgtgccattgcactctagcctgggctacaagagcaaatctgtctcaaaaaaaaaaaaacttaaaaaattgaagaggaaatcaagactgcctgtgagagcacatcaggatggttatttaaggaaagaaaatggagatttttgctagtttgtttttagattaggggattatccattttgttaacagtagaaccttagctacagagcactttatttagtattattgtatacactcatgttttcaagataccacaatttttcacttcaagtgataaaaaaaattttatatcaacccttttgaatagaaataaccccaagctgcaaaacaatatactaatgtatcttcttaaatagaatatactcattatgggccacaggcagtgggtcatgccagtaatcccagcagtctgggaggctgaagtgggcagaccacgaggtcaggagttcgagacgaacctggccaacatagtgaaaccccgtctctattaaaaatacaaaaaaaattagctgggcgtggtggcgggtgcctgtaatcccagttacttgggaggctgaggcaaggagaattgcttgaacttgggaggcggaggttgcagctagccaagatcatgtgactgcactccagccctggtgacagtgcaagactccatctcaaaaaaaaaaaaagaaaaaaaagagcatatactcattatggttttttgacatacagctactggtttcaaaatcccaagaggttctggaatgacatttttgacctcatgtctgtttttcgcgccactgcactccagcctgggtgacagagcgagactccgtctcaaaaaaaaaaaacagtgataggtaggattcctgaaaaacattgtttttagttcaagggtagaaagtgtataagccatgaggatacgtgtatttctggcattctaactgaagctacgaccaaaatgcagggagtttagttactcttctaaacaaaatatctctggcattattttatctaagccaaatgagatagttttgaacaccaaatatgaaaagttttattttagtaaatttataaagagcatactatttaactttactgaggttaataaaagagaaactctgtgatgaacagagcaaagtaagaaaatttctagttctatttgtgaaaaaagcaggaaggtaaggaaagagaaaaggacaaggcctctcccatgtctccctcttggagtaccactgagcaaaagcctactacagcatcttcacttagtcccccccagtcttctgtccatgtctctaaaacacattccactgtaaccactaccctacagaccctcttatcctctctgtcctgtgcttagccacattcctgaggggcctcatgaagcagggctacccaagccatatcactagtctgaatctttctcagaataatagaaagtaataaatttgctagtccttcaacatagataaggaaaaaaaatttttttaagtaataaatttataataactgctgggacagaatatataaatgaaccacgacattgtgcatgatactgtccaaatgccatgataaaggaggaattagaaaacaaattagggaaatacgttaaccagataaatcaactctttaaaaacaaggctaaagatgaaagtaaaatcataaaagacagacaaccgggtaataagcatttaaaatacttgctcttgttggccaggtgcagtggatcacacctgtaatcccagcactttgggaggccaaggcgggtggatcacctcaggtcagaagttcaagaccagcctggccaacgtaacgaaaccccatctctactaaaaatacaaaattagcccggtgtggtggcacatgcctgtagcctcagctactcgggaggctgagagaggagaactgcttgaacccggggaagtggaggccgcagtgagccgagacagcgccaccgccctccatcctgggcgacagaacaagactctgtcccccccctccaaaaaaaaacaaataaaatcgaataaaataaaatacttgctcctgttactaattttaaaaataaaaatttaagcaagatacaagttttcatctaaaaatcacagagatctgttttcaatagcacccagtaaaggcaaaaagtaatgagatatgacaagcattctctcactttgcttgtggaatttaaactggcactaaaataatttggcaatatgttatcaagagtctaaaacgttctttttacttgatccaataattctactcataggactttgtacaaacaaataataaaacatgaacaaacactcaatccttatttcaaagtgaacgtaataaagagataaaatgcaatactccacttgcttggatcaccagttttgctaaaacataaataaagcaaaaagcaaaaaattgaaaaaaaaaaaaaaatagccacattgcctgccactagtcaggccatactaaccccactaactagctctacccctcaaaaccttccgatttaaccaagacaggctgcagtacaatcctgtaagacaggtaaaaaagcacactgatatgtttaagtgttttcacatgactgaaaataaaaagggttttcccaagaaagaaaagaaagcaatcttccacatcaactatgaaatgttacttcccaatttatttcataaagaaattcaaatatatttgtaaataacttcattaggcagtaagaattataacacagcaatgcaaaaatttgttagtcacattgtaagcaattgatgggcattaaataaaagctaaaaaactgcatgtcaaactccctgtgccactttagaaataaaattaaatataaaaggtttatttcttagaaaatcagtttaaaagctacattaaatggaaagtaagtccctttataaaaatatgaaaagtatcaaaatacaaaatcaggatcaataaataagatttgtatctattcccattcacacggaagcaatctgatttctacaccataagaatgcttgagtaagttctagccagagcaactaagcaagaaaaagaaataaaaggcatacaaacagaaaagaaagaagtaaaattattcctgttcacagatggtaggctcttatatacagtaaaccttaaagatttcacacaaaaaacctgttagaataaatgaattcagtaaagtagcagaatacaaagtcaacacgcaaaaatcaattgcatttttataaactaataataaatatgatgaaaaggaaattatgtagtttttacaatagtatcaaaaagaaaaaatatttcaaaattaaccacgaaaatgaaaacctgtacaataacaactataaaacattgctgaaagatattaaagaacacataaataaatagaaacacagctcatgttcatgtactggaagacttaattttttttttccccatcagcctatgtgggaaaagaaagacttaatattgctaagatatcaatactacccaaacaaatttacagattcactacaattcctctcaaaatcccaattttttttttttatcagaaatagaaaaactcattctaaaattcacgtggaatctcaagggccccaaatagccaaaacaatcttacaaaataattaaagctggagaattcactcttcctgattccaagacatattacatagctacggtaatcaaaactgtgatactggcataaagacagacatctagaccaatggaataaatcaacagtcacaacctttttggccaggaccagtttcatggcagacaattttcccacaggccaggggaatggtttctggatgaaactgttccacctcagatcatcaggcattagattctcgtaaggagcatgcaatctagatcccttacatgcacagttcacagtagggttcctgcacctatgagaatctaatgccactgctgatctgacaggaggtggagctcaggctgtaatgctcgaattcctgctgctcacctcctgctgctcacctcccgctgtgcgacctggtttctaacaggctgtggactggtgctagtccacggcctgagggttggagaccttggaacagagaacctggaaataaaacctcacatacatggtcaaatactttttgacaagggtgctaagatcattcagtgagggaaaggacaggcttttcaacaaatggtggggaaaaactggatatccacaaacaaaagaacaaagctggacactcacctaataccatatacgaaaattaactcaaaagagatcaggcttaaatgtaagacctaaaactataaaattcttaaaggaaaacacagggcaaaaccttcacagcatgaagtttagcaatgatttcttggatatgacaccaaaggcataggcaacaacaacaaaaaataaacaaattggaatttcatgaaaaaatgttaagttgtacatcaaaagacactatcaacagagtaaaaaaggcaaaccacagagtgggagaaaatatttgcacattcatatatctgataagggattatatccagaatatacagagaactcctaaaactcaacaacaataaaacaaaccaattcaaaaatgggcaagagacttggctatacatttcttgaaagatacataaatggccaaaaagcacatgaaaatgcacaatatcaccatcattacagacatgcaaatcaaagctacaataagataccacctgacacccattataatggccactataaaaaaaaaaggaaaataaaagtgttgttaaggatgtggagaaactggaacccttgtgcactgttgaagggaatgtaaaatgcagctgccacggaaaacagtatggtgatgcctcaaaatactaaaaacagaatgactatgtgatccagcaattccacttgtgggtatacagccagaagaattgaaaagcagggtctcaaagagatacgtgtatacccgtgtccacagaattattcgcaatagctaaaatgtgggagcaacccaagtgtccaatggataagcaaaatgtggtatcctataacacagaaatatagaagtaaaaccagaagaaacagctaaaataattaaggttgttgcctcttgaaagtgagattgagggatgagtagtggagtgagcaaaagattactatttttctttaaaaatgtatactattgtattatttagcctttaaaaggaaagaaattctaacataaactacagcatgctagaaccttgaggacattacatttagtgaaataagccagtcacaagacaaatactgtatgattccaacgacatgaggtacttggaatagtcaaaatcatagacagtggaagtagaatggtaactgccaggggctagtgggagaggaggagaggaaggctattgtttaatgggtacagagtttcagcttcagaagatgaaaagagttctggagatggatggcagtgatggctgcacaacattaccaacatacttaacaccactcaactgtacactttaaaatgatcaagatgatacattttatattatgtgtattttacaataaaagaattggagaagaagaaagatcaaatgatatgaaataaagcttctattagatttcagtcatggttgccgaatttttatccgtatattcaaacattcggcattgatgcctcaatttcactatattaacagcacatcattaatcaatagttgaaggtctctcatttcatttactatcttgttcagaagaaactgaattctcaaacacttacctaaactcgtgggcttgatgagaacatcaaggacatcataaaagggcagattttttaactgcacatcaggatggacaggaggaattgggggagatggctgctgcatctcaaatgtgggcttagtatcttgaagcagcacagaaccaacaggagaggatggtgagtgaggtgtaactgaagtggaaggcaacgagtggattccagccacggccaagtcaggttctacaggtgatgagccaccatccaaactgaaaaccgatgatttgattgtggataaatcagaaagtccttcaagagttcgtggatatcggcgtctatacaattctcggattttaatctgaaccgcagggctgcagccgctcttcaataaatgcagcgccctcatcaggaggtcatgcttgcgtccacttttattccgtccagcaaagcctagtaatacttgtagttcagaaaccctaaaactagaaaccatattctaaaaggaaagaaaaaaaaacataagccaagtcaccctcaagcatacaaaaatcctatctaaaatataatgtaaaatgtgatttttccagcattctatcaattggcatgtgctagtaacagcatttcacataccacttagaatcattaccattcataagacaatcccgtaaaaattacattcaagttacggtgttaattatattttgttgtacaagatcttaattttggtaatctatagtctattggtttctactaaccacttcattatctgattatgctctaatgcaaacagttatttgctttatgactataaaatctatcaccaatgaatatactccttttcaaaaccaacccctcccaatatacaatgtaatgtttgttacagaattatcgccaattaaccaaacaaaaaatcagattttcacaatgttagatgtgtaacttttgatgctgagtagtaaatccataaaaatcaagtcagaactgtgatccaaaatgcaatgaattttttaccccaattcaaacattaacaaacaaacaacataataaagatattttaaaatattaaagctaaaaaatcacatacatcttatttagcagtcaaacttctaaaacaactgaaattcccagctgggtatccaaatgagaaaaagacctttgaagagcaaggaaatgagcagtcatcaatcttaaagggcaacatttcctccacactactctactggcttgtgcttgggcgtaaaacaaaggttataagcagttgcagcttcacatcacaccttctattttttcagcaaaacttaatgaatatttttaaccccttgcagcctcaggaatccacctacttagtgatttccagtcaattctgaactcagaggcaaatcacacttgggtcagataccacacatgcatcatctagcaagaaagaggaagaacacctggagctgaccaaagccctgtcagaaacctacccaggagaactacctgtggtttggtgtcccatcccatcctcatcactcccccaacccagcccgtgctacacactccacagtcacttgggattccttttcaacctgcttgtctcatcagtatagtggaaatgtggggcagttgctctgtactttttaagtctcagggacggcccagaagcaactgtttaaaaccctatatggtttttaaatacttgttggtataaatacttgctagtttactaaaatgcaaacagatttaaatatgccaaagtaatccatatacactgtcataactgtactttgtgtactatatatgtctctatatttcataatgtacaagtgagagaatattaaattgtaatcctggcaagccattttatactctaattcagtgctgtccaacacaaattaatagaagacacacattaaacctcctagtagtcacattaaaaaaactaatttaggccaggaacagtggctcacacctataatcccagtgcttttggaggccaacacaagaggatcacttgagcccaggagttcgagaccacactggacaacatactaacaccccgtctccacaaaaatttaaaaattagccagccatggtggtgtgtgtgcctgtggtccaagccactcaggagactgaggcgagaggatcacttgagcccaggaatttgaggctacagtgaactgtgatcacaccaccatattccagcctaggcaatattaagactgtctcaaaaataataataataataatgataatttacattaacatagttatttaacccaatatatcaaaactatcttttcatctcaacatgcaatcaatttttgtaatttaaaaataatcattttttaaagtgtcagtgggattttttttatactaagtcttcaatatctggtgtatattttacacttacaatacatctaaatttggactaaccacatttcaagtgcttaagagccacatgtggccactagctaccacactgtggtagctctaaatcatactctaatagaacacataccacaatgtgtgttacctctacagtgcagacaacaaagaaggaaaacaagaaaacttttggcctatctcataacaaaccagtcacagcttactcaacatctcatgcattaaacagaagacaacagcttcttgggaagggtttacccaagcaagtaatacgatgcatctttccctcaatcttagtaaatacttcaattgattgtggaacactaatactaaaaaaggcaatcacacagataaaacataactgattttttctaactcagaattcactactttgcttcactccttatacttattgtcagatattcttcattttaagggaagctattttacagaaatgacaaaacaaagcacaaagtcatcctacctaagcttgactctcagaggaatttctaggaggtctcatatctcatatttccagtgataacattatttggcaaaggatgttaatgcaactggctctatgggctgttgtaaatagacaaacaaaaagtaagaaagagataagagcttagactatgaatgcggaatcacagaattctgaacagcagatgggacagtctttgcattacaaaatgctgcaaagataaagtattgctggacacatagccaaaggtaattaagtcaacagggccctgtgaaaaacttcaagccagcaatcagcagttgtggttcaagcccaagcaccaagactttggaccctgggaaagtcatttcatccctctggtcatcaatttctattttaaaataacaaacaccccccaaaaaaatccctctccttggccaggcacagtggctcacgcttataatctcagcactctgggaggcaaggcgggtggatcatttgaggtcaggagttcaagaccagcctgaccaacatggtgaaaccccgtctctactaaaattacaaaaattagccaggcttggtggtacacacctgtagtccctgctactcgggaggctgaggcaggagaatttcttcaacccaggaggtggaagttgcagtgagccaagactgagccactgcactccaacctgggcgacagagtgagaccccatctcaaaaagcaaaaatcaaaaatccctttcctttatttagcacttactgataaaataatctcaaagcagcttactaagtaaaattctacaaatatgttgtttggcaaatcttaccagatcccacttcctctaggagtaatacctattttttcttaacttagtctttcaccaagtttcaggcccttcccccacagtgagtgggtgtggtgagtagagagggtcaccagagcccacatgggggttaaggttagcctgctatgaacactaccaagaatggatttcagttgtttttctccaccaacctctgatgttggtatctttagtctaattttttccaagcggtttttccactccactgcgctaactctcaaaggctcccaagtcagcccacttcagttaaaactgttattcctacagacgaatttccctacagagaaatgtgttggcataattaattgtgtaaaaagatacgtaatctaaattctaaacaaaaactaacataaattaagaccagagttttaagtcaaccttgttcctttatcaaatgaaaataaacacaaaattattaaaaattttaaagctgggatattatataattgaaacactacatacaaagatgaaggcaagctgaaggtgctacctcattaggtagaaaatacctcattaggctgggcgcggtggctcatacctgtaatcccagcactttgggaggctgaggtgggtggatcacttgaggtcaggagtttgagaccagcctgaccaacacggtgaaaccccgtctctactaaaaatacaaaaaaattagccaggcatggtggcaggtgcctgtaatcccagctactcaggaggatgaggcaggagaatcgcttgaaaccgggaggcggaggatgcagtgagtcgagaccataccattgcactccagcctaggcaacgagagggaaactccatctcggaaaaaaaaaaaaaaaatacctcatcaaacaggtatacatgacagttacatgtaatcaccagtgaataaaaatatttccctgagattgctcttcaattctaaaacatgagacagaagctgcaataacggcctagaatttggggaagtgctaataaggttagaaatcatggtaaaggtcaataagaactctgtagattccccatctgctatgatgtatataatacaggagaagacgagaagctgctgagggcaactgacaaactgcattattaatattgcctactccagctacaatattaaaataatctacctcaggacggacacggtggctcacacctgtaaccccagcacttcgggaggccaaagcgggcggatcatctgaggtcaggagttgaagaacagccaggccaaaaaggcaaaaccctgtctctactaaaaatacaaaaattagccgggtgtggtgtctcgcacctgtaattccagctactagggaggctgaggcaggagaaatgcttgaacccgggaagtggtggttgcggtgagcggagatcacactactgcactccagcctgggtgacagagtgagactccatctcaaaaaagaataataatcatctacatcttcatttataagtaggaataaagaaaaactgccagattaacataatccctcaaaaaagagtgaccaagctaatgccatacataagaggaactatgtggcaagccagaaagatactgcttactcttttcaaaggtcattggaggccccagttcctggtcctgtattcctggtgaaatcatgtaatccctataattaaatccacttttatttgagagactaatgggtttctcccttacaagataatgattacaataactcctaggttaaagaaatcaaattgaaaatcaactattaagagaaacaataaaaaaaatgctacattccaaattcagggaaaacatctccctaaatgcttctattattatacaacagagatttaaaataaagtagtcaattaaggaagcaaaaaagtaataataaaataaaccaaaagggctggggaagcattacaggataaaaagaaaaaagcaaaaaaaaaaaaaaaaaaaattaattagaaagcaaaatgcagtgaagtcagatccacaaaagggaaagtaaacaaacgtatggtcttataaatgaaaaaaaaaaaactaaacaaatttctttaaacaaagaaaatagtgcatgcaactatatattctaataacttaaatacagataaaagtggtttcctagaaaaatacaaattactccatctgattcaagaagaggtatattgtcttgccctccctccacatccaaaaacatctacccaaacaagacagcttcatgaataaattccaccaagctttcaaggaaaggatggaattctgttccttaaactgttcaagagaataaaagccagggagtaaaatacatacgtgttagaagacaaatatagaaaaatgctgaacacaaaacatgaaattcaaaaaacatgcaaattattggttttcaaacttcagcagggagaagtccaccctatccaaccaaacttttaggcaaaagcctatgaaatggcgggcctagtataccatacattctttctcatttatcaacatggaccataagaagtctttgtgtaacacaatttacaaaccaatattaacacatcaatgtttcctgtgagtgtagacataaaagtcctcaatgcacccaatacagtgtaatctaccaatataagaatggtttaacataaattaagtaaattgcttggttaagattatttctatccttacagtcataagattgagtatttatgtataaaattatacaatatatggagtttcctttcaaataatttgggggaagtaggtggggacatatatgacaaaagactggagttgattaacttctgaagctgtgtactggggacacgaagaattttctatcattgtaaatttaagagtgtttcaataactcaaaagtttgcttgaacaggggaaactgggtgtgggcatgtggggactctaccaccttcccaagttttctgtaaatctaaaggtattctagatttcattaaacaaaaactgttagtctgtttgaaggtgaggtaaaaaagcggttatggcataaatactatttcccataaaaggaacccagactccttggggaaataaatggctgactgcaggtctggggcaggaaatgcacaagataagcctataacattttatcgcaccagaaaacagagaagctatcaaagatcacggggccttgtcagaagggcaaagaaaacatccagaatgggctcctagtagcctaagatgagaaaatttgagcatcaaaaagaataataactgcattggattcaaaccgattaaatatagtaatgtttcattttattcataataatactttaaaaatcactgatctcctttaaaggatgttaagggaaaaattcatcattattctgacaactgatagagaaaatgcaaacagatttttggtttgagtagaaaagccatatgattaatggctaaatgctagaagggcatttgataaaattctattcattcctgatgaaatctctcaataaacaagaaaagaaagaaattctgttaacatgataactggtatctgtcagaaagcaatagctaatatactaaaaatgaaacactaaatcacaaagctaagacttctaaaatgtatactatgttctgtcatttgacagtattctaaaaattctagataatacaaggcaatataatttttgggttttttttttttgagacaggatctcgttttattgcccaagctggagtgtggcaacacgatcttggctctctgcagcctcaacctcccaggctcaagtgatcctcccacctcggcctccagagtagctgggaggccagcccagttaatttttacttttcatacagacagagtctccctgtgttgtccgggttggtcttaaacttctgggtccaagtgatccttccaccttgacctcccaaagtgctggaattacaggtgtgagctactacaccaaggcaatataattttttttttttgagagagagaatctcactctgtcacccaggctggagtgcagtggcaccatcttggctcactgcaacctctgcctctgggattctttgcctcagcctcccaaatacttgggattactggcacacaccaccacacctggctaaattttgtattttagtagagacagggttgccatgttggccaggttggtcttgaactccggcctcaagtgatccacccacctcggtttcccaaagtgctgggattacaggcatgagccaccatgcccagcaaggcaatataaattttttaaaagtaacatttactatttacaaatgacaagactctctctattagaaatataagacaatccactgaaaaatttaaaccaataatattaaggcaaaacattgaattttccgtatatcaaatacattttcaaatggctgaaaaagagtattaaaaaaaccgaagtaacacaaaaacataaaatgcaaaagaataaattttaaaattttgcaagaggtacattaaaaaactatagaataaaagaagctttgaggccgggtgcagtggctcacgcctctaatctcaacactttggggggctgaggcaggtggatcacctgaggtcagaagttagagaccagcatggacgacacggtgaaatcccgtctctactaaaaatacaaatattagccgggcgtgatgggagggtgcctgtaatcccagctacttgggaggctgaggcaggaaaattgcttgaatctgggaggcggaggttgcagttagccgagattgcaccactgctctccagcctgggtgacagagtgagactccatctcaaaaaaaaaaaaaagctttgaataaattaaacagactgtatcatgcatgttactagataaaaatactcaacactgaaaaggtatcaattgtttccaagttataaatataaaaaaattccaacgactggttaatgagttggagagcttaacagaccaaaaccttaataaagaattaaataaaacatataatatggcaggtcatgatgaataaaatgaacaaaaacaaaggaggaagggacacaaaaagtgaagaagtagaggatttgccattttaaaggggaaaggcctcactgaaatagtaactgaataagtaactgaagcaggaggaaagcactctatggatacctgaggaaaagcattccaaggcattccatagcaaatgcaaaagtcctgaagacaaaggcaggcctaacacactcaatgaaagtgaaaggcaaaaagctcaccactgccgaaccagagtaatctagaggaatgagttatttgttgctatttgagacagggtcttggctcagctgcccagagtgcagtggtgcaaacactgctcactgcagcctcaacctcctgagctcaagtgatcttcctgcctcagcctccagcataactgggactacaagcacacaccaccatgcctgctaatctttttaattttagtaaagatgagatttcattatgttttgcaggctggtctcaaactcctgggctcaagtgatgctcctgccttggcctctaaaagtgcataagccaccatgctgggcccagaatgagtattaaaatcacagaatgatgttcgtttttcacagaaaacaaatgtggggagggaggtagtcaactaaacaaacctttactatatgaagtaactatcaaatttgtgaggttaagaaaacacagatctcatcctgacagcatcaggaaaaatataaaaataagacagaatgaaaatgctgagcaatgaaggcatataaattggtagtagggtgcaagggtgcattttgggaggccaagtgggcagatcacttgaagccagaagtttgagatcagtctggtcaacatggtccaacatcgtctctactaaaaatacaaaaattggctgggcatggtggctcacgcctgaaatcccagcactttgggaggccgaggcgggcaaatcacttgaggttaggagttcatgaccagcctggccaacatggtaaaacacagtctctacagaaaataaaaaattagctgggtgtggtgtgggagcctgttatcccagctactcgggaggctgagacaggagaatcgcttaaacccaggaggcagaggttgcagtaagcagagatcacgccactgcactccagcctaggtgacagagtgagactccatctttaaaaaaaaaaaaagataatataggcaaggaacagtggctccaaccttttaatcccagctatttgggaggctgaggcaggaagatcacttgggccaggagttcaagaccagcctgggaaacaaagtgagacccaggttctaccaaaaaaaaaaaattgtttttaattaccacggcttggtggtgctcaactgtagtcttgattacttaggaggctgaggcaggaggataccctgggcccaggagtttgaggctgcagtgagctataatcatgccaatattcccagcctgggtgacagagtaagacctcatctgaaaaaaatacaaaatagaggctgggcacagtggctcacacctgtaatctcagcattttgggagaccgaggcgggtgaatcacgaggtcaggcgttcaagaccagcctggccaagatggtgaaaccccatctctcctaaaaatacaaaaattagctgggcccggtggcaggcgcctataatcccagctgctcaggaggctgaggcagaagaatcacctgaaccctagaggcggaggttgcggtgagccgacgtcgtgccattgtactccagcctgggtgataagaacgaaactctgtctcaaataatattaaaaaataaaaataaggaagaactaacaacaattcaatataatttcttccagaaaacagaagatgagagaatatttccaaattcattttatgaaactaatattaccatgataccaaaacaaaacaaagacaacacaaaaaattaaactacaggctgggtgcggtggctcacacctgtaatctcagcactttgggaggccaaggcgggcggatcacctgcggtcaggagttcgaggccagcctgaccaacatggagaaccccatctctaagaaaaatacaaaattagccatggcacatgcctgtactcccagctactcaggaggctgaggcaggagaatcgcttgaacctgggaggcggacgttgtggtgagccaggatcatgccattgcactccagcctgggcaacaagagcaaaactgtctccaaaaaaaaattaaactacaaaccaatattcgtcatgaatatagacgttaaaacccttaacaaaatattagtcaataaaattcagcaatatataaaaagaattaaacaccatggtcattatgcaccatgaccaagtggagtttattccagtatgcaagactggttcattatatgccactgctgctcagcattttcactgtgtcttatctctgtatttgttttgagatctatagaatacatcatattaacagttacaaaaaaccaaatcatatgatcaaatcaatcaatgcgaaaaacgcatttcacaaattcaacacctgttcatgatttaaaaaccctcaaaaacaagaatagaggagagcttcctcaatttgataaacaggtctaccaaaaaaataaaattaagccaatattatactcagggcggaaagattgctttccctctaatattgggactgaggcaaagatgcctactatcacccctcattcaacacagtactaaaagttctagctagcagaataagacaagaaatggaaataaaagcagtaagagttgaaaggaaaaaataaaactatatttgtagatggaatgattgttcacatagaaaatctcaacaaatctacaaaacaactcctagaacttgtgagttcagcaaggtcccaggatataaaatcaacacacaaaaaccaaccacatctttatacactaaaaatgaacatgtgaaaacaagttaaaaacatcaccatttataacactccaaagaaaattaaaatacatatgtaaaaatgtaacaaacacgtacaggacttatatgctgaaagctacaaaacactgaaaaaaaaaaaaaaaatctaagaaaatctaaaggccgggcacgatggctcacgcctgtaatctcagcactttgggaggctgaggtgggcagatcacctgaggccgggagttcgaaaccagtctcaccaaaatggagaaaccccgtctctactaaagatgcaaaaaaaattagccatgcatggtggcacatgcctgtaatcccagctactcgggaggttgaggtaggagaattgcttgaacccgggaggcacaggttgcagcgagccgagatcgtgccattgcactccagcctgggcaacaaaagtaaaactctgtctcaaaaaaaaaagagaaaagaaaacctaaacaaataaattcttcacggattggaaaactcaacatagtaaagatgtcaactttccccaaaccgatatataggtttaacataattcctatccaaattccaacaagatttttgtagatatagatgagattattctaaaatgtatatgaaaaggcaaaagaaatattaatagaacagccaaaacaatttttaaaaagaacagagggagaggaatcaatctatcccattttacaacttagctaggactgacagactgcatggtattagtggaagggtagacacatagatcaagcaaagagaatacagaacccagaaacagacatatacatacatacccaaataatttttgataaaggtgtaaaattaactcagtggaagaaagacagcctttcaatatatggtgctggatcaactggacacccatagacagaaaaatgaacttccacttaagtctcataccttatacaaaaataactccaaatggatcacagagtcaaatgtaaaaataaaactgtaaaacttttttttaataagcaggaaaatatttgggatctaagactaggcagagttcttagatttgacactaaaagcaagatccataaaaggaaatatgacacactggacttcacacaaactaaaacctgtgctacgcaaaagacccctttaaaaggaaaaaaagacaatcaacagactcaaagaaaatattaacatttgcaaacacatatctgacaaaggactactatctaggatatacttagaactctcaaaactcaacaggaaaagaaaaagaattcaattagaaaaaggacaaaagacacaaagagacatgtcatggattgggatatacagatggcaaataagcacataaaaatatgttcagcatcattagccattggggaaatgcaaataaaaacctcactgagatatcactagatacctaccagaatggctaaaatgaaaaacactgataacaccaaatgctggcgaggatgctgagaaactggatcactccatacattgctggtagggatgtaaaatggtacagccactctggaaaacagtttagcaagttctttaaaaactatacatacaatgaccacacaacccagcaactacactcctgggcatttatctccgagaaagatgtgtgcgtaagtttaccaaaaaaacctatgcacaaatctttatagcatttttattcataattatcaaaaaactgtaaacaacccagatgtccctcaacaggtgaatggttaaacaaactatagtgaattcatatcgtggaaaactattcagcaataaaaagggatgagctgtttatatacaacaacttggatgaatttccagaattatgctgaatgaaaaagccagacccaaaaggttatccactgtgtgattctatttatgtaatatttttgaaaagacaaaaatcatagaaatgaaaaagatgagcgggccccagagagtgagggaactggatgagacaggaacaagtgtgactataaaataacaatactttggagagagggatccttgtggtgataaaatggtctatatcttgattgtgttcatgtcaatatcctggttgtgatactgtactatggtctttaagatgttaactctgaaaaaaaactagagagagtatacagaatgtctctgtattatttcctagaaatgcaagtgaactgacaattatcttcattaaaagtttaattaaaactacaaggagtaagactatcagactagatttttaattttcttaaaattcaatggtattatatttgaaagagataaaactgaaataaaaggacacaaaaatgtaacggtgaggagaaattttttaaattaggcaaaactgacaaaaaaagaaaaataacctagaaggccgggtgcggtggctcaggcctgtaatcccagcactttgagaggcccaggtgggcagatcacctgagatcaggagttcaagaccagcctggccaacatggtgaaacaccatctctactaaaaatacaaaaattagccaggcatggtggcaggcacctgtagtcccagctactcaggaggctgaaacaggagaatcacttgaacccacgaggtggaggttgcagtgagccgagatcgcgccactgccctccagcctgggtgacacagcaagactccatccgtctcaaaaaaaaaaaaaaaacagagatgggggtctcactatggtacccaggctggtctcaaactcttgggctcaagtgatcctcccacctcagcctcccaaggtgctaagattacaggattacagttctttcatgtgctagtaataatgttaaaatatggtttaaaaatcgatagaactacaaagaaaaatgaaaaacgaaacaaaattctagtaaaagattaactctgctctcttaataaaaaataaagatatgagatttgaacaacataattaacaaggctacataatgaacatatataaaactgcaccaaaaaccaggcaatacatagtctcttcatgtacaaataaaaattattaaaatggaccacatttttaatagtctaaacatatttcaaagagttggcattatacacaccaattggcatcacactcaaacaggctgcctaaccaaaatgcaattacaaatcaacagccaaatcaactagaggaactctgtttggaaattaaatttttaaatagctcataagttaaagaattcacaacggaaaatagaaaaatacaagtaaaaataacggaaatatcacacacatcaaaacaaggaggcaatacgcagacattttatgatcttaaataactatgttaaaatgctgaaaattaatgacaggcacccagcttaagaaattagaaaaaaagaacagaactacaaaggaaatgtaagaaaagaaaagaagagcaaaaattaatgaaacaggaaggatacactaaagagcataaacaatatcaaaaacttgattctctgaaaaatctttaaaaattggcaaacttttagccaaaaattatcaagaaaaaaagaaggcattttaaaaaaagacaaggggatattaactacaagtaactgcaaagaagagattaacaactaaatgctacaaattcaagaatgtggatgaaatgaacaactttctataaaagtatgaactactaaaacaggtttgaaacttgaaaatatgaacagtcctacaaccaaagcaattgaagcattcctcaaagaaaacaatagtaataattttataagcaagttctactaaatatttaagaaacagacctttctaatgttacataaactcttccagaagagaaaaggtatattttttaactataggctagttttactcattatgagagacaaaaatcctaaattaaatatctccaaactgagtccagtgaaaaaaaggaacagatagatcagggttgaatttatacttgcaacacaaagtttgtttaaatattgggaaaaaaattaatataactcagcatgttaacagattacaaaagagaaataattttctcaaaagatgcagaaaaagcttctgataaaattcattcatgattttttaaattagcaaactaagaaagggaacatccttaacctgaaaagattatctataataaacctacagcaagcatcatacttaactgtgaaactttgaaagcattccctttaaaatcaggaacaagatcaggatgcccccatcacagcttctattcaacattgtactggagatcctagccagcacattaagacaagaaaaagaaagaaaaaaaaaaagcataagaattggaaaggaggaaacaaagaggtcattattcacagataggactgtctgcatagaaaaatccaaaagaaatctaaagataattaatcacaattaggagtatagcaaggttattatacaaagtcaaactgtacttctgtgcaccagcaaagtataattataaaaagttaatatttatgatttgctataaaaataatttgttagaaataaatctaacaaaatatttgcaatactttaactgaaaataacaaaactttattgaaagatgttgtaaaaaacctaaaagaaatggagattacaatgattgtggttaagaaaacttagcagcaaaatgtaattctctccaagctaatttacagattcagtgcatttcccatcaaaataccaacaagatgtatgtgtgtgtgtggggggggggggaggtgtataacatgaaaatatgattctaaaattacatggagaagcaaacaatcaagaagttccttgaacaattacaagccaggaggacttgtgctacttctgtctccctcaatgactgactagactgtttcataccaaccctccctgtgagaacttaacaactgaatataatattaaaaaacaaaaatctgtgtgaatgcaggaggcactacaaaggcagtaaggacctgagacaccaagactctgaaaagaaggagagcctgcaaagctgagtctcttgatgccttccccggagatatctgccaatggaaaagggcaatggagaggttaaaagtccagcagaactctgaatagactcaggggaaacaagagaaggtatgtgcaaaacataaccagcaagagatggtttccaagatgtataatgaactcctacgaatcagtatggaaaagacagatgtcccaatataaaaatgagtaaaagacttggcaagccactttacaaaagaaacccaaatggccaataagcacattcaaaggagcttgacatcattacttattagggagatgcaaattaaaaccactacacattcaccagagtgtctaaaattaaaagggtagacaaggatatggagcaactggaactctactatatcactagcaaaagggaatgaaccaactacaactacagacaacaataaggatgaatctggcaaacgaaacagaaaaaaaggcagaaacaacagaatacatatacagaaacagaatacagttgacctttgaataacaataacatatagttgaatattgaataacaataacatatccaataacaaaaacctgtgttagtcaaaggtcaactgtatcttgtcaactggtttgaactgtgcaggtccacttatacgcatatttttttttcaaccaaatgcagatcaaaaatatggtatttgcaggacgtgaaacccacatatacagagggccaacttttcctatacatgggttctgcagggccaacttcaggacttgagtacacatgattttcctgttgggagggtggatcctagaaccaatcccccaggtacaccaaggggcaactgtatatatactacacaggttccatttatataaagttcaaaaacaggcaatactaatctgttaaagttaggatagtaggtcgcttttggaagaatgaggtgaggttagccactggggaggggaatatttagagtgctggtaatgttctctttcttgacctgcacgattattattttgagaaaattcatccagctataatttcattatctgtgtacttcctatgtgtatgctatatatcaaaagaagtttggttttttattataaaaaatattatcttacacagagatggggtctcaccatgttgcccaggctggtcttgaactcctggctcaagtgatgctcccaccatggcctcccaaagtgatgggattacagccttgagccacctcaccaggcaagaagtttgtttatgctagcagcagcatcatcttgttttagttactgtaactttttaacaatttctgtaaaaacagactaacggcccagagtccagaaccaaagcacagatgagtgatggcatccaaaccagtgaagaaaaaaatttgcatgaaaggtgatggaacaatttattattctttgaggaaaaaccatgcatcttggtcaccacttcacactgtatacaaaatcaactccaggtggattaaaaccttaaatgagaaaaggtaaaaaaaaaacaaaaacaaaaaacaaaaaaactacgtcttatacttttacaataatggaaaatatcttcgagaactctgttgaaaaatttcttcaacaagattcaaaagcactatccataaagaaaagcctgataaatgcaatcacataaaaattaagaacttctactcatcaaaaaacgcataaggctggatgcagttgctcatgcctataatcccagcactttgggagaccaaggtgggcagatcacctgaggtcaggagttcgagaccagcttgaccaacatggtgaaaccccgtctctattaaaaatacaaatattagccaggcatggtggcgggtacctgtaatcccagctactcagaagtctgagacaggagaatctcttgaaccttgggggtggagggtgcagtaaactgagatcacgccactgcactccagccagggctacagagtgagactccatctcaaaaaataaaaataaaaatgatttaaaagtgagcccaattgaaaggagaaatttgcaccacatgcatccaactgtgaaactattaaaaatcagtatgaaataatttttttaaaaaactagtacaaacatgggcaaaagacatgaataggaatgtgagaaaagggaagaatggctaatcagtatagtaaaagatgctcaaactcattagcaaagcaaatgaaaactaaaaggtggtattttatactcgtgggtaaaaacttttttttttgaaacagggtctcactctgttgcccaagctggcgtgcaatggcatgatcacagctcacttcctagcttcaggtgatcctcccatctcagcctgccaagtagctgggactacaggtgtgggccactatgcccagctaattttgttttgttttggtagagatggggtttcaccattttacccaggctggtctcaaactcctggtctcaagccatccacccaccatggcctcccaaagtgctaggattacaggcgtgagctaccatgcccaaccgataaaaccttttgaagtgtgacaaaagtagatgttagcaagaaagctgagtaatgaaaacttctgcattgctggagagaacgaagactgacaccaccttttttggaagataatctgacattatccaatattggtgaatatgcacacattcttcttaaataccagcaattctattcctagaatctctacagtgaaacatacaaatattcacactaagtgagatcaacaaagattacaatatcagtgcaggtcagggtttttctgcaagacaagtttggtgaaactttacagtttttttctcttcattttcaaacatttggatttaagaaatatggatggccagacacagtagctcacacctgtgatcccagcactttgggaggccaaggcgggtggatcacctgaagtcaggagttcaagaccagcctggccaacatggtgaaaactaataatacaaaaaaattagccgggcatggtgcacacctgtaatcccggctactcgggaggctgaggcagtaaaattgcttgaacctgggaggaggaggttgcggtgagtcaagatcgcgccactgcactccagcctgggcaagaagagcaaaactccgtctcaaaaaataaataaataaataaataaattttacatatgtatatatgttaaaagtataaagacagaccaggaatgatgaatccaaaattcagtacaatggctactgtcattggtgaaggtggacatggttgcagtggatgtgatcaggaaagtgcatcctgctaaagttacactaatgaattagtaaactggttggtaattatatgtatgtttgtttacatacgccttacctgttataatcttttgtacttatcaaataacttaaatatttaaaatacaaaaattagtatggaatacctaaatacaaacccactgttagagtcaccaattcagggaagtgtctcaagaactctagagaaattagcatcagagaaattcaaggtatttccccataaatcaaggacaggttgctatttaaaaagaaagaaaaatgaaagatgatagaagaactcttataaattaaagataactactgaaataaattttatagaaaagttcaaagacaaaatcaaagaaacctttcagaatgtaaacaaatcccgtagatcgtagactacaattgtagattacaatcttctacaggagaataaccatcagatctgcaatggacctctgattagcacaccaagtattttagattcccacagcaaagttttcaaaattctgaggaatttataattccacatgtaaactttcaatcaggaacaaagacaagccattttcaacattcgagaactcagaaagtttatcaccagcatatccttccagaaacaactattgaaggctgtattcctgtaaaataaaaaaggtatctaaaagagaaaaacatgggatccaaataacaatagatctaacccaggagaacaatgtgaagtaatcccaggatgacagctgggtaacaggtctactaagcttcccaaattagaaaaggcaggccaagactccggaaagtctaccaagacaagctgaatggctacaacatgagaacccattataatattaaattttaaaaataacttcaatgagctttcctcattcaaccaggactttgttatatttcttttttttttttttttcctgagacgaagccttgctttgtcacccagcctggagtgcaatgacatgatcttggctcactgcaacctccacctcccgggttcaagcaattctcctgcctcagcctcccgagtagctgggattacaggtgcccaccaccacgtcgggctaatttttgcatttttagtagagacggggtttcaccatgttagccaggctggtctctaactcctgacctgaggcgatccgcctgcctgggcctctcaaagtgctgggcttacagacgtgagccactgtgcccggctgactttgttatatttcctttttaaggatcacaggtttaacagaagtgaagtttctctatggctccacagtacttggttctatagtaactaatactcatgtcaacatacatatttaaaagagtggctattagtactcaatttctagattttcctgcagaagcacagaaaactttagaagagttataaaacattatataaatgcaataaatcttgccaatgtaacagtactaaccaaaaacaaaggctggggccgggctcagcggctcatgcctgtaatcccaccactttgggaggccaagggagggggagtggatcaccggaggtcaggagttcaagaccagcctgaccaacatggtgaaaccctgtctctattacaaatacaaaaattagccaggcatggttgcaggtgcctgtaatcccagctaatcgcgaggctgaggcaggagaatcgcttgaacccaggaggcggaggttgcagtgagccaagatggcgccattgctctccagcctgggcaacaagagcaaaatcctgtctcaaaaaaaaaaggaaaaaagaaaacaaaggctaggaagggaggagggaaaaacaaaggcaaggtttggcttttaaatcccaaaaggaaagggatcggtgttatatctttttctgaaagaccaggaagtgaggaaatatagttgtctctcagtatccgtagggggctggtaccagggtcccctgcagataccaaaatccaagaatgctcaagtctcttacatgaaatggcatagtatttgcatataagctatacacatcctcctacgtactttacatcatttctagtttacaatacctaatatatggcaaatgctatgaaatggttgttatactatactgtttaggaaatactgacaaggaaaaaagtctgtacatgttcagtacagatgtaaccaaccttttttcctgaatatttttgatccaaggttggttgaaaccaaagataagtcattcacagacatgaagggccaaatatactgtctaaaagtgataggtcaataaacagaaatttataataaaaagttaaaaataacagcaaaattaggaaccaaaatgtaactgatagaaatcaaagtctaggacaggtggaaaatgacctaaatttcttatctagcaaaaagttaagaaatattttttttgagttgaaaaaatatagagagaaaggcatggtatatttttagacttttggaacaacaataaaaccctaaaaacaaacaaacaaaaatggttaaaagcataatgggagtgggatttaatggaaaagggaagactttcactattttgaattttttcagtactgtctgcacaaatattgctttcatttaaaaaatatgagaaatggaaatgagagaataaaaaatgtgacatcaggtgatccacccgccccaggctcccaaaatgctgagattacagccttgagccactgcgcccagcctatttcactttaagttaaatatattttgtttcgaacgtgctttcatagacatgagctcaggtgaagccttggaaattttagttgcatcccataatagctttgaatcatatggaagattctgttatatctatcatagctattagtctgtatccctgcccaataaatggggagaggagcgtgatgaggacctctaacctcaaatcccccattaacttcccattctcctgctgcatcctaacagcacttgaagttatcaggatggtgactcctggtaggtgtaaggaaaccaaacacttaagccttctagacagaagaccttctgttacagaattacttaggcttcttagcatgaaagacccaaatctgatcttcgaattatgacacaacaaatttacccagtttggtaaatgttctggtttacccagtatctattgataaagttatcatcgctggctctctcaggccaaatgcacaaccagattctcacaggcacattctctctcattctgagacacacacagaataaattctcaatgcatgaaaagaaggggatgaagaatacagaagggagatccttaaaaaaaaaaaaaaagtcactacaatagatccccctcctccccattgagtgatgagaagtagggaaagtagattaaccaggttaaagtgtagcagggacctttttgtgaatgactgccaccagcagaccacaatattggaaatatgcaactggaagggtaaagaaaaagctgctctggttaaagaagaggtaagtgattccagaaactcaactcctgctctcctccatccctgtgcttagctcttctacagactagtttgagacagggtctccctctgtcgctcaggctggagtgcagtgtcaagatcagagctagctgtaacccagaaatcctggcttcaagcgatcctcttgcctctcaaagcgctggaattacaggtgtgagctaccaagccctgccctccagaccatttttggaggaggaagcaaggcagcagtgacagaagttcaggccatcaaatcttatgatcttgtcccacattaattcacaactagttaattcaaaatctgttcattcacaaactaatcactccttcagctcctaacaacacagatgccataaataagcaactggtaaattgagtaatttcttctctggcaccttgaaagcttctaatatataacacattattgtaaccatctttgagcacacaggccacattttcccttttcagagaacttccccacttcctttccttcaatccatcaggataatctgctgatcaggtttgtgtgctttgactctaagcccccggctatggatgattagaacagaagtagagacctaaactcagccaatcagattctctctcccagaagaactggaagagaggtgggctggtattctggtcacccggactgaaaggcaacaaggtatagagctgccatattctgctatgaccagccaagatctctggtactggctcacgcagcagtctccaaaactgaaatagtcaggcgacccccttaacagttgcctaatcgaataaccaaccctcccccccccaactccacccccgacacacaagtctgaaaagcaaaggcaccagggtcaccaaaccacactgaggattacctttcccaaaattccctatctccagtatagatgcagcactagccaggatatgaactgctctggttatacttgtccaaaatgagtagccttgaagggtaatggaaatcctctctgtggcatatcagcagccaaatatgtggcatccagatcggctgaccaatttctctactgccaagaagttagccaacaaactaatgcccaaaatttttcctggtcctataatttacttgagcatcactctgaccaccacaatatattctgatccaaggaccatcattttgagaatccaagattatttcttccccttttctttctttctattccgttttttagtctgtttttcttcctttattataatgtcacacaagaaggatgttaccaatcatttaatttaggagcaatcgcaggatgatggctagaagctccacctagaccccaaggtaccagaacaaagtagtgtagcccgggctctgaaaagcccagactctaaaagctacatgtctaagattaaaaatcttagcttttcaaatctcaagctgtgtgatttaggtcaggttaacctctctgtgcttcaatttcttgaaaaaattgtgagaattaaataagtatagaaaaaatgcttagaccagaaccaggcatggaataaccactatattaaaatgggtatataccatcatcatcattactgtctgtaatgggatgtaagggcggggtacagttcatcttcaagtgtagggtaacatgggtctgcacagagcagttaaggcaaagaaaagcagatgatgcttactgcatgtgcccagcctgcacccctcactcctctgaaaattctccccagttagtctctgttgggcacgtcatatgaattgtgggagaggggccatcttctaaaaatgcaagaagtaaagacagctgatttacaggaaaagaggatgaagctgatccacaaaccaaaacagagaggaaggcagaaaggaagagaaaaaaaagcttctttggtttctatcactttccagttgctggttgcactccaatctgagcactgactgcttttactctgctctataagagcgagtaaattcttcgctttacattaagctttggccaacaacattcacaagagtctaataaaaatcctggaaagttttcattaacaaaaaaaaaaaaaagaacttagaaaacttgtatacatctgttactacacaaaaattaaaaatggcaggtaaaaataaatataacttcagagttcagtcttctcaacccatcctaaatctaacgcatgaatttacagaggtgaggttcagggttcgttgtttgaaaagctccacaggtgttaaaagctctacagctggggctctgagccactaaaacccttaaacttatcaagtatgaacaccctttacctacacttatggttctctgcataaactagtatggggcataacatgtattaatatgtgtttactgggaacttaataattatttttgaaacagcaggagggaatatggcaggcactgtgcaaactccaacaatctccgtttagagcagaggatacgttcttttgctcacgtccactaagcaggtaaccagccaacatccttcccccatcccatctcttgcggaaaacaataaatatacaaaactgaaccttttaccggattcctcttccttatttgaaaaagaaatcctaatatcataagtgttacacaaacgagttgcagtaaatgtaatttcaagtttacactcatctctaccttgatacatttaaaaaaaaaaaaaatcagggtttctgtccgtaaacatctcatttatgtcgccagtaattcagcgatacacacaaatccatctcattcgtcacacttagttaggactttaaaggttatcagtctggggggaaaaagtctcttctgttctacccccatcacagccctattccagacctctgctatacaagggtatcaacaataaagttatgatcttgttttaagactgagaagaaaaaaatatttttcctcaagagtaaaaggggtgcacaaacctcacaacatagactttgcagatttcttactaaaacactaagaaaatatcgaggtttaaggccgattattgaaggcagggatccccaaacattaggttcctcgaagatgttaggaggcaagggtgggagaaggggccttttctcgtgacagacctgactaaacggtagcatcagccataagaagaggagagattcctaaacgcaacttcagctttcagaaaacagtcctccaccaagtgagtagcatgcagacttgtgaatagccacagacacgtacaccccggtgaaggtgcaagatcaaacgttgcttcccacatcggccctcactgcgaaccgggatgtcgggtccccatgtgcccctcctggagggcgccccgaccccccgcgccaggtgtgcggaccactggcagcactcaggagccggctcgccgcggcccaggcccgccgcccccgcgccgcccgcgtgccctccgccggcccgctcccctcccccgcgccctcggcgcccgttcgtccgcgggccggggctcagggctccgccaaccggccccagaggcacgagcaggcggcggccggcgacgttgcggtttccccacctcctctcccatcccctcccccgcggcctccgctctccactcccgcttaccctcaactcttcgaaatccgccattttataccacccgcgggcgccgccgccgctgccgccgcacccactcccgctgccgccaacgacgctgccgccaccacggccgccgccgcctccagcaccatcctgcactgggcgccgcttaagacgccgcggccgccgccgctacagccgggcccgtcacgtgaacggcgcgggagctccgcctccg
